United States Patent 9,328,346 (POLYCOMB-ASSOCIATED NON-CODING RNAS) - sequence listing, part 140

SEQ ID NO: 192062 - RNA, 85380 nt, Homo sapiens
gcggcgcgggcccgcagccgggcgcccugcucagccagcgccagcggccgccgcacccagccgcgccggcgaggacaugggcagccgcggcgcgcccaccccccgcgccggugagugccgcgcucugggaaccccggccgggcggccucuggggcugggcggcgggagcucucugggacggccggugaccuuggggcagccucucaggagauaggcgugggguagagagagcugcgcguggcccaugugacaugccgcgggcgagaggguuaacugcaugugacgcgaagggcugaaguugggcacagagcgcaacuggcguugcauuuucgcgggggcugcaugcuagcgaaccaaccgacgcccggagggacuguuugggggagcugggguggugcacggauugccagggguaaaggcgagucagccgacccacuacucagagugagugaccuuggguagguuaaccaucugcucuuccgccccuucgcuuuuucucaucuuucaaacgagaggcuagggggucuuugcaguuccagaaugcuguugugccauccuacugcgagcugagaaagagcccuaaaguacgguucugcagguaccggagaugcaaagcuuaaccauguuuauucuaggagggguuuccauuaauuggcuccuaaagugguaagaaauguuaucguugucuggaagauuauggagcaagcagucggugguccggagaauggcuucuuaagaugcacagguuaaaaccucuuuggugcccuaaagacaugaacaaaaucaggauuaaugcuccuaaguucuucuuuccuguaguuaaucuaauaggaaacuuuguauuugaacagguaaaaucaaaacccaaucguggcaggcagcagcaaauuaagugagucauuucuucaaugugcacgagguuuaugugugugugugcgcgcgugugugugugugcgugugugcgcgugcgcucucguccucagcucaaagucugcguacggcaguguuggaaauuauuucauaggaguaaccagaaauaaugcuagaaugauucgaauccacaaaagugcagcucucucagaagcaagggcaaacauuugcaacuugcuuuuaaaauaagagguuuguagaguaaauauauucuuuauugagaaccauccccagauuugcacauuguaucugccuucugggcccugucacugaaugcgcguguguguauguguguguguguguguuggggggggcggguuccuuggcacuuauaauauuuuuagcguugacugguacuaaaaaggacacuuaggcccccuuccauauccacugucuauaaacuucccucuuccacggaggggaauggaggacguacccucucacagguaccccugguugccccuucugacuuucuacuuaaagcuacccuugauuuucauucgaaucugauuucaucuguauaagaacguggguugggaagacacaguuuccaaugcuaaugaauaagcuucugcaagcuuguuuaccugagggcuuaauaaccuuuaauguguuacauguuagaaaucugauagcauacggauagaaaaauacuuaguguccaggaauucaaccaugaagcccuaccaaccauuuaaugagccacacuacauggugcuuggaaacguuauuagcgcauuauucagccuccucucucugcaggccacuaggcugugucacuccgaccuggcuuuaaaugucuuguuucuuguauccugcagccacacucuugcauuuucauuuuuuauguagcugaacccaccuucucucccgagcaccagagccugagugaacaacuugccgcagaagagccuucucuaguguccuccaccgucucaccagaguagggaugcucuuccgcuucuccuuagugcugccuccaaaccaaugcaccaucaccaaccaagucuccucucggaagguagugcuaucugcuugugccccuacccuccuucuuaucuucugguccagugcuucccaaaccugggggcuccucagaaucaccugggacauuuugaaaaacuuggucuuuagacucucucagauauaccaaauuagaaucauugggggcuggggcagggugggggaguaagaccuaaaaaucccuacuuuaaaaacaaaccccaaaaggaggagcagcaggagacgaugaagagaaggaacagaacucucugggcaauucugauguacacccagguacaguggggaucucuucacuugaugccccaaaaaagggauaaacaaacaaaaaacgugagcagccagcuucauucucuucucugcuuugucucuugccagugacuuuggguuuuguguugaagcucucuuaauucuuugaccuugaaguuccucaacaucuaucccaguagccucaguuuccacuuugcuucaacuaacaucuuggacuuguucagucuugaacaagacuaaaccuuugagaucuugaacucggacuucagccuacuuagcugauacuacccacauacugcucuggauuuuaaccaucgcugaggacccuggucccuuaagcacuugcuguuccaauccuucagccccucugugacucuguuucuccacuuggggcauguaaguugcuggccauuuccauucugucugggaucccagaauccuuuguuucaauguguugggcuucuuauauuucaguccucaauccaaaaucacccccgcuugccugcuuauucuucucccagccugccacauuaucuaggaggaagucacaaagaccuuuggacagguuccauugaaaauuuacguuggcucuaauuucaccagauaaauucccacuuuaccuuccucaaggcccccaagcaucuuucucuuccucucuuuguccuucuuuauuucgucuuucucaaaggaagaaaaugucuacaagucccuuccccaagguuaauccacaugcaauccacacucuucauucucuggacuugauuccuuccuucucaccucuuuugggaacuggcugcauuuguuauuccucuucuccagugucuuugguccuucccuacucugccccaacccuuacuccaccauaugggucauccuucccauaagaaacucuggugggguccucgcucuguccaguagaauuuucugcggugagaaaaauauuuuauaucugcacuguuccguaugguagucacugcccacauguggcucuuaagcacacgaaguguggcuaguaugacugaggaaccaaguuuuccauuuuaguaaauucuaaacuaacuuaaauccaauugaaguagucacauagggccaauggcuaucguaugggguagcacuguuuuugacccugcuacucuguugaacuguccucagguucucuucuuuguccacucaccuauucugguuucacccucaucuuucuguugaaacugcuuccucagagggcucuggcauagguguccuggcugcagaucugaggccuuugcccuggcuuucccuuccuuggucccugcccugcgucuccuggcagcagucagcccuuugcgccucuguaucucccugucuccaugacacugguuguccaggcccacucgaaccucauuuguuuccuuuuucuuccuggcauguagacacggggaugcugugagauccuguccuuggucuuuccuuuccuuuuccuccucccuucccccugccccagccucaccucugagcccgcaguaguauuuaaagagcacugggcacuuuccccgcgccucacugggcgcccucgcccacuuguacuacuuccucuaauccucacuccaacucugugaggcagagacucugauuacucccguuauguaggugcagaaauugaaauggagggagauuugaauaacuuaaagaaaacacugcuuucaaggagcagaccugggaaagggacuccaccagucugaccuuagagccccacuuuuaacccuguuuacccagggcccccagguacuucaaaucuauauuuugggcccugagcuguugcccacauuucacucagaauguaauacucagaagccugacugcuuugucucuaccuugucuuccuggcuucuguaaucauuuuuccccuuuuuaaaccuuuuacuuugaauaauucaaauuuauagaaaaguugcaauaacuggccagguacaguggcucaugcuuguaaucccagcacuuugggaggccaaggcggguguaucaccugaggucaggaguuccagaccagccuggcuaacauauagugaaaccccaucucuacuaaaaaaauacaaaaauuagcugggcaugguggugagcgccuguaaucccagcuacucaggaggcugaggcaggagaauugcuugaacccagaagguggagguugcagugagcugagaucgcgccacugcacuccagccugggcgacagagcgagacuccgucucucaaaaaaaaaaaaaaaaaaaaaagaaaagaaaagaaaaagaaaagucgcaauaauuaaaauaauucccaacauaccuuucaaccaaauucucuaaauauuaauuuuuaccacacuuguuuuaccuuucucgcucuauccuauucucucauucucucucugugugucuguguaucuguguguuuauucacacacauauguaugaacacacauauguauacacacacacaagugcauauguugucauuuucccugaaccauuuuagagugaguuguagacaugauacaccuuuguccaccuaaauacucguguauauuuccuuuuaaaaaggacauuuucuuguauaagugccaaaaucagaaaauuagcauuaagagcuauuaucuaaucaacaggccuuauucauguaucaucuauugaccuaauaauguccuucauggcaaaagaggagaaaaaaagaucuuuauuguuuuauuuuguuuuugaaauggagucuugcucgguugcccagggcggaacgcaauggcacaaucucggcucacugcagccuccgccucccugguucaagcaauucuccugccucagccucccgaguagcugggauuacaggcacccaccaucaugccuggcuaacuuuuguaauuuuguagagacaguguuucaccacguuggccaggcuggucuugaacuccugaccucaggugaucugccugccuuggccucccaaaaugcugggauuauggguaugagccacugcaccuggccaaaaagaucuuuuaaaaaaaagauguuuucugguccaggauccaguccaggauguguuacauuccuugucaugccucuuucauuuccucuaaucugggaccguuucccagucauucugucucucgugaaccuugacacguuugaagggugcaggucaguuauguaguagaaugcccuguagcuuggccuugucugauguuucucaugaguaguggagugugucccuuucagugcauuccuugaugacguuagugccaucauccucuucucuguaaccagagcuugaacaccugggguuauucugacuuucuguuccuugcacucccacauccagacagucauugagucaaguugagguguccccugcacagucucccuccauucguccuuuccuuucugugccuacugucucucuccuguuuggggcaguuauggagugaaggccugugcacacuggccucaaucgacuguuccagccuaauuggccgcugcuuagcaacaggaacccaagggucccauaguccucaccaaucagcauuuccucugcuuugccccgucuccaccccuucucaugcugcucugaauucacaucauuuaccccuuugaauaucagacucaaaugccugcuccucaagugcuuuuccugauggcccaguucaaacugauccugccuucugcccaguggcacugaccagccccuccauucuugcacgguggcuugcuaguguuauuucccugcauaaugggaguuccugcagcgcaggggcugugucuuguucagcacuguagaggcucaaugaauauuuguugacuggacuaaauuauuugaugaaaucauuaagcaagugcacagaauaaccguggagcugucugcuagcacguggugugcgaugguggaugugagacccaugccuuacccgaagagucagguggguguuggcucaaaauaggaucuuuuuaguaaaaccguggauaauuugagaaggcauuuucauguuguaaguggaaaaaaugauucuucccugaugacaucuuaacgucguguguaugugucaagacaaagaaagagcauauuugauuuuucaaaaaaagaguagagaaacuaacauagcauauuaaaaauggcccaucuaguucuucacacgccaaaugagcagcugaaugugagaggaguaguuucuccagcucccuuccucccugggagaccuggagccaccugccuccucuggcugucuggccuccucucucuccucugcuguccuucagcacugccuccccacucuacucacuguuucucuccucccguauuucacucuuucugucuguuacucucucuuaguaacucuucuacuguccucccucucccuauugacuguuuuauuuuauuuuuugacuuauuggaugugguuuuauguuccaugaguuuuuccauauaaaagcaggugauuuuugcaaaaagagaaaacccaauugcuuuuuaugccuugguggucuuuugucgacuccuuccauagcucagugguucuuguuauuuuaaaaauguagcuaucagugauaauaaaaugguuuaucggaaggaacauaauuaccucuuucugguccaccaggaaaauuacuaggaaugugcugguugauaaauaucaaaaagccuaaaauuuucaguugcuaccaagggaacauugguacuugagguugaaagucagauuucaguguggugaaaacucagauuuccggguggcgagcugcugagcuuacugggaacuucagucuuccucccugaaggugucugcguuugcugacugguugucacccccugccccacuucagaacgcguuugugaagaagacauucucucuggaugaagcaacuacagaagugcaggcaagacauugugcugccgucgcugaguguggcuuaaauaaaaagcauguuuaugugggagagaauguguggggguugcuuucgcauuauggaauucuuaaaauuguugaaccgggaagauguuauucagaaaccccugguggcuucagcuugcuuuuuguguauuucagguuucuuuuuucccccauuuuuaauuaucucuggaaaaacucaagaguccuccccugcuccuaaaauaguuauaaaauuaaugugcuguacucaagucguuacuccacguaaaagaguaaaagacucccauauuaagcagagaaguccagccuccucucucugagugugugaaaaagggcauagacuggagacuggaucuuucuucuaagccuaaauucuuagcuuuucagccagcgauuuauagaugguagaaccaaaagucaccaccagcauucugucuguaugagagcacacagaaucgugcuuuccccugcuaguuuaguagguagagaguuuacaugggcuuuuaauaauauuuuuucucuucuagcuguugcacuuggcagguuccuuuuuuaacauuugguaauguaucuuuucuaaugcuagaaagaaaaguugccaaauauugcuguugaucauaauaaaacacccuaaaaguaaugacuucuuuuugggugugagugcccgggcccacugcagggugaccuccagccuuccgccgagcucacagcuggaagggcaccuucagucagcaaucgauaugucauuuggguagagcaacucaacaaugaaaacagugggucuucccaaauuagaaaaacaaaaaggugaaugaacaaauauguaugaguguccgugaagaggcgucguguuaggcuucguggagauuacagguucauguaggaugugguuuccgcugcccuacggcagcucagcuggggagacauaauccagaaagguucaaauaacaauagaagauuuaaauagcauuucaaaauagcuguuauuaauagaggagaacaaaaaccaaucuguuuuugcaaggguucuccuaaaaauguuaacaucauucuaagcuguggagaguggauugaacaucagagaccagucauuggguucuagaggucugucuguaaaucugucuggaucugacagaggccauguguguauugcagauuggccgccucccuucaguuaugcagaaaucucugcacuggcuggaagagcacugucaaauguuguaagcauucuaaaguucaccuuugugggucagaaacacaucaccccucacccuucuaccuccaacagaauucccuuuaugaaugugauagaauggaggggaaagaaugcaagucuugcuaaguggacucaaggccauuuucacaaagagcacugaaaauaucugcucugggaccccauggagggacuugcaguuuuccuggaaccucgaguuuuuggaauacugugcuggcaucacuccagaaucacuggaccuguacaacaugcugauucccugaugcacaggcgauccaggcuucauucccagcuuugaugagagcaccagccucaagccuuguucugugcccacaaggaaaugaaaguaaaaauugauagcaaacuucuuuuaacuaaaccauagucuuuaaagcccagaaucaggcuuguuucuugguuuugguagcuguaaaugagcaauuuaugcuuuuuguuguuauugucauucacugguucauucuuuucuucaagaagguuuuauuuaaauuuguguaauugugaaaauagcacacuuguuaaaguauuuugaaaauaaggaaaagcagaauaaaaauguacccagugccacuauuuacauuucaguuuauuucuuuccacuguuuuaaaagauaugacuauacuaauacuucuaguccuagaauccuugccucacccucuccaagaugguuguaggauuucuggguugcugagguaauguacaguugaaaaaaugucaagaugugucagguaagcuauaucugcuguuggccuaaggacagauauuuugguguaaggaugccuaaugucuuagagaccguguaagaccucgaugacuuacccagcuuuccccagaucggccucacaaccauaaugccaugugcguuccucaaugugcuagcccaguauauuucuuccaaggacugcucagcuguucuaaaaaauucuggucagggguggugagagaugagcugccuaugaaggagacagagugugcuuauuugcacuguuuucauuuccuuugcacauaauuuggaggcacuuccucaauugggacagugugguuaauuuguggaaagcuccugcuauuagcauuggucuuuccuuuggccuugucaaucuagauacauuggcuugggaaauuaggcaugcugaccucaguugcacagcccucuuccuccuucuuuuaccaaagcacaugauuuagccagauaacaacuauccacaccacagagauaauuccagcaauuuggcagggggaaaguugguaggaggaugagugaagggaggggaggggaaaacagcauuaaagguagccucaagaccauggaggcaucuaggcaugaagggaggaggccucagauacaggagcgaaggaaggcagauaauugguggccugggcacucagcagggcagugguugccuucuccuugacuuugagucuccugccucauccaucuuugcuggcccauggucaagcagucuucucacuguggggagaaagggaagagggaggagcaagaggaguaggaugugguaaugguggcagugguagugguaguagauaacuucaacauuugcaggguuggcugggagugguggcucaggccuguaaucccagcauuuugggaguccuaggugggcagaucaugugaggucaggcuuuugagaccaccauggacaacauggcgaaaccccgccucuacuaaaaauacaaaaauuagcugugugugguggcaugcaccuguaaucccagauacucaggaggcugaggcaggagaaucacuugaacccgggagguagauguugcaguggguggagauugugccacagcacuccagccugggccacugagugagacucugccugaaaaaaaagaaauugcaguguccuuuaaacucaugagucaaaauguuugcaccaucuaaacuguggugccuuggagcaaagugcuggcuuccaggcccugguuguaguucuaaauaauguguacuauugugcauuguagaauguuuaguaagauagauagauagguagauagauagauagauaaagcauacuauaaauccaccuugguggguuuuuuuuuucuuuuuuaccuuaacauuauauagcaaggacauaaauacauaaauauauucuuagcuguuauuuuuuguuuuuuaguuuuuuuagagacaagaucuagcuagcucuguugcccaagcuggagugcagugucaugcaguguugaacuccugggcucaagcaauccuguugccuuaggcuccugaguaucuuggacuacagcuguucgccaccaugccuggcuaauuuauuuuuuauuguuauuuuguuguagagacgggggcauugcuauguugcacaggcuggucuugaacuccuggccugaaaugaucauccuacuucagccucuaaaaauguugggauuacagacauguaauccaucaugccuggccagcuauugauauucuuuugaguggaugugcuguguucuaacuaacugcucuucuauuguuggacauuuauccaauagccauuuauagaaauguugcuaucuaguuaagaucacauaguauuaaguauggauaaaaugcuuuaagaguagagauuucauggagauuaguuacuuuugccauggaauuccaauuucaugguccuagaaugcuuagggcaagagugaguucuguacaugcccuggagagucuaacaauuugacuccccuuugaacucuugguuuacauauuuuuuuuaagugggggcaagaagaaguaauuuauuucuuuuaaauugauacagugaaaaauuaaguuuaagaaguaaaagauauguuuagucaaagccccaaguauuuuaccuauuccucucuauuucucacuuagaaagaaauaugacccugauuugguauuugucauuuccacauucaucuugagauguuacagauuuggcauauuauuuggcauguuuuaaaccuuuaaaaaaugacauuguaggccgggcacgguggcucacgccuguaaucccagcacuuugggaggccaaggcgggcggaucacgaggucaggagaucgagaccauccuggcuaacacagugaaaccccgucucuacuaaaaaacacaaaaaauuagccgggcgugguggcgggcgccuguagucccagcuacgcgggaggcugaggcaggagaauggcgugaacccgggaagcggagcuugcagugagccgagaucgcgccacugcacuccagccugggcgacagagcgagacucugucucaaaaaaaaaaaaaaaaaaaaaaaaaaaaaaugacauuguauaguguucuuauccuucuucagcuuacuuuuuucacuuaauauauuugugagauucauucacauugggacuuguaauuauaauucauuucuuuuucucuuucuuuccuuuuuuuuugugagacaaaaucucacgcuguugcccaggcuggaaugcagugaugaggucacugcucacugcagccuugaccuccccaggaucaggugauccucccaccucagccuccuugguagcugggacaauaggugugugccaccacacccagcuaauuuuucuuucuuucuuuuuuuuuuuuuuuuaauguaaaugggguugccauguugcccaggcccaguccuggguucaagccaucugccgccucggccucccaaagggcugggauuacaggccugagccacugcaccucgcugcuaauucauuuauuuucaauacuauuuguucuuucauugcaugaauauaucauaguuuauucuuccauuugccuaaugaugggcguucauuccccacuccucacuuuuuugcuauuagaaagaaugcuaccuuaaguauucuugcaaaugucuucuuaagagcacauuuggaaaguuuuugaggauuuuuuaauaguagaauuauuaggucauuagguuugugcaucuucagcuuuacuagauauucaacauugcuuucuaaagugguaguaucaauucacacucccaucuugugcuccuguuguuccauauauauucuugucaauacuugaucuuuucauacuugauuuuugccagucugaugugaugaaaugguaucucugggggauuuuaucucuuauggcaaauuagauuuauuuuauaauuugcuuccauuguccagaacagagccaauguugcauauauuaagaacaacaacaacaaaacuuauucaaguucuuacccuucaauauucuuuuaagauuugccaagcaagacagccacuuggaaauccauuuagacuuaaaacuuagauuauaaaguaaauauucuauuuccagugaacagaauuacacccuauguaguuugguauuagaaccccagcugacuccaacugcccacugaguacacgugacugucaguuggcuggucucuggaugcuguauucucuugguuagaagcaagucacaggucccacccacacucaaagggagaggaccaugcaaggugugaacaccaagagacaaggaugguguugugggggcacccuaugagucuguccaccacagcagggaccauguuuugaucaucauguuucagcaucauggguuccagugucauggguuuagaucagcauuguuagggugaucagagauuaucagggggcugacuuaccuagucugguucccaucagaggugaaauuccaauauauuaauucacaccaagaaaaguagcuggcagauagacuugggcuuguguuugccgauuccuguguacucuccuuuuaugcacagcuauaugggaagcuaaaagaugugguuggugaguauggacucagggcaaggagugaauaggauuaucuuuacggcuaaugucacuggaccaugggagccuaaugcaucccccucuauuauagagcuuuuccugcugcccuggauuccuagguccuugaaaacaccaauaauuuuuuuuuuuuuuuugagaugagucucacucuauccagcccaggcuagaaggcaguggugugaucugggcucacugcaacuucugucuucuggguucaagugauucuucugccugagccuuccgaguagcugcgauaacagguguggaccaucacgcucagcuaauuuuuguauuuucaguagagaugcaguuuccucauguuggucaggcugguguugaacuccugaccucaaaugauccguccaccucggccucccaaagugcugggauuauaggcaugagccaccacaucuggucaccaauacauuuugucucuucaagcucugcuuuuaguagacaugcuguguauaccauccuccuuucugguugcacauucauucucaagccagaauauaauucaguugauuauauucaacaauaugaaauuacuucaauucaguuaucucuccuggacauucacucacccagcaaacauuuacugauuagcucugaugugccaagugcuugggauauagcuguggacaacacagguccucauggagcaugcagcauagagccaaagauggauauugaacuaguaugaugaguguuugccgaauuucaguaaugagugucagcagugucuuggaucauuuuuguggaucagcuguucccaucucuuccugauucuucagauuucguugucaaagucucaucuuaacuugaauuuugcaguguucccauuggcuuucuacacuaccugcaucauuuuguagaacaaaggaaaggaaaauaagauaccaaaaagcugaacugauccaugauuauaaacgcuauuucagugaaaauguccaucauuaaggggcuggcuaacaauuaugggagauccauucaguggacuaucacacaggcauuaaagauggugauguaggcugagcguaguggcucacgccuguaauuccagcacuuugggaggccaaggugggaggauuacuugaggcugggaguuugaggccagccugggcaauauaguaagaccucaucucuguaaaaaauugaaaaauuagccacguauggugguaagugccuguggucccggcuaaucuggaggcugaggcaggaggauugcuugagccuaggaauuggaggcugcagugagcuaugaccaagccacuguauucuaaccugggugacagaaugagacagugucucacacaaaaaaauuuuuaauggugauguauaucuuuauauauugacguggaaucaugcucaugauguagugucaauucgaaaaugcagcauacacauagucuaugaaguauuauuauauuauauuauuuauuuagaaacaggaucucacucugucaccugagcuggaguacaguggcaugaucucaggucacugcagcuuccaacuuaccaggcucaggugguccuccuaccuuagccuccuaaguagcugggacugcaggcauacaccaacaugccuggcuaauuuuuguauuuuuuguagagauaggauuuugcuguguugcccaggcuggucuugaacuccugggcucaagugauccuccugccucggccucccaaagugcugggaucauaggcaugagccaccgcuccuggcugaaaguuuuauuuuaaaaaauagauauguauucuaucagauguucauaaagggacauuagccagggaagggaaaggaaccaacccuuacuggaagcuuauccagugugcuaaggccagacacuguucuggauauuccauagccuccuguggcuaaugccuggugaugcagaggcugagguucuagguccaaaucucugcucuacugcuucuuggccaugugauguugggccaguugcugaacauuucuaagucucuguuuccucugguucaauguugauaauaagaguauaauacuuuacaaaugauugugaggaugaauuaaacuaaugcacauaaaugugcuucaugaguaccggcccuucucaaguaagcaguuacucguuacguuacgugugagcagcuguuaguuaugugacccccaacucaaccaacuaaggugggcccgcugagaucauacagcuaguggggaagccaggauugaagcaagagccuuucuuauccuaccaccauguuuucuaugagagaaaaauauguuggacuguagcugugcaaagggagagugagagaaagagggaugagagagacaguagaagaaggaaaacaggcaguaaaaaugggaaguuaagagaaagggcaaaggaaaaugaagaggacucaaugguggggaaagcaaaaaaaaaaaauuuggaagagaggaggcagggagaagguaagggagaagagcuggaagaggguagggagggaggcaagaggagagagaggaaugagaagugcuaggugaaucucgauaccucuccugcuacuccagccagaucccaucucugggcugccugaauucccagucuagucaccagggccuugggccugcaugcaccacugugacuccccaucuccucugacuccugccugccugggaggcccuugccuucugccaucccacaacuuccuaucacuccucagggccuggggaucaaguccaaaggccugagggugcuguuggaggugaguuagagaacaacauccagcugucuuuccagacaaaccuuccacuguuccugcccucuauccuuucacucuguuuuuagcuauaaggaaauaggguuuuuuguuuuaccaucauauuacaaccacuuuauucauaaaugcuuugccuauuuuuuauucugaugguugggcauaauguaucaauccuauauuuuaauagugaaaugaaaaauuaacuguuuuuacaugauugguauucaacucuuuaguaaaaauuaucauuuuaauuuauuaaauucauuuaccauuuuacauuaaaaugguauggcagguuuuucuacucagugucacaucacuuauaaaacuauaauaauugguuggcauuaaugucuucuuuuucauuaaaauuuuaaaauauucaucucuauguauaucuacuuccuuuuuuguuucucccuucacagaauccucauaaucacaaauaaucauuuugauuuagauaauagcauuucacuuuacucuucugugaacuucugaauucuauuuauauauugcauauuuugggcauuuggauuauuuuucuuuuuucuuuuuuugagacagggucuuacucugucacccaggcuagagugcaguggugcagucauggcucacugcagccuugaccucccaggcucaggugauuuucccaccuuagccucccggguagcugggacuacagaugcaugccaccaugcccagcuaauuuuuuuuauuuuuuuuuacuuuuuguagagacgggguuuugcuuuguugcccaggcuggucucaaacuccuaggcucaagaaauccucccaccuuagccucccagguaggacuacaggugugugccuccacaccuggcuaauuuuuuuuuguuuguauuuuuuguagagaugggguuuugccauguugcccaggcuggucccaaacuccugggcucaccuuagccucccagguugcugagacuacaggugugugccaccacaccuggcuaacuuuuuuuuuuuuuuuuguagagauggcauuucaccauauugcccaggcuggucucaaacuccugagcucaagccauccacuuaccucaaccucccaaagugcugagauuacaggccacagugccuggccccagaguuuauuuuuucuuacuucuuuccauucuuuucuucuugcuuuaccuaccugucccuucccccaacuucccccaauuuuaaaacuuuauaaaguggagauuguuuaauauauuguuuaauauaguggaaucacugcacaaucaaaacagcaugaaacccagaccugugugauaagguuguagacagaccugugguaucagugaucagauuuauaaacguacaggagaugauaaccucaggcagguaagccagaauuaacaacgggaagaucuggaaacaaugcuugagauguuauuuaauccugugacuuauucauuaucaaucuuuauucaucugcaauauagauuccacguucuggcaaagaaucgugaugcuaacaaaccaagcgaccugccagauaugcagauccucaccacauucauaaagggcacccauucugaauaaugugucuugugagcucaugccuuaugaaauuucuugucauagagcugcauagcgcuuaggaggguuugcuucugaaaagccaucuccgauaaucagugguguggcuugacuuuuguggcucuguucagguagaugaaauggccuucagagaaggggaugccaaaguccccauucuuucagauacuuauugagugucuaauauuugggauucagucuugguaaauaauuauacuuuuuaacuaaaguauauugucuuauaucuuuauugcugcaguuucugaucuggaagugcugggcauucacucauucauuaacaaacauauauggauacuucuaggucagcccuguguuuauuaagauuugaaacaugccuguaaggagcgugucauuuaguaggggagcuagacuauuaaacaacuaaaaagaauagagcacaauaaauaguauacaaacagauaaagagcuggagaaaugcaagagagagagccacuuuauagacuggaggggcuaguggggcuuuaaagagugcaugaauuuucuaggcuggcaggggugggaagggcauuucccauagagcgcacgcacagaggugugauggcaggagugugcaggacauauccaaggacggugguggaugggguggcgggggcggggguucccggugacuggagcaggugauugugguagggaguggccaaauaugagggcggaagaacagguuaggcaggccagagcauguucagaagaaaggaaguagagguuggaguguugaagagaagcuguggaacaaucucuccauccccuauuuugggaaagccuacucauucucaucaguucuuccugaccuagcugcuacccaggaaaaaucgaccccucuccuguuuucccuccccaugugcuuuuuuucacaggguuagccacuuaacccauuguuuuuguuuguuuguauuugagacagagucuccucuauugcccaggcuggagugcaguggcgcuaucauggcucacuguagccucagccucccugggcucaggugauccuccugaguagccuccagaguagcuuggacuacaggugugcaucaauacgccuggcuaauuuuuguauuuuuuguagagaugggauuucgccauguugcccagcuggccucgaaauucugggcuugaacuccugggcucaagcaauccuccaacuuuggccucccaaagugcugggauuacaggcaugagccacaacccauuguuuucugguugguuuagaugacuucugcugagggaagggauuuuaguuuuuccuaguuagguuacuuaauuaccuaauagaugccaaauacauguuucuuaaguuaggcuauucuguagauuaauaucucaacugagaugucuuacaacuuuaaaacuguaaagauucuaugauucuaaauaacagcauuucccacacuggccugauuuuauuuacgguaguccccccuuaucgaugguuucacuuuccacauuauccaaggucaaccauggucaaaaauauuaaauaaaaaauucuagaaauaaacaauucauaaguuuuaaauuguguguuguucugaaauagugugaugaaaucuugugcgauccugcucccuccugcccagaacgggaaucauccucuuguccagcauauccacaccauguauaccuggcccugugagucacuuaauagccaucucuguuaucagauugacuguugggguauugcagugcuugugaccaaguaacccuuauuuuacuucauaauagccccaaagugcaagagcacugugccuaauuuaugaauuaaacuuaaucaugaguauguauguguagaaaagaauaguauauauaggcuucgguuucaggcauccacugggggucuuggaauguaccccugacagaugagggagggcuacuguagucuauauggcagaaaugcuucucuuugacacugaagaacucuuugggcaccauagcuuguuuggcaugaaugacuuuuuuuuccuuaaauguaauuuguuuaaaguucuuugucuaagaaaaugaaaugugcacauuuugaaacuccaaaaauaaaacacuagagagaugacgccaaaacagugauuucaaucagaaaugcuuucugaauccagcaucuaaaugagaauuaauuauggaaucagaucauaguuaguaggcauucauuauuuuaaggcaauugauagcaguauugaggaaccuaaauaauaaaguauuuuaaacauccucuaguguuuuucacauuucuaaugaguuguggggaccaaauguuccuuauaugcaagaugaaauaugaaugauuguaucuuauuauaaaguuuucaaguucuaaugaggaauaucuuucucacucccuugguggauagauaucuucccacaaaucagaucacauugaucaugugcuguuuuauuugagauuaauuuagaaauaagugcucuucauuuaccauggaauuaguaguaaaaguuuucugagaucaaauuuacugagguaguuuccugcaaaauucuacagagaaguauaagauuggauaagccuauuaaacacucuaguuucuguuaaaagugguuucucaagcuugagaugcagauuuggagugaggaaacuucaggaaacuccauuguacagucccuguuggucugucuugcaaggcuuagcaauauuaauuucagaagagcuuugauuuugcuugauugcuuuucuucuuauuuggaaacauaugcuguuuauuucauguauaagauacaaaacauuuaauaauauaacuuaucaguguuucaacauaauuuaugauccacuuagcaacuuaauaauaagcuuuugagguuaaguucuagauauaaacuguuaaauaauuuagugcuuauuuuuucaacagaugugaauuauuaaaaagaaaauggcccaacggagcacuguauuuccuucucgugucaccaaggaaagguauaauauauggaaaauaugcaucuaagguauacuuuuccuuuccacucaucccaugggggcugcuagugggugugauaguuacaaaucaaagcuugggcuguuacauuaucggagaaugguuuuguucaagggcaagagaaacacuauuguguccucuagcuuucaauuuauaggauacuguggaccacucagugaccccaagaaguagagauuucacaguaguccuacaguagacuugaauuuccuguugagagugaaauauaacuccgggggcuucaggcuaacaucccuguuaagcuuuuuaaaucagaaguugcagauuaggggccuaucggccaaaauuggcucaugaaguacauugcuuggccuagcauguucuuaaauacuuuuuuuggagacagggucucacucuguuccccaggcuagagugcaguggcacagucacagcucacugcagccuugaccuccugggcuuaggugaucucccaccuagccuccugaguagcugggacuauaguuaugugccaccaugcccagcuaauuuuuaaauaauuuuuuuuguagagauagggucucguuguguugcccaggcugaucuuaaacuccugggcucaagcaguccucccaccucagccacccaaaguguugggauuacaggugugagccacugugcuggccuuaaauacuuuuuaaaugaaucguuaacauuuuaaaaucaagcgauuucacauacaagucgggauuugcuagcuuuucuugagaaauaucagaucaucuggaaaaagggaccugaaaucccugauggucacucauggguggagcagaacuguggcucccuuuagcugggaaaugcccuuuccagaucucuaaaucccugacacucccuauugccucauauguaguaugcuucacucauuuaugucgccugccugacccacguaggcauugaguuuguaaccacuguuucagagagggaggaggaggagagcauguuaggagacuuuguuaaugcacuugaucuugauaacauagauuauauuggggagacaucucgguguacccaacucugccagccucuugcucuuggaagucauggagaccgcuucuaaaacacugaagucugugggcaugauuauuuaaagaucuuucccggcuugugaagaaaacuuuuuuaggcagaaauccugccucaaacccuauuuagcuuguaguuauagauaauuuguauuuccagacuucucugggaaguuuugaaucuggcuuuaaacauuauuuuuucccaauuaacaacccucaugguucccuucugcaggcgagugagaaccaugccccgacacagccagucccugaccauggcaccauacucaucuguaagccucguggagcagcuggaagacaggauccucugccaugagaaaaccaccgccgcccucguagagcacgccuuucggauuaaagaugacauugucaacaguuugcagaaaaugcaaaacaaagggggaggugaccgcuuggccaggcuuuucuuggaggagcauaucagaaacauaacugccauagugaagcaacuuaaucgggauaucgagguaagguuugugaaagucagguggccuaugucccuuuccacagaauugcuccaugucaggaggucacccacaucuaacuccuaccucccaggcaguacugcauuuagaacaaagcugucugucuugucuauucuuaaugaucgccaaggagacagcuugcagaaauauccuaauuaaauuuauuccaguguuugauaacaguuacuguuaguguuauguuuaaucuaaauuuaccuugcugauuauuaaaugauuuuauuuuguuuggcucuuaaugaagagagagaagaacuagucgaauaguuucacucuauaaucuuucauaucuuugaagacagcuauuaagucaauuacuaaggucagacucuguugcuucagauuaaauguuucuaggucauaaugauuauauguaauacaguuuauuacucaaacaauuuaggcauuuggauugcuccucagacuccccuuuuuacugcuguaguuuucuuugaaaugagaccaauaaaaggccaauauugucuauuuuuagaauugguagauuuacugcuauuuauugagcaaucacagggaccacacaguuuaguucagaaagcuucagaucauuuagggcuuggguuucccucacuacgcaauguucauaucuuucacauguaaugacugaauauaugaauacuaauagauauauggcuagauuaaggaaaacuuuugcuuccugugauggagauuauaucugaauuaugcuuccuaaaauuaaaccucauuucuuuuuuuuccauugucagauuuguauguauguauuuauuuuaaccgcuuuauugagauauaauguaaaugucacaaaaaguguaaaauuaaaugauuuuuaguaaauuuauaaaauugugcaaccucaacacaauucaauuuuaggacacugccaucaccuucccaaaauucacauaagccuguuugcagucaauuccuacuucuaccccagcccaggcaaccacucaucuacuuucuaucucuagaaauuggucuuuuccagacauuucauauaaauggaaaccuuacaauaugaggucuuucgcaucuggcuucuuucuuuccuuuucuuucuuuuuguuuguuuguuuguuuguuuguuuugaaugcaguugugcaaucauggcucacugaagccuugaccucucaggcucaaccgauccuccugcaucggcgucccaaguagcugggacuacaggugugcacaaucaugcccagcuaauuuuuguauuuuuaauacuacaagguccaucuauacuauaguauuuuuuguagagacaucgucucacuauguugcccagacagggcuugaacuccugggcucaagcaaucugucugccucagccucccaaagugcugggauuacagaugugagccacugugcccagccuggccucucucauuuagcauaaucuuucugcgguucagacauauccuagcauguaucauauuccuuuuuaugucugaguaauauucuauuuucuggauauaccacauucuguuuaaccauucaugaacugaugggcauuugguuuguuuccaguucuuagcuuuuaugaguaaagcugcuaugaacauuugugacaggucuuugaugugaaaauaugucuuuauuucucuuggguaaauuacuaggaguagaauugcugggucuuauagugagcuuauguuuaacuuuuuaaaacauagcuggcagggcgcgguggcucaugccuguaaucccagcucuuaaggaggccgaggcagguggaucacaaggucaggagauugagaccauccuggcuaacacagugaaaccccaucucuacuaaaaacacaaaaaauuagcugggcgagguagcgggugccuguagucccagcuacucgggagguugaggcaggagaauggcgugaaccugggagcugcagcuugcagugagccaagaccaugccacugcccuccagccugggcgacagagcgagacugcaucucaaaaaaaaaaaaaaaaaacauagccaaauaauuuuccaaaguggcuauaacauuuuacaaucccacaagcaauguaugaaggucccaguuucucuacccccucagcaauacuuggcauuaucuuuuuuuauuauagucauucuaauggauguguagugguaucucauugugguuuuaauuuguauuuuccuaaugacuaaugaucuugaacaccuuuucauaugcuuauugaucauuuguaugucuuuguuggugaaaugucuauguaagucuucuacccauuuuauuaaaguuagauuuucuucauuguggggaaaaaagcuaccauuuuaaccauuuuaaguguauaaucuaaugacauuaaguacauucacaauguugggcaaucauuauuacugucuauuuccaaaagauuuccaucaucccaaagugagacuuuguucccauuaaaaaguaacuccccacuccacuuuccccucagccccuggugaccucuauucuauuuucuguccuuaugaauuugcuuauucuagcuacuucauauaaguggaaucagacaauaauuuguacuuuugugucuggcuuuuuucacuuagcauaauguuuucaagguccauccauaauguagcauguaucagaauucauuuuuauauuggguuauuugucauauuauugauaacuuaugaaaguuuuuauguaguuuagauacaagucccuuaucagauaugugaucuacaaauauuuucucccacucuguggcuuauauuuucguuuuccuaauagugucuuuugaagugugaacauuuuuaguuuuauugaagucuaauaucaauuuuuuucuucaaugguuuauucuuuuuguguugcaucuuuacaacuauuugcuuauuaauucaaggucacaaagauuuucuccuauguuuaauucaagauucucaguuuauacacuuaggucugugaaccauuuugagguaauuuuuguauauggugugagguaagggucuaaguuaauuuuuuuuucaucucgcuaucuuaggaaaaucuauccuuuucccauuuguccuuuuguugaaaaucaauugaacauaaaauauaacgguuuauuucuggauuccacuguucuguaugauuuucuuaaugucaaugccacauugucuugauuucuaguuuuagaguauauuuuugaaauaagguaauguaaguucuccaacuugcaacuaauguaaguucuuuuuaaaagguaguuuuggacuagucuauguccuuugcauuuucguuuaaauuuuaggauuagcuuaucaguuuauauuaaacagugacuuugauagagauugcuuugcauguauagauuuuaaaaaggcugggugcaguggcucacaccuguaaucccagcacuuugggaggcagagguaggagaaucacuugaacacaggaauuugagaccagccugagcaacauagugagacccuaucuuucucuaaaaauaacaauaauaauaauaauaauaaaaagaaauaauguauagauccauuuggggagaguugccaucuuaauuacugugucugauuguucaaggaaccaacuuuugguuuuauuaauuuugucaguuuuuuuuguuuuuguuauuaauuuaaaaauuuuaaaauugacagacaauaauuauacauauucuugggguaccuagugauguuucaauacaucuaauaugcagugaccagaucaagguaauuuugugucguuuaacaaguugcuauaucuccuucccuucccccuacccaucccauccucuaguauucucuauucuaauuuuuacuucuuugagaucaacuuuuuuuagcuuucacauaugaguaagaacaugcaguguuuaacuuucuguuccuggcuuauuucacauaacauaauguccugcuguucuauccguguuguugcaaaagacagaauuuuguucuuuuuuauggcugauaguauuccauuguguauauacaccacauugucuuuauccauucauccauuguuggacaccuagguuugauuccauaucuuggcuauuaugaauagugcugcaauaaacaugggggugaagaugucucuucaauauacugauuuccuuuccuuuggauaaauucccaguagugggauugcuggaucauaugguaguucuauuuguaguuuuuugaggaaccuccauacuuuucuccauaguggcuguacuaguuuacauucccgccaacaguguauaagagcucccuuuucucuguauccuugccagcaugaguuacuuuuuguguuuugguaauagcaguuauaacuggagugagaugauaccucauugugauuuugauuugcauuucccugauaauuagugauauugggccuuuuuucauacauuuguuugccauuuguaugucugcuuuugagaaauauuuguucaaaucauuuacccauuuaaaaaauuggauauuuuuugcuauugaguuguuugaguuccuucuguauucuggauauuaauccccuauuggaugaguaguuugcagguauuuuucucccauccuguagauugucuuuucacuuuguggauugcuuccuuuauugugcagaagcguuuuuguuugauauaauccauuuguuuauuuuugcuuuuguugucugugcuuuugaggucuuauuaauaaaaucuucuccuagaccaguguccugaaguguuuccccuauguuuucuucuaguaguuuuaucauguugggccuuacauuuaggucuuuuguccauuuggaguuuauuuuuguauugggugagaggugggggccuaguuuaauucuuuugcauauggauguccagcuuucccagcaccauuuauugaagauuugucuuucccucaaugaguauucuuggcaccuuuguccaaaaucagauggcuguagauacguggauuaauuucuagguucucuuuucuguuccauuguucuaugugucuauuuuuaugccaguaccaugcuguuuugguuacuacagcuauguaguauauuuugaggucugguagugugaugccucuggcuuuguucuuauuuauuuauuuacuuauuuauugagauacagucucacucuuuugcccaggcuagagugcaguggcgugauauuggcucacggcaaccucagccucccagguucaaguguuucuccugccucagccuccugaguagcugagauuacaggcacaugucaucaugccaggcuaauuuuuguauuuuuaguagagacaggguuucaccauguuggcuaggcuggucuccaacuccugaccucaggugauccgcccaucucggccucccaaagugcugggauuacgggcaugagccauugcgccuggcccuaguuuuguucuugcccaggguugcuuugucuauucgcggucuuuugugguuccauacaaauuuuaggguuuuugguugagugcagagaacauccuuuuuguuuucuuuccuuuucuuuucuuuuuucuuuuuaaauuauacuguaaguuuuaggguacaugcgcacaacgugcagguuugauacauaguuauacaugugccauguugguuugcugcacccaucaacucaucauuuacauuagauauuucuccuaaugcuaucccgcccccagccccccguccgcugacagaccccggugugugauguucccugccauguguccaagugaucucauuguucaguucccaccugugaaugagaacaugcgguguuugguuuucuguccuugugauaguuugcugagaaaguuugcugagaaugaugguuuccagccugauccgugucccugcaaaggacaugaacucauccuuuuuuauagcugcauaguauuucaugguguauaugugccacauuuucuuaauccagucuaucacugauggacauuuggguugguuccaagucuuugcuauucugaauagugcugcaauaaacauacaugugcaugauuuauaguaguaugauuugcaauccuuuggguauauacccaguaaugggauugcugggucaaaugguaauucuaguucuagaucccugaggaaucgccacacugucuuccacaaugguuaaacuaauuuacacucccaccaacaguguaaaagcguuccuauuucuccacauccuugcuagcaucuguuguuuccugacuuuuuaaugauugccauucuaacuggcgugagaugguaucucuuugcgguuuugauuugcacuucugugaugaccagugaugaugagcauuuuuucaugugucuguuggcugcauagacgucuucuuuugagaugugucuguucauuuccuuugcccacuuuuugaugggguuguuuguuuuuuucuuguaaauuuguuugaguucuuuguagauucuggauguuagcccuuugucagauggguagauugcaaaaauuuucucccauucuguagguugccuguucacucugaugguaguuucuuuugcugugcagaagcucuuuaguuuaauuagaucccauuugucuauuuuggcuuuuauugccauugcuuuugguguuuuaggcaugaaguccuugcccaugccuauguccugaaugguacugccuagguuucuucuaggguuuuuaggguuuuuaggucuaacauuuaagucuuuaauccaucuugaauuaguuuuuguauaagguguaaggaagggauccaguuucagcuuucugcauauggcuagccaguuuucccagcaccauuuauuaaauagggcguccuuuccccauuucuuguuuuugucagguuugucaaagaucagaugguuguagaugugugguauuauuucugaggccucuguucuguuccauuggucuauaugucuguuuuaguaccaguaccaugccguuuugguuacuguagccuuguaggauaguuugaagucagguagcaugaugcuuccagcuuuguucuuuuugcuuaggauugucuuggcaauucaggcucuuuuuugguuccauaugaacuuuaaagcaguuuuuuucaauucugugaagaaagucauugguagcuugauggggauggcauugaaucuauaaauuacuuugagcaguauggccauuuucacgauauugauucuuccuauccaugagcauggaauauucuuccauuuguuuguguccucuuucauuuuguugagcagugguuuguaguucuuccuugaagagguccuucacaucccuuguaaguuggauuccuagguauuuuauucucuuuguagcaauugugaaugggaguucacucaugauuuggcucucuguuugucuguuaaugguguauaggaaugcuugugauuuuugcacauugauuuuguauccugagacuuuccugaaguugcuuaucagcuuaagaagauuuugggcugagaugaugggguuuucuaaauauacaaucaugucaucugcaaacagggacaauuugacuuccucauuuucuaauugaacacccuuuauuuauuucuuuugccugauugcccuggccagaacuuccaacaccauguugaacaggaauggugagagagagcauccuuguuuugugccgguuuucaaaggaaauccuuccaguuuugcccauucaguaugauauuggcuguggguuugucauaaaauagcucuuauuauuuugagauacguuccaucaauaccuagucaaaugagaguuuuuagcacgacgggcuguugaauuuugucaaaggccuuuucugcaucuauugagauaaucauguggguuuugucauugguucuguuugugugauggauuaugauuauugauuugcauauguugaaccaaccuugcaucccagggaugaagccaacuugaucuugguggauaagcuuuuugaugugcugcuggauucgguuugccaguauuuuauugaggauuuucacauugaguucaucagggauauuggccuaaaagucucuuuuuuuguugugucucugccaggcuuugguaucaggaagaugcuggccucauaaagugaguuagggaggauucccucuuuuucuacugauuggaauaguuucagaaggaaugguaccagcuccucuuuguaccucugguagaauucggcugugaauccgucugguccuggacuuuuuuugacugguggccuauuuauuauugccucaauuuuagagccuguuacuggucuauucagagauucaacuucuuccugguuuagucuugggaggguguguguguccaggaauuuauccauuucuucuagauuuucuaguuuauuuguguagagguguuuauaguauucucugauaguaguuuguauuucugugcgaucaguggugauauccccuuuaccauuuuuuauugcaucuauuugauucuucucucuuuucuucuuuauuagucuugcuagcagucuaucaauuuuguugauguuuaaaaaaaaaaacccagcuccuggauucauugauuuuuuugaaggguuuuuuguuucucugucucuuucaguucugcuuugagcuuaguuauuucuugccuuaugcuagcuuuugaauguguuugcucuugcuucucuaguucuuuuaauuguguuguuagggugucaaauuuagaucuuuccugcuuucucuugugggcauuuagugcuauaaauuucugucuacacaaugcuuuaaaugugucccagagauucugguacguugugucuuuguucucauugguuucaacaucuuuauuucugccuucauuuuguuauguacccaguagucauucaggagcaaguuguucaguuuacauguaguugugcaguuuugaaugaguaucuuaauccugaguucugauuugauugcacuguggucugagagacaguuuguugugauuucuguucuuuuacauuuucugaggagugcuuuacuuccaauuauguggucaauuuuagaauaagugugauguggugcugagaagaauguauauucuguugauuugggguggagaguucuguagaugucuauuaggucugccuguugcagagcugaguucagguccuggauauccuuguuaaccuugugucucacugaucugucuaauauugacagugggguguuaaagucucccauuauuauuguaugggagucuaagucucuuuguaggucucuaaggacuugcuuuaugaaucugggugcuccuguauugggugcauauauauuuagcauaguuagcucuucuuguugaauugaucucuuuaccauuauauaauggccuucuuugucucuuuugaucuuuguugguuuaaagucuguuuuaucagagacuaggaaugcaaccccugcuuuuuuuuuuuuugcuuuccauuugcuugguagaucuuccuccaucccuuuauuuugagccugugugugucuuugcacaugagaugggucuccugaauacagcacacugaugggucuugacucuuuauccaauuugccagucugugucuuuuaauuggggcauuuagcccacuuacauuuaagguuaagauuauuaugugugaauuugauccugucacuaugauguucacugguuauuuugcccguuaguugaugcaguuucuucacagcaucaauggucuuuacaauuuggcauguuuuugcaguggcugguaccgguuguuccuuuccauguuuagugcuuccuucaggagcucuuguaaggcagaccugguggugacaaaaucucucagcauuugcuugucuguaaaggauuuuauuucuccuucccuuaugaagcuggauaugaaauucuggguggaaaaaauucuuuucuuuaagaauguugauuauuggcccccacucucuucuggcuuauaggguuucugccgagagaucugcuguuagucugauggacuuaccuuuauggguaacucgaccuuucugucuggcugccguuaacacuuuuuccuucauuucaaccuugugaaucugacaauuaugugucuugggguugcucuucucuaggaguaucuuugugguguucucuguauuuccugaauuugaauguuggccuggcuagguuggggaaauucuccuggaugauauccugaagaguguuuuccaacuugguuccauucuccccaucacuuucagguacaacaauccaauguagauuuggucuuuucacauagucccauauuucuuggaggcuuuacuaauuucuuuuuacucuuuuuucucuaaccuugucuucuuccuuuauuucauuaauuuugucuucaaucacugauacccuuucuuccacuugauugaaucggcuauugaagcuugugcaugcaucacgaaguucucgugccaugguuuucagcuccaucaggucauuuaaggucuucucuacacuguuuauuccaguuagccauucaucuaaucuuuuuucaagauuuuuagcuuccuugcaauggguuagaacaugcuccuuuagcucagagaacuuuguuauuacugaccuucugaagccuacuucugucaacucaucaaggucauucuccauccagcuuuguugaaaucacccgucuucugcauugaucaugcugggagcugcagaccagagcuguuccuauuuggccauauuggaacacccuccuuuuuuuucuuuuuuugagacagggucugucugucaccuaggcugguauagugcaguggcucuauuacagcucacugcagccucaaccuccugggcucaggugauucuuccaucucagccuccugaguagcuggaacuacaggugcaugccaccacauccagcuaauuuuuuguagagacaagguuuugccauguugcccagguuggucuugaacuucugggcucaagugauccuccugccucagcuucucaaagugguaggauuacagacaugagucaccacacuuggcugagaacauacuuuguauauuuuuaaccucuuuacauuuuuugagacuuguuugguggccuucuguauucuuacugauuuucuuucuuguucuauuaguuauugaaauauccaacucuuauugcugaauugucuguuucuucuuccaguuuugucaguuuuugcuuccuguauuugggcacuguuguuaggcucauauacauuuauaauugcauauaucuaccugaugcauugacccuuuugccauagaaagucucucugugucucuuguaauguuucuucucuuaaagucuguuuugucugguaucaguacagguauuccaucuccuuugugacuacuguuugcauaauucauguucuuuuuuuucuggagagacaaaaccucuguuacccaggcuggagugcaguggugcaaucauaacucacugcagcgucaaacuccugggcucaagugauccucccacuucagccucuaaguagcugggacuacagacacaugcuaccaugcccugcuaauuuuucuuauuuuuuuuuuuuguagagaugaggucuugcuuuguugcccagccucugccucugccucccaaagugcugggauuauagguaugagccacuguaccuggucuccuuuuuuugauaauucucaccaagcuugugccucuuggcucuggccuacauacauaguuaucaaauuucacuguucuuugagauucucacauguuuacuaaggacaaggauucacucagaauuauauccuaauugaagugcauuugucuucaggguucuaagaguucuaguggauacuucuuaugaugguuaaagaaaaugacuguguauuuguuaguaagacagugcaaugggucuguguugcuuuggugccuuaugguauccauuccagauuucuuuuggucacagcaauuugauuucuuuuuggauuuaccuuucuuucauugaauacaaacugggauggcuaauaaucagguugccuuauccccuuuuuagcuaaaggggguuggggcccauaacucaggcuagagcacugagacccucccuuucuggaauuuaaaaccugagcaggcugggcugggcgcgguggcucauaccuguaaucccagugcuuugggaggccgaggugggaggaaucguugaaccucggagguugcugcagugagccguagucaugccgggguacuccagcauggguaacagagggagaugcuacauucaaaacuaaaaccaaaccaaaccaaaccaaaacauaacgaaaaccugagcaggcuaauucaaagacuggaaauggccauaguaccuuccuugcagccacuuugccugcgggauacuggcuaguaguuccugcugcuuggaccucaggaaauacucuuugugucuucuucucaaccugcauaacccagcuucccuguugauuauguguuccuuuccccauuccuuuuuuuuuuuuuuaaauguuuucuggagacggggucuggcugugcagugguaugaucauagcucacuguagccucuaacuccuggguucaggugauccucccaccucagccuccugaggagcugagacuacaggcacaggccaccaugcccagcuaauuauuuuauuuuuuguagagacgggagucuugguauguuguccaaucauuuccauuaacccccuuaaguuagucagguccaauuaccugcaacuaaagaagugcaaugaccucagaggaacguagaaaguuuacaaaauugcuguaaauaauauacuugucuuuggaugcugguaucuauauuaagaaugaucuuuucaguuuuauuuuugggugcugagucaguuuuaucccagacgcuaaaaacuaagcaacccuaaguugacaacuguacaaaauugaagaaccccaacucgaacauuucaauuuugaaagggauuucagauuuaucaagagacugauagcucugcugcaccuaaaucuaacgacagguaaaauccaagugauggggaucaauaagaauucucagguucccauccccucaaccacuggcaaagaaguacaguaggccccuuuaucuguggcuucacucuccgcaauuucaguuaucuguggccaaccaugaucuggaaauauuaaauggaaaaauccauaaauaagcaauugauaaguuuuaaauugugugccauucugaguagcaugaugaaaucuuucaccacccggccugggugggacgugaaucacuacuuuguccacacuguauaugcuaccugcccguuagucacuuaguagaugucuugauuaucagaucaaaaaaacauaguauauguaggguuugguacuaucugcagugucaggcauccacaggaagucuuggaacguguccccugcagauaagagggugccaggguauguuacaaaaaauacaaacuuuucccauguuucacauuagaaaauacuguuacuuccccauucuuagaauacccagcacuuuccugugggaacucagcucuguucccuuugcuuacgggggugggggaagacuagagaugggagucagucuauucugacauuaccguccccuccagguaaaagcacaguauaacucuacccuuaagaaauccuggucuuaauuuuuucugucaacguaagaggugauaguguuuuagcugcaacugucggauccagggaauaauuuccuauuugguagcugccacguacuacuccaguggccagaaccacuuuauuuuauuuuauuuuuuuagagacaaggucuugcuauguugcccaggcuggucuugaacuccugggcccaagcaguccucucaccuuggccucccaaaguguugggauuacaggcauaagcuacagugcccagccagaaccauuuuaaauacauaauuuccaacuucagcugggccacugaugcuauuuaacaguuccuucauuuuaggaagcccuccuugccaguuccucucaugcccccaguuuccuuucccucaguguauccuggacacugaacucgugccacucuuacuauagcauuuauugaauaggacuaacauuguuacuuuacaagccucucaaaaagagaggaaccuugucuuccucaucuuugcauugucuaguacaauauuuggagcaaaaugcggugaaugcugucauaguauauuuguguugcuauaacaaaauaccugagauuggguaauuuauaaagaacagaaauuuauuucucacaguucuggaggcugggaaguccaagcccaaggcacuggcauuuggcaucuggugagggucuucuugcugcaugcuuacauggcagaagguggaagggcaagaaugaugaauccuguguccucacauugcaaaaggauugaacagaguggaccuccucccauaaacccuuuuuauaagggccccaguccauucaggguggagcccucaugacuuaaucaccuccugaaauaccacgccucuuaauaccaccacaauggggauuaaguucaacauaauuuuuggagggggugccaucauucaaaccucagcaaauacuuauuaagugaauaaaugcccaauacagagugaagccaguuguagauaugcugguagcaaaaaggacuagaagagacuaugagguuaucaaugcaaagaacauccuuuucagauaggcugagugaaguggccugagguaucaaggccaguuaguggcagugcugagaauaaacccauguggcaaaacuccaaaaauaugcucuuuucucuuuucuacuuuaccucuuagaagcucuucuagaaccugaucuucuauaaucgacucucaaaugugacaggcugugcuauucagccauucuuugcuuucugaguuucaggaagaacuuguuuaugaaacuagauaauucuagcuuuaguucucacugaguucuccccugacccauccuugcuuugaugagagaucacuugaauugcuucaauaaucagcuguaucaaaaaaucugccuaaggaaucugaagucaucaauuguuuaggcuuuugauaauuauuuuuuccaaaaccuuuuuuuuuuuugagacaaggucucacucccucacccaggcuggagugcagucgugugaucucagcucacugcaaccuccgccucccagguucaagugauucucaugccucagccucccaaguagcuggaauuucaggcacaccaccacacccggcugauuuuuguauuuuuguagagacaggguuucaccauguuggccaggcuggucuugagcuccuguccucaagugaccaaccaguuauguauggccucccaaagugcuggaauuauaggcaugagccaccaugccuggccuaaacauguuucuuuaagaugauuuuugaaaaauuuacaaugcagugagaaaguaauuucaauuuugcuguuuucccaacguccgaaacacauuuuauguaaugguuauucuugccuuaaccagacagcacucuuuuauauuuacauguauuuuuggagugugcaauuuugcaagugaugauuuccgugauagacagggaaaacugaguaaaaucuaaauuuggcaaaaaauuuaguuuguauuugaguguuuacuuuuuuuguaacugguaguaacuauauauaaugacaaaguaacaacaaggaaguuuaaaaauuuaagacuccaaugugaaacacuaauuauauugauuuauauguauuaugaacuuaagcaugucuaccuaaacauguuaggaugcuugaugacagaucagaauugcugucuuauagccaaacuucauuaaaaugaaaucaugauugucuuaguuuaggcugcuaugacaaauuaccauagacuggguagcuuaaacaacagaaauuucuuuuucaugauucuggagacugggaaguccaagaucaaaaugcugguagauccagugucuggugagacccugcugccugaauuguagauggucgucuuuucguauccuugcauggcagaaaguagagagcagaagcaagaccuucuuuuaagguacuaaucccauucgugaagauucuacccucaugaccuaaucaccucuuauaggccccaccuccuaauaccaucacaucaaggguuaggaguuuaaccuacaauuuuuuuuuuuuuuuuagacugggucuugcucugucauucaggcuggaaugcagugguaugaucauggcucacugcagccucaaccuccugggcucaaguaauccuccugccuuggucuuccgaagugcugggauuacaggcaugagccaccacgcuuggugaacauaugaauuuuuggaggacacaaacauucaguccguaacaaugauguagaguaaauuuaaaaaguacuaaaaggaagucuucauuuauaaguaauauaaaaauuggcaccaggcacgguggcucacgccuguaaucccaucacuuugggugugggauccacaagguggguggaucacuugaggucaggaguucgagaccagccuggccaacaugaugaaaccccaucucuccuaaaaauauauauaaaaauuagcugggccugauggcaugugccuguaaucccagcuacuugggaggcugaggaaggagaauuguuugaaccugggagguggagguugcagugagccaggaucaugccacugcacuccagccuggcugacagagcaagacuccaucucuaaauaaauaaauaaauugggagagugggcauaauauaaaacugauacuuggccgggcgugguggcucacaccuguaaucccagcacuuugggagaccaaggugggcagaucaugagaucaggaguucaagaccagccuggccaacauggugaaaccccaucucuacuaaaaauacaaaaauuagcugggugugguggcaggugccuguaaccccagcuacuugggaggcugaggcaggagaaucacuugaacccaggaggcggagguuacagucagccgagaucgugccacugcccuccagccugggcaacagagugagacucugacucaaaaaaaaaaaaagcaaaaacaaacagaaaacaaaacaaagaacaaaauaaccucauacuuguaguaucaguuuuaaaacagaggugugaagauauuuaaauuguauuucaaugauguaaaagguguauuuuuuauuuauagauucuugaagaauaucuucuguaaauugccugaguuuuuauuauuauuauuauugcugguuuauagcuguuuuucaguucacgcaguaaaauuuuacuggguuauuugauuuuugagaaucaucccugcaggugauuuuauauuacaaaaguaaagcugaagccauucuuaagaugugaaacuuacugcuagacccugauagaacuagucaaaucgagauauauuaacacuguaucuuggcaaauuugccuagauaagucuuuaugauuuucugucaugugacucugaacaguuauacacuggaaaaaaaguaaaauauguuuucaaaccauuacccuaugugauccucaagagcuagaacagagucuuaauauuucuauuuucaacaccuaccaaugucuaagacauaguaggagcucaauaaauguuucauaaucaagagcucugggucuccuugccccuuccagaacccuauaauuauugcuuauauucuuucagcagauaccagugucaaaacagaugacucuuguauacuaauacacaguaagugcuugauaaauguugaauggaagaauuuauuguuuuaauacaucuccauccacagugucuguuagcgguuugccuugugauauggagaagcuuaucaauuauuuauuccucagaaacuuuccaccaaugaucaucaucauuauaaauuuagaggaaguaauauagucaacuaugaauuauacaugucuggguuauccauacugucuuugguuuaagccguuaucggucccuggaagccgagcccuggugagcaguccgugguccuuuuauuggugguaagcuuuccuuuccaugccaguuugauggcuggggguaguaguuuggacccccaugucuuuuuauggcuuuagcugugucucuggccuuugggaaccaugcaguggggucugccaccuggcugguuagaaucugcggaccuacuuuaguucccaugugcucaacuucaugauguccuucuggcuuggaauguuggcuuuaaccuaguuggguuaugggaaacuguaucaagcccucaucuaauugaauauaucauacguaguuugcuaguuuaauaauuugcaaaaggacuacuggaguuuuugaacuugagcgaugagugcagcauugggcuuuacuaacaugggaaagcaggggcguagacagugauguuaacauguagucggacuaacauacaggaccuugguucagugugcuuccaguacugccaaugaggaaagaguuuuggcuacuggacuucaugcauuuuacugaaaaagggaauuucagccugcagcucugugaucugguucuauugaaacagguauaucagcggagggguuuuggugauuaucauccaaauucauuuuguuuucauucuacccacuagauguggcguguuguaugccuugacuucgggggagaagacaguaaauugaauggaauucgaauauuuauucaguucuguugacagagguuuuucaauguaaaugaauaaauuaguguucuggugucugcucugucuccaguacauuuuagcuugucugaguccucuuugaggaccugaucaugucugggaaccagagauugauaacagcucaaaucaaagggauugauaacagcuuaaaccaaagacaggauggacagcuagagauagucucuaagccuucaacucagaagaccagauccuagaacauggagcuaaauuaauugauaaaucacucacuaauccacuaacccacuaacagccaggcauuguuagaggcacuggagcugcaguaauggcccaagcacacaggccucugaucuucgcccugcugcacacuuuagugggguguacaggcagucaaugcuaaguaaccaaggugauguuagcugaugucaagugcucugaugagaggaugugauggagagugacuguguggcugucuuagaaaggaugguggccgggcgcgguggcucaugccuguaaucccagcacuuuugggaggccgaggcgugcagaucacgaggucaggaguucaagaccagacugaccaauauggugauacccugucucuacuaaaaauacaaaaauuagccgggugugguggcacgugccuguacucccagcugcuugggaggcugaggcaggagaauugcuugaacccgggaggcggagguugcagugagcugagauugugccauugcacuccagccugggugacagagugagacucugucucaaaaauaagaaaaaaaaaaaaaaaaaaaaaaaggaugguaagggaauaaggugacgugugaauugagaauggaaugacauauggggccaggcaagccaagguggugguguugagggaggagacacccagggggaucacuccagagcgagggcaguucaaguuccaaggccauaaguaggaagaggcguggcacguuuaagaagcagaaaggggaccaguggauggagugcugugagcugggggaagggcagcccgugagacuugaagguugugauaagaaguuuggagucuggaaaugggaagccauuauuuaguguucagccaaggaauuuaaauaauccacucacacucuuguugcuggggcuacauuagugaauaaaacacagauaaaagcccuuguccuuguggauauagacugauuuauguuugaaaaagaucacgcuggcuacuucguggagaaggauuuuaggggagcaagaauugaagcagggagucaaguuaggggacuacuucaagguucagggagaggcauggcaugguggagauggggagaagauggauucuggagugauuuuggagauagagcugacaggacuuccugccuauuggagggagagacuucuaucaaaugguggaaaugccaagaaggcaauuugauauaugaggcuggaacugugguaaaaagcccuguaggggaauacuaccuuauaauucgcugcucugcuguaguugggccuuucucuaggugauuugaaauuauacuuccucauuuccaaacccuucccaaucuaggaagaguuggagaaggaggaacauggagagcuguuucuuuccugguuccuggcaacgcuggccugucuggggggcuuagaugucccaggggauugguugucaucaccuuugcauaaacugcauuauacagcacauugaggcucccacagaagucccuauuccaagccguuuugggaagggagguuuuuuaaagauaggccguaucuuugaaaaaauaaaugaggacuugggacaucacuuuuucaagguggcuagcuucugcuccgugcuugugugaagcauguuuauugugugcaccuggacaaugcacuuuccacccuuuaguuuuucuugcugcaagaaaagcaagaaagcucccugaggguaugccugaugcucagcacacaguaggugugcaaaaacaaguuucuugaauugaauugaaaauaauggagaagcaaugccauauauaacgauauaaucuuuuuaaaaauaaaugcaucaugaugauauauuguuccaaaaugacaaauucaggaacauuauugacuuuacaaaggaauuacuuuucuaaguuuucauucuagaauguauuuaaguaauaagccgucuaacaccuucuguuuucauauuacuuucuaguaacaugaauacuuuguuaaugucagguaggauucuuuccuguauucuucaaagcacuucuuucuuaaauuuuuauucauuuguuuuuugagacagggucuugcucuguugcucaggcuggagugcaguugugggaacauggcucacugcagccucugccucccagguucaagcaauccucuugccucagccucccgaauagcuaggaccaggggugugcaccacaacucuuggcuaauuaaaaaaaaaauguguguagagacaggguuucaccauguugcccaggcuagucucaaacuccugggcucaggcaauccuccugccucggucucccagagugcugggauuacaggagugagccaucgcacccgaccccagagcgguucuaauacaauaccuuauuaaucugcauaagaauuuggagaguuaaaugggcuuuuuuaaauuucuaagcauuuuuuaaagcacauuuuuuuuucuggcuauaaaaguaauguauguccauuguuggacauacaaaaaaaaagaauaaaccauaauuccacccuagagauaagcaaaacuuucacauucuaguauuuuauaugccucuuaauacacagcuggaaucaugcuccauauuuauuuucuaugcuuucuuuuugcuuaguauuaaguuguacacacuuucccuuguugcuaaaaacccuuuaugaacaucuuaguguuuccauaauaauguaccuugugaaauacuugacauguguaucacacucugaagacaucuuuaugcauacauuuuucuuauuauuucauuuaauauuaauuccaagaacuagaguuacugggucaaagguuaugaacauuaugaauauauauuuuuuggcauuggucuccaggaaaguuguauugggaagggccagcugugccuuuuuuauuucuauuuuuuaggcaagcagaagaugcugaaaccuuuuugauuuuugauauauuuuuaauauuauagauuuaaaauauuugcuucuuuaauaagugaaaaugcuauuuuugagguuuaaaaaauagacuuuauuuuuuagagcauuuuuugguucauagcaaaauugagcagaaaguauacucucugcucccacacaugcgcagccucucccacuaucaacaucccacaccagagugguaugcuauaauaguaugauuuguacuucuuauuucuuugcuuuacuagaaagguugaaccuuuuaaaaaauguguguuuuuuuaagccccuuuuuuugugaauugcuuuccauuuucauugcuuagagauugaaaaacaacucagaugaaauaagauugguuauagccuuugucauuucugaagugucuauuuuguuuuguuuuuugagaugggguuuugcucuugucauccaggcuggaggacaauggugugaucuuggcucacuacgaucuccacuaccuggguccaagcaauucuccugccucagccuccugaguagcugggauuacaggugcccgccaccaugccuggcuaauuuuuguauuuuuaguagagacgggguuucaccauguuggccaggcuggucuugaacuccugaccucaggugauccaccugccuugaccucccaaagugcugggauuaugggcgugagccaccaugcccagcucuauagugucuaauacaguguauuaggcgcugggcucguucucuagcuuugguuuucuggagaugggguccaagaauuugcaugcguaacaagccaucugggugagacuuauguaucccaaagauauuugagaaccacuggucuuaugccuuacuauaggcaaagguuugcaccacuacauacaaaaagaauaaguguuacuuucuauugacucuaacuaauagguguuacuuccuauuaagagagagugcaccggagcuugccagcgccuucucaucagugggagagugccagaaccacauuagucagaugcgaaguugucuugcaagaauguauucauaugacucacauuuugucauucacaggugauuguaacuaguuuguguuccucuucauagagcagguucauugagaaaaagcuggaagcuacagaaauaauagauaggucuugcaauucuaaauucuuucuggugaauuuuuuuuuuuuuugacggagucuugcucuguugcccaggcuggagugcaguggcacaaucucgguucacugcaaccucugccuccuggguucaagcaauucuucugccucagccuccugaguagcugggacuacaggugcgugccaucacgccugacuaauuuuuguauuuuuaguagagacggggguuucaccauuuuggccaggcuggucucgaacuccugaucuugugauccacccgccucggccucccaaagugcugggauuacaggugugagcuacuguggccgcccagugaaauuuuccuuuuuacugucagugccucaagcagguuuccacugagggaaacacagaauauuuacauuccuaauuucuuuuuuuuuacuaagaaguuugaaaauccugaaaaaaauacacaaguauuuucuuuauguauguuauacuucaaaaaagaaaagaaaauagaguuaagaagagggagcacaaaaacaaauuauguaagcauaauuacaucucuacuugggcuuuccuauucauuuccaaaugggccugcaaauugucaguacaucagaaaccaucaaaauuucuagaaauaaguaguaacaagcagauacccaggaauguaaucucaagaaacccuuggauuggugcagaaggcaagagaagauggugguuuagugugccugucucuagucuguucccaauccaggugcuaccuuccugaacaguugggauaggcaggcaggaaagccuggggagccagcaggaucccaugguuaggagucucaggaggaggguccaggcucacugcuucgcacccuauaacuaagccagucuccugccccauggagggguggacagguuguaggggcgggcucguuccccacugccucucagcugggagagcugagggaauaggauguaaagaggcauccuccugguaccucaccuggagacaggcccugugcuucccacuggcugcaccacccguccacaagccccuuccacuacucucaagacuaccuacuuaaggcacuccagugaguagagagagcaaagucacauagcaucuaauggggcccugcagccacaaggaggaagaauaaguacugcccuuaaaacaggugcagaugaaauagaaaacagguaggccuugaauaaaaaauaauuccuacauuuaaggagauccaagugucacauaaaauuucuucuugaacuuaaauuucuaaaagucaguagauggacaggagggcagaggaagauggcagaauagaagccuccaccaauuguccuccccacaugaacaccaaauuuaacaacugucuacaaaauaaagcaccuucaugagaaccaaaaagcagguaagcgaucacaguaccugauuuuaacaucauaucacugaaagaggcacugaagaggguaggaaggacagucuugaaucaccaacaccaccccuccaccauucccugucagcggaccacauggcccggagagagaaucugugugcuuugaggagggagagugcaguguuuaugggacauuguuuuggaaugcagggcagccaaccagcagugauaagcaaguagugugccaugggccuuggguaagacucagacauucuggcuuuaagggugccucugcacuuucacagccgugguggcugugaggagagauuucuucugcuugagaaaagcagagggaaaaguaaaggggacuuugucuuuagcuuagguaccagcuuggccacaguggagaggagcaccaagaagucuuuuggggucccugacuccaggccuuggcucuuggacucuuggaucucuagauguacccugggcuaaaggcgggcccgcugcucugaagggugagucccaggccugacaggauucaccacaaacugaauaaagagcccuugggccuuaggugaacaauggcaguagcauggcuuuauucccuuugggcaugugguagacguagggagacuccucacccuggggaaaguggagggaagagugggaaggacuuuggugguuucggcacuagcucagccacaguagaauagaguaccagguagauuucuaagguuucugauucuaggcccaggcaccuggacagccucucuggaccugcguggagccugggggaacucauugcccuuaggggaaggacacaagccuggcuggcuucaccacuugcugauuguagagcccuagggccuugagugaacauacggguagccauguagugauuacagcaggacuugagcaagauucggugcugugcuggcuucaggucagacccaucagagucccaauggugguggguacagaggugcuugugccccacuucccagcuccagguagcucagcacaaagaaagaaagacuuugcuuguuugggagaaaguaagggaagggaaggagagucucugccugguaauccagagaaaucuucuggauuuuauccaagaccaccaagguaguacuucuacaaguaugcaagaacuacaguguuauugggcuugggguacccccuaaugcagauaugguugcagugaccgaaaacuuagauuacuuaacacccaagucccuuugaauaucuggaaagccuucgcaagaagaauggguacaaacauugacuaacauccacaagcaucaagaccaucuaggaaaacaugaccucaccaaauuaacuaaauaagacaccagaagucaaucccagagagacaaagauaugugaccuuuuagacagagaauucaaaauagcuguuuugaggaaacucaaagaaauucaagauaacaccgagaaggaauucagaauccuaucagauaaauuuaacaaagaaauugaaauaacuggccaggugcagcggcucaugccuguaaucccagcacuuugggaggccaaggcggguggaucaccugaggucagaaguucgagaccagccuggccaacaugaugaaaccccaucuguacuaaaaauacggaaauuagccaggugugguggugggugccuguaaucccagcuacucaggaggcugaggcaggagaaucgcuugaacccaggaggcagagguugcaguaaaccaagaucaugccacugcacuccauccugggcaacaagagcaacacucugaagaaagaaagaaaggaaagaaaggaagggaaauaauuaaaaagaagcagaaauucuggaguggaaaaaugcuagugacauacugaagaaugcaucagucuguuagcagaauugaucaaacagaagaaagaauuaaugagcuugaagacaggcuauuugaaaauacacagaggagacaaaaaaagaaugaaaaaaaugaugcacaccuacgagaucuagaaaguagcuucaaaaggacaaaucuaaaaguuauugguuuuuaagaggagguagagagagaaauagugguagaaaguuuaucaaaagggauaacagagaacuucccaaacaaaagauaucaaaauucaaguacaagaaaucaaaauucaagcacaagaagguuauagaacaccaaguagauuuaacucaaagaagaccaccucauggcauuuaauaacaaaacucccagaggucaaggauaaagaagggauccuaaaggcaacaagacaaaagaaacaaauaacauacaauggagcuccaauaaguuuggcaacagacuuguggcaugacgucuuuaaagugcugaaggaaaaaaaaacuuagcauaaaaccuaccauaguguaucuguugaaacuauacuucaaacuugaaggagaaauaaagacuuucccagacaaacaaaagcugagggauuuaucaacaccaggccuguccuacaagaaaugcuaaaaggaguucuucaacauucaagaaaagaauguuaaugagcaauaagaaaucaucugaagguacaaaacucacugguaauaguaaguacacagaaaaacgcagaauauuauaauacuguaauugugguauguaaacuauuccuuaucuuaaauagaaagaugaaaagaugaaccaaucaaaaauaauaacuuuuccagacauagacaguacaauaagauaugaauagaaacaacaaaaaguuaaaaaguguggagaugauguuaaaguauagaguuagcagcacuccugaauauauauauauauuuuauauauauauuauauauauaucuuauauguauauuauauauauauuauauauauauuaguauagaguuuuuuauuaguuuucuuuuugcuuguuuguuuguuuauaagugccuacaucaaaaaagaagaaaccuucaaauaaacgaucuaaggauaugucuuaaagaaucagaaaagcaagagcaaaccaaacccaaaguuaguagaagaaaggaaauaaugaagaucagagcagacauaagugaaaugagaacaauuuaaaaaaaucaaugaaacaaaaaguuggguuuuugaaaagauaaacaaauugacaaacuuuagcuagacuaagaaaaaaacagaaaagacccaacuaaauaaaaucagagaugaaaaaggagaccuuacaacccauaucacagaaauucaaaggaucauuagaggcuacuaggagcaacuauaugccaaaaaacuagaaaaccuagaagaaauggauaaauucuuagacacauacaaccuaccacaauugaauaaugaagaaauccaaaaccugaacaaaccaguaacaaguaacgagauugaagccauaauaaaaaccuccuagcaaagaaaagcccuggacccaauggcuucucugcuaaauuuuaccacauuuaaagagaauuaauagcaaucauacuguaacuauucugaaaaguagaagaggaggaaauacuuccaaacucauucuaugaggccaguauuaccuugguaccaaaauuaaagaugcaaaacaaaaacaaaaacaacaacaaaaaaacaaaaaaccuacaggccaauaucccuguugaacacugaugcaaaaacccucaacaaaauacugggaaacugaauucagcaacauguuaaaaagaucauucaucauuaacaagugggauucauuccagggaugcaaagaugguucaacauaugcaaaucaaucagugugauacaucauaucaacaaaaugaaagacaaaaagcauaugaucauaucaaccgaugcugaaaaagcauuggauaaaauucaacaucccuucaugagaaaaacccucaaaaaacuagguauacaaggaacacaucucaacauaauaaaagccauauaugacagacccacaguuaguaauauacuaaauggagaagacaggaaagccuuuaucuaagaucuggaacacaaaaaggaugcccacuuuuacugcuguuauuccacauaguacuagauguccuagcuagagcaaucagacaaaagaaagaaagaaagggcauccaaauuggaaaggaagaagacaaauuauucuuguuugcagaugauaugaucuuauauuuggaaaagccuaaagacuccaccaaaaaacuauuaguacugauaaacaaauucaauaaaauuucaggauacaaaaucaacauacagaaauuaguggcauuucuauaugccaauggggaacaaucugaagaagaaaucaagaaaguaaucucauuuccaauugcuguaaauaaaauuaaauacuggccaggugcuguggcucacgccuauaaucccagcacuuugggaggccaaggugggcagauuacuugagcucaggaauuugagaccagccuggguaacauggcgaaacccugucucuaccaaaaauacgauaaaauagcugagcgugcugcugugugccucgggaggcugagcugggaagauugcuugugccuugggggcagagguugcaaugagccaagauugugccacugcuuuccagccuggguucagcgcaagacccugucucaauaauuaaauaaauaaauauaggcugggugcgguggcucacgccuguaaucccagcacuuugggaggcugaggcaggcggaucacgaggucaggagaucgagaccauacuggcuaacacggagaaaccccaucucuacuaaaaauacaaaaaauuagccgggcauaguggcgggcgccuguagucccagcuacucgggaggcugaggcaggagaauggcaugaaccugggaggcggagguugcagugagccgagauugcgccacugcacucuagccgggacaacagagcgagacuccaucucaaauacauacauacauacauacauacauacauacauacauacauacauauauacauacauacauacauaccugugaauuaaccaaagaagugaaagaucucuacaaugaaaacuauaaaacauugaugugagaaauuggagaagacucauaaaaauggaaagauauuccauguucgugguuuggaauacauaauauuguuaaaaugucuguacuaccugaagcaaucuacaaauucaaugcaaucccuaucaaaauaccaaugacauucuucacagaaauagaaaaaaaaaauccuaaaguucacauggaaccacaaaauaccaaaauagccaaaacuauccugagcaaaagaacaaaacuggagaggucacauuaccugacuugcaauuauacuacagagcuacaguaaccaaaacagcauggcacuggcauaaaaauagacacauagaccaauggagcagaauagagaacccagaaacaaauccauacaucuacaguaaaauccuuuuugaaaaaggagccaugaucaugcaauggggaaaugacagucuguucaauaaguggugcugggaaaacugaauauccauaugcagaagcaugaaauuagaccccuauuucauaccauguacagaaaaucaaaucaaaauggauuaaagauuagagaggagcagaaaagauaacuguuggguacugggcuuaauguacagaaucuguacaacaacacauuaaacccaguauacaauaguuguguuuaauuaucucacagaaauaaucuguacaacaaacauccauggcacgaguuuaccuauguaaaaaaccuucacauguacccugaaccaaaaauaaaaguugaaaaaaaaaaaacuuaaaucuaagaccucaaacuaugaaacaacuaaaagaaaacauuggauaaacucucuaggacauuggagugggcaaagauuucuugagaaauaccccucaagcacaggcaaccaaagcaaaaauggacaaaugggaucaaauuaaguuaaaaagcuucugcacaucaaaagaagaacaaaguggagggagaacguaguugcaaacucuccaucugacaagggauugaucaccagaauauauaaggagcucaaacaacucuauaagaaaaaaaucuaauaaucuguuuaaaaaaugggcaaaagaucugaauacacauuucucaaaagaagacauagaaauggcaaacacagguauaugaaaaggugcucaacaucauugaucaucagagaaaugcaaaucaaaacuacaugagauauuggcugagugcagcggcucacaccuguaaucccagcacuuugggaggccgagguggguggauuacuugaagccagggguuucagaccagccuggucaacacggugaaacuccaucucuacuaaaaauacaaaaaaaauuuagccuggcauggugaugcaugccuguaaucccagcuacuugggaggcugaggcaugagaaucgcuugaauccaggagguggagguugcagugagccgauaucaugccacuacacuccagccugggugacagugagacuuagucucaaaaagcaaacaaacaaaacuacaaugagauaucaucucaccccaguuaaaauggcuuuuauccaaaagacaggcaauaucaaaugcuggcaaggauauggagaaaagggagcacucauacaguguuggcgggaauguaaauuaguacaaccacuguggagaacacuuuggagguaccucacaaaacuaaaacagagcuaccauaugauucagcaaucccacugcuagguauauaccuacaagaaaggaaaucaguauauggaagagauaucugcacucccguguuuauugcagcacuauccacaauagccaagauuuggaagcuacccaaguguccaucaacaggcaaauggauaaagaagugugguacagauacacaauggaguguauucagccguaagaaagaaugagguucugucauuugcaaaaacauggauagaacgagaggucauuauguuaagugaaaugaaauaagccaggcacagaaagauaagcuucgcauguucucacucacuugugggagcuaaaaauuaaaacaauugaacucacggagauagagaguagaaugaugguuaccagaggcugagaaggauaguggggggugggguggaaauguggaugauuaaugggcauuaaaaaauaguuagaauuaauaagaucuaguauuugauagcacaacagggugacuguagucaauaauaauuuaauuguacauguaaacauaacuaaaagaguauaauuggguuguuuguaauagaaacaguaaauacuugaggugagggauaccucauucacccugaugugauuauuacacauugcaugccuguaucaaaauagcccauggcucaaaccuguaaucccagcacuuugggaggccaaggugugcgugucaccugaugucaggaauucaagaccagccuggccaacauggcgaaaccccaucucuacuaacacaaacuccgucucuauuaaaaaugcaaaacuuagccaggugugauggcacaugccuguaaucccagcugcucgggaagcugaggcaggagaauugcuugaaccugggaggcagaaguugcagugagcugagauugugccacugcacuccagccugggcaacagagcaagacuccaucucaaaaaaaaaagaaaaaagaaaaaagaaaaagaaaguggcuucauuacuaaggaagaaauacuaaaaccaaaggaacuuaguuuuuaaugguaaauaaagggacuugcucugggaggagccucuaaggucucucucugucuaggcccccuaguucucuguuuaagugugccuuaggugacuguugaaaaggagucucuuaugaaagacugaguuaaacauucuuauuuuugccaaaaguauaaaaugcuuuuguggaagcacgugaauucuuagaugacucccuuaguguuuuuuauguugcccagguacuccaggagcagauucgugcccgggacaacauuagcuauggaacuaauucugccuuaaagacccuggagaugcgccagcucuccgguuugggagaucuucgaggaagaguggcaagguagguguucaaauguuggggucucugcucaucaaaaaccauuuucuauaaacuccauuauaguggggaauauauuaaugaagccccaaagcaaauggcuugcauuccuuuaguacauucccucccugcuuuggccauaaaauccagugguaggaguuaaaccugguugugagggugccauggguuucuuuuguuacgcaauugguguugucuuccugggaagaaaugaugggagaacucacucagcugaccuuguaauuugauaggguaaauacuaaguuuaucgaauccgaaaauauaaaguugagauaguuuguaugucauuuuggaaauuuaauuuuuccuguuauucauuuuuauuuuauuuucggaaaguauuggucugggaaagauuggaaacuuagaaaaaagaucuuucuucucaguaugaaaagugcuauuuucucaaagugugcugcauggaccagcagccucaacagcaccugggaccuuguuagaaauguacugucuccagcccacccugcaacuacugaguuagaaucugcauuuuaacaagaucccugaauucauaugcaugggaaaguccgggaagcacuguaccaggacugugucuagggcuauuuuuaucuggcugggacaaauuuguccgaaguauuuaugggccucuucugcccucugcugggccuaagagccaagcacauuaaugcauaucagcaccggagcugaggagcaaauggcacuucccgucagccugagguggcaaugaggguggucugcauggagucggguggaagaaagaacaaggaccuccugcaugcaaggccucuggagcagggaggaguaguauuagggugucuuugugcagacaacgugucgagggccuugaaugcuggacauguguguuugagucugcuggguaaagaucugucuauaauagcagagggcugcauggauuggauggggaacagguugaucacucuccuucugugauuuucuguccucaucaggaugaacuccagucuccuuagugugauccuuggugaugacacccuguugacucccucuucucucucuacccuugcacuguaccuuucagcagugaucaacuuuuuuguuagucccugaauaaaccaugcucuucuauugcuccaccuuuguacaugcuguucucguaccuagcaugccuuuccuccuccuuuucuuuucuuuuuauuuuugagacaauucucacucugucugccaggcuggagagcgguggcacaaucucggcucacugcaaccuccgccuccuggauucaagcgauucuccugccucagccucccgaguagcugagacuacaggcacucgccaccacggccagcuaaguuuuguauuuuuaguagagaugagguuuuaccauguuggccaggcuggcuucuaacuccugaccucaggugauccgcccaccucggccuccaagagugcugggauuacaggugugagccaccgcgcccggccuccuccuucuuuucuaacuucuuuucagucuuuaaaguucagcugaagugucacccccucugggagucuucccugacacccccacuccauagagcucuccuagcacucacugcucuauugagucucuccaaugucuuccucacucugcuaccuuuacuauguugaagggggauuccagauauguuaccugucuauagcuaagugccuggaacggucucuggaaaacaguagauacucaacauucaucaucaauuuggaugaagaaaugaccuggaaacucacuauaauaggacuggaaaaccuugacuccuuguuuaugcauuucggcuuaaaagaaaucccagcucugugauaccucucagaacagcagggaguuagaagaacuugcgagcuauaggacagaguagggacuuuaggaggacucugaggaucuucguagccgcuugaguugcggaugaagaucaagugggagaauacaugugagaggcuuggugcccugcaugcgaugaaaagggccugcaaccagugguggcuuuaucaucucaggggcaagagcaguggcauuguccuuaugaugcugguucuaauacaaaguagaaaaauuauuuugaaauacuuucaggaaucuuauauucuucaguuucuuaucaacuucucuacucaacuuguugcuucccuguaacaaaaacuuucacucuaaaggcaucaaaaguguuuguuaugaguacuaaauauuuuugcuuuguuuuuuuggcuauauuagaaugcugaugagacuugauuguugaaaugaauucaugugaaauaaaaauucuuuggaaaaguuucuuggcuuucuuguguugauuauguaauuguauuggagggguaugaacauuuuaagugguauucuuaagacacuagguugcuauauuauuucauauuuaauuuuauaguuuuuauguguccauuggugauguaauuaguagcaaaugggccuugauuuuuuuccccuguaaauccagcucagaagggcaaaggcaaguucuccauaaagaugagauacacauuuagcucauguggcauaccguguucuaaacaggacuugaucagaccugaaggcccgauacauagccuccuuucucucuccucucucucucugaacaccuuuagugagaucuaacuauauaagucaccuacuuaaagcacacaauucagugauuuuuaguguauucacacagucauguagucaucaccacaaucgauuucagaacguuuuuaucauccaaaaagaaaccccauaccuguuagcugucacuccccauuuuuccccagccuccccaguuccccaguccauggcaggccuacauucucugucugauggauuucccucuucugagcauuucgagugaauguguucccuugauucuggcuucugacacuuagcaucauguuuucaggguucauccauguuguagcauguaucagcacuacauuccuuguuauggcugcauaguaccucauuguguacugcauuuuaaaaaccuguucaucaguugaacguugggguuguuuccacuuuugacuauuuuaaauaaugcugcugugaacauuugucuauuuguuuuugugugcucauagguuuucauuucucuuggauauguaccuagaaugaaaaagcugaguaacaugauaacucuauauucaacuuuugaggaacagcgcagcuagacuguuugccgaaguggccgccacuuuacauugcccccagcagugucugagggcuccgauuccuucacauccucacuaacaguuguuuucuaucuuuucgauuauagccaucccaguggguuugaagagguaucucauugugguuuugauugcaucccccugaggacuaaugguguugaacaucauuuaaugugcuugcucgucauuggcauaucuucuuuaggaaaauauuuauucagauuccuugcccauuuuuaaauuggguaauugucuuucuauuauugagcuguaggaguuuuaaaaauuauauauucuagauauaauucccuuaucagauaucugauuugaaaaauuacugucccauucuaagggaugucuuuucauuuucucaugucuuuugaaacuuaaaaauuuuuaaucuugcuuauaucuaacaucuaucuuuucuucaguugcuaguguuuggggugucauauuuaagaaacucuugccuaauccaggucacaaagauuuaugccuauauuuucuuuuuaaguuuuauaguuucagcucuuacauuuaggccugugauccauuuuuaguuaauuuuuuuguauauaguauaagguaagguuccacauuuauuauuuuccuuguagauaucuauuuaucccagcauaauuuguugaaaagucuauucuuucccccaucaaauggucuuggcacccuaguugaaaaaucacuuggcggccgggagcgguggcucacgccuguaaucccagugcauugggaggccgaggcgggcagaucaggaggucaggaguucaagaccagccugaccaauauggugaaaccccgucucuacuaaaaauacaaaaauuugccagguguggcggccugcgccuguagucccagcuacucaggaggcugaagcaggagaaucacuugaaccugggaggcggagguuguagugagccaagaucucgccacugcacuccagccugggcaacauagcaagacucuaucucaaaaaaaaaagaaagaaaaucacuuggcaaauagguguauagauuuauuuguagacucucaauucuauuccauugauucucaauuauuuucuuaugcugguaccacacugucuugauugcuauagcuuugugguacauuuugaaauugagaagugugaguccuccaacuucauccuuuuuuuucaagauuguguuagcuguuuuagguccauuguauuuccuuaugaaauuuaggaucaggccaggugcaguggcucacgcuuguagucccagcacuuugggaggccaaggcggguggaucuccugaggucagguauuugagaucagccuggccaacauggugaaaucccaucucuaccaaaaagacaaaaauuagcugggugugguagcgcacaccuguaaucucagcuccuggggaggcugaggcaggagaaucgcuugaaccuagagguugcagugagccgggauugugccacugcacuccagccugggugacagagcaaaacuuugucucaaauuuaaaaaagaagaagaagaagaagaagaagaaauuuaggaucaggcuaggcauggcggcucacgccuguaaucccagcacuuugggaggcugaggugggcagaucacgagaucaggaguuugagaccagccuggccaacauggugaaaucccaucucuacuaaaaauacaaaaauuagccaggugugguaguggccaccuguaaucccagcuacucggguggcugaggcaggauaaucgcuugaaccugagaggcggaggcugcagugagccgagguugugccacugcacuccagccugggcaacagagcaagacucugucucaaaaaaaaaaaaauuuaagaucaguuugucaauuucugcaaagaaaccaguuggaauauugauagggacuguguugaaucuguagauccguuuggggaauauugccauuuuaaaaauauuaagucuuucaguggguucagugucucaugccuguaaucccagggauuugggaggccaagguaggaggauugcuugaggccaggaguuugaggccaggaguuugaggccaggaguuugagaccauguuuggcaacauagcaagacuguauaucuaugaaaaaaugaauauaaguuagcugggcaugguggcacaugccuguaguugcagggagcuaugaucauaucacugcacuucaaccagggugacagagcaagacccuguuucaaaaaaaauaaacaaauaagccuuuauuuaaaaaaaauuuuuuuagaaacauugucuuccuuuguugcccacacuggagugcaguggcaugaucacaauucccugcaguuugaacucuugggcucaagcaauccucccaccucagcuuccugaguagcugggacuacaggcaugugccaccacaucugacuaauuuuuuucauuuuuuguagagacagggucucucccaggcuggucuugaauuccugguuucaagugauccucucacuuuggccucccaaaguguugggauuacagguguuagucaccaugccuggccccaaaauucaguauuuggauccacaaauguggauaucuuuccauuuauuuuggucaucuuuaauaucuuucaacacuauuuuggaguuuuaaaaguauaaauuucacacuucuuuaaauuuauuccuaaguauuuuauucuuuuugaugcuauuguaaauagcaaaucauuuugguuuuuuauugccacuuagauaaguacaguagauuuuguauauuggucuuguguccugcaacccugcugaacucauuaauuacuucuaauaauuucuaguggauguuuaaaaggauuuucuacauacagaucaugccaucugcaaauaaagauaguuuuacuuuuuacuuuccaaucaggauuucauuucauuuucuugccuaauugcccugacuagaaccucgaguacgauguugaauaaauguggugagagcagauacucuugucuuguuuuuuuauuuuaggagaaagcauccauacuuucauuauuuaguagguguuagguguggauuuuuguuuuuuccuuuggagacagagucuugcucugucgcccaagcuacagugaagaggugcgaucuuggcucacugcccccuccgccccuccagguucaagugauucuccugccucagccucccgaguagccgggauuacaggugccugccaccaugcccagcuaauuuuuguauuucuguuagagauggggauucgccauauuggccaggcuggucucgaacuccugaccucaagugauccaccugccucggccuuaggaucacuugauuacaaaguguuaggauuacaggugugagccaccgcacccagcccaaauguggauuuuuuuguauaugcucuuuauuagguugagaaagauuuucuuuuccuaguuuccuaguuuguuggcuguuuuuaucaugaaggggauuggauuuuaucaaaugcuuuuuuuccaccuauugagaugaucgugugggguuugaccuuuuuucaauugauaagguuuauuacacuaauugcuuuucugauguuaaagcaaauuugcauucuugaaauaaaucucacuuggucaugauauauaauccuuuuuuuauauugcaggaucaguuugcuaguauuuuguugaaaugacaccaucuguugucauuuccuuacccccaauacagcuuugcucauccaccuccuuugugcuauuaucaaauacguuaaauuuguaauguaauguacauuguucuauguauguaacaauacaauuguaugcauauuauuuuaaacaauugcuuuuuuaaucaauuaugacaggagagaaaauauucauuuauauugcucguuauaauuacauaauuaccuuuacccacgcucuguguuuuuucaugaggauucaaauuacuaacuggggcacuugcuuuuagccugacagacuucguuugguauuucuucuagcgugguucuucuaacaaugaauucucucauuuuuuguuuuucugggaugucuuuauuuugccuuauuuuuuugaaaaguaguaagauucuugguuggauguaagauucuugguugacagcuuauuuucuuuuagcgccaugaauaugucaucuacugccuuguggucucaauuauuucugaugaaaaauuagcuauuaauauuauucuaguucccuuguaugugaggaauuuuuuuuucuugcugcuuucaaauauuucuaugucuuuuucauuuucauuuuuuuuuuuuuuugagacagauacccugucgcccaggcugaagugcaguggcaugaucucagcucacugcaaccucugccucccagguucaagcgagucucaugccucagcccccuguguagcugggauuacaggcgugcaccaccacaccuggcuaauuuauguauuguuggucgagacaggguuucaccauguuggccaggcuggucucaaacuccuggccucaagugaucugcccgccucagcuucccaaagugcugggauuacaggcgugagccaccaugcccggccaugaugugucugguauggaucucuugguguuugcccuacuuggaguuuguugaacuacuuguuuguaucaauuaauguuuuucauaacauuuuggaaguuuucagccauuauuuuuugaauauuuuuuaugcucuuuucucuucucuuucucucucuuuccuuugaguuggagucuuacucuucacccaggcuagagugaaguggcaagaucauggcucauuguaaucucaaacugcugggcucaagcgaccccccaacuuuagucuccugaguagcugggacuguaggcaugcaucaccaugcccagcuaaguauuuuuauuuuuauuuuuagagacagggucucacuguguugcccaggcuggucucaaaguccuggccucaagcaauucuccugccucagccucccgaguugcugggauuacagguguaagccaccaugccuggcaucuucucuccuauuauucucauuaugcauauguuggugcauuuacuggugucucauuuuuuuuuuuggagacucucuucauuuuucuuucuuucuuuuuuucaucucuguucaucagacugcauaaucucuagccaccuauuuucaaguucacuagucuuuguucuaccuauucacguuuucuguugagccccucuaucaauuuuuuguuccaguauuuccauuagguucuucuuuuucuuuuauaauuucuauagcuuuauuaauauuuuuuauuugaagaaacauuguuauuauacauuccuuuacuuuuaaaauugugguuucaaucauccuauguuugcucauucuauauuuauauuagcuauuugaaguuuucuuuuuuaaaaucugacaucuauguccucuuacaggcaguugguuuaccuguuuuuuuccgccugaguauaguucacauuuuccuggccauuuuagauaauauauuguagcaacucuggauacaagcccucuaagcuuguuuuugagguuguuugcauguuuauuuguuuagcgacuugaauggacucuuuuagugaugucuguuuauccuguaauaugaagccucugaugucacuccucaguacaguuugggaaaugggcacaauuauuugcaaugacagugguuuuggaagggcucuguuugacugucucuuucccugauauuuuauuagguuaucuuccucuguugauaucacacccaaaucuuaggcuccacuaauugcuagcauauugcuauacuauuuuugacaaugcccugggacauaaauugucguauagucugaugguacuauaauuaaauaacugccagcuauaaagggcuuaaugauacauauauauauaauaauuauguauauauacaaaaauuacaauaauauggaaaaugagcaaccaaauugauguuuuaaaugucauuggguuugguauguuaugcuacuaugucauaugcugacagagaaguucugcaucagcguguggcccaagucauacccuuuagacguuugggacucucuagauggacuucugaccaccagugauuagguaagccuagcaauagagucacucugccaccugauggccacaaccuggaauuguaucugggagguaacagcugucuaaagacccaaaaagggaaaauuuggaaugaguacauuauuguucaucaugauguaaagcauuaaggacgaauaggaaaacugguuagauucauugcaaauucuuguuuaacuaaagcuguugagccauaugcgcaguuauauuagagcccugaggcugucuuuuaugaguuuuuuuuaagacaggaaugaugucuuugauuuaacgcuagaugaaauagcaauauuccuuuccuucuuuuaucuuaaauauauuuuuauuuugaaauaauuuuaaauuuauaaaaaauuacaaaacucaccaauuguuaacaauaugucacauuuacuguauuauucuuucaugcauguaauuuuuuucugaaacauuuuagaguaagaacauuauuuuuauuuuuuauuuuuuucuuuuucuuuuucuuuuuuuauuuuauuuuauuauuauuauacuuuaaguuuuaggguacaugugcacaaugugcagguuaguuacauauguauacaugugccaugcuggugugcugcacccauuaacucgucauuuagcauuagguauaucuccuaaagcuaucccuucccgcuccccccccaacaacaguccccagagugugauguuccccuuccuguguccauguguucucauuguucaauucccaccuaugagugagaauaugcgguguuugguauuuugaagaacauuauuuuuaacauaaaaaaaccagaguugacuucacuguguguguguguguguguguguguguguguguguguguguguuuugagacagaguuucgcucuguugccuaugcuggagugcaauggcgcgaucucggcucacugcaaucucugccuccuggguucaagcgauucuccugcuucagccucccgaguagcugggauuacaggcgccuaccaccacgcccggcuaauuuuuguauuuuuuauuuuuuaguagagacgggguuuuaccauguaggccaggcuggucucgaauuccugaccccagguaauccgcccaccucgccuuccaaagugcugggauuacaggcgugagccaccgcgccagccguguuuucuaaugggagucuuugguaucuuaccuugugcucuucucuguguccccugcccagccugcuucuuuuuuuacaaaaguacacgagggaugugugcugguaggaaagaaucagaaaugcaauuaaauauacaaaauaaaaaugaagccuggccaggagugguggcagcacuuugggaggccgagguggguggauuaccugaggucaggaguucugagaccagccucgccaacauggugaaaaccagugucuacuaaaaauacuaaaauuagcugggccugguagugggugccuguaaucccagccacucaggaggcugaggcaggacaaucgcuugagcccgggagguugcagugagcugagaucgugccacugcacuccagccugggcaacagagugagacugucucaaaaaaaaaaaaaaaaaaaaaaaagccuuaccaccucuuggcucuguuuuacuccuuagagguaacuaauguuaacagucuguugucuguccuuucagacuuuucucauaaguaauaauaagauaauaguuuauuauauacaaugguagaaugguuuguagucuaauaaguuucuuuacagugugauuuuaacuuuacaaaguauuauauauacuauucugcaacauaaguuuuuccacauaacauguggacacuuccaguaugcacauagaucuagcaugcuuuuuaauuggauauggaguauucugcuacaucuauguacuauaagucaauguauuuagccacuauuuuuuuuuuuugacagagucucacugugucacccaggcuggagugcaauggcgcagucucagcucacugcaaccuccgccucccaggcucaagcgauucuugugccucagccuccugaguagcugggauuacaugcgugcaccaccacacccagcuaauuuuuguauuuuuaguagagaugggguuuucccauguuggccgggcuggucucaaacuccuggccucaagugauccaccugccucggccuccuaaagugcugggauuacaggugugagccacugugcccagcccuagccacuguuguauuaauagaaauuuauguuauaguacuuguguuuccaagugagacacagcauugaagccaagugauagcuagugaaagcuucagaauacuuuugagacuuuucaaacuacauuuuaaaacacagucugucccucaaacggcuuuguaaaguugaugaaacuggucugauguagugauaccugauaguguuuaucuaggaagcuuauguuuggacuggaaaauaaugucuuuuaaaaaaacuauuauauuuuuuauuucauaguauuuuaaaaaccucagcuuuccccaaauaugauuucaauaauauuuugcuaaaaaauuaugaacucaaaauaaaaaaucagggucuacauuuggcauuauuuuuaaucaucauugacaugggaaugauuugugaggauuaaugaaauaauauaugucaaguaucuaguacaguaccuaguacauaguaaauauuuccuuauauucauucauucacaaauauuuauuaagccucuaccauaugcaaggcaauaaauaaaacuaggguuuuaggugaugaaagaggcauauauaaugucuccuugcaugcaguuuacauucuagaacaguuguugcaaaguaagagucuauaagaaaguuggaauaauugagcugguagcuuacuuucuuuagagucaauaauaaguuuaccacaauuuuauccauuuacucacuauuguuuuuugcacccuacuccuucuuuguggguguucuuuucucuuuacugaaguacauucauuaguaacuuuuucaguauuggcuugugggugauauuuuucuaaucuuugcauguuagaaaaagucuuuauuuuguacuuauucuuggaugauagguuauuuacccucaauacuuagaagauguuucuccauuaucuucugauaucuguugucuccuauaucuauugugggcugucagucuuauugucaguuuuugguagcuuuggguagguuacuucucuuuagucuguagcuuuuaagauuuuauauuuaucauugguuaucugaauuuccccaugcuuuauguauuuuuacuuaucccaguuuguagucauugaacaucuuaaaauucaugucuuucuucaauuuuagaaaauuguuggcauucacaccucaaauauugcuucuuugccauuaucucuauuuccuucuguuggaacuccuccuugacuuauguuaacaucccucuauuugacuuccauguuucuuaacuauuuuuucauguuuuuaaucucuguccacuacauucugagugaguuccuugcuacuaucauugaagccacugauucuaucuucaacuaugucuagucuagaauuaagacaagggcugggcgcgguggcacacaucuguaaucccagcacuuugggaggcugaggcggguggauugccugaggucaggaguuugagaccagcccggccaacauggugaaaccucauguuuacuaaaaauacaaaaauuagccaggcauggugauguguaccuguaaucccagcuacucaggaggcugaggcaggagaacggcuugaacccaggaggcagagguugcagugagccgagaucacgccacugcacuccagccugggugacagaguuagacucugucucgaaaaaaaaaaaaaaaucacagaaaggcgucauugaucaucuuagccaccuauagcauggaaguaagugauuugcuggauggugucugccuggaaguggauguacaccucacaucugcaguucaccccugugucugcccaccacugacaggggagaauaaaggguucuccucuucuaccuucugagucuuguauaaaugacucucacugucagaaucuaacuccgaacccuucuggcaaugacgucugggaaguauaguuuggggcuucagucccuacgagacaaagagcauuuacaaggagcaaaaauguugugucacuuaagaaugauccauuuauguaaacucuuuuccuugucacuaauccuccaguuuuuuuccuaagucucuaaccauuagccacuuuccuugaaugucuggccaucucuuauuccaggcaaaaugaaucucccaauauauuguuagaaauucugucuuccuaacaaucuuuagggcuacuccuaaguggacuuagaagcaucagcagucuuauuccagaaggugucagcauacugggugugaccaucuguaagccaggccugacuuucucccucaguccaccuggucaucaagaacucuucuagaagccacagauuuuuuuguuuguuuguuuuguuuuguuuuguauuaucguuuuaucuuuuuguagacacagggucuugcuauguugcccaggcuggccuugaacuccugggcucaagcaauucuccugccucaaccucagccucccaagcagcaggagggagaagaugaagaagucauaggcauggauugaaggagaguuggugcaguagcaggaauagaugccauggugggagucugugcucuuguaacuuacuugugccuuuugaaccugcuugaacccuuccccuugaagauggagugcuguucuaggcccaccuucuagugugguauucaugauggauugcuccgauugcagagucaccuaauggcauucugucucuacugagcccaguagcaagccagcagcuucuucucaacagaggaauauugucucagaacagagcauuaguuagcucuaaacucuuauggguccauucugugacucuccuauuaggacucgacagaggccccacacagcucaucugccacacauacuuugaguaccauuggaucugccaaguugcaaggcccacagggcagcagcuuuuacuacagcuugaacuggcugcaaagccuuccccugcucuacacccuacucauacuauacagccuuacgagugauucagucaaaguuuagaaguaauauuuucuaacaugguagaaguuuccucccaaauccaaggaggcccccaacuucgaaaggcaggggugguacugaagagugacagaccacauccagcacacuagcuaugcucuuuguauuggccucucgcugcacauacaguguuguacucaugaucguuggaaagacuuuauuucuuuggugguuacaucucuagccuuauuaagcaacaucccugugguuuaccuuaaaaaccauaaugaggccagcucuuggaauucauuugaaccucuguucaaaagaaugauggauagugcacuuucuuugaguggguuuugcauuucagaguguauaaggaagcuuuugcgcauuguuuuuaaacuuuaauaagaaucagcuuuguucuuugucuggacagaugugaugccagcauagcuagacuuucugcagagcacaaaacgaccuaugaggggcuccagcacuugaacaaagaacagcaggcugccaaacuuaucuuggaaacgaaaaucaaagaugcagagggacagguacgaccuguuucagguagcuuuuagaagcggguaauuuguucuuagcuaagaauaacaugguguugauuauuucuuacaggagaaaccagcuggggcaucuagcauggguuuaugccaaucauaagcaucuuuucuuugauucuuccuuuccuauuucacuagaguggcccuucaugugucuggcaaccaaaccaccaaaauuguuugguauaguccuaauucuacuccccaccaccacauuccuagaacaacuaauacauuccagaaauucuaaaugacaccuugaaagcuaucucuugcacaaguaagugaucaagcauccuuuacaugccacucgucccaauuuuugauucaggaaauaauguauucccugggacucauuguauguacuaccucaucacauagucuguaugugggacaaaauuaggcaaagcuagagcauaggcaggcuaaugaauaugagaguauuugaccucaaacgucacagauuaauuucacaaagcaaaacuuuuggcauuucaguuuguuuuuuggccacuuaaaaguuucccuuugccaucauagggcgugucuucuaggacuuuuucuacaauaucugccuuauuugcuauuguucguuuaaagagacuauuccaguaaaauaggagcaucugguuaacuuacuggauuaaauacauuuauaccuuaaucaucuccaauaagaauauaaagcuacuuaugugaaaaauacagauauuauaaaacuaugaaaaagaauaaaaagacaauccaauaauaauuucuuuuuugaagaaugagugagaauggaauuacuacaccagagaagagauguuaaggaaaucauaagcuucuuuauagccaggccaagucaaauauguacagauauccaucaaaagagacauucuuucucuuucuucuggaucugacaaauaccaugaaucuuuaaguaaggaacauggaacauucuaauuuuugcagaaaaggcagaaauuucacacaggacugguuuuuguuaaauugcaguaaagacaagggacauggguagguggugugagaaaggaacaggagggagauagucuacaaguuauauugacuggugaccugacuuguuauggagguaaaucugagaccuugauggauuuuguaaacaauaaaaauucuauuuucuaugacgagccguuaaacugaugguagaaauuccaagguaagguugacuaucaugacagcugguagaaguugcggucuuggguaggaauugggcuugcuccucagagaauuauguguaaaauuaagugcuuagugcaggaugaauauuuuggcagugcuacuggucuugauuuucgauggguauauaagaaagaaaauggagguggaaagaugagguagacuuauaaaugaauuuaucaaauuagauagaaucuuaaugccauugacuacaauauggcuuacuaaauguuuucugaaguugcaucugaagacguuagaugugauauuuauaagcaagauuucuuuuccagauuucucagcuuuugaacagaguggacuugucaauaucagagcagagcaccaaacugaagaugucucacagagacaguaaccaccagcuucagcuuuuggacacuaaguaagcaaucaauuuauuaaaaaaauaaaacuuaaaguucuuuaugaguuuaugcaauacuaugauuuuuuuccucuugguuuuuauuuauugcacaaauugaaaacaauaauggaaguuaaaaagaaaaguuuccuuguaucauguugccacuuuuccuucauaauuauuguuuuuuguguuuggauaauuauccaccuauucauucaacaaguguauauugaguauucauuggccuaggggcugaggaucuggguaaugaacacaaaccagacucuguucuuauccuuguggaguuuagucuggggagcugaugaccauuaaucaaugacauaaaugagcaucuacuauauuauugcuaauggugguaagugcguugaagguucgguucaugguuguguaggcugaauaaugguccucuaaacaucuucauguccuaaucccuggaaguugcgaauauauuaccuuauauggcaaaaggggacuuugcagaugugauuaaguuauggauuuuaaaauggguuuuaucugauaagccugaugugaucacuagaguccuuauaagagggaggcaauagggucacagucaagagagaaggccaugugacaauggaagcgagacugcagugaugcacuuugaggacggggcaaagaauuccaagccaaggaacacaugaggccacuagaaugagugagaggccugguuguggggccuuccugaggaagggauguuugaggugagagcugaagagugaauggggcuuugcucuguaaagaguaggaugagaauauaugagguugaauagccugucgugggaggaaugugacaugcaagaaacugaaagauggcgagggugacuggaacagggagugagggugaagcaguggggcaugaggcugcaggggaggugggccagcucgcaguugugauuuuuugugacagcaauagacacaaauagaaggagacagagugagaaggcccaaccuaugccuaaugagaaucuuaugagagauaauagagggaauagaggagaagcaguaucaaaagagagaauggcagacaagcauacagaauugaugaaagagaaaucucaaacuuagaaaaccaaauacauggugggugcaguggcucaugccuauaaucucagcacucugggaggccaaggcagauggaucaccugagggcaggaguuucagaccaaccuggcuaacauggugaaacccugucucuacuaaaaauacaaaaauuagccaggcaugguggcacaggccuguaaucccagcuacucgggagggugagacaugagcauugcuugaaccaaggaggcagagguugcagcagugagccgagaucacaccacugcacuccagccugggcaauagaauaggacucugucucaaaaaaaaaaaaaaagaaagccaacuacauuccaguagaauaaguaaaaagccaagucuagacacaucaguuuggugcucuaaaacuacagaacaccaaauaaauauagaaagaucuuaaagcagagagagaaauuagaccaaugcugauuucucagccauauuaagggugagaagguggucugguaccuucagauacugagagucugauugucagccaguggaaaaauaaagauguuucagacaaauaagaacucaaaguuagcuggauaugguugugcaugccuauagucccagcuacucaggaggcugaggcaagagaauugcuugaguccaggagguugaggcuguagugagcuaugauugagccacugcacuccagccuaagugacagaaugagacccugucucaaaaaaaaaaaaaaaaaaaaaaaaaaaaaagaacucaaaguguacuaauaaaacuacacuaauggaauuuuaaaaagacagccuucauggcuggauguggugguucgcgcccauaaucccagcacuuuggaagguugaggcgggcagaucaccugaggucaggaauucaagaccagccuggccaacauggugaaauccugucucuauuaaaaauacgaaaguagcuggaaaucaccugaacccaggagguggagguugcaaugagccgaaaucaugccacugcacuccagccugggcaacagagcgagacuccaucucaaaaaaagaaaacgaagaagaaacaaagaaaauaauacaaaaagaagguccaaaauauaagaagaaaggaugagcaaagaauaugaugaacauugggcaaaucuaaacaaacaguaauauuaaagucagauuugcagaggaucaaaacacaacuaaaauauaggucaaugacaacaucuaaaugaggaggaagauuucugaaauuauucuuaggaguuuuucaggaucaaauuagaaacauugaauaacuuuagacuuugauaaauuaaauguguguauuaaaauuuccauucuaaaagaauaaaauugguauaauuuccaaacauuagaagaaauccaaaggacacggguucacaucagauaugugaaaguguuagcaaggauguggggaacaggaccucuuuauagcgcugaguaaaaugugaaguaguacaaccacucuagaaaacagucugguguuuucuggaaaaguuggacguguucagacccuagagaaauucucccaaaugugaaccaggagcuauguaucaguauuuuuguaacagcauuauuauuuauuuuauuuauuuauuuugagauggagucuugcugugucgccaggcuggagcgcagugugcuugaucucggcucacugcaaccuccaccucccggguucagcgauucuccugccucagccucccgaguagcugggacuacaggcacgugccaccaugcccagcuaauuuuuguauuuuugguagagaugggguuucaccauguuagccaggauggucucaaucuccugaccucgugaucugcccaccucggccucccaaagugcugggauuacaggcguaagccacugcacccggcccauaacagcauuauuuuuaauagcaaagauggauaaaaacaaaccaaaacaaauguccaucaacagaagacuggauaagcugugguauauucauaaaauugaauauuauucaacaaugaaaaugaauucacuacagcuauacaaaucagcaugaaugaaucucacagacauauguugagugaaaaaugaguagaaaacucacacuuuaguacguuccauuuguauaaaauuuaaaaauaugcaaugcuggccaggcgagggggcuaacgccuguaaucccagcacugugggaggccaaggcaggcagaucacuugaguuugggagacuagccuggccaacauggugaaacccugucuguacaaaaauacaaaaauuagcugggcaugguggugcgcgccuguagucccagcuauucaagaggcugaggccggagaaucacuugaaccugagaggcagagguugcagugagccaaaaucacaccacuguacuccagccugggcgacagagcgaaacuccaucucaaaaaaaaaaaaaaaaaaaaaaaaaagcaaugcugaaaaauaugcuguuuuaagauccaaaccaauagaauaaaaugaugaagaacaauaaguuccaguuaaugguuacuucuuggguuguggggugaucgcaaaguacacuugggucuucuaagguccuggcaguguuccaugucuuaccuggcagggguucacgguuguguacuuaggguacaggcuagcuuccaugcuggcucucacauaacagugcggagaucagugguccagaggagacaggcagcagucgcaacucagugugguuuuuccaaggcuccaguccucgucccuucccagucaccugggacagggagagaguccagggcagaagcuuuguuuuuaaagauaggacuggaaaggcgugcuuaugacuuugaugcaucaugaggcuauaucucgcugcaagggauccugggaaauguggucucuggcuaggcagccauguacccaguuaacauuugagggcuucuuaauaaggaagaagaagagaacagauauugcaggacaagugguagcucuacuacaauggguguucauguuaucacuauuuaagucacaugucuacaucacauacauucuucuguauuuuauuacauauuauaauaaaaacuggaaagaaguaauuaagagggagguagcagguauggacaguuauaaggaauuugggaagggagaggaauggaaggaugggaggguuuuauuuuuuucuuucaauuuuucuuuugauuuacauuaggaaauauccauagaggacaagggcaauuuggggaacguuagagagaaagggagccagguucuagucccaagagauaaaagggacuaggaggaagagccuggggaagaaggggacccuagaagaggagaugagagacacuguguccucugagccaggaguaucguggacccucggaacugccggggucuguggcuggcccagcucugugucgcugugucaccucagugccugugccgcguacuccucguggguaggaagcacaaucagaugguuuaucuguuguauucucccgccuuaccagcuucccauguuagugcuaagugcaauucuaagaaaaggaaaauauguaauucugauugagccuaguuuaauguuggcauauauaccagaaauaugauaguuggaaauugauauuguaugaugucauuaaaaaaaauuguuagaaccagaaauaccauuugacccagcaaucccauuacugggcauauacccaaaggaauauacaucauucaguuacaaagauacaugcauacguauguucacugcagcaguguucacaauagcaaagauauggaaucaaccgaaauguccaucaaugauagacuagauaaagaaaauaugguacuuauauagcauggaauacugugcaaccauaaaaaggaaugagaucaugcccuuugcagggacauggauggaucuggaagccauuauccucagcaaaguaacacaggaacagaaaaccaaacaccacauguucuuacuuauaagugggagcugaacaaugagaacauguggacacagggaggggaccaacacauacuggggcuugggggcauggggggggcaagggagagcaucaggaaaaauagcuaauagaugcagggcuuaauaccuaggugauggguugacagaugcagcaaaccaccauggcacauguuuaccuguguaacaaaucuguauauccucaacauguacccuggaacuuaaaauaaaaaaaauaaaaaauaaacuguuuuacaucuaacuugcaauuuuuuuuuuuuagauuuaaagguacaguugaggaacucaguaaccagauauuaucugcacggaguugguugcaacaggaacaagaacggauagaaaaagagcuuuuacagaaaauugaucagcuuuccuugauuguuaaggaaaacaguguagguauugauguuuagcaaaaauuuaguaaaguuauucagugggggccuacacuguuugaauaauaauaccuaguaauuuaucacugauuuagcuguucaauuguuucuugccuuaaaauccauuuccauaguuccauauugaugcuuuguauucuucauaaagacauagaacacucugacuuguuuugguuaacaaagacuaaguagaaaauuucaguacuuucaguuaagaugaaguuaagcuaaaaccuuaaugauccaaauuguucaucuucguuucuacauaaaacuaagaaucaccaacuucauucuuguuuguuuuaauuucuugaucuggguuugcuuuuuugccugguguugaauagauuucugucuccagaucacaccauucuacuguagcuacaugugagauaccacagugcaacauguaaacagaauccaccauuuuuuuccccauuuuccuucuccuucaucccagucucucacagagcuaagguuuguagaacugcucaaaaacgauaucaagaaagucuugugccgggcacuguggcucacuccuguaaucccagcacuuugggaggcugaggcgggaggaucgcuugagcccaggaguucgagaccagccugggaaacauggugaaaccccaucucuacaaaaaacacaaaaauuagcugagcauggugacacacgcuuguagucccagcuacucaggaggcugagccugaauccaccuugagcccaggaaggucaaaacugcagugagguaugacugcacgcugcacuccagccugggcgacagagugagacucuaucucaaaaaaagaaaaaaaagucuugcauauguaguauucaaaauuguuaugcucccaaaccaguaccuggcaagcaaaguuucauugguuuucauuguuuagcaugacaucucugucucccuucccuuuucuuguacuguuuccucuuguuggauauugaugauugagcugaaaugacuggugcaguacaucucugacucugcucucuccagauguggagcuguugaauugcagacucugcauugagcaccaucaagagaggaguaucaugccauaacccacuuacagcuuggaguuugcagucuuggccuccaagcucacuggcagacacagauucccauaaaaaccaagcauguggaaaggcaaaaggaaaggaaagacuuaauuuucauauaugauuuuauauauauuuaaaauauuaaauauguucuuuuaaguauuuccccauauuuccaucacaucuacuaauuggcuuacuuggauuuauacuaauacauuuguacuaauaauucuuggucuuuggaucacuguuuauauauggauugguuuaauagcuaacaguaaaccccaggauaauaguggcuuucaugaaauagaaacuuauuuuuuauuucgcauaauggaagucuggguauagguaaugcaggacugguaugauagcuucucaguccucagugacccaggauccuuccaguuuaacuuuuugccaacccuagagugauccauaucuucauaauucaauauagcugcuagagcuccagccauucuggcugaauuccagaaagggaaggacgaaggaagaaguaaggagauacaucagcugucuuuuaacuuuuccuggaagcugccauauacacuuguacuuacaucucauugaauguagugguuuuuuuuuuuuuuuuuugagacagagucucacucuguuacccaggcuggaguggaauggcgagaucuuggcucacugcaaccucgccuccccuguucaagugauucuccugccucagccuccuauguagcugggauuacaggcacccaccaccauccaucccuggcuaauuuuuguauuuuuaauaaagacaggguuucaccauguuggccaggcuugucucgaacuccugaccucaagugaucugccugccucggccucccaaagugcuggaauuacaggcgugagccaccgcacccagccugaaaauguagucuuuguuuugaaugaccuuguacccagccgaaaaucauggaucuguuaaggaagaaagggagaacggauauuauggugggcaacaagcagcuguugcaaaucuguuucuugcagauuguuguuaaacgauauuauggcugaugugaaugcaaugcagauuucuuuuuggagugauuaagugcaguucuuaucauggaucucagggagccagugaaagggauauggagaagaagcucagccagaugucagccaggcuugacaaaauagaagagggucaaaagaagacuuuugauggucagagaacaaggcaagaagaggagaagaugcacgggcgaaucaccaagcuggaguuacagaugaaccagaacaucaaggaaaugaaagcagaaguuaaugcugguaggccaaaaccagaacagcucacgugcuuuauuuucuguuuguucuaaaaccuauuaauuaguauccccugcaacuaccuaugaaccuggcuaaugguaauaaccgugaaauauccuuaguugauuuucugaguagcugugcuguauuuucuaaguagcuacaaugcuguuugaauuucagcuauauaaagagccaccgugagagacaggcaaacagaacugaaauugcuuagccugcaacugagguacauuuucuucagcaccaucggccaauucuuuucuguucauagccaagguuaacaugucucagaaggaagcacauaucuuugaggggguuuugagggcuuauuuuauagugcuagcaguacaguaccacccuggcaaagaaugauuuuccucuacuggcaggucagcagggcgcauuaauucacacuugcuuagaggagaacauuagcacugauuucaaguucugagugcugucauauaugggagggauuagauuuacgcucugaacucaggaauacagaacugugaccacuaaguggaagguacccgaagacagauuuuaacucaauaugaggcagaaguaccuugaaguuaaugaguccuaaaagacugauggcuuucggagcuugagagcucuuuguuacagaaaauauucaaguagaggcugguugauuguggucaggaagaagacguuccuguagugugagaaguggaacuaaauucucuccuagcuucuuccaguuguaugauuccaugaauuuucuucuaugaaauuguucuguuuuggccacauggaaauaaaagugcuaguuaucccuagaauaauuuuguuauuaccaccaaauguuuauuauuuuauuuauaggagcuacaauuaaauauaugaauuggagaacuuguaaagauaaaaaugaauuuucuuucuuagucuuuggacuauuaaaauaugguauuugaauauuucaucaauguuuaaccucgcaucauucccugaaggaauguauuguuauuuaacauaccauugaggauguuaauauuuagcaccuaauaugaaaagcaucugagccuuuuaaaaaauaaagccauuuucuuuauuacaaagacaauauauuucuucuuucuuccuuuuuuuuuuuuguuuuggagacagaaucuugcucuguugccagccuggagugcaguggcgugaucuuggcucacugcaaccucugccuucaggguacaagcgauucuccugccucagccuccugaguagcugggauuacaggcgccugacaucacggccggcuaauuuuuuuuuuuuuuuuuuaauagaaacaagguuucaccauguuggccaggcuagucuugaacccccaaccucaaaugauccucccgccucggccugcugaagugcugggauuacaggcaagagccaccaggccuagccucaugaugccuuuuuaccccuuuauuauuuccauuuuuuuggaaauuaaaaaaaaugacagaaugagacagaggcucacucuguugccuaggccggggugaaguggugugaucguagcucacuacagccuccugggcucaggugagcccccugccucgaccuccugagcagcuaggacuaugggcaugugccaccaugcccagcucauuuuuuuauuuaaaaaauuuuuuuagagauggguccucaguauguugcccagacuggucuggaacuccuggccucaagcaguccucuugccuugaccugccaaagcucuggaauuacaggugugagccgcugccugguugcccuuuuauuauuucaguguauauauccuaagaacaaggauauucucuuauaaauaacuuuaauacaauguaucaucaaugaaauauuuuuuaauauucaauuuucaacgugccauuauuuccuuuauagcaacccuuuuccagucuagugucuuuuuuuuucuaauuacauguuuuuuaaauaaaaaaaauuguuguguauauuuaagguauacaacaagauguuuauauuuugauauauauauacauagugaaauaguuacuguauucaagcagguuaacauauguaucaucucacagguauuugugugugugugucuguguguguguguguguguguguguguguguguggcaagaacaccugaaaauguacucuuuuagcaaaaaucccaaauacaauacaauauuauugacugcaguccucaugcuauacauuagacaucuggucuuguucauucuccauaucagcaauuuguaucuuuugaccugcaucuccccauuuccuccucuuccgccccaccuuuggcaaccaccauuuuauucucuauguuuuugacuuucuuucuuuucuuuuuuuuuuuagacagagucuugcucugucgcccaggcuggagugcaguggugcagucucggcugacugcgaccuauucuucgcaaguucaagugauucucauaccucagccccgcggguagcugggauuguagaugugcaccaccaggcccagcuaauuuuuguauuuuuaguagagauggaguuucaugguguuggccaggcuggucucaaacuacugaccucaaguaauccacccgccucggccugccuuccucccucccucccucccuccuuuccuuccuuccuuccuuccucccuccuucucucuuucucucuuucuuuccuuucuuucucuuucuuuucuuucuuccuuucuuuccuuucccuucccuucccuucccuuccuuucccuuccccuccccuccccuucccuucuuccuuccuuuucuuuuuuuagauuccacauaugagaucgugcaguauuuuucuuucuguaucugucuuauuucacuuagcauaauguccuccauuuuuauccauuugugacaaauggcaggcucuccuuuuuuguaaagcugaauaauauucaucauuuguauauauacacaauuucuuuauucacuaauuuuuugauggacacacuucaguuguuuccauaucuuggcuauuguaaauaauggugcagugaacaggggagugcagauaucuuuaugaggcaguaauuuaauuucuuuugggaauauacccaguagugagauugcugggucguaugguaguucuauuuuaaauuucuuuaguaaccucuauaccaagcuuguccaacccacaucccgcaggccacaugcgacccaggauggcuuugaaugcagccuaacccaaauucguaaacuuucuuaaaacauuaugagauuuuuuugugauuuuuuuuuuuaaaucacucaucagcuaucauuaguguuaguguauuuguauugcccaagacaauucuuucaguguggcccaaggaagcugaaaguuuggauaccccugcccuauacuguuuuccacuauggcugccccauccugcauucccaccaacaguguacaaguguuccccuuucuucacacccucgcuaaugcuuguacucguuugucuuuuugauaauagccauccuaacaggugugaggugauaacucauugugguuuuaauuuguauuuuuccuauaauuagugauguuggcccuucagguucuaauccagaauuacacaucguauuuaguugucauguuucuuuauuuagucucuauuaaucuggaucaguuucucagugauguugaccuuuuuaaagaauaccagccagccagcauuuuguagacuaucccuaguuuagauuuguuugcuucauuuuuuuuuuuuuuuuuuugagacgagucuugcucugucgccgaggcuggagugcaguagcacaaucucagcucacugcaacguccgcuuccuggguucaagcaauucucccugccucagccucccgaguagcugggacuacaggugugcgccaccauacccagcuaauuuuuguauuuuuaguagagacaggguuucgccguguuggccaggcuggcucgaacuccugaccucaggugauccauccgccuuggccucccaaagugcugggauuacuggcaugagccaccguaccaggccuguuugcuucaucuugauauaauuuagguuguguauuuugguauucuuuaaaaaugucaagaagugauguugugcccugcucaggguaucuuuucagaaguuacgugauguuguuucucccaguaugggugacgugagauuugaucacuugguuaaagggguauaugacagucuucuccauuguaauaguuccuuuuuccuuuuuguaauuaaaaaguaaucucuagggagaaacuagaaacucaccuguuccccaucauacuuucaucccagagguuuuagcaucuauuaauaauuuuugccugaaucaaccauuacuagauacuauagaauuugauacagcauuuuaaaaaaauuguuaacuguugugaaauuuaccucuccuucaaggguuuacagccgucuaugaaagcauaggaucccucaggcaaguucucgaggccaagaugaagcuggacagggaccagcuacagaagcaaauccagcugaugcagaagccagagacccccaugugaagggagcugggacaagguccuaaaagacaguuuugccaguggggcuaggagccggauaccucuguagccaggccaucgcugcauucaggauuguuccauccauggcgugcaugugccaagaaauguguuuuuaugggucuaaauguuuaccuugagucuugaaaauacucuuuuguuaaaaguaugaaauacaguuuuuaccaguuuauuucacuucucuaaauucaauggaaaucccccgcccuggauuuugaaaggcuuuuaucuucuucauuuuacgaauggaaagacgacaauuuuucuucaaugcuugaugcacuaaugaagacuguuuacuauuuugaaaaaugucauggggauuuuuuuuuaauuaagaaacuaaugaaucaucacaggaauguguugcuccucacccuaaauuaagagaaugucccaguagauuagacuucaaccuuugaguccaauuuggauuuuauuaucguugucuaugcacuucuuauauugguuaucuucuuguaaaucuucugucuuuuguaaggggaaaggauuuaacauuuagaauaaaccccaccauuuauguaauggaaauaguuuaaaaauugcuaacugccauguggauugcaaauuaaauggaaacuuauuuagauaacguaaggcucaauaucugcguugaccaccuagauauuacagguuuuaauauuuaaaacuauuuuugaauuauccacaaccuguauagugauagccauauauuuaauaauggaauggugguuaacagucuauuuacugcacaauuaauuguucacuaaucaaauagaaugugguaauuuuucagacuuuaugaucuguuuccaaaauuggcacaaagugcuaggguuuauauacacuuaucguaacuguauuuuugugccuugguuuuaucaugucaaugcacuguacucuguaaaaguuuugcagacaaaauagaaaguaugauaauccgucagaaguaugauguaaaacuggaauccucuguauuuuuuaaauguucuaaaaauuuuaucgcuguuaagguauuaaucauucaguauuacuaauggaauagaaauucauacuuuuguauggacaacaauucaaauugauauugcauuuauagcacuguaagaaacuuucaucuugagcaacuuuguagaugauggguguuuuauuuucaaucgccauauuugaucagucauugaaaauuggccccagugcuguuuguucaucucuguauguaaaaacugacagugagacacaacguucugaacugugagggugucccaggaaaaagaaaaacaggaauacuuuaacaauuaaaaagaaaaaaauguuuuuuguuugccaaggacucaggaaaauaaaaagcauuuucuauuuuuaggacaaaucacaaaugaagugucuaacuggcuauuacuguuuacccauauaaaauaugcugcuaaaguacauauuuugcugucaauggcuugacaauuuuuuuuuucaaauuuggacaugagagguuauauagggacuauauuauccaacacauauuuucuuauuuugccacaaauuuccacuuaacaaauaaaaaaaggcgaaugcuguuuugcaaucagaaagugaauuucuuuugugguagcguacacgugguucaugugguucuccacguuuaagcacaaaccacagcacaggaagccacacccccuccagcaucucugucuuguggggucuuugaggagaaggaaucagaacaucgacaccugggaagagggaggcggggaacaccagcuggacucuggccaaggagugauguaagcaggugacacuuggcugucagcugagcuucucaggugcuucugacauugccagccccuugagaugagccaccgcaggugugcucaccuuggcuacauguugaaaucauccagaggaguugggaaaucuacugaugccccgcugugccucccagaccgauuaagucagaaccucugggaggugggucgcaggcaucagugcgugcccgaggccuccgcguguuugggugugcagccgagguggugagcugucgagccacagugcaguucucuucucaccaaagcucaaaugagaaucagcuuccauguucuuuccuuuaccagaaauuugcaauaaaaagaaaaauaaaauuuucacau

SEQ ID NO: 192063 - RNA, 19961 nt, Homo sapiens
uaccuuaagaaaaaccaaucgcuuuauuuuuccucaauauauguuuagaaaacuggucugagaagagguuucaugagauagaccagaggacuauguacaaaaucaagaguucuaaaccaauaagaaaaagggcacaaugaagcacacauccccaggggccacggcagccuaggaccuuccuaucaguggggaggcaaggucuuugacggcuuuugaguucagcugagggaucaugcugaucuucaggaguuugcugcuugcauacuuauucuugauggccugcagaagucauuugugauuaagcacaugucaggaacccccaaugauaccuuauuccuagucuaacucacaauuaucaaagguccacggcuacaaucaugaucacauugaugaugcccaaucgcugaagccagugaaagcucugggcucauaacaugugccugaccauuuccuuccauccccauuaaugaauaaaacacagcugguagcacaggugauaggaacaaaugauuucaagguccaaguagcaggcuuccucuuguaggcuaccagagggaugggagggggagcuguguuuacgacaccuaagugccaucaggacauaacagguucaccaggccuggcagcaauaggaacaauuaaaagacaauaaaagacaauaaaagaggguggcaacuagugcuuaacaaaucccagacaguccucucaggacugaacacauauuacacuuccaugaagcaaaucauguugugaggacacuugagacucuucugagguucaaauaccuugcucuuugccaccacacacuuggugagcucugauguuuggugucacacaagcacaggacagcacuaagucuccuuuggcuccuccucauaggugggccaugcagagauagacaccaugcccucaggaugcccccugaaugggccucuucccucuuaaccaugcuugcuaauuaggcguuuuuccaucauugccucaaaagacccuggacaaaggcucugaguaacaucaccugaauacgcaauauaauacaccgccauuugaagugggcccucucucuucccaaucacaugcagaccagccuucccugcuugcaaagugcccuccccaggaugcuaguauaagcacagaguaauucaauacauugaguaaccgacugguugacugggaucugggccuggacauggcuagccuaucgaccuuguuucaaauaaagcuugcuuucaggguuuaucaguaugcuccauaccauacuguaccagaaaaauauaaaggauaaaggauuugugcuaaaacucccacauguuauuaauauauuuacaugacggcacacaccgcccccccccgcccaacauacacacaaaacccagaaccuaaagcuuuccacagcuuaagaaaacaguaguacuuacgaugaauuuaguuaaguuuucauuuacuuucaccacauucuuggccaugugcugcaugacuuccaauacuucauucucuguguauccuguguaauacugcugcuuuaaguucugaaacacaagaagcagacagacagacaugacugaggggcaagagaaaaccucugcuucuuuagaagaacacaucuuguacaugaugacauuacuuauguaaaagcuguacaagaauauucuuaccuucuggaaauucaaucaaagcccuaaccacucucacaguaccagcaacacuaaagcagcugguaaaugcaagaugauucuggcccugagaccagacuaaaucaagugccaaaggucccauacgaucuuucaaagacguugcacagguaagaguccuucaaguaacaacacugaaaggggauggaaaaggagacacuuaaaacaaagugccccuuuacagugcuggccacaucucacacaacccugcaucaaagcccugcccagcugucccuguuaugagcucaagagcccaaacagacauacugucagucagggaaagauguucggaaauaagaaauaaacugugcuacaagcaacaaucuaucaaauccagaagaacuaggacuaccuaugauucucuuguugaacccuguguaguuaagcaccaaacagcagagagaacuuagacacuaccacaccaagccuugugaccuagccucccaaagaguaaaauucaaguaaaagaacagcugucaauugauaauaagauguaucauguaagaagauauauaaauuggcggggcacaguggcucacgccuauaaucccagcacuuucggaggccaaggcaagaagaucgcuugagcuuaagaguuucagaccagcuuggguaacauugggagacccuaucucuaugaaaaaugaaaaauuagccaagcuuggugguguacaccuauagucccaguuacuugaggagcugaggaggaaggauugcuugagcccagaaguuugagguaaugagcgauauuaacgccauugcacuccagccugggcaacacagugagacccugucucaaaaaaaaaagaaaaaaaaagaaaaaaaaaaaaggccaggcgcaguggcucacgccuguaaucccaacacuuugggaggccgaggugggcggaucaccugaggucaggaguucgagaccagccugaccaacauggugaaaccccaucucuacuaaaaauacauaaauuccccgggcaugguggugugcgccugaggcaggagaaucgcuggaacccgggaggcagaggcugcagugagcugagaucgcaccacugcacuccagucugggugacagagaaagacucugucucaaaaaaaaaaaaaaaaaaaaaaaaagauaugucaacugacuuuauuuaagaguucugugacaaaaauucuaaaagcgaaaguacguuuuuuucauaugcaugguauaauuggcaaaauaaaccacaauuuaaucucuuuuuuucuuugaagaccgggucucaacucuguugcccaggcuggagugcaguggcacuaucaaagcucacugcagccgugacauccugggcucaagugauccucccaccucaaccucccuaguagcugaaacuauagguguaugccaccaugccuggguaauuucuccuuuuuuuuuuuuuuuuuuuuuuuuuuuuuugagacagagucucauucugucgcccaggcuggagugcaguggugcaaugucugcucacugcaacgucuaccuuccggguuuaggcaauucucgugucucagccuccuggguagcugagacuacaggcaugugccaccacgcccagcuaauuuuuguauuuuuaauagagacagaguuuuaccauguuggcuaggcuggucucaaacuccuggccucaagugauccacccgccucagccucccaaagugcugggacuacaggcaugagccacugcgcccagccaguuucucuguuuuuuuguggaggcgagguuucgccauguugcccagcuggucucaaacugcugggcucaagcaaucugucugccucagccuccaaaacugcugaaacuacaggugugagccacugugcccagucuacacaauuuaauccuaaaauacuuugaagggaagaaagaggaaacgaguaaaaacugaaauaaugcacaauuucuagccuuuugaaauaaauucucagaaaacugggagagcgaagcacauuuaagaguaaggugacuaaaaaugagccauugguaccauguaccagugacauuuuugccucaaauguuuuauuuauuucaaaaaauuccaaaucuacagaaaaacugaaagaaugauccucuauauauccuucauguagacugaucaaucaugaacaugugccacguuucccuccucucccucucuguguauacucacacacaauuuuugcuaugccauuugaaagcgauuugcagauaucacagcacaucccugcuaaauguuucagaagcauauucuaaaaaguacguuuucguaccuauccauaacaccauucucacauaagaaacacugucaccagugacuuuuuuuuuuuaagcaucgaggcaguuccuuuuaaaaugucucacauucuggauuugcauauuuccucaagauuuaauucaugucaaacauuuugggcaugaauaggugauaauguauacaucuuacugcacaacacggcauggcaacucaggucgucugccagugguaaugcugagcuuaaucacugggugaagguggaaaccaccagaccacuucaucauagaugugcaguuuuguuacagaauuaauaaguaucuaugggaugauaaauugagaccacgugaaucuuguuucccaaaauuauuccaucuaaugauuuuugcauucauugaugcaccuugcuugaauaaauuauuacauuacagguugaaaauuagugguuucuaacucuaucauucuacuuuaauuagcugguauucugauuuuuaaaaaugaaccccucuuuuauuuuuuaugucauuauggucccaggaauccuuuuuuuuauacacuauaaucuauuacugucauuauucuuuuuaaugcucuaauucagucagccagaguccuuucaagccaguuccuaucucccuccuucccuuccuuccuauuuuauuguggugcaaucauaggucaaugcagccuccaacuccugggcucaagggauccugccucagccuccugaguaucugggacuauaggcacaugcuaccaugaccagcucuccuauguccuuuugaugugaccucauugaucuuugagaauuugugugcuaucuggcacaaauuguucuaggcucaccuuguacuuccccugccauagcccugaaaucagcaauuucacuaaacagcccuaguugccaguagauaaugguauuuaguauccaagaugugggcacuaaauaugcucacuacuacugaguugucacuguuucugagacccuuuauuaugaauuugcuguuauuuccaaaacauaauagggguuuuccuuuguuuuuguuuugcuauuuccuacgugaggacuaaccuuuuguuuuuaauuguuaauauuuucucucuuaggccaggcacaguggcucacgucuguaaucccagcacuuugggaggccaaggcgagaagaucacuugagccuaggaguucgagaccagccugggcaacacagggagagcuaaucucuacaaaaaaacuuuaaaauuagccaggcaugauggcguguggcugggucccaguuacgugggaggcugaagugggaggaucacuugagcccaggcaauugaggcugcagugagcugugacagcagcacugcacuccagccuggaugacaaagcaagacccuguauaagaaaaaauuaaugaauuaauaauuuaaaacucuuccuauauugaaaauuuuaguccuuaauaacaugaauaaauuuguuuuauccuacaauacacauaaacuaguuccaaaauuauaauaacagauuacuauuaacaaugaaccuacuaaguaaacuugauguuaccacuuuaguccuuuauuuugucauacuuuaaaucccacuaaggaugcacagucagaaugcuguguucagguuacagauuuguuuuuuuuuuuuuuuuuggagacaggguuuugcucuguugcccagguuggagugcacuggcaggaucauagcuacuucagccuugaacuccugggcucaagcaauccuccugccucagccuccugaguaacuaggacuacaggugugugccaccauacccagcuaauuuuuuaauuuuuuauagagaugggggucuugcuacgcuacccaggcugggcucaagcaacaaguacuuaaauuaauucuuuccucuguguucuguuaccaauuucacauguaguuacauuguuuauuuccacuuaauuacaauuuaaaguuugcauaaaauauuuacauuguucaaaagucaaaaaaguuacacuguauuauaaagucaauaaaagguuacaaucagaaguccucucauccucaaccuccacccuauucccaaagaaccccauaguuuccacuuucauucuuucugguuuauuccucccguaccaaaaaauuaacaaauauauaaauauauauacauacacacacuuucuugcauaaaauguaaacuacaauauacauuguuuaggugaacagcuccaccaugcugcccuggugaccuugccuauauccauauaggccacacaggccaaggccugaaccacagcugaucuguccuggcaaaaugcuuugugauccuccugaaaaaggaggagauggcaggugugggcagagcugccgcccagccaucucccacucaccucccuaucuccccugggaggcugucacgagacaacuucuucuuuuuuauauuuuuuuuggagacagagucucgcccuguccgccaggcuggagugcaguagcacgaucuuggcucaaagcaacuuuugucuuccggguucaagugauucuuaugccuaggccuccagaguagccuggauuacaggcagcugccaccaugccuggcuaauuuuuguauuuuuaguagagacggggguuuugccauguuggccaggcuggucucaaacuccugaccucaggugaucuguccaccuuggcuucccaaagugcugggauuacuggcauggcacccggccaagacagcuucguauccccuagguucugaugagguuuucuauuguacugcucucaggguauaacugcagacuagaagacuguuuagcgguggucuagaacuggcuucuccacaacaguguaccugugacuugcauugcagccauccagcuccauuuguuuccacauuauccuuuuugccaugugaaacaaagacccgaggagcugccauccuuggcuacucuucuaaaucuacaaguggcucauucuauucuuacuggcuaaaucagucaggccuuggccuuccuuugucuugugugcuugacaacuugcuuguuucacuuaacguaauaucuaagaaaucauacaugucaguucuuaguggccuuccucauucuguacaacucuauacugcacacaugcaccuuaguauguauagucaacucacuucuaugugaacuguuccaagcagcuugcuugcuuucuuucccaagagacaagggucucucuguguuccccaggauagacuugaacuccugggccugggcucaaaugauccuccucccucagccucccaaguagcuagaacuacaagcacaagcccccaugccccucuccaaguaguuuuccuuuaggacuuuggacuuuaaacaauugcuucaggccaggcacuguggcucacaccugaaauccuagcacuuugggaggccaaggugggcagacugcuugagccgaguucaaggcuagccuagacaacauggcaaaacccugucucuacaaaaaaauuuacaaaaauuagcgaggcauggucaugcaugccuguagucccugcuacucgggaggcugagguaggaggauuacuugagccugggaagucaaggcugcagugggcugugauggcaccaccacacuccagccuacgugacagaaugagacccugucucaaaaacacaaaacaaaaccaacugcuucaaggauaguguuguaaaaaugcuaaggccuuuuguauuacgaaggacuaaaauauagccuaauuaguuucuucuuaaauccaccacucacccauuuuccuuguccuagaaccuucugagacaagcaggaagcagcugcugcuaccuuagaaggaugauaaugcaccauaucauagucgaugagagucagcuccaucaaauacuuggcuaaagugugcuguucaacaucaaccuaagaaagaacagcaagggauaguaagaaucacaaguguaauuacugucuugcaaaauucugcgugaaggccuaggaacuccaauucacuugacucacuuauccuucucaagaauuacucuauuccacacuauguuguaaacauagaucaugaggccuuuucucuuaagaacugaugaggaaagcauuaagacuuaccuaaaggaagcguccuauaaauaagcuuuccuuaaauuaggucaagguuucugggaugagacaccaagcaaaaauagucucuuacagagcuggaggcacuuaccuccccggcuuuugaugcucgccuuaagaaguguaguggcaagggucgacccaacucaaauuucaauucuuucaaaauuagaguuuccauuucucggauuugggaacugguauaagcauugucugugauguaaacaaagucuucaauauuuggagaaaacaucuccucauacuuggaagccaagagcagagcaguaaucccaacuaauugaagcuucuuccgggaaacuggcugaaccuaauggaaaauuaauguaacaaaagucacaccuaacaagaagagugaagcuuuaggugggagaaggggaaaggaaaccaaguccuggaaaagugcacauugucuuugcucauaagggcacaggagaccugacuguucuaccacugaucaugacagcuaucuguaauugagcacugugugcuaggcacagugcuaagauucuaacauauuaucucacccaauccucauaaaaauucuaggaaaggcauauuuuauuccucaauuacaaauagauguccugagaacagauucagacaccaugccaagaucauucaauugccaagaagggaagaauccaagccugaauaccaagcuccuagucacccuucccacaaccucaugcugacuugaguaucuguggcagcccuggccugacacacuaaacauggucugaauagaaaugaggccaaagaaaaaagugagaauuuaauggauggcucauuuccuuaauccuuaccaaaagcauacccauuauucagcuuagaaaaucuuucgcuaaugcuuuggagucaggcagacucucaggcuaggguaaagcguuucccuuaauugcuuuuuuuuuuuccucccaaacucuguacuuuucuugcuucaacucucauuauuaaaaaucuaccacggaugggcacaguggcucaugccuauaaucccaacacuuugggaggccgaggugggcagaucacuugagcuaaggaguucgagaccagccugagcaacauggcaaaaccccaucucuauaaaaaaaucaaaaacuuagcugggcgugguagcauaugccuauagucccagcuacuugggaagcugagguagaaggauugauugaacccaggaaauugaggcuacagugagcccagauugugucacugcacuccagcgugggcaacaacagaauaaaacccugucucaaaaaaauaaaaaauaaagaaaccuaccuaaaauacuguugugcuuuccugcccaaagaggaaugcaugcuaccugggauuuuguaguaucucagggucauuauuguaaaguaauuuuuauuacauuguuuggacagaauuugugccugaccuaaaccccuauccugaauguugacuuuaaauaaauaaaaccuuaucugcagggcuauuguuugguagauaacacacuggcaauuuauaucugcugucucuucuaacaggucaggggcugugcauuacccacucauaaauaugcugaagauuauguuugccucuuauuuucuuauauuacucuuuauuacacuacauucucaguccacuccacacacaaccccugcuccuuuaaaaaaaacaaauacugccaccuucuucuucuacagugauucaaugacauaguuggcuggaaauguggagguucuccagccaaacucaucguuuuucagaugaggaaacuuaacaccagagcaccaaacuauggaaauugugcaagcaggcccagaaaaccagcauccaaaggcacuacaggcuucagauggacuuucagcccaacugaugguauauuuccucugaugaaggauuguggcaaugcaauauuucccccaaguacuuuuuagcuggcuggccuuacagaaaugcccauuauugguccgcaucaucaaaggcuugacacacuuggauuacuucccuuuuuaguccccaaaguucuuuggcuucucacaauuugauuuuuggucuuuuuuucagaaguacccacuuuaguuuucuaucccccaagcauaaaugcaauguucaaugagccacuggcgugaagucccugaagccacaccuaccuguaaaaaucgauccauaaugccaacgcacauguacagagucuccugcagaagccuaaacuuggaguggacuuguaccagccaauccacuaggauggcacgcaugcguccauuuauaucucuuccaucuaagaaauguggguuuauggacugcaaaaccuguggguagaaucaaaaguuuaaaaagcugaccuuguuugcuucccagcugugugguaaauuccacauugcuuauacaaccaaaacacaaaggcccaccuaccuccagcugccugagauacugauagauauccuuaacguagucacugcagagcugaggguucucccaaucuucguuaucaauguccucgauuuugcagagcaaggcaucagaaaaagcuuggcagagauucucuuccuucauggagacauccucaggugugggagaaggacccuacaccaacaaauuuaggcacauguaggagcagccuuaaccauaaauacaugcagagccaacuggcuuaaauaucaauaucauacgcacaucugaaauauguuaaagacacaacaaauuucauaccaagaggugaauaauucaagauauaguaugugaaguucuucaagagacacuucucuguuuaaaacucucuaauuucacucaaacugaaaacuuaaguccucccaauggccuacagaccuuauauaaucuggcccuccccaguucccucgcugacccaucuccugcuucucucccuugacugcuucacucaagccagguucuucuuacccagaaugcucuugccccuauguccauauggguaauucccuuacuucaaguuuuacuuaaauguuacauucucaauggggucuauccuaacuccuauuuaaaauuaucaggccaugcacgguggcucacgccuguaauucuagcacuuugggaggccaaggcagguggauggcuugagccccggaguucaagaccagccuggccaauauggcaaaaccccaucucuacuuuaaaaauacaaaaacuagcugggcgugauggugcgccccuguagucccagcuacucaggaggcugaggcagagguugcaaugagccaagaucacgccacugcacuccagccugggcuggacggaacaagacuccgccucaaaaccaaccaaauaaacaaaaaacaaaauuaucaccugccuccaaucccuguccuccuacccuacccauaugucucaucucauaaaaccuauacuucuaaaauucuauaguuaauauguguauuauucuguuuuuucucauaaagccuauacuucuaaauucuauaguuuauauguguauuauucuguuuuuucucauaauaccuauacuucuaaaauucuauaguuuauauaguauguguauuauuuucugucuaccucugccagaauguaagcucuaaaagcuuacguuuauuuaauugguuuugcccacuaaggcaccucaaacaucuauauaaucccugauacguaguaggugcucaauaaauggaagaaacuugaccaccuggguucaaagauuacuggagcugaucauucuacuuuaguagcagccucuucugcaguauaauguuuucuucucuuuaacuaauuuauucuaaauugaaaaacuggcaacuaaaaaggagaaaagcauauugcagucuauaaauaaaauaggagaagggagcgaagacugagcaaguucacaacucaguauuucacuuuccuaugcugacuggguaauuauuuauaaaaauuaugcaaauuaaaaauuuauaaagcaguuaaaacaaguauuuauuaaugaaagauaaaaaaaucuuugcuuuuuuaaauguuuuuuuuuuugagauggagucucgcucugucgcccaggcuggagugcaguggcacgaccuuggcucacugcaagcuccgccucccggguucacgccauucuccugccucagcuucuggaguagcugggacuacaggcgccuuccaccacacucgccuaauuuuuuguauuuuuaguagagacgggguuucaccguguuagccaggauggucucgaucuccugaccuugugauccgcccaccucggccucccaaaguguugggauuacaggcuugagccacugcacccagccaaaucaaugcuuucaaaaaaaaaguacuucuccaaguaaaaccuaacaagaugcuaagcuauacaaauauauauuaagguaauaaaauauuuuuuaaaaagaggaggcggccaggccugguggcucacgccuauaaucccagcacuuugggaggccaagguggguggaucacgaggucagaaguuugaaaucagccuaaccaacauggugaaaccccaucucuacuaaaaauacaaaaauuagcugggccuguggugucacacaccuguaaucccagcuacucaggaggcugaggcaggagaaucguuugaaccugggaggcagagguugcagugagcggagaucacaccacugcacuccagccugggugacagagcgagacucugucucaaaaaaaaaaagacaauuuuaauuuacaguaaagcucaaugauuauaauuuccagucuucgaggaugcaucaauaacaacaauaacaaaacaaaaaaacaguuuaaaacauguccuccccucuuaaaucaaaggucuuaaacugaggaagaaccaggugagcaagaacuaugcaggcaugcaugccauuuauacaagaauuugagaacccaggccaagugcgguggcucacaccuguaaucccagcauuuuggaaggcugaggcagguggauugcuucagcucaggaguuugaggccagcuugggaaacauggcaaaaccucgccucuacaaaaaauacaaaaauuagccaggcaugguggcgcacacuuguugucccaacuacuuggaggcugaaaugggagaaucaccugagcccaggagaucaaaacugcagugacccaugauuaugccacuguacuccagccuagagacagagugagacucugucaaaaaaaaaaaaaaaaagaaagaaagaaagaaaagaauagaauagaauuugggaaccuggaaaccucaaggagcuagaacaaaugaguagagguacccaggguaccagagacgguaagaccuuaaggaagaugaacaggcaaaagcaaaccaaagaaaaucaaggcaauucugggaacugcaaauugauuugagaugucagcaggauagccugugagguaugagaagaugagcugaaaagcugaacaacagccgagcuucuagaagcuuagauuuuauccaaacguuaaggugaaaaacugaaggaguuuaucaagugacuagaaucagauuugcauuguaauaagcauaugcagcuucagcugaagguuaacuuuuucaaggauaagcauuaucacccaccccuggaagggcagucaauaacaaaaagucugguuuaaggagauagagguuaucaugugcuaucauaccacuuuagaauauuuuucuggcuccuauucagaagugcaacugaguuuagccauauccaaaagccaccaagggcuuggcgugguggcucacaucugugauccgggcacuuuggaagcccaaggugggaggauugcuugugcccaggaguuugaguccaaccugggcaacauagugagaucuucuccaucaaucaagcagucaacaacaaaagccacuaggauaagacaaagauucuugcccuggcccuuaauuuagaauuccuugaaagcauucauuuugaacuccaacauaauuuaauuauuguaagacccuuucuaagauccuacucaucuggucagguaaucuguucuagcuaugacuccucaguaccucucauaagcaugcaucucucuuugugacagauaaagccauacuucuacuccuauguccuccaacuugacugggagcuccucuagacagaaucgaugguuuauucaacuuguuuccccaguguccagcaaacaugggacuaguagaaagccuuccauguccuuucuaacuacuguguuuaccaaagccucauuaaucagcaaaaaacaccauuuucuccaaaaccugcaggauaauaagcuucuaugacuaccuguaaagggcuggaacucuuccgaggucucagccagggcacuuugugauucaguugugucaacugcuacagagaaagaaaccugcccuccaguuuugcaaaaaggauaguauaaauuugguuagaagacugggaacaucuccuaucauggacacauggcuuauguuaucaccuuuccaggaaaauugauagaaaccugugcacucaaguggcauuuccacaccuccagggauuggcucuaaagaacagugauaacccugcagauaaagcagaugacaaaguaaaagccagaaggcugaccagagacaggcaggcagagagacucaccugcuagaaggugggacucuaccuaaaucguggacuuagagauuccuucacuacuuucucagagggaaauguauuugaauuggaaauaauuccuguucauuaauuccucauaacuucuaaaucuagaacauguagcuauauguuucaacccuggaauugauuuuuauaugaacugagcuacggguccauaaugcuuuaucucaaacaguggccucaauuuugccaggaagcaagagaaaaaggagucagccaaggaguaaaggaaacacaaaaaggaugaaguuauggaggucacaggaggaaacuauuuuucccuuuguuucuuuaguaacauauuuauggucuuugcuuuuaaaaaaagaaaaaaaaaagccuucuuuucuucuucucuaacuugaacaguaauauguacccaugguaaaaguuugaaguuuuuuguuuuuguucuuguuuuguuguuguuguuuuuugagacagagucucgcugucgcccaggcuggagugcaguggcacaaucucggcucacugcaggcuccggcccccaggguucacgccauucuccugccucagccucccaaguagcugggacuacaggcgcccaccaccucgcccggcuaauuuuuuguauuuuuaguagagacgggguuuuacuguguuagccaggauggucucgaucuccugaccucgcgauccgcccgccucggccucccaaagugcugggauuacaggcgugagccacugcacccggccaaaguuugacguuuuaaggaagaaaaugaaagucaaucuuaaguccaacauaauauucaaaaauaacuaccaucaauauucugcauacaaauguacauuuuaaaagcaaaucugggguugcacuguuuauauauuguuauaaucugauuuuuccacuuaauguuacaagcauuuugaugccuuuaaauauucuacuaaaacaugauauuuauggcugcauaguauuuccuuaaauggauuuaacuaggguauuucucuacucuauaagagacacucaucauagcacuaucuaaaaguacuugauuaucccucugaucauuuucuuuggauaaaaaacaaagcuacuggguauggagaauaaccauuugaaauauacuaccgccaggcgcaguggcucacaccuguaaucccagcacuuugaggggcgggggcagguggaucaccugaggucaagaguuggagaccagccaggccaacauagugaaaaucagcugggcaugguagcaugcaccuguaaucccagcuacucgggaggcugagacaggagaaucgcuugaacccgggaggcggagguugcaguuagcagagaucgagccacugaacugcagccugggcgacagagcaagacuccguccccccccaaaaauauauacauauacugccaaaucgcccuccugcgaugugggaggaaccacauucaaaccauuacacauguaaaacacugcacaacugcuaagagaucaaggucugaaaaccagccuuuggguuuggcuuucaggaggucacuguuauagaaaccuucuagggaaggcuuuuuaaaugaagucccaucucaacuacuuuuucuaagcuuuaguucucauaaagagcaaagagcuuucaaccaucaucucugugaagaaagcugacaaaucuguuccuugccuucagauguugcugccacauuuccaacugcauuuccaggcagaugucccucgguuaccucaacaaaucggaagccaaacaggauaccuuuaccaaagcuaccgcccucuccugacuuuccuacuuuuuguucauuuauugcauaaaugguuuauuuaauauccaaguggguaaggauaccacuccugcagugcaagccauguguccaaaguauucuuuccuaaauacaagaugaaagacauucugagacauccuaacacauuugauguuguuucuucauacccacuauugauacugguguauggguaggcgcuuagggaagaucugggcuagcuccagacccucaucagcucuugcuuggauaagugcaauaccuccuaacuuaccucccuacauuguuuucaucauuucgguacuccucaaaacuuuguuuccucaagccuaaugggauaaaaauccaaauuccaaguccuucaaauccaacugcaaccuucuucccagccuuaucuucugguuccucacucaagccgccugacucaguuaagucuuucagacuccuuaacgaaaggacaugauuauagguccauauccgcuuugguaccuugaucuuuguugcuacuuuguucuccacaaacgugcccuuuccugucagcuaucaucuucucucuaccccuaaaaaucucacucauuccaugaauuuucugaaccauucuguccuuuauuuggguauuaagguaaucaacuuuauuauucagggucguaauauuuauuuuuuuuuuucagagacaaggucuugcuccgcuguccaggcuagagugcaguggcaccauuauagcacauugcagccuugaauuccuggccucaggcgauccuccugccucagccucucaaagugcugagauuacaggcauaagccaccaugcccagcuucaaggucauaauguuauuaaguuaaaagguguauauacucauuuccuacacuauugcuucaaagcagagcuccagcuaugaauguucguuagaagguacagcaaugauaaaggcacccuuguagucuggcuaaaaacaggcuaccucauuaaauacguuuguaaauucagaacuuccuaccuuuggagccaacuuuuccaucuguacugguuugacagaagcaguagguuucaguuguuuguugacauuuguuguuuugguggguugaacuggaacuuugguguucugagcuuucuauaaggaaaaagaaacaugaauagcgcaagacagccagcguugugggacucagcacuauacagaaucggccucuguauucacauucagucuucaucauuguuaccuuagcuacuugugcugcucugguuguaacucuauuuccaauuucuucuaaaacaguucgccuaauagucacaugacucuuaacuuuagaauuaacuccugugucaauauucuccaaaucacuggacaccugaaaaaaaaaaaaaaaaguaaugaaaccuugaaagaauuugaaauacuuugcuaauguuagauacucaaauuuagaauugcuuugggaaaggacaauacgucaagaucuauuugcaagauggaaaagguacauuucaggaagucuaaaaaugcuauuugugauuaauaacaucacucuaaauuaggcaaaucacccaucuacuuuauccguaauaaagauccucccacuaaccuugcaaagcuauucugaguauucaagugggccuguaagagaacuucaaagcuuauuaguauuuaaugauuauuucucauauaguacccauaucacuuguuagagaucccugcaaguuaaaggcauauauuuaaaaaccuuccuuuacagagcuugguaaaaaguaaauuaagaugaaaaauaauaaagcuauaauauuaauaguuaauaauaggucugguuguuuaaaaaccagauguuuaaaaccuaaacuagcuuugauucuuaugccauuucacaaauaagaaaugcuccuguaugcaugaucuuuuagaacuacagcuuuuuaaaaugagguugccauagaauggauuuucucuuauauuaaggacauuuagaauggaaguaguuuucuugaguaauauaguuuuagcucccaaacucagggaagguuggaauuguaugaaauaaaaauugucaguugaccuuaaccugcuuuagacauaaugugcuuggaaauaaaacuugcuaggaaaagcaacucauaccaaaaaaaguuuauuauagaagugauaaacauuucauuaaaaaagaaaaaagcaaaaaaccagcauguccuaucccugagaguucagggucccgacucuaauaaaacucccaacaagggguuugaguggaucuaccaggcagagagaggggccagggaaacucaagccuucccugaacagaaagguuuugacuauuaaauaacguuauagaauacauuauuauaaaaaauuacuugucaguuggacuuagauccacaaaaggauauuaauuaaaugcuaaauguauucaaucuauuaggauucucaaaagucacacuucaauuucuuccagcagcaacugccaaucugaaaaaguguuugaaaauguaaugcuuauggguagaagccugguaaugugacucaauuuaaauucaucuggauaggaaaauuggcagcuuuuaucuaaccuuauagccaagaugauggaacucaggugugucagggcccucuagcuuucggcaaaggaaaaaaguaggucccgguacaauucaagcccacaggaaaaauacccaaaacaccauaacacuuugaucucugcaaggaugaaauaaaugaauuuggacccuuuucucucagucugccacauugguccaaauuauauucaaaaaccucuguuacauuugaguaaagaaauuaauuuuuuaaggggacaaacccauuuauuagugaacguagcauggaagacuuagcgugccgaaauaaaugggaaacucauacaaaaagaaaugugaacaaucugaaaaacagccuggcaguugccugaugaaacacgccguacacuuuacugccuacagaacccuuccaguccuccucccagccgccaucacaggucccuuaguuggcaaggaguuguaagaaagggggagggaaaucccaggaacguggaaguagauaacucucuagcaaugaagagcacucggggaucgcucgcugaguacuaggccuagugcucugggggcucacuugacaggcgccaucucggaagcgcuuuccuacacuucucccaccccggggcagggagggguuaggggagggcggaauccagacggggaaaggcgggccggagaggaccggccgcagggccagggacgcgggcgaagcagugagcuccggagaagagaaaagcagccccgguugggacggagaagcucggagcagaugagagaagcgacaggggagcuguggggccgacggacucgccucugagagcgguccccgggcacacucaccgucgggcgucggagcagcgccaugagggacggggaaggcaagagugccagcccggcccagggagggacgcggacugaaaagggaggacacuagcguacgaggcgccguuaggacugcucuccgagcccgcagcgcuggggaucuucgacgcuguagccuuguuccaggauucaaauaccgcgucgcuugcgccccauugggcggccc

SEQ ID NO: 192064 - RNA, 19961 nt, Homo sapiens
gggccgcccaauggggcgcaagcgacgcgguauuugaauccuggaacaaggcuacagcgucgaagauccccagcgcugcgggcucggagagcaguccuaacggcgccucguacgcuaguguccucccuuuucaguccgcgucccucccugggccgggcuggcacucuugccuuccccgucccucauggcgcugcuccgacgcccgacggugagugugcccggggaccgcucucagaggcgaguccgucggccccacagcuccccugucgcuucucucaucugcuccgagcuucuccgucccaaccggggcugcuuuucucuucuccggagcucacugcuucgcccgcgucccuggcccugcggccgguccucuccggcccgccuuuccccgucuggauuccgcccuccccuaaccccucccugccccggggugggagaaguguaggaaagcgcuuccgagauggcgccugucaagugagcccccagagcacuaggccuaguacucagcgagcgauccccgagugcucuucauugcuagagaguuaucuacuuccacguuccugggauuucccucccccuuucuuacaacuccuugccaacuaagggaccugugauggcggcugggaggaggacuggaaggguucuguaggcaguaaaguguacggcguguuucaucaggcaacugccaggcuguuuuucagauuguucacauuucuuuuuguaugaguuucccauuuauuucggcacgcuaagucuuccaugcuacguucacuaauaaauggguuuguccccuuaaaaaauuaauuucuuuacucaaauguaacagagguuuuugaauauaauuuggaccaauguggcagacugagagaaaaggguccaaauucauuuauuucauccuugcagagaucaaaguguuaugguguuuuggguauuuuuccugugggcuugaauuguaccgggaccuacuuuuuuccuuugccgaaagcuagagggcccugacacaccugaguuccaucaucuuggcuauaagguuagauaaaagcugccaauuuuccuauccagaugaauuuaaauugagucacauuaccaggcuucuacccauaagcauuacauuuucaaacacuuuuucagauuggcaguugcugcuggaagaaauugaagugugacuuuugagaauccuaauagauugaauacauuuagcauuuaauuaauauccuuuuguggaucuaaguccaacugacaaguaauuuuuuauaauaauguauucuauaacguuauuuaauagucaaaaccuuucuguucagggaaggcuugaguuucccuggccccucucucugccugguagauccacucaaaccccuuguugggaguuuuauuagagucgggacccugaacucucagggauaggacaugcugguuuuuugcuuuuuucuuuuuuaaugaaauguuuaucacuucuauaauaaacuuuuuuugguaugaguugcuuuuccuagcaaguuuuauuuccaagcacauuaugucuaaagcagguuaaggucaacugacaauuuuuauuucauacaauuccaaccuucccugaguuugggagcuaaaacuauauuacucaagaaaacuacuuccauucuaaauguccuuaauauaagagaaaauccauucuauggcaaccucauuuuaaaaagcuguaguucuaaaagaucaugcauacaggagcauuucuuauuugugaaauggcauaagaaucaaagcuaguuuagguuuuaaacaucugguuuuuaaacaaccagaccuauuauuaacuauuaauauuauagcuuuauuauuuuucaucuuaauuuacuuuuuaccaagcucuguaaaggaagguuuuuaaauauaugccuuuaacuugcagggaucucuaacaagugauauggguacuauaugagaaauaaucauuaaauacuaauaagcuuugaaguucucuuacaggcccacuugaauacucagaauagcuuugcaagguuagugggaggaucuuuauuacggauaaaguagaugggugauuugccuaauuuagagugauguuauuaaucacaaauagcauuuuuagacuuccugaaauguaccuuuuccaucuugcaaauagaucuugacguauuguccuuucccaaagcaauucuaaauuugaguaucuaacauuagcaaaguauuucaaauucuuucaagguuucauuacuuuuuuuuuuuuuuuucagguguccagugauuuggagaauauugacacaggaguuaauucuaaaguuaagagucaugugacuauuaggcgaacuguuuuagaagaaauuggaaauagaguuacaaccagagcagcacaaguagcuaagguaacaaugaugaagacugaaugugaauacagaggccgauucuguauagugcugagucccacaacgcuggcugucuugcgcuauucauguuucuuuuuccuuauagaaagcucagaacaccaaaguuccaguucaacccaccaaaacaacaaaugucaacaaacaacugaaaccuacugcuucugucaaaccaguacagauggaaaaguuggcuccaaagguaggaaguucugaauuuacaaacguauuuaaugagguagccuguuuuuagccagacuacaagggugccuuuaucauugcuguaccuucuaacgaacauucauagcuggagcucugcuuugaagcaauaguguaggaaaugaguauauacaccuuuuaacuuaauaacauuaugaccuugaagcugggcaugguggcuuaugccuguaaucucagcacuuugagaggcugaggcaggaggaucgccugaggccaggaauucaaggcugcaaugugcuauaauggugccacugcacucuagccuggacagcggagcaagaccuugucucugaaaaaaaaaaauaaauauuacgacccugaauaauaaaguugauuaccuuaauacccaaauaaaggacagaaugguucagaaaauucauggaaugagugagauuuuuagggguagagagaagaugauagcugacaggaaagggcacguuuguggagaacaaaguagcaacaaagaucaagguaccaaagcggauauggaccuauaaucauguccuuucguuaaggagucugaaagacuuaacugagucaggcggcuugagugaggaaccagaagauaaggcugggaagaagguugcaguuggauuugaaggacuuggaauuuggauuuuuaucccauuaggcuugaggaaacaaaguuuugaggaguaccgaaaugaugaaaacaauguagggagguaaguuaggagguauugcacuuauccaagcaagagcugaugagggucuggagcuagcccagaucuucccuaagcgccuacccauacaccaguaucaauaguggguaugaagaaacaacaucaaauguguuaggaugucucagaaugucuuucaucuuguauuuaggaaagaauacuuuggacacauggcuugcacugcaggagugguauccuuacccacuuggauauuaaauaaaccauuuaugcaauaaaugaacaaaaaguaggaaagucaggagagggcgguagcuuugguaaagguauccuguuuggcuuccgauuuguugagguaaccgagggacaucugccuggaaaugcaguuggaaauguggcagcaacaucugaaggcaaggaacagauuugucagcuuucuucacagagaugaugguugaaagcucuuugcucuuuaugagaacuaaagcuuagaaaaaguaguugagaugggacuucauuuaaaaagccuucccuagaagguuucuauaacagugaccuccugaaagccaaacccaaaggcugguuuucagaccuugaucucuuagcaguugugcaguguuuuacauguguaaugguuugaaugugguuccucccacaucgcaggagggcgauuuggcaguauauguauauauuuuuggggggggacggagucuugcucugucgcccaggcugcaguucaguggcucgaucucugcuaacugcaaccuccgccucccggguucaagcgauucuccugucucagccucccgaguagcugggauuacaggugcaugcuaccaugcccagcugauuuucacuauguuggccuggcuggucuccaacucuugaccucaggugauccaccugcccccgccccucaaagugcugggauuacaggugugagccacugcgccuggcgguaguauauuucaaaugguuauucuccauacccaguagcuuuguuuuuuauccaaagaaaaugaucagagggauaaucaaguacuuuuagauagugcuaugaugagugucucuuauagaguagagaaauacccuaguuaaauccauuuaaggaaauacuaugcagccauaaauaucauguuuuaguagaauauuuaaaggcaucaaaaugcuuguaacauuaaguggaaaaaucagauuauaacaauauauaaacagugcaaccccagauuugcuuuuaaaauguacauuuguaugcagaauauugaugguaguuauuuuugaauauuauguuggacuuaagauugacuuucauuuucuuccuuaaaacgucaaacuuuggccgggugcaguggcucacgccuguaaucccagcacuuugggaggccgaggcgggcggaucgcgaggucaggagaucgagaccauccuggcuaacacaguaaaaccccgucucuacuaaaaauacaaaaaauuagccgggcgagguggugggcgccuguagucccagcuacuugggaggcugaggcaggagaauggcgugaacccugggggccggagccugcagugagccgagauugugccacugcacuccagccugggcgacagcgagacucugucucaaaaaacaacaacaacaaaacaagaacaaaaacaaaaaacuucaaacuuuuaccauggguacauauuacuguucaaguuagagaagaagaaaagaaggcuuuuuuuuuucuuuuuuuaaaagcaaagaccauaaauauguuacuaaagaaacaaagggaaaaauaguuuccuccugugaccuccauaacuucauccuuuuuguguuuccuuuacuccuuggcugacuccuuuuucucuugcuuccuggcaaaauugaggccacuguuugagauaaagcauuauggacccguagcucaguucauauaaaaaucaauuccaggguugaaacauauagcuacauguucuagauuuagaaguuaugaggaauuaaugaacaggaauuauuuccaauucaaauacauuucccucugagaaaguagugaaggaaucucuaaguccacgauuuagguagagucccaccuucuagcaggugagucucucugccugccugucucuggucagccuucuggcuuuuacuuugucaucugcuuuaucugcaggguuaucacuguucuuuagagccaaucccuggagguguggaaaugccacuugagugcacagguuucuaucaauuuuccuggaaaggugauaacauaagccauguguccaugauaggagauguucccagucuucuaaccaaauuuauacuauccuuuuugcaaaacuggagggcagguuucuuucucuguagcaguugacacaacugaaucacaaagugcccuggcugagaccucggaagaguuccagcccuuuacagguagucauagaagcuuauuauccugcagguuuuggagaaaaugguguuuuuugcugauuaaugaggcuuugguaaacacaguaguuagaaaggacauggaaggcuuucuacuagucccauguuugcuggacacuggggaaacaaguugaauaaaccaucgauucugucuagaggagcucccagucaaguuggaggacauaggaguagaaguauggcuuuaucugucacaaagagagaugcaugcuuaugagagguacugaggagucauagcuagaacagauuaccugaccagaugaguaggaucuuagaaagggucuuacaauaauuaaauuauguuggaguucaaaaugaaugcuuucaaggaauucuaaauuaagggccagggcaagaaucuuugucuuauccuaguggcuuuuguuguugacugcuugauugauggagaagaucucacuauguugcccagguuggacucaaacuccugggcacaagcaauccucccaccuugggcuuccaaagugcccggaucacagaugugagccaccacgccaagcccuugguggcuuuuggauauggcuaaacucaguugcacuucugaauaggagccagaaaaauauucuaaagugguaugauagcacaugauaaccucuaucuccuuaaaccagacuuuuuguuauugacugcccuuccaggggugggugauaaugcuuauccuugaaaaaguuaaccuucagcugaagcugcauaugcuuauuacaaugcaaaucugauucuagucacuugauaaacuccuucaguuuuucaccuuaacguuuggauaaaaucuaagcuucuagaagcucggcuguuguucagcuuuucagcucaucuucucauaccucacaggcuauccugcugacaucucaaaucaauuugcaguucccagaauugccuugauuuucuuugguuugcuuuugccuguucaucuuccuuaaggucuuaccgucucugguacccuggguaccucuacucauuuguucuagcuccuugagguuuccagguucccaaauucuauucuauucuuuucuuucuuucuuucuuuuuuuuuuuuuuuuugacagagucucacucugucucuaggcuggaguacaguggcauaaucaugggucacugcaguuuugaucuccugggcucaggugauucucccauuucagccuccaaguaguugggacaacaagugugcgccaccaugccuggcuaauuuuuguauuuuuuguagaggcgagguuuugccauguuucccaagcuggccucaaacuccugagcugaagcaauccaccugccucagccuuccaaaaugcugggauuacaggugugagccaccgcacuuggccuggguucucaaauucuuguauaaauggcaugcaugccugcauaguucuugcucaccugguucuuccucaguuuaagaccuuugauuuaagaggggaggacauguuuuaaacuguuuuuuuguuuuguuauuguuguuauugaugcauccucgaagacuggaaauuauaaucauugagcuuuacuguaaauuaaaauugucuuuuuuuuuuugagacagagucucgcucugucacccaggcuggagugcaguggugugaucuccgcucacugcaaccucugccucccagguucaaacgauucuccugccucagccuccugaguagcugggauuacaggugugugacaccacaggcccagcuaauuuuuguauuuuuaguagagaugggguuucaccauguugguuaggcugauuucaaacuucugaccucgugauccacccaccuuggccucccaaagugcugggauuauaggcgugagccaccaggccuggccgccuccucuuuuuaaaaaauauuuuauuaccuuaauauauauuuguauagcuuagcaucuuguuagguuuuacuuggagaaguacuuuuuuuuugaaagcauugauuuggcugggugcaguggcucaagccuguaaucccaacacuuugggaggccgaggugggcggaucacaaggucaggagaucgagaccauccuggcuaacacggugaaaccccgucucuacuaaaaauacaaaaaauuaggcgagugugguggaaggcgccuguagucccagcuacuccagaagcugaggcaggagaauggcgugaacccgggaggcggagcuugcagugagccaaggucgugccacugcacuccagccugggcgacagagcgagacuccaucucaaaaaaaaaaacauuuaaaaaagcaaagauuuuuuuaucuuucauuaauaaauacuuguuuuaacugcuuuauaaauuuuuaauuugcauaauuuuuauaaauaauuacccagucagcauaggaaagugaaauacugaguugugaacuugcucagucuucgcucccuucuccuauuuuauuuauagacugcaauaugcuuuucuccuuuuuaguugccaguuuuucaauuuagaauaaauuaguuaaagagaagaaaacauuauacugcagaagaggcugcuacuaaaguagaaugaucagcuccaguaaucuuugaacccagguggucaaguuucuuccauuuauugagcaccuacuacguaucagggauuauauagauguuugaggugccuuagugggcaaaaccaauuaaauaaacguaagcuuuuagagcuuacauucuggcagagguagacagaaaauaauacacauacuauauaaacuauagaauuuuagaaguauagguauuaugagaaaaaacagaauaauacacauauaaacuauagaauuuagaaguauaggcuuuaugagaaaaaacagaauaauacacauauuaacuauagaauuuuagaaguauagguuuuaugagaugagacauauggguaggguaggaggacagggauuggaggcaggugauaauuuuguuuuuuguuuauuugguugguuuugaggcggagucuuguuccguccagcccaggcuggagugcaguggcgugaucuuggcucauugcaaccucugccucagccuccugaguagcugggacuacaggggcgcaccaucacgcccagcuaguuuuuguauuuuuaaaguagagaugggguuuugccauauuggccaggcuggucuugaacuccggggcucaagccauccaccugccuuggccucccaaagugcuagaauuacaggcgugagccaccgugcauggccugauaauuuuaaauaggaguuaggauagaccccauugagaauguaacauuuaaguaaaacuugaaguaagggaauuacccauauggacauaggggcaagagcauucuggguaagaagaaccuggcuugagugaagcagucaagggagagaagcaggagaugggucagcgagggaacuggggagggccagauuauauaaggucuguaggccauugggaggacuuaaguuuucaguuugagugaaauuagagaguuuuaaacagagaagugucucuugaagaacuucacauacuauaucuugaauuauucaccucuugguaugaaauuuguugugucuuuaacauauuucagaugugcguaugauauugauauuuaagccaguuggcucugcauguauuuaugguuaaggcugcuccuacaugugccuaaauuuguugguguaggguccuucucccacaccugaggaugucuccaugaaggaagagaaucucugccaagcuuuuucugaugccuugcucugcaaaaucgaggacauugauaacgaagauugggagaacccucagcucugcagugacuacguuaaggauaucuaucaguaucucaggcagcuggagguaggugggccuuuguguuuugguuguauaagcaauguggaauuuaccacacagcugggaagcaaacaaggucagcuuuuuaaacuuuugauucuacccacagguuuugcaguccauaaacccacauuucuuagauggaagagauauaaauggacgcaugcgugccauccuaguggauuggcugguacaaguccacuccaaguuuaggcuucugcaggagacucuguacaugugcguuggcauuauggaucgauuuuuacagguagguguggcuucagggacuucacgccaguggcucauugaacauugcauuuaugcuugggggauagaaaacuaaaguggguacuucugaaaaaaagaccaaaaaucaaauugugagaagccaaagaacuuuggggacuaaaaagggaaguaauccaagugugucaagccuuugaugaugcggaccaauaaugggcauuucuguaaggccagccagcuaaaaaguacuugggggaaauauugcauugccacaauccuucaucagaggaaauauaccaucaguugggcugaaaguccaucugaagccuguagugccuuuggaugcugguuuucugggccugcuugcacaauuuccauaguuuggugcucugguguuaaguuuccucaucugaaaaacgaugaguuuggcuggagaaccuccacauuuccagccaacuaugucauugaaucacuguagaagaagaagguggcaguauuuguuuuuuuuaaaggagcagggguuguguguggaguggacugagaauguaguguaauaaagaguaauauaagaaaauaagaggcaaacauaaucuucagcauauuuaugaguggguaaugcacagccccugaccuguuagaagagacagcagauauaaauugccaguguguuaucuaccaaacaauagcccugcagauaagguuuuauuuauuuaaagucaacauucaggauagggguuuaggucaggcacaaauucuguccaaacaauguaauaaaaauuacuuuacaauaaugacccugagauacuacaaaaucccagguagcaugcauuccucuuugggcaggaaagcacaacaguauuuuagguagguuucuuuauuuuuuauuuuuuugagacaggguuuuauucuguuguugcccacgcuggagugcagugacacaaucugggcucacuguagccucaauuuccuggguucaaucaauccuucuaccucagcuucccaaguagcugggacuauaggcauaugcuaccacgcccagcuaaguuuuugauuuuuuuauagagaugggguuuugccauguugcucaggcuggucucgaacuccuuagcucaagugaucugcccaccucggccucccaaaguguugggauuauaggcaugagccacugugcccauccgugguagauuuuuaauaaugagaguugaagcaagaaaaguacagaguuugggaggaaaaaaaaaaagcaauuaagggaaacgcuuuacccuagccugagagucugccugacuccaaagcauuagcgaaagauuuucuaagcugaauaauggguaugcuuuugguaaggauuaaggaaaugagccauccauuaaauucucacuuuuuucuuuggccucauuucuauucagaccauguuuagugugucaggccagggcugccacagauacucaagucagcaugagguugugggaagggugacuaggagcuugguauucaggcuuggauucuucccuucuuggcaauugaaugaucuuggcauggugucugaaucuguucucaggacaucuauuuguaauugaggaauaaaauaugccuuuccuagaauuuuuaugaggauugggugagauaauauguuagaaucuuagcacugugccuagcacacagugcucaauuacagauagcugucaugaucagugguagaacagucaggucuccugugcccuuaugagcaaagacaaugugcacuuuuccaggacuugguuuccuuuccccuucucccaccuaaagcuucacucuucuuguuaggugugacuuuuguuacauuaauuuuccauuagguucagccaguuucccggaagaagcuucaauuaguugggauuacugcucugcucuuggcuuccaaguaugaggagauguuuucuccaaauauugaagacuuuguuuacaucacagacaaugcuuauaccaguucccaaauccgagaaauggaaacucuaauuuugaaagaauugaaauuugaguugggucgacccuugccacuacacuucuuaaggcgagcaucaaaagccggggagguaagugccuccagcucuguaagagacuauuuuugcuuggugucucaucccagaaaccuugaccuaauuuaaggaaagcuuauuuauaggacgcuuccuuuagguaagucuuaaugcuuuccucaucaguucuuaagagaaaaggccucaugaucuauguuuacaacauaguguggaauagaguaauucuugagaaggauaagugagucaagugaauuggaguuccuaggccuucacgcagaauuuugcaagacaguaauuacacuugugauucuuacuaucccuugcuguucuuucuuagguugauguugaacagcacacuuuagccaaguauuugauggagcugacucucaucgacuaugauauggugcauuaucauccuucuaagguagcagcagcugcuuccugcuugucucagaagguucuaggacaaggaaaaugggugagugguggauuuaagaagaaacuaauuaggcuauauuuuaguccuucguaauacaaaaggccuuagcauuuuuacaacacuauccuugaagcaguugguuuuguuuuguguuuuugagacagggucucauucugucacguaggcuggagugugguggugccaucacagcccacugcagccuugacuucccaggcucaaguaauccuccuaccucagccucccgaguagcagggacuacaggcaugcaugaccaugccucgcuaauuuuuguaaauuuuuuuguagagacaggguuuugccauguugucuaggcuagccuugaacucggcucaagcagucugcccaccuuggccucccaaagugcuaggauuucaggugugagccacagugccuggccugaagcaauuguuuaaaguccaaaguccuaaaggaaaacuacuuggagaggggcaugggggcuugugcuuguaguucuagcuacuugggaggcugagggaggaggaucauuugagcccaggcccaggaguucaagucuauccuggggaacacagagagacccuugucucuugggaaagaaagcaagcaagcugcuuggaacaguucacauagaagugaguugacuauacauacuaaggugcaugugugcaguauagaguuguacagaaugaggaaggccacuaagaacugacauguaugauuucuuagauauuacguuaagugaaacaagcaaguugucaagcacacaagacaaaggaaggccaaggccugacugauuuagccaguaagaauagaaugagccacuuguagauuuagaagaguagccaaggauggcagcuccucgggucuuuguuucacauggcaaaaaggauaauguggaaacaaauggagcuggauggcugcaaugcaagucacagguacacuguuguggagaagccaguucuagaccaccgcuaaacagucuucuagucugcaguuauacccugagagcaguacaauagaaaaccucaucagaaccuaggggauacgaagcugucuuggccgggugccaugccaguaaucccagcacuuugggaagccaagguggacagaucaccugaggucaggaguuugagaccagccuggccaacauggcaaaacccccgucucuacuaaaaauacaaaaauuagccaggcaugguggcagcugccuguaauccaggcuacucuggaggccuaggcauaagaaucacuugaacccggaagacaaaaguugcuuugagccaagaucgugcuacugcacuccagccuggcggacagggcgagacucugucuccaaaaaaaauauaaaaaagaagaaguugucucgugacagccucccaggggagauagggaggugagugggagauggcugggcggcagcucugcccacaccugccaucuccuccuuuuucaggaggaucacaaagcauuuugccaggacagaucagcugugguucaggccuuggccuguguggccuauauggauauaggcaaggucaccagggcagcaugguggagcuguucaccuaaacaauguauauuguaguuuacauuuuaugcaagaaaguguguguauguauauauauuuauauauuuguuaauuuuuugguacgggaggaauaaaccagaaagaaugaaaguggaaacuaugggguucuuugggaauaggguggagguugaggaugagaggacuucugauuguaaccuuuuauugacuuuauaauacaguguaacuuuuuugacuuuugaacaauguaaauauuuuaugcaaacuuuaaauuguaauuaaguggaaauaaacaauguaacuacaugugaaauugguaacagaacacagaggaaagaauuaauuuaaguacuuguugcuugagcccagccuggguagcguagcaagacccccaucucuauaaaaaauuaaaaaauuagcuggguaugguggcacacaccuguaguccuaguuacucaggaggcugaggcaggaggauugcuugagcccaggaguucaaggcugaaguagcuaugauccugccagugcacuccaaccugggcaacagagcaaaacccugucuccaaaaaaaaaaaaaaaaacaaaucuguaaccugaacacagcauucugacugugcauccuuagugggauuuaaaguaugacaaaauaaaggacuaaagugguaacaucaaguuuacuuaguagguucauuguuaauaguaaucuguuauuauaauuuuggaacuaguuuauguguauuguaggauaaaacaaauuuauucauguuauuaaggacuaaaauuuucaauauaggaagaguuuuaaauuauuaauucauuaauuuuuucuuauacagggucuugcuuugucauccaggcuggagugcagugcugcugucacagcucacugcagccucaauugccugggcucaagugauccucccacuucagccucccacguaacugggacccagccacacgccaucaugccuggcuaauuuuaaaguuuuuuuguagagauuagcucucccuguguugcccaggcuggucucgaacuccuaggcucaagugaucuucucgccuuggccucccaaagugcugggauuacagacgugagccacugugccuggccuaagagagaaaauauuaacaauuaaaaacaaaagguuaguccucacguaggaaauagcaaaacaaaaacaaaggaaaaccccuauuauguuuuggaaauaacagcaaauucauaauaaagggucucagaaacagugacaacucaguaguagugagcauauuuagugcccacaucuuggauacuaaauaccauuaucuacuggcaacuagggcuguuuagugaaauugcugauuucagggcuauggcaggggaaguacaaggugagccuagaacaauuugugccagauagcacacaaauucucaaagaucaaugaggucacaucaaaaggacauaggagagcuggucaugguagcaugugccuauagucccagauacucaggaggcugaggcaggaucccuugagcccaggaguuggaggcugcauugaccuaugauugcaccacaauaaaauaggaaggaagggaaggagggagauaggaacuggcuugaaaggacucuggcugacugaauuagagcauuaaaaagaauaaugacaguaauagauuauaguguauaaaaaaaaggauuccugggaccauaaugacauaaaaaauaaaagagggguucauuuuuaaaaaucagaauaccagcuaauuaaaguagaaugauagaguuagaaaccacuaauuuucaaccuguaauguaauaauuuauucaagcaaggugcaucaaugaaugcaaaaaucauuagauggaauaauuuugggaaacaagauucacguggucucaauuuaucaucccauagauacuuauuaauucuguaacaaaacugcacaucuaugaugaaguggucuggugguuuccaccuucacccagugauuaagcucagcauuaccacuggcagacgaccugaguugccaugccguguugugcaguaagauguauacauuaucaccuauucaugcccaaaauguuugacaugaauuaaaucuugaggaaauaugcaaauccagaaugugagacauuuuaaaaggaacugccucgaugcuuaaaaaaaaaaagucacuggugacaguguuucuuaugugagaaugguguuauggauagguacgaaaacguacuuuuuagaauaugcuucugaaacauuuagcagggaugugcugugauaucugcaaaucgcuuucaaauggcauagcaaaaauugugugugaguauacacagagagggagaggagggaaacguggcacauguucaugauugaucagucuacaugaaggauauauagaggaucauucuuucaguuuuucuguagauuuggaauuuuuugaaauaaauaaaacauuugaggcaaaaaugucacugguacaugguaccaauggcucauuuuuagucaccuuacucuuaaaugugcuucgcucucccaguuuucugagaauuuauuucaaaaggcuagaaauugugcauuauuucaguuuuuacucguuuccucuuucuucccuucaaaguauuuuaggauuaaauuguguagacugggcacaguggcucacaccuguaguuucagcaguuuuggaggcugaggcagacagauugcuugagcccagcaguuugagaccagcugggcaacauggcgaaaccucgccuccacaaaaaaacagagaaacuggcugggcgcaguggcucaugccuguagucccagcacuuugggaggcugaggcggguggaucacuugaggccaggaguuugagaccagccuagccaacaugguaaaacucugucucuauuaaaaauacaaaaauuagcugggcgugguggcacaugccuguagucucagcuacccaggaggcugagacacgagaauugccuaaacccggaagguagacguugcagugagcagacauugcaccacugcacuccagccugggcgacagaaugagacucugucucaaaaaaaaaaaaaaaaaaaaaaaaaaaaaaggagaaauuacccaggcaugguggcauacaccuauaguuucagcuacuagggagguugaggugggaggaucacuugagcccaggaugucacggcugcagugagcuuugauagugccacugcacuccagccugggcaacagaguugagacccggucuucaaagaaaaaaagagauuaaauugugguuuauuuugccaauuauaccaugcauaugaaaaaaacguacuuucgcuuuuagaauuuuugucacagaacucuuaaauaaagucaguugacauaucuuuuuuuuuuuuuuuuuuuuuuuuugagacagagucuuucucugucacccagacuggagugcaguggugcgaucucagcucacugcagccucugccucccggguuccagcgauucuccugccucaggcgcacaccaccaugcccggggaauuuauguauuuuuaguagagaugggguuucaccauguuggucaggcuggucucgaacuccugaccucaggugauccgcccaccucggccucccaaaguguugggauuacaggcgugagccacugcgccuggccuuuuuuuuuuuucuuuuuuuuucuuuuuuuuuugagacagggucucacuguguugcccaggcuggagugcaauggcguuaauaucgcucauuaccucaaacuucugggcucaagcaauccuuccuccucagcuccucaaguaacugggacuauagguguacaccaccaagcuuggcuaauuuuucauuuuucauagagauagggucucccaauguuacccaagcuggucugaaacucuuaagcucaagcgaucuucuugccuuggccuccgaaagugcugggauuauaggcgugagccacugugccccgccaauuuauauaucuucuuacaugauacaucuuauuaucaauugacagcuguucuuuuacuugaauuuuacucuuugggaggcuaggucacaaggcuuggugugguagugucuaaguucucucugcuguuuggugcuuaacuacacaggguucaacaagagaaucauagguaguccuaguucuucuggauuugauagauuguugcuuguagcacaguuuauuucuuauuuccgaacaucuuucccugacugacaguaugucuguuugggcucuugagcucauaacagggacagcugggcagggcuuugaugcaggguugugugagauguggccagcacuguaaaggggcacuuuguuuuaagugucuccuuuuccauccccuuucaguguuguuacuugaaggacucuuaccugugcaacgucuuugaaagaucguaugggaccuuuggcacuugauuuagucuggucucagggccagaaucaucuugcauuuaccagcugcuuuaguguugcugguacugugagagugguuagggcuuugauugaauuuccagaagguaagaauauucuuguacagcuuuuacauaaguaaugucaucauguacaagauguguucuucuaaagaagcagagguuuucucuugccccucagucaugucugucugucugcuucuuguguuucagaacuuaaagcagcaguauuacacaggauacacagagaaugaaguauuggaagucaugcagcacauggccaagaauguggugaaaguaaaugaaaacuuaacuaaauucaucguaaguacuacuguuuucuuaagcuguggaaagcuuuagguucuggguuuuguguguauguugggcgggggggggcggugugugccgucauguaaauauauuaauaacaugugggaguuuuagcacaaauccuuuauccuuuauauuuuucugguacaguaugguauggagcauacugauaaacccugaaagcaagcuuuauuugaaacaaggucgauaggcuagccauguccaggcccagaucccagucaaccagucgguuacucaauguauugaauuacucugugcuuauacuagcauccuggggagggcacuuugcaagcagggaaggcuggucugcaugugauugggaagagagagggcccacuucaaauggcgguguauuauauugcguauucaggugauguuacucagagccuuuguccagggucuuuugaggcaaugauggaaaaacgccuaauuagcaagcaugguuaagagggaagaggcccauucagggggcauccugagggcauggugucuaucucugcauggcccaccuaugaggaggagccaaaggagacuuagugcuguccugugcuugugugacaccaaacaucagagcucaccaagugugugguggcaaagagcaagguauuugaaccucagaagagucucaaguguccucacaacaugauuugcuucauggaaguguaauauguguucaguccugagaggacugucugggauuuguuaagcacuaguugccacccucuuuuauugucuuuuauugucuuuuaauuguuccuauugcugccaggccuggugaaccuguuauguccugauggcacuuaggugucguaaacacagcucccccucccaucccucugguagccuacaagaggaagccugcuacuuggaccuugaaaucauuuguuccuaucaccugugcuaccagcuguguuuuauucauuaauggggauggaaggaaauggucaggcacauguuaugagcccagagcuuucacuggcuucagcgauugggcaucaucaaugugaucaugauuguagccguggaccuuugauaauugugaguuagacuaggaauaagguaucauuggggguuccugacaugugcuuaaucacaaaugacuucugcaggccaucaagaauaaguaugcaagcagcaaacuccugaagaucagcaugaucccucagcugaacucaaaagccgucaaagaccuugccuccccacugauaggaagguccuaggcugccguggccccuggggaugugugcuucauugugcccuuuuucuuauugguuuagaacucuugauuuuguacauaguccucuggucuaucucaugaaaccucuucucagaccaguuuucuaaacauauauugaggaaaaauaaagcgauugguuuuucuuaaggua

SEQ ID NO: 192065 - RNA, 109389 nt, Homo sapiens
gucgugcucuccucgguaggggaggaauugguuaggcggcggcggcggcgaagcggcggcggcggcuguaggggagcagcggcaguggcggcgacggcgaggagguguucgguuugcgcagcguagaaacgcccgcagcuucagagaaggaguucuugugggaccaaauuaggcauucugaacccacgccggcuuagcugggccgaguccaggcgcugccgcacguacaguuuugguggcggugacagacacuguucuugacucuaggggccuauuaggccgacgucugaggcgcagaucgcuggcucucgacgcauuacucuuuacgccuuacauuucugucuuccuuccugggucagugauucccggacccuggaagagaagaggguggcuaaugauuaaggugaggggaacggggggggaggggauccauuggaggccgcgcgugcgcgcaacgggggaggggccggccuggaggggagaaagaggaagggcugcggccgcggaaggcuggggucggugaccggccgguuaucucuggcucgguggugacuuagggucugggucuccgcagacgauuuguguuugggcaaggcauucgucuaccgacacacccacagccuacagugagggagugugggugaggggauuucucucccacuuccgacucucccuagagucucaggaugggggcugaggaccgaggcgugggagugcgauuugacaauggagugaugaagguaacccggacccggggaguuggagggcgcuaagucagcccugacggcuagggagucgccugcugcugcugugaucaaggaaacguaguccgcggaacagcugaaauacagacgcgucagauuuuguauggaguuggcuuguuggucauuuaaaaagaaacugauguuuuuacuauuguccuucgauaauuuaucagagucagugucagugcuauagugggaauaucuguucagugcagcagaaauagauuuguuacaacaguucuuaaauagguuauaguagauagaucuuuacagauggguauuucucaaccuaaguuuugauuauucaaaaaauaccagaaaguaugagguauucauuuaauuuguucguguguguguuguggggugacuccauuguguuguuguaagcuuuccuguuucuugauuuaugugcggcauuaauuuagaauucucuugaaugguaagaugccagcugacauagacuacguuuuguaggauuuccuguagcuuuugaaugugacuuaaucuaaacuuuauuucauuugguauuuuaucuauaauuuucuuguuuuaggggccucuugaacuaaaaagaacaaacugggaaaaacauaagcuaagguuccauuuccuuucccauuuuuguugugugugugugugaugguuguaaaugcuugaaugugauuuugagauuaccauacacaacuucuguaacgcuggacuuagcuuuauuacaguaaagauacaucuuuugauaguuuauuacuauauguauuuuuguaaaaaucuucaugucaguauaagccacauuguuucacccuagucugguuauauuugugaggugaaacagauggauaagaaggaagcccuuuuacuuuuacaaucauuuuaaauugauuguuucuaaagccuugauuuaucuuauuuuggacacuuucuugccauuuaaccuuggacaaaugacuuuaucaucucucuccugcucauuuguuugugaccaaagauucacaacaguauucuaagaauuggugaggguguuuauaaaucuaaauaauauuuuaggaaaaaguaggaagaaugagucuccuuguuuaucacgggugcuauaucaugugcagauccuucugucacuucuuaacuuuuguuuggugucuguuggccacuuguuugcuaguuauuucaccagacauagaacugguuuuuaaagaaagguauaaacaaagugacuucauuuuggugaaaaaugcauuacagcagagguuacaucuuaacgaauuucacuuugguacuccauuucuacagauuauugagagagagcuguugugauguuuaagagaaaagcaccuugcuuguauaaagcuaaggugcagucauuuagcagauacuccuaguuauuuuacuuuaaaauaaaaaauauaaaggaaacuaauugaaucaaaccauuuagauuuuuagauguuuccuucuuuuuuuuuuuguuauaguuuaaagagagguuucuguaucaugcuuuacuugaggcauacuuaugugcccuucuuuugacuuuuucuccccuuuugggccaagacuucaguaggaaauaaaagagaccaucugaaaaaugauagcaguuaaaauauguuauaacuugacauuaccguucuauggguaacguuaucuuaugaaauaauauagggcuaaggacaggagaucuagauuuuagaucuaucuuugcuugcuauacauuagaucuccgaguuuauuguuaacccuccuugggcuucaggucucucuguuuaaaugagaauuguagaauagauaacuuucguuuucuuuaggucccaaauuuaaugguuuguauaucuaguuagguuuuugguauucauuguuguguuugucguaauugaauccccagaaagaaaugcuguacaaaaagcaucaauucccucaugaaauguguauguguaaaaccugucaugaagcugugggccaggcgugguggcucaccccuguaaucccagcacuuugggaggccaaggcgggcgaaucacuugaggugaccagucuggccaaaauggugaaaccccaucucuacugaaaauacaaaaaauuagccgagcuuaguggugugcgccuguagucccagcugccugggaagcugaggcaggagaauggcuugaaccucggaggcggagguugcaguaagcggagaucgugccacucacugcacuccagcuugggcgacagagcgagacuguuucucaaaacaaacaaacaaaaaaacuaugauuguuguuccacauauuauugcuauuguugucccauuguagauauuaauuacugaagcuuuaauagcuuucagaugguacuaaaaaugaaauuuuuuauuacuccugguaacauuuuaaaaaucaucuggaauaauuuguuuuucuuucagaaaccuguaauuauuguucaguaaaaguccacaauuacauuugaaugucuuauaccucuguuuguuucuuuccuacauccuacagauucuugguaacagcuggcccagguuucuacagguacucaauuuauaucauuacaugaggagugaauuacaaauauuuaaagacaaauacuuagcugaggcugggugcgcuugcucauaccuguaaucccagcacuuugggaagccgaggcggguagaucaugaggucggguucgagagcagccaggccaacauggugaaaccccgucuguacuaaaaaaaaaauacaaaaauuagcugggcauggugguggcaugcgccuguaauccuggcugcucaagaggguaaggcagaauugcuugaacccgggagguggagguuccacugagcugagaucugcacuccagccugggugacagagcaagacuccaucuugaaaaaaaacaaaacaacaaaaaagccuccaaauacuuagcugagcuuacauuuuaaagagcgguacugcauuauuacguagauacauuuauugaaugucucauguucuaggcacagucacuggucuucagugaaggcacucugccuucauggagcugacauucuguucugugugugggaacauaauaaacagaaugguuucagguagugguaagugccaugaggaaaauaggaccaugugauacggcauggauggaagugguuuuacuguagauugagugguuagggagggccuuuuuagaggugguaauuugaccugugacuucaaugacuagaaaaaaucagccauagugacgauuuggaggaagacugcuacagauagcaggggcggcaaaugcauuaggugagguuugauucuagagaaucuacaaauguaaauuaauuauuugguuugucuguuaagcuuuucauauuugcugucagaugauguagacagauuaaaauuauuuuauguguaguaaccaaauacaauauguugguguuguuuaaacccugacucaaaccaauuguagaaagucauuuuugaaacauugggggaaaucugaauauggauggguauuagaugauaucaaggaguuauuguaacuuuguuagggaugauaauggcauuauguuuauguaagaaaaugaccacuuuuuauuagugauagagacugaggaaugagggagaaaacuugcaaaugucugguauuuuauuuuauuuuauuuuauuuugagauggaguuucccucguugcccaagcuggagugcaguggugugaucucagcucacugaagccuccaccucccggguucaagcaauucuucugcgucagucuccugaguagcugggauuacaggagcgcgccaccacgccugcuaacuuuuuguauuuuuaguagaaacgguuuuucaccauguuagccaggcuggucuugaacucgugaucucaggugauucgcccgucucggccucccaaagugcugggauuacagacgugggccaccgugcccagcaaugucuguuauuuuaaacagauaccagauaaaaaccaaaaaaugugguggagggagauaagauagaugaagcaggucuggcacaaucuggauaauuguuggguuggggugauggguacauggguauuaauaauauuguucucugcuuuugugagguuugaaaauuguucauauuuuaaaauauauuuuuuuggcugggcccaguggcucaugccuguaaucauagcaccuugggaggcugaggaagguggauugcuugagcccaggaguuugagacuaggcugggcaaugugacgaaauucuggcuguaccaaaaaaauacaaaaauuagacaggcauaauggcacaugccuguagucccagcuacucgggaggcugaggugagaggauggcuugagcccgggaggcagagguugcaaugagccgagauugugccacugcauuccagccucggugacaaagccagacccuaucucaaaauaaauaaguaaaugaaauaaaauaaaauaauauauuuuugaaaacguucauucauguuuaggcuggacaugguggugcacaccuguaguaauccuagcacuuugggaggcugaggcaggcggaucaccugaggucaggaguuugagaccagccugcccaacguggcaaaacccugucucuacuaaaaaauacaaaaaguagccgggcaugguggcgggugcuuguaaucccagcuacuugggagguugaggcaggagaaugacuugaacccaggaggcagagguugcagugagccaagauugcgccacugcccuucagucugggugacagagcaagauuccaucucaaaaaaaagaaaauguucaauuguaaauaaaaauguuuuaaaauaauuaguaaaaguggccagguauaguggcucacaccuguaaucccagaacuuugggaggccaaggcgaguggaucaccugacaucaggaguucgagaccagccuggccaacauggugaaaccuugucucuacuaaaaacacaaaaauaaaaaaaauauaacuguaaauacaaaaauuagcugggcgugguggugggugccuguaaucccagcugcuugggaggcugagacaggagaauugcuugaacccaggagguggagguugcagugagcugagauugcaccacugcacuccaaccugaguaacagagugagacuccaucucaaaauuugugaaaguaccauauuuaagugucuguucccuuccacgcuucuuuucauuuugauaaaaauacaguauuucguuucuauuuguaaauguucaguauuuauucaacaaacaggaguguuguauuucaggcacugugccagugcuugaguuaaaacaaagggcaggcucuuaacaccugccugaaggggcuuauggcuugcugguggaaaggagaguuuggcaguguggauuguguuaacauggagaagauuuuuguguuuuccugagggcauacacgauuagcaucuuaguuuaguuuguaugugauuggauucuuaaaaaauauuuuuccuuuucuaccaaauagaaaauuuaagaaauucuauauauggcuaggugucaagucugaaucaauguuguagucauuucccuuauucauauguacuauagggcacucgaauaaauuacuuauuuuacuaucuuuugacaucccaauuuguuguuacuuaaauuuuuuuuuuuuuuuuuuuuuuuuaauggagucucacucuguggcccaggcuggagugcaguggccccaucuuggcucauugucaccuccaccuuccagcuucaagugauuuuccugacucacccucccagguagcugggauuagaggugcacgcuaccacgcucagguuauuuuuuauauuuuugguagagaugggguuucgcuauguuggccaggcuggucucgaacuccugaccucaaguaauccucccgccuuggccucccaaagugcugggauuacaggcgugagccaccacgccuggcuacuuacauuuuuauuuugacauaauuucaaacuuaccgaaagauuuaaaaaauaguacugagaacucuugaauacucauuauucagauucaccaauuuuuaauguugucacucuugcuuucuuauuuucucucucuuuuuuuuuuuuuuuuuuuuuugagguggagucucgcuguguugcccaggcuggagugcagcagugugaucucggcucacuguaaccuccaucucccagguucaagcgauucuccuaccucagccuccugaguagcugagauuauaggugcccgccaccacguccagcuaauuuuuguauuuuaguuagagacgagguuucacccucuuggccaggcuggucucaaacccaugacuuuaagugaucagccuacuucagccucccaaagugcuggggugagccuuugcgccuggccccuuauucucucuugaaucauuuaaaaguaaauugcuuacauuaugcccauuacauugcauuaugcccauuuguuucuaaauauucacuguguauuguauucuuuugcguuaucacugcaccaguuacaaaauucagaaaauuaaacuuugauaauauuaaucuacagcucauuuuccaguuuugucgaauuguccugauaauagcauuuaucccuuuacagcauuuuccucauaggacccaguucaggaucacaaaaugcauuuaguugucauaucucuuuagucuccuguaauguggaacagugcaccuaauaagcaaucuguggggauaacuuugagauagugcagcuacucugcuccucaucagaucauccuguuccucaucacuccccacaucccccaaggcccauguagcauccauugauguuucuugccuaugcugaucuuuacugaucuuuacucuaaugguuggaaaguguuuauuuuguaacucauccauuuucuucacuaauggacauucuuuuauaaggaagagacauucuuuuaucugauuaauacagaauuguguguuuccuguuuuauucaguggguuaaauaacccauuauaaccuuuauuuugauguucaaauugucccagauuuguccauuaggagccuuuccaagugggcuccugugucuuuuuaacauaaccucuuguuuuuuuuuuuugacggagucucacucuugucucccaggcuggagugcaguggcgcgaucuuggcucacugcaaccucugccucccggguucaagcaauucucugccucagccucccaaauagcugggauuauaggcgccugccaccaugcccggcuaauuuuuguauuuuuaguagagacgggguuucaccaucuuggacaggcuggucuugaacuccugaccuugugaccucgugauccaccugccucagccucccaaagugcugggauuacaggcaugagaugccgugccccggccuuuuuuuuuuuuuuuuuuuuuuuuaaguauuuccugucuuucuggcacagcaagauguugcaagcacaucuuauuucuuuccuuugucagucuuggaaugagccguuuuccauggaacccugguuccuuuuagugagcaauccaauuugcuguuguguuauuuauauacaggaauaaucuuuuuuucaugcaucaggacaucgcuaggaaacuaaauuuaaauuagauuuuugauaguagguuuauauuucuuugaagauuuuaugaaguaaucacguaagacucagcaacuuauugucauaaagcaauuuuuuucuucuuuucuuuuucaaauacauaaugaguuauguucuuaauugugaucauaugaaaugagaaaaaauuguguguguauguuuagccacuuaacuguuuauuaaaaaccugaaguuuauacuuuuaacuauuuuuaacuaagucaucaaacauucuaaucugaagaaaacuguugcuuuuuaagaaacuuuaaaaugaguucaaaaaauugggcugggugcgguagcucauaccuauaaucccagcacuucgggaggccgaggcauauggaucccuugaggccaggaguucaagaucauccuggccaaccugaugaaacccugucucaacugaaaaaugcaaaaaaaaaaaaguagccaagugggguggugcaugccuguaaucccagcuacuuggguggcuggagcaggagaaucgcuugaaccugggagguggagguugcagugagccgagaucaugccacuguacuccagccugggcaguagagcaagacuccaucucaagaaaaaaaaaauuaaaaaauuaugaaacagaauuuuuguaugugauugaaaacucaucaguacuuucuuuuuuuuuuuuuuuuuuuuuuuuuuuuuacccaggcaguuacuguuacaucuugguauauuucauagccaguuucucaccuguguauggauauuugcuuuauuuacuuauucaaucuaacuuaauguguguuuuuucaaaguaauauuuugaauauuuuaaauuuucaaccaauuaauaucuguacacgguuuuaaaagucaguuucaaaagacuuacaaugaaaaacagugguuuccuaugcaacucuccuaaucuccuaguuguacugcuuaaacagaaacauuuuagcucucaaaaauuauuucuguagucuauaccuuuauauuuauaaguaguaugcuuauauuuguuuguauuuacuuguguacuuauauuucuacuaauaugcuuaauuuuuacuuaguuuucaugucaguuuaagugucuuuuuuuaaguuaauuuuuucagagaaaaguaauauauacaaaguguaccaaauuuauaagguacaaagaauguacagggaaaaaaaacaaggcuccuugccauucuuaucuuccuaugacccaagucuuuucucugaagauguaucucuuuccuccuguauuuuauaugugcauccagaguagugguucucagaguguggucuguugacucuugagguagcucuuccaaguguucaggaggucuaccagguugaaacuauuucagaauauuaccaaguucucauuuucuauguaacugaugugaacaccaguugacauuugcacugauggugcaaaaaacaguggugcauuaaacuaauggcccuguagcacaaaucaagacaguggccaaacugcauuaguaaucacuauguucuucaugacuacacauuugcaguuaaaaaaaaaaaaaaaaucagggcuggguauggugucucacgccuguaaucccagcacuuugggaggcugagguggccacaucacgaggucaagagaucgagaccauccugggcaacauggggaaacuccaucucuacuaaaaauacaaaauuagcagggcgugguggcauaugucuguaaucccagcuacucgggaggcugaggcaggaggauggcuugaacccgggaggcagagguugcagugagccaagauugcgccacugcacuccagccuggcgacagugugagacuccaucucaaaaaaaaaaacaaaaacccaaaaaauuuguaaauuuauuuugauucuugagcacauguguguauguguuuuuuuuguuuuucuuuuuguuuguuuuuuguuuuuuuugaagcugagucucacuccguugcccaggcuggagugcaguggggcgauccuggcucacuguaaucucugccucccagguugaaucaauucuccugccucaggcucccuaguagcugggauuacaggcccgugccaccacacccggcuaauuuuuguauuuuuaguagagacgugguuucacuauguuggugaggcuggucucgaucuccugaccucgugauccgccagccucggccucccaaagugcugggauuacaggcaugagccaccgugucuggccaagcacauguguuuuuaauauuccaugugacaaaaugggaaguuuuuuuuuuuuuuuaaguuuaaguucagggguauaaaugcagguuuguuacauagguaaacuugugucauagaguuuguuguacagauuauuucaccacccagguauuaagccuaguaccuguuaguuauuuuuccuuauccucucccuccucccacccuccacacucugaaagauuacagugaguguucuuccccucauuguguccguauguucuugggaagguuguuacagggucuuccauugcauaccaaaguaugaugcuuauuuugagaaaagaacuuguuugauuuaguuauaaaauggauuagcaaacuagucacuucuuucauggaacacauuuuuacuugaaagaagcaaacuguaguugugugaacuuggauauuuguacauauuuucucaaaaauaaaugaagugagccguucacuucaagaaaaacaaaugacagaauuuauugccaaaauaaaauucaaacuuucaagcaaaaauuagaauuguggaaaacgccuaucagucacuguaauuuuggcaguuucucaggacuuugcaaugagauugguuguguuauuaacaaaauuuauuuuuuuacuguuacauaaugaaaugugucauguuugaaagaggugcguaacuuggugaaacaauauuuuucagaugaccaugauguuacaaagucaugucugggugaaagaucuauguaaagugcaguaucgagcaguuguuuuuucacugauaguaugagguuucauugauaugguuucaaauuccacauugcaauuaaguucaaacugccuuuguaaaguuuugggguaguaucaaagaggaauaacacccacacuuaccugaaaagguuauuaaauauacuacucccuuuuucaacuacauauuugugugaaacuggauuuucuuauaauuuaaccagaacagcauaucaugauaaauggaauacagaugcagaugugacaauccaguuuucuucuguuaagcuagucauuagagagauuugcaaaaaauguauagcauuaccgcucuuauuaaaguuuugaaaauauuuuaauaaaaguuacuuauauuagauauaauggguuugcagugggguuuguuuguuuuugagacggagucacacugucacccaggcuggagugcaguggugcaaucucaguucacugcaaucuccgccccccagguucaagcaauucugcugccucagccucccgaguagcugggauuacaggcaugcaccaucacacccggcuaauuuuuguauuuuuaguagagacaggguuucacuauguuucccaggcuggucucgaacuccugaccucaggugauccgcccaccucagccuccucaagugcugggauuacaggugucagccacugugcccggccuauuacugcaguuuuaaaauaauacauuuuaaagcauuuaugaguuuuacuuucuaauaggguaaggguauuaguucguucucacacugcuauaaauaacugagacuggguaauuuauaaagaaaagggguuuaauuggcucaagguuccauagguuuuauaggaagcguggcagcaucugcuucuggggaggccucugagcuuuuacucaugguagagggcaaagcaagaguaggugucuuacauggcaggagcaggagagaagggggaagugccacacaauuuuaaaaaaccacaucucaugagaacuccauaaugagaacagcaccaaagggauggugcugaaccauuagaaauugcccagauaauccagucaccuccaggcaggccccaccuccaacaaugggaauuacacuuugaccugagauuugguugaggacacagauccagaccauaucaauaaguaucaguagauauaacccauauaauaaaagcuuuuucagaucuuccagugauuuuuuuuuucccuuuuuuuuuuuuuuuuuugagacagggucucucucuguuacccaggcuagagugcaguggugagaucuuaguucacuacauucucugccuccugggcucaggcaguccucccacuucagccucccaaguagcugggacuacaggcauguaccaccacacuuggcucauuuuucuauuuuuaguagagacggguuucaccauguuguccaggcugaucucaaacugcuaggcacccggcccauuuuuaagauuaugaaggaccucaggaccgggccugguggcucacaucuguaauugcagcacuuugggaggccgaggcaggcggaucaccugaggucaggaauuugagaccagccuggccaacuuggggaaacccugucucuacgaaaaauacaaaacagccagguaugguggcgggcgccuauaauccuagcuauucgggaggcugaggcacgagaauugcuugaacugggaggcagauguuucagugagccaagauggcaccacuccgcuccauccugggugacagagcugaacuccgucucaaaaaaaaaaaaaaaagauaacugcugcugcagagaauuaaccaauuuuugaugguagaugagcccacuauucuccuuucaucccaucuuucaguuaugucagaauuuuugauuauuuuaaagaacaauucagcaaaugccuauugaaugccaaauauguguucuaagcuuuugggcacauaguagugaucaaaacgaaaucugcucugguggggaaacaaaguuguagauggucauuguggaaauaagugagcuggaaaaggaagauagagggugggguuaacuuuuuauuuuuuugccuuuccacaaaaauuuuaauguugguauuaacuacuaaugugagguggucagggaagguaucauggauaaggaaacauuugaacacagauguaaaggaagugaaugagugagccucgugguuaucugggggaagagcauucaaggcagcgugacuagccauagcaugguugaccugcuugagaaauagccuagaaacuacuggggcuuuaguggaguaggugaggaggagaaugguggucucugagaacagagguaugaaggguucauguucuucaguuauaugaaauauuuacauugccuuugauaacuucuuagccauuuuuuaccucucuucucuuuucuggauuuccugucaaucagguaacaggauucuauugccaucucuacuuugccugcuauuaguuccuauuuuuguuguugauuaaaaaaaaauucuuuuuacuaucaguuuaguggggauuggagggagauuugaaauaaaggucuuguauaacuuaccauguuuuuaaaaaaugugaacuuuugcuuuugauaaucaugacaguuuuaccaggaaaaaguuauauuagugacauggaaaugggcucuccacauuuggcgaauagguucacuuuaggaagacuaagucuauuuugacagcuagguucuuuaauagaaaauacuuaauacuuuuauuaagugaagaaaaucaugugauauaagauuuguuacagaacaccuacaaaacauacauuaucaugggauuuuauuuuauuuuuuaugaaaucauguuuaaagaacuaaguacaguaguccucccuuauccaugagggauacaguccaagacccccaguagaugcuuaacagccacaacaugcauaccuauuauaaaguuuaauuuauacauugggcagaguaagacauuaauagcaauaacuaauaaaaaaauuuauaacuauauuuaauaaaaauugugugaaugucaucucucaaaauauuguacucaccuuucuugugaugacggaaaaugaugauaaaauggcgaaaugagguuaaugacaugggcacuguguaggcauucauaagcgguuaaagcuugugagcuguuuauuucuagaguuuuuucuuuaauauuuuuggaccaugguugaccauagguaacugaaaccguagacaguaaauugugguuaaggggagacuacuguauaguguugguuaaaacucaccauucuauuuucuugacuaucuucccgccauuucucugauguauccuuauccuuauucuccacuugaaauuuuacuuuuaaagaucaacucuuaaacuucuuucagguuuuuccuuuagaauuaauagcugucccuuccguuuucccaugguauuugguacuuuguuauuuguagcaguuaccaugcuuuauuagaacauucuuaugugagggacaaguuccugaaaaucugcaugguaaauacgggaaguacgguugaguaacauauguaauaaucuuauguaaaaguagucaugggaacugaaguucugagugaaagcccucauaacugugcauuuaauuaaaaaaaaaaaaagagagagagugaccaaacucaacaacuuagauagucauuuagauccaggcuuugcuaucaggucuuaggcaagucacuucuguaaucuucaguucccuauaguucuuaguaaagauaaaaugaaauaaaaauguggcacacaguucccuacaggcucuaccugaucuggcccugacuacuucugaugucauugugugccauuucccuuuccuuccacuucccuucuuuuaguucuuugcaccuguuaggcauauuccugucacauagucuuuccuauuuuuucucucccaggaauacucuuccucuagaauuguguggcuugacugacuaguggcuaguuucuugucaugauucaugucuuuagcuucuuagagaggauccuguugauggucaaccuuuacauuuguuuuguuuucuuucuuccuuuuuugugauaagaucucauuauguugccagcgcgggauugcaguuggcuauucacaggugcuauuaaagcuuacugcagccuugaacuccuggccucaagugauccuacugccuguuuaauuuucuuuuuucuuuuuucgagacaaggucucacucaguuucgcaggcuggagugcaguggcucaaugucagcucacugcaaccucugccuccugggcucaagcgauccucccaccucagccuccugaguagcugggacaggcauguaccaccacacccagcuaaguuuuuguagagacaugcuuuugcccuguggcccaggcuggucuggaacuccugagcucaagccaucugcccaccuugaccucccaaaguuaugggauuacaggugugagccgccacacccggccuuuuucuuuuuugagacagagucuggcucuguugcucagacuggagugcaguggcaugaucccugcuuacugcaaccuccaccuccuaggcucaaaccauccucccaccucagccucuccaguagcugggacuacaggugcgugcuaccacacccagcuaauuuuuuuaaaauuuuuuguagagacaggguuuugccguguugcccaggcuggucuugaacuccugagcucaagcgaucugccugccucagccucccaaacugcuggaauuacaggugugagccacugcacguggcguauuuucuuaauagcacguguuucgcucuaaaauuaucuugguuuuuuggucucauuugcauguaauuuccaugagagcaaagacuuucuauguccuguucguggcugaugccagugccuaaaacaagugccuagcucauuauaggcuuucaauaaauauuuauugaaugagaaccauaaaugaauaagugauagcuaauguauugucagugauacuguaucuucuaaaauauuaauaagcuacuguaaaauuaauuucucuuuccugauugacuuuucuugguuuuguucucauuccagaugcuugggauggaagaaguuugagugaccuauccuguguuuauccuccuugccguagcugaguugaucuuuuugaaacccucuucccagacucuuggauuuauuuauuuuauuccagugugaaugcauguuuuuucccucauagauggcaguucuggauuagcaguuuuaaggucucaacuuuguuuuuaguuaucuuccuuuaacaagcuucaauuuaaaauacuccuucuuuucucucccaauuaucuuuacugauccuuaguugucucuuuuuauuaucuccaacagaaggaacuugcuguuuagguuuacugaaacuaaaauucugaagauugcaaaaaaguauauagguaaauguguguagaugagacuuaacguguacaagaauucacauuaggauuaagguuacuauuuuuaucuagaauaugaaauuuguuaggaaaggguagcaccuuacuaucuuuuuaucaccuugaucagugacguacaguaaaaauucaaaccauaaaagguuuguuaaauaaaguagcugacaucaguaugcaggauaaugaauucuugguuuccccaaaccaguauucuagaguuguuuaauaucuugguguuuuuuguuucuuguaacaagaauuuucacuucacugucugaauauacugauccaaggaaagcaaaaauggcauuuagucaaagauaaccuuggaaaucccuaaaguugcccaaauauacauuauaaauaugcagucucuggaagucuagcacuucccguuuucccuccacuauuggaauaaaucauguuuucauuguuaaauaucagagaaagaguagguuuguguauauggccuauaauaugggaaaaauaaauggcucuaaauauuagaaucugacagcauaguaagaugcucacauucugagagacacuugggaagugagacccaguggagagcagcaaaauuuaaucuccuauuuuguguugauucuaggcauauaaucagugagcagaagggcaagcauaaucuccuacaugguuuaaauuauuuuuuucuugucaaguucacuuuaugggcuugaugucuaucuagagguguucucccaaauuccaacuuucaguaugccuauacugucagccauuaaagugucaguaagucuuccugguuuuccucuuacaacucaaguucucuuucuuuaguacauacuguuuguuuauuugucgagacagucucaccuauguugccuaggcugaucucaaacuccugggcacaagcaguccucccugcaugaagugcugggauuacaggcacgagccacugcacccagccucuagaacauaggcuuucauuacuauucuccagauuacauauuuugacugaccuaaaucauauauguagaguaaaaacaaauuuuaucuaaauaaacuuauuggacuucauucaaagagaaauuguuuccuugggcaguuuugcucccaacauuagaucccgcauucucaggacagcugucaucuuuuuaauuuaguuuucugauuuuauuuuuauuuauuuuguuacuccaaccuuugcuuuggccuuuaacaacucaguguuuuggucuaaucuucaagaggaauuugagguucacuugaauaaguuagacuaguuugagguggguguagcuagaggauugaagucguaccaaaaaaaaaauguauguauauguauauguggugaucguggguagggggaagaauucagagggaagaagcuuguggacgucuuugccuggacgauuucuaaaaacuagcugacucgucaucuuuaaaacaacaacaauaaaagcuaucauaugcauauguuacuuuguuuaauauuuacaacaacccuuugugguaaauauuuucauuuuucagaugaggaaauucaggcacagaaugauuaauaauuugcuaaugagucacagcagugauggggauguggagauuuaaaucaaugcauuuugaguugccugagcaaagaauuccaaaauuuaggaagucacuauuucuguauuuccuucuaaggaaaaccaucuaaaguauauuuuuaucuccaguaggcguggucauugucaagagaaggaaagguuggugauuuuauuagggugaugggauugggacuuaauuucucuuugcuuuuucuguguauuccagauuuuauauagugaacuuauuuuaaaaaccaaccaaguugauguuugauguauaauuuauauacaauaugaggcacacguuuuauguauaguuggaugaauuuuggcaaaugugucuguccaugcaguuagcaccccaaucaggacauaaaacauuccaucacucuagaaaguuccuuugugcucuuuugccaucagccacccacaucuccugccucaggcaacuacucaucugauuuuugacaucauagaugaguuuucuuuguuuuagaauuucauguaaguaguaguauuauuacucuuguguuugauacucugcucaucaaauguuuucccuuuagcauuuuauuaugcaaaauugcaaacagaaaagaugaaagaauuguacagugaacgcccaucucccugccaccuagauucuaugauuaacaauuugcuauuuuuuugcuuuacauuucuagccaucuauuuguuccuccaaccguccaucaaccaaaccuguugcuuuuuaugcauuuuaaaguuacaaaaauaaaaaaaauaaaguuacagacgccagugcauuuuacccguaaaaaacuacaguuucaugucacuaacuagagucaaauauuuguuuacaguuauuuauuuuuuuucuuugagauggagucuugcucugucgcccaggcuggagugcaauggcaugaucuuggcucacugcaaccuccgccucccggguucaagcaguucucugccucagccccccgaguagcugggauugcaggcgcccgcuaccacgcccagcuaauuuuuuuguauuuuuaguagaaaugggguuucaccaucuuggccaggcuggucuugaacuccugaccuugugaucugccugccucagccucuugaagugcuggaauuccaggcuguuuacaguuuuuaaaguaaacuuuacauacggugaaaugcacaaaucuuaaguauaccauuuaaguuuugccaaaugcaucuauuuauugcccaaauccuuaugaagguauugaacacgaacaaccaugaccucaaaaaguuacaugcuccuuccuugucaguccuuuccccaucccuugaagacacaaccaauguucaauuuuuuuuuuuuuuuuacuuuagguuagcuuugccugucuggaauuucaaauaaauagaagcauaccgauacuuugugucuaguuuucccuuagcaugauauuuuugagauuaauccguauugauacauguaucaguaguuccuucuuuguuguugcuguuugguaucccguuguagcuguauaacauaauuuauccauucacuuggagauuuauuuuuucucuaauuuuuggcuauuaugaguaaagcgaugaacauucauauacaagucuuuguauucacguuuuccaacuuaggcauggaauuacuggaucauacguuagaugugugcauaacuaacauuauuagaagcugccagagagucauguguggaguuccaguuguggaauauccuugccaguguuuggugguuuuggucuuuuuaguuuuagucuuauuggguguguaaugguauauuacuauaguuuuaauuugcauuccucuggugacuaaagauauugaagauuuuuaaauuuacuuauuggguauuuuuguauguuuuguaaaaucuuuugccuauuuuuugugggguuguguuauuagaauauaagaguuuuuuauauucaguauucaaguuacguauauguguuuguauacacacacaaacacauguauauauaauuuuaucugucuuuagcuuaccagcuuguccuuuuguuuucuuaaugcugucucugaagagcggagguuuugauuuugauaaagucaagcuuacuaauuuuuuuaagaaaugguaguacuuucuguauccugugaaaucuuugcccaugauauaaucacauaaacuuucugcuguguuuuuucuagaagcuuuauaguuuuagguugaguuaguuuuuguaucuggugugagguagguguugagauuccuuuuuuuccuaucuggcucuccaguuguuucacgaccauuuuuguuuguuuguuuuuggagacaagagucuuucucuguugcccaggcugcagugcaguggcacagucguggaucacugcagccucauccuccugagcucaagcgauccuccugccucagccuccugaguagcugagacugcaaggacgcaccaccaugccugacuaguuuuaaaauuuuuuuguagagacagggucucacuuuauugcccaggcuggucucgacuccugagcucaagcaauccuccugcgucagccucccaaagugcugguauuuacaggcgugagccaccgcacucagccuaccaccauuuguugaaaaaacaguuccuuccucauuaucuuggcacuuuuguuggaaaaucauuugaugauauauuuaagucuguuucuggacucucuagucuguccuuacaccaauagccccaguguugauacaauuggauuuaaaucugucaguuugcuguuuguuuucuguuugucccaccugucccuuuucucuuuuccugccuccuuuuggauugaggguuuuuaaaaaucauauuacauuuaucaccacuuuuggcuuauacuuuaaaaaaaaucuuuugugguucuuuuaggguuuacacuaugcaucuuugucacagucuuucuucaaggaauaauagacgguuguauguauaauaugagaaacuuaaaacaguauacuuucauuuguuccccuccuguccuuuguguuaauauugucacguauuuuauuuuauuuuauuuuauuuuuuugagacagagucccauucugucacccaggcuggaaugcaguggcacaaucuuggcucacugcaaccuccaccuccuggguucaagcgauucucuugccucagccucccgagcagcugggauuauaggugcaccaccauguccagcuaauuuuuuuguauuuuuaguagagaugggguuucaccaaguuggccaggcuggucuuaaacucugaccucaggugauccgcccaccuuggccuuucaaagugcugggauuacaggcgugagccacugcgccuggccacguauuuuacuuuuacauguuaucagcuuugggaggauuuauuuuucauaucuugggauauuucaucuuagcuagagcauagucuuugugagggugacuaucucugugagggaagaugcuaguagaacccacuuuauuccauugugcuuuuuacaagugaccaaauggugaugacuuaauaucaaagucaguaugacuuaauaucaaauaucaaaguuuucugaucugaaauuaucaaauucuaaagaaaaagucuuuagaauuugauaauuucagaucagaaaacuuugauauuugagucugaagaaaggugauuagauaauauagaacgauaccaaaauuagaacuuggagcauuugugagugaguguccagaauauuacccaguaauuugacucaaggaaauuauucaguggccgggcacaguggcucaugccuguaaucucaacacuuugagaaguugaggcagguagaucacuugaagccaggaguuugagaccagacugggcaacauggcaaaaccucgucucugcaaaaaauucaaaaaauuagcugggcaugauggcucaugucucuagucccaguuaccugggaggcugaggcgggaggaucacuugagcccaggaagucaaggcugcagugagcugugauccugccauugugcuccagccugggcaaaagcaagaccuuaucucaaaaacaaacaaacaaaaauuaaaaugauuuugcuaaauuguaaguuaauuauuuucagguucugauuuugucauucaguuuauaugcaauuuuuuuuuagcuuugugucauuugagaaugugacauuuuguuuaugcccucacaugaaaucauggcuaaaaacagauuuuggaauacauguuaucggcaaauuuuuaauugugaacauuguuuuaugcugcuaauuauauauuuuuagacaaguuuugggauugauucuuuuuguuuuaauuuaagaaaaauauuuauuuugaaauuaauaaacccaugacauguaaauauaaauaguauuuuaugaaaacuuuuucaaaacaaaaacauugagaagagcaaauuucauauuuuugcagcugugucugucuugauagaugacagauggauuccacaucuguuuuauuuauuuauuuauuuuuucuuucuuuuuuugagauggagucucacucugucgcccaggcuggagugcaguggugugaucucagcucacuccaaccauugccuccuagguuuaagcgauucuccugccucagccucccaaguagcugggauuacaggugcccaccaccacaccuaacuaauuuuuauauuuuuaguagggacaggguuuuaccauguugaccaggcuggucuugaacuccugacaucaggugaucugcccacuuuggccucccagaguguugggauuacagucauaagccaccacaucugaccuccacaucuguuuuaaucuuugaaguguauuauaaguuauaguucucccugcuugaagguaauggaaaaguugagacuggguugccugaugagagauguagggagcuuaguauuaauguugaagauuaaaggagagccugugguuuuaggucuaauacaguagauuccuucuccuguuauuuaauuggaaugaauucugagggaaauuuuguaauucugugggcuuuugucuaguuuuucauaugcucaaaagugucugaagaagucaucuaauuuccccuuuucucccuaacggucaucguucuagacagauaguuguuugaauuuggcaucuugaagaugaaaaauugucuaucagaagauuguauuuugucuuucauauaacuuguuuuauacauuuuuagguauacuucaucauuaauuauauaguuuauucagggaaacucugccaugagaaauaggguaauugggucucuguucuucgaauuucacugucuuauccuuccuggaaaacuuuuccugguacacccuacccuucagaaucggauuagauucuacuucuauuaaguuucagugcauaccucuaucauaacacuuauacugcauuuugauuaccuagugauauuucucacuaacugcuagacuauaacuuccucaggacuggucugugucuuuauucauucuuguguuuacaauacuuggggcauucuagcacauuuaagguacucagaaaguguuuauuccacaguguauuaguuugcuugggcugcgguaaugaaaugccacagauggaguggcuuaaaccacaaaacuuuacuuacuccuaguucuguagaguguaaguccaguauuaagguaucagcagguuugguuuuuccugaggccccucuucuugguuuauaaaugaucgcuugcuguguucucacauaaucuuuuuuucuguguguuugcauccugauguugcuuuguguguuuaaauuuccccuucuuuuaaggacuccagucagauuggauuaggacccauucauaugacuucaucuaacauuaauuaccucuuuaaaugucuuaucucuaaauacagacacauuuugaaguacuggguguuaggacuucaacguaugaauuuuggggaacacaaagaaguucauagcacauugaaacugacacuuggcauauguuccaacugaagauaaugucuuaugguucacuaccaaacuaggauugucaaaguugggaccaaagauuccuagcuuauauaagaauaaguggcuuaauuuuaguguucuuuuuuguuuguuugccuuuuuuuuuuuuuuuuuuuuuuuuuuuuugagauggagucucgcucugucacccaggcgggaaugcagugaguggugcgaucuugcgucacuguaaccuccgccuccugaguucaggugauucucaugccucagccuucugaguagcugggauuacaggcaugcaucuccacacccggcugauuuuuguauuuuuaguagagacacaguuucacuguguuggccaggcuggucucgaacuucugaccucaggugguccacuugccuaggccucccaaaauguugagauuacaggcgugagccacugcaccuggccugcuguucugucuuaauuuccacuuagguaauuacaguauuugauaauuaagacccuuagccuuuagugcuuugaaguacuacuuaucuguucucauuuaauaguagguuuucuuuacgcuuuaugucacaaaaagauaaaagacagguauacacacuugggcauauguaugcuuuguguacguauugacuauuaaugcaugauugcugaacauuuuaacacaagaaauguguuuauuuggaaaauuaccagugguaauuugagaagaugacaugauuggauguuuuaauagaaaaauuacguauaauuuuuugacuuacacauaauuucucaguguauacagauguaugucuugcuaucccaguggagcaacuggaugguuuuaggcccuuucuuuucucauggugguuccaacucuuuuuuucuuuuuuuuuuuuugagacagagucuugcuuugucaccugggcuggagugcaguggcacaaucucagcucacuguaaccugugccccccagguucaagcgauucucccaccucagccucccaaguaucugugauuacaggugccugacaccacaccuggcuaauuuuuguauuuuuaguugagacgggguuucgccauguuggccaggcuggucuugaacuccugaccucaggugauccaccugccuuggccucccaaagugcugagauuauaggcgugagccaccgcgaccggccugguuccagcuuuagauuuuuggagauuggcaguagugagagaauggauggugaaguuagagagcaggguaagcuccauagucacucauuucucuccugccuuuccuagggaucaggggaaguuuguaaauaauacccuuguuuuuaaaaaaaugaauuuauuuugcaguaguuuuacauuuacauugcaaaaauaguacacagaguucccauauaucgcucacucaguuacccuuguuguuaacaucuuacccauuacacguuugucaugacuaagagacccacauugauacaucacuguuaaauaaacuccagauaauauuucauuguagacucugguuucacaguuucucagucuucccuuauuuuuucuaacaguuuuguggguuaccugucaaauauuuuauagaccaucccugaaucuagguuaguggaauguuuuucucauaguuugggguuuugggaaagaauaccacagaaguaaagugcccugccuuucucaucacauuguaucaggaguacauggugucaacaugacuuagcacugauuugaucaauugugaucagcuggcugaguaguguuugccagguuucuccacuauaaaguuacucuuuucuugccuacuugagauuggugggggagggguuguuaaguuucaacuccugaacgagggaguguccacauaaauguuuggaauucuucuguaaggaagauuuauuuauaucaguauggauucauggauauucauuuuuuuucuuuuuuuuuggagacaagagucucacucuguugcccaggcuggaguauaguggugcuuucuuggcucacugcaaccucugccucccagguucaaguaauucuuaugccucagcgucccgaguagcugggguuacaggcacacgccaccacgccuggcuaauuuuuguauuuuuuaguggagacaaagguuucacuauauugcccaggcuggucuugaacuccugagcuuaggcaauccgccuuccauggccucccaacaugcuaggauuacaggugugagccacugccgccagccucauuuuuaaauuuuggaguagaauuaauacuacauuauuuauuuuguugucaaaauuuuuccagcuuuggccuuugggagcucuuucagcuugguuccaguguccuguuugacaugccccuauucuuuuguguguuucuuuacuuucuggcacuaccagaugcuacaggcuuguauuuucaaugcccuggugaaaucagcuguuuugccaagaaaccuuuguucuuuuuauuggagaaugguauuacaagucagaaucugagcacuaggacuuagugcccuuuuugacuccucaguuccuaugcagaaugcuuggagaauuugaaucuggauauuuggaggaauagugaaggguaaaaauaccugcaguaucacauuuguaucauaauacuuggcaguaucuauguguugacuuuucugcuguggaauuauagaaagcagcuuuucaaaagcauuuuucuguucuuaagaaguuagaaagcuucagaagaaauguauacuuguuuuaggggcaagcacauaggggaaaguuguuagauucuucuguuuuauucugagucuaagaaaaaaugaucucucuuugggugcagaaagaaagcauguuaucaggaaaacugccaugaacaaagagguguaugugaaaaauuguauuaacaggaauugcagacuuuuuuuuuuuuuuuugagacagggucuuccucuauggaccaccuggagugcaguggcaccaucacggcucacugcaguccuuaccuccugggcucaagcgauucuccuaccucagccuucugaauagcugggacaugugugcgccaccacucuccccuaauuuuuguauuuuuuuagagacagaguuucaccauguuguccaggcuggucuuguccuggccucaggccaucugccugccuuggccuccguaagugcugggauaauacgugugagccugaccacugugccucgccacccaauuucuuguuauuuuaaaauucuguaguuuggccuuugcuauuuagccuuaguuuuagaucaguacuuacuaggaccaaagucgaauuuuuuaaauucugauauuuuucuucauaauuuucucaaaauaaaagggaaauaaagaauaaaaauaaaauaugauggauaagauagaagucacuuauguuuuccuuaucauuuugaaggcuuucuuugcauacuagcauguuagagauauugucauguuuuguguuuuguauguuucuaaauuuuuauuuuaucauucuuaugaauucacauauaguuuuacaauaguauugaaauauuuuaugcauuuuaauaaaaauggagauaauauuguuagucacaauuggcauguuaauguggugaaacugcuaaaacuacucuuugcccccaucacuguaagagcuuccuccguagucuuucugacuuucccucuagccuguucccuucagcuccucagguaaagucuuccuaaaacuagguuaaacagaaaccuauaaucccucacucugauaauuugacccuagcuuauucuccccuacuaaaaaaaaaaaaagaacaaaagaaccuacagccccaagcauuagaguauuuagauguugccauuucuuagcauuguuugaagugaauauucuucgcccaccgucacccugugcauccuucaugguuugacuuggaugugacuuucuuuaugaagccauuaucagaguccuuaauugccucguuuuguuccuacagagugcuuuuauuuauagcauguuuauaacguauucugguuauuuauuuauuuauucgagacagguucucacgcccagguuggagugcaguggcgugaucuuggcccacugcaaccucugccccugggcucaagugauccucccaccucagccuccugaguagcugggacuccaggugcaccccaccacaccuagauaacuuuuguauuuuuaguagagacaggguuuugccauguuuugaccuccuagcucaagcagucugcccaccuuggccuccaagagugcuaggauuacaggcaugagucacugcuccuggccaauuuugguuaaaaaauauauauauguauauauauauaguuuuuuuuuuuuagagauagagucuugcucuguugccaggcuggagugcaguggcaugauuuuggcucacugcaaccuccaccuccuggauucaagcgauucuccugccucagccacucgaguagcugggacuacaggcacgcaccaccacgcccagcugauuucuguauuuuuaguagagaugggguuucaccauguuggccaggauggucuugaucucuugacuucgugaucugcccacuuuggccuaauuauuuauauucuguaauucuuuccaucauccuaaauugugagcuucuugaaggaugggaaccuguauuuucucucucugcccacagauccagcauauaaaguaguuauucuguaauuauuugaauaauugagcauauaccauauuagucaacauuuuucaucuugcucggcccaccauaauuuuguucuacccuaccuauuucaaacaguauuuccugccucucacaaggaugugcucacugcuucagugacauuguuuucuccaaagaguucuguauagcaggguuccccaaccccugggccacggacugguacccaucuguggccuauuaggaacuaggccauguaccaguaggugagugguggaugaguagugaagcuucaucuauauuuacagccagucccugucacuuacauuacugcuugaguucugcuuccugucagaucagcagcggcauucuuguaggagcaugaacccuauugugaacugcaugugagggaucuagguugcuugcuccuuacgagaaucuaaugccugaugaucugucacugucucccaucacccccaguugggaccaucuaguugcaggagagcaagcucagggcucccacugauucuauauuacggugaauuguauaauauuauauauugcaaugcaaugauaauagaaacaaagugcacaauaaauguacucggaucaucucaaaccacacccacccacccccacccugggucuguggaaaaauugucuucuacgaauccguucccuggugccaaaaagguuggaaaccgcugcuguguaggccacgauaauuuuuauuuuuguauuuuuaaguuugauuuuccagagaucguaaaugcgucauucagcauaugugacaaugcuuauucauaagagaaacaccaagccauuuaauagcauugacaaaaaaauuaauaguucaguauguaaaaugugcugcuguaaagauuuaagagcuuauuucgaaauaugguuuaauuuuacauuuaccuguuacagauuguuaaauuuugaagacauguugaagcagccaucuuuucuguauauuuauaaaaacaucaauugucuuuagguuuggcuucuaucacuuuaaaagagagaacucuucaguuccaaucuccaaggaaaucuggaagccacuuaaaguucaguuuuggaaacaggaaguuaaaauaacagaaaucucuaagaguaguuuguaaguuugaagcuuugaaaguugacagauuuauuacuugaauuaucaagaacaaaagguccuggagguuugucuuccagguuuguuacauuauuuguugaacucuuuuuuuuuuuuuuuuuuuuugagauggaguuucgcucuuguuguccaggcuagagugcaauggcacaaucucggcucucugcaaccuccacuuccuggguucaaacgauucuccugcuucagccucccgaguagcugggauuacaggcgccugccaucaugcccagcuaauuuuuuguauuuuugguagagacgggguuucaucauguuggccaggcuggucucgaacuccugaccucaggugacccaccugccucagccucccaaagcgcugggauuauagguaugaggcaccacgcccggccuauuuguugagcucuuauagacuacuuuccauuaaugcagcaaucauaauuauuacacuuuuaaugaagaaagauuuugugaaaugguuugauaaauuauuaucauuuucgagcauuaaaauuuauuuguaaagauggguucaaaaacaacaugccuagauuuguagacuaacaucaguaacuaaaaaucauuucucacauuugacaauuccauucaaaucugcuaacggucacugccauuucugaguuucugcccuauucugucauuaagguguccaggauugguggucauuucuggucacuuaagaaauuuuaugccuagccaagauuccuguaaaaauugugcuugcauauauuugauuuguuuguguagaaaucuguugucaacaaaguuguguucuaauauagugaaaaauuuaaauauauuauguucucauaauuuauuuccuuaaaaaaucuuuaauuucaaaauugguaaaugguuacuuuuuagaaaaaaaacaaacuauauauacagaaacuuauaaaggguaaaagacccccacccagugcuauaaauuucuacccuauuguuucacucccaaacuguuaaguguguauuuuacaaaugcauauauuaauauaaguuguuuuacgaagaagaauccuauaauagcagacuuacuuguaguccguuuaaagaaaaugauccauacuuuccauaacaguuuguacaaauccugccugauuuuaaaaggcugcuuagcaguuaauuuuauguaauacuuuuuuuuaaauaagaaaaggaugaaaaaaaguuugaguucagcuuuucccuuuuguuucugcccucuuauuugugcauauaacuguauauuuguuucuuuucuuuuuucuuuuuuuugagacagcgccaugcucugucgcccagguuggagugcagugguaagaccucagcucacugcagccucugccuuccgggcuugagugauccucccaccucagccacccguguaggugagacuucaggcacgugccaccacccuggcuaauuuuuguauuuuuguauuuuuuuuuuuuuuuuuguagaggugagguuucauguugcccagggugguuuugaaccccugggcucaagugauccaccugccuuggccucacaaagugcugggauuacaggugugauccauuuauuuauuuuauuaaauuaaguuuuaauuauuuuaaaguuccacugaacaaaauaaugagaaaaugcaaacaauauuacuuugaauggauccuuagguguauauauucaggccauuugaaaaaauacaguguuuuuaaaggccugauaugucugaugguaauguuuauguuuuauaguuuuaaaaaaaauuggcuuucuucuaauuugugacggagccaauuuggaguccuuguucauccagaaaugaggucucucgcucuuuacuaggauugucuguuacauccuguuguacaguuuuguaguguuuuucauauggguuuauacaccauucuugucaggcuuaauaccuuggaauaacuauauagcuauuuuuguugcuuuggggaaagugaucuuuuuuccauuguacuuuuaaacauguuauuauuggauauuuaaaaguauuuaagccaggcgugguggcuuaugccuguaaucccagcacuuugggaagcugagguggguggaucaccugaggucaggaauucgagaccggccuggccaacgugguaaaacccugucuuuacugaaaauacaaaaauuagccaggugugguggugugugccuauaguccuagcugcucgggaggcugaggcagcaaaauugcuugaaccugggagauggagguugcagugagucgagaucgugccacugcacuucagccugggugacagacugagacuccaucucaaaaaaacaaaaaacacaaaaguauuuauugauaggaaaauauagcuacugcaccgaaaugggguuaauggauuuuugaguuuaguucucuuagauuuuauuuuauauaucauauaauuuuauauuuuguguuauauaagauauaaauauauauuucauauauaaaauacauauuuuauauauguuagauauauaaaauuuguuagauauguaauaugcaaauauacuauauauuuuguaagauacuuaauucuauauacaauaaagauaauauguauauacuguacauaaauauaacaauauaugcauuauauauaguaaauaugcauuauauauuguaauauauaguaauuaauuagcaguaucuuuaugucuuauuuaguauacauuucaggauccaggcuuccuuaccagaaauauuagacacuugugcaguaugccccuaugacuuguagugcugccacccuaccaaaaaagaacugacucccagauacuguucaggcuugugagguuagauacacccuucauuuugcuauuggcuguaauaauaacagagucauugcuagagcaguagacucuguaacauauugaacuucacccaguuuguauugacaggagauguaaguugauguuauguuucucuuugaugacuaauauuuaaggauuucagaauacuuuaacaagacagaugagaaaaucauuaaguucacugagaaauugaaaccuauuaguugagagagguuuaacuuaucuguuuccagaagcagaauaucugguauuagaauuuagggggcugaaacauccagcuaccaaacuccaguccuccauaauagaggaaagucuguagaauucuuggcuuugauagguuuuaugcuaaagaaauuugguucuuuguuucuauacuucaaacuuuugugggaacaguuuuuuaugcccuucuuuuuuguuguuuuaauuuuuauuuuuuaaaucucaguagguuuuuggggaacaggugguguuugguuacaugaauaaguucuuuaguggugauuucugagauuuuggugcacccaucaccugagccauguauacuguaccuaauguguagucuuuuaucccugaccucacuuuccacccuuucccccaaaguccuuuguaucauucuuaugccucuguguccucauagguuagaucccagauuuuaugcccugccuuuuuuuguuuguuugagaugaagucuugcucuguugcccaggauggagugcagugaugcgaucucggcucacugcaaacuccgccucgugaguucaagugauucuccugucucagccuggccaguagcugggauuacaggugggugccaccaugcccggcuaauuuuuguauuuuuaguagagacaggguuuuguuauguuggccaggcuggucucgaacuccugaccucaauucauccgccugucucggccucccaaaguguugggauuauagguaugaaccaccaugccuggccuaugcccuucuggaucucaaagauuacauuuauuuuuagguguaagagaaagucuuaaauguuaagucuuauguauguaccugcuccuuuaggaaaguaauuaauaauaacagccacuaugccaugugcuuuguuagguacucucauuuaaccguuacggaauuuuaugagguaaguacuauuauuauuccaauuuuauagacuaaaaacaguuuuagagaguacuauggccaagauuacauaggggcagagucaagacuguaacucagugaucccuggaucgaaaaucuacaucacuguucacuguuuaucacucaguauucauugaauauuucauuuuccauaauuucacuuguuuccuagauuuacuauagcuuuuugguuauugcuaugcguucauuuuuucuagcuucuuauaaauuuuuuuuugagucagaguuugcucugucacccaggcugaaguacagugacgugaccucaccucacugcaaccuugccucccagguucaagcgauccucccgccucagccucccgaguagcuggaacuacaggcgcgugccaccaugccuggcuaauuuuuguauuuuuaguugagacgggguaucaccauguuggccaggcuggacucgaacuccugaccuaaagugaucuccccgccuuggccgcccaaagugcugggauuacaagcaugagccaccacgccuggccaagcuuccuauaaaauauuuuggaaauauuuuauaagacuaauuaaccuugaaauuuuccucuuagugguuuugucuguuagcuaguucucuacccuaaguguuuugaggucuuuguacuuagaggcgacagagaauuuuacuucauucagagcaagccuuagcugagauacuaaaaucaugugaaagucugucuaaauguaagggugguuccaucuuugcuucucaguuccucuuuaccugucagaggagauaguuauccuagacagaccucccaaaagauaacuuugacuuccagauucugacaguucuaaucuccauuuaacuguauuuucuuuccuuuuuauagcaugagcaguaauauccagaccaacauggaauggaggaugucccuuaaucuccucacauggcuaucccuugugcaguccucuuuuaacaaguaauuguuucuguggauaucuguuaagguuaaggaguauagugaacgucuuuggguuuagguuguuuaaccucuucacacuccauauaaaucauucuuccaaugucuuuuaaaugcaaccaaaagacucaccaaagugacauuggcagauaauaggaaacuucucauuauuaauaucagcauagacacauccaguaaggagauugccuguccuuccugcucucuaccuagagggugucuagguuuuacuuuggaucugagaaaaguaaggagaaauucucagcugguuaaugcagaaguaugaacagaucugcaguguucugguggauucccuggaugacagaggaucuuugaaagugaggaaauuggcugggcgcgguggcuuacgccuguaaucccagcacuuugggaggccgaggcgggaggaucaccugaggucaggaguucgagaccagccuggccaacguggugaaacccugucucuacuaaaaauacaaaaaauuaacugggcaugguggugcgugucuguaaucccagcuacucgggaggcugaggcaggagaaucgguugaauccgggaggcguagguugcagugagcugagaucacaccacugcacucccgccugggugacagagcaagacucaaucucaaagaaaaaaagaaagugaggaaguagcaugcugguuuacccuguuuuauaacugaauuugcuauuauuuuggcaugaaauugaauuucccauaaauuuuugcguaacugacauuguuauaauuguuuucauguagguccuuugugucucuuguuaaauuucauaccagauauuaaauauuuucauuccucuuguaaguaguauauuuuuguuauucuguaguauuuucuaacuagcuacuguuuguguaaaggaaagucauugauuuuuggaguguuauuuuuauuuauauauuuuugguaaauauauaaguaacuggccugucuuacuguugccagugguuuucuacuauugagcucauuugucagugucaucugccaauaaugaaaaaaauuaccuucuuuuaaauauauaugcccauucccuuguuuaaaugaguuuacuagccuuuccagaagaauguuuuauaacagugaauuccuuuuuuucuuccagauuuuaaugagaaugccuauaguguuucacuauuaaccaucaguuuuuuucccccugaauuauguaugccaaacaaaccaugucugugagcugaauccugccagucuaguuugaagauuuacuuuauaacuuugagccuugagacccuaagggacaugaagagugaucuuaauagacuuucuggaaggugcaaccacuuuccuauuuaauauuuccuauucuccaagaaguagcauguagaucaguuuaccaauaauauauaggaaaaaaucuuuuggcucccugcuguucuuuucuauggucaguuucucucuuuuaaggaccugauuauccccaguuauaugguaaauaucuuguggcuacagaauaccugaagaaggaaauugagcaauaguaaauuuucaagaaaucuuagguauuauuuuccuaauuuuguuauuauuauucucauucugcauauuuucuuuucuaucucagcuauuggugucaccauauucuuaguuaccuaagcuagaaauauggcaguuguguuuuacuuccuuccuuuuacucauucuuuuacagauuaaugcaauuaaaaaaaauacuaauugagugccuaguaugugcgagucaacuguuuucauugcuagagaucugccuagaugagauuccugcuuccuuggaacuuauauucuacugagacgcuuuguguaauaaauaggcuagcaagaucuuuucagcaaguacuuuaagaaagacagaauaugaguuugagugaugaggaagagagggugauuuuuuaaaguguguuuuaguccagauucucugagaagcagaugccaacauaggauuacauguucuuuuacauauuuaugcgcauucucuuuuuugagugacuuuacuagccuuuccaggauaauguuuuauaacaauaucucuuuugaauuauuuuggucguuuaaauguacguaacauaaaauuaccauuuuuaaguuuauaauuuggcauuaaguacauugacauuguugugcaacaucuccaucuauuuccacaacuuuuuaucuuccccgacugaaacucaguaacuguuaaacacuaacuccuauucucccccucccucagguccucgcaaccaccauuuuauuuucugucuaugaauuugacuacucuggguaauucauauaaguggaaucauacaauauuugucuuguugugucuucuuauuucacuuagcauaaugucuucaagauucauccauguuguaaugcgucaggguuuccuuuuuaaggcugaauacuauuucauuguacguguauaucacauuuguuuaucuauucaucacuucaguggacacuugagaugcuuccaccuuuugguuuuugcaaauaaugcuguuacgauccgcccuccuccgccucccaaagugcagggauuacaggcgugagccacugcgcccaggcagaaaucaaguuuaucuuauaguuucauagcaguuaucgugaguauaacuuucuccuuucuacuaggaaagguaauaaguuuaucaagggucccacucuucuuuucauaauugaguacauuauuagguuguguacuccuagcagaaaucucuugagaaauuuuaguacgagcuaaugcacuugaggguccauagugauacuuuugagggaaaauaccuuucuugcuaaugaaauuuuggcuauuuagaauauguaacaaagcauauugucuguauuaucuagauaugaguaguaguaguuauagguaguagaagagaauauucuuucaggcauuugauuuaauauacuuaagcuggcacauaguaaaauaaauaagagaauuaaaaauuuaauacacaccccaagugauaucccuguaguacagguauuauuuuuuucacuuaauuauauuaaaaagauaguuaaaugguagacauauuucuaguugauuuucugauaaucucuaaaacuuuuguagaaaaaugccaagucaucuauggcuuuuuuuuuuucuuuuuucuuuugugucggaauuuugcucuugucucccaggcuggagugcaauggcgcgaucucggcucaccgcaaccgcugccuugcggauucaagcgauucuccugccucagccucccgaguagcugggauuacaggcaugugccaccacgccuggcuaacuuugcauuuuugguggagacggguuuuuuccauguuggucaggcuggucucgaacucccaaccucaggugaucugccugccuuagccgcccaaagugcugggauuacaggcgugagccacugugcccggccggcuuuuuuuuuuucuuuuaaaaucuuauuucuuuagagucauguaagcaaucauuacauuuuuauuuaaaguugaaacaaguauucauauuuauaauugguggugaagcaucauaccaauaauaguguaucacaguuuagaaguagaguuccucagaguuguauggauagucuuaauggguuuuuccuccuuuugcucacauaaacuuguuuaugaugugaauuacuaaaucccaacccuaauuuuuaguuuugaaaguuaguauuuuuuuuuagcuaucguauuuucuuagugcaagguuuacuaauagugguguauucuacacuaguaucaggaguaauuagcaugcagucaucaugacauagcaaugaaaugauuggaucgaucuacacaaagagggacuaguauuaugguuucaguauugaaacaguguguaacagcaagccauuuauaaugucaccaaggagauauaucuuguacgcauuugccuccuuuguaaauuagaucagccaauaauuuuuacaaaaauaaaagacuagaauaugguuuuaucaaacagcaaauaauuuagaauauuaucuguuauauuugcugcuuuuuaaguuaaaugcaauacuuguguuuauuuccuuuugaacuuuccucuucuaaguucaaaauacagccugauacaauuacagggauggauuuuagaaaaaaaaauuuagaacaugauacaauacagcgauggauuuuagaaaaaaaaauaguaugaauuacucccugggugggaaccucuuaguuauaugggauauuaauuuugcauuuaaugacugcaugauauguuaacucagagaagaguuaacugguguacaaacacacaccacagcauacaccaaaccacccccccuugcucuccucuacccuugucucauuggacagacuaaacugaucaaaaaucagagcagauuuaaccauaaagaguugauugcauuguuuuggcuuugggacaugaaaugauggaaaagaaauuggguuuaguuaauugugcugugaauugcuucuuuguaaauuaauguauggcugcauguucucagaauuugucugguuuuuggcaaguuuucauugcuucucaugaucuccauuaucaacaugaggacuuaguaauuacggaugaggagucuaauuuuuaaaucuucagcccauaaagacuccaagaucuccuccucugaaauccaccagaacauaacucugacauggguuucuggaagaaccccagcuguuuccaacauacaucaugagacuucuguugcugauggagucucugaugccuagaaaucuugauacuuuuccucuugacuuuuucacuuuuuuuaaaccucuugacuuucuggcaggaguuuuauugagauuuuauuucacuggguuuuuaguauauucacagaguugaauagcuggcaccacaaucaguuguagaacauuuucaguucacugaaaauaaaagaaauucuauaccuuuuuuucuuuuuuuuuuugggagacagagucuugcucuguugcccaggcuggagugcaauggcgcaaucucggcucacugcaaccuaugucuccuggguucaagcgauucugcugcgucagccuccugaguagcugggauuacaggugccugccaccaugccuggcuaauuuuuguauuuuuaguaagacaggguuucuuuucaccauguuggucaggcuggucucaaacuccuaaccucaggugauccacccgcuucagccucccaaaguggugggauuacaggcgugagccacugcaccuggcccaccuuuuuuuuuuuuuuuccccacucuuguuguccaagcuggagugcaguggugugaucucagcucacuacaaccucugccucccugguucaagcaauucuccugccucagccuccugaguagcugggauuacaggugcacgccaccaugcccggauaauuuuuuguauuuuuaguagagaugggguuucaccauguuggccaggcuggccucgaacuccugaccucaggugaucugcccgccucggccucccaaaguguaggguuuggccaccgcgccuggccagaaacuccaugcuuuucggccaucauaguugaauccuccgaugauccccagcccuagguaaccacauucuaucuauguagauuugccuauuccagacauuccauauaaagggaaucuuacauuauguuaucuuuuugacugguuucuuuuacuuagcauauuguuuauccauguuguagcuugagucaguaugguagucugcgccccuguccaaggggaaaccauucugagucccccaguggaugccugaaaccauauaguguuuuuuuuuucauauaccuacaugccuaugauaaaguuuaauuuauaaauuaggcagaauaagagacuaacaacaacaauaaaguagcaaaauucuaacaacauacugugauaaaacuuaugugaauguggucucucucucauagugugaguaacugaagcuguggaaaguuaaacuggauagugagggacuaccguacuucauuucuuucuauugcugaguaauaaucuuuuguauggauuuauuuauucaucaguugauuggcauuuguguucccacuuuuuuggcuguuaugacuaauguugcuguuuauaaguuuuuuuaugaauauguguuuucauuucucuuggguacauaccuaggaguggaaaugcuaggucacauagcaauuuuguguuuaauuuuuuuuuuuuucuugagauagagucuugcucuguugcucaagcuggacuguagcggugcagucccagcucacuguaaccucugccucccagguucaagcgauucucaugcuucagccucccaaguagcugggauuacagucagugcgccacuauccuggcuaauuuuuguauuuuuaguagagaugggguuucaccauguuggccaggcugaucucgaacuccuggccuccagugauccgcccgccuuggccucccaaaguggugggauuacagacaugagccaccgcgcccagcuuguauuuaauuuuugaggaucugcuagaccgcuucccaaaguagcuuguaucauuuuacauuuccaucagcaauauaugaggguuccaauguuuuuuuuuuaugcauccucucuaacacuuguuauuaccuguguucuuuauuacagccauccuguuuggccccauucaacucuuagaucacauguaccuguguuuuaucauugugacuucuguguucuugccuuuaauuaaagugauccuugucugacuggcugccuucuguaauuugcucauugccaugcucauguucacucaucuuuguauuccugguuuaucacugauccugcugaacuacagauagcgcgugauggcugaucuuggauacagcacugccugugcuugugaauaagaauaaaagaagauagugguuuugauagcuuucuguaggaauaggucauucuaugccuuaauuauugucauuuguucugauaguaaaguuauauacuauaguaacaugggagaccuguaagauuauauauuucuguaacccauuuguagagagggaaaauacuugcuuacuaaacagcuguuguacucgcuuuuuaggaacugguuucaaaauguauuuuaugggcaaaacaaaucuguggugucagaaguuacaauagugguuaacaguuuggugggcuguaguaaugggaagaagauuucuagggugcugguuauguuguuuaucugugugccaguuacauagagguguucauuuuuuuaguguucauucaucuauaaacuuagaauauguguguaugcuauacuuaauaaaaacuuguuaaaaauauguuaacauuguuuauucauguuuugcacuaguaaagcucuucauuugucacauuuacugccuuucugauuaauauauuucauuuugagucaugauauuuacuauuacauuauuuucauauguacauugcauugauguaaaugcuuuaaauucagaucucuuuuuggcagcucguaauuuaagauguugaaugauuuagauagauuagcuguacaaaguuugauuuuauguucugcuguauuguuuauuuaacugaaugaucuucagcagcccacagucuuggcucuaaucuuuuuguauuuaaaacugaaaugcaguaguugugucuacuaucaggagaauucagauucucauuagagaauuaauagaguaguaugaaggaaaaaaaauagaaaagagaagcuuauauucauuagcucauuauuaauaauaucaaucuaauguaguaaccaucuagauguacagaaacauuuaauaauaaccacuuaaaaaugucauaccaggaguaaaacauguugacuaauuagucuuuugaauucgaauccuuuuauuuauauuucacugaaauagguuuugaaguaauuguuugauuugaccaaauauguuuuguugcugaagguagugagauaugcaauaagaucaguuuuugguuaauagaaguuuuuaaguaggcuuaugcucuauaucuacuguauuucuaaaaauuggaugcaugaguagagugaccagagaaaaacguuuuauaagaauaguaaaauaauucauaacagacauuuuguguacugaugaggaaaagacaguucugccuuuauaagggaucuucuugguggaauuugagaacucuucaauuaaauaguauaauaaaacacauuaaaaaucuuuuaaauaucuaauuuugucuucuaggcuuuccuuaaaguuucccaugucucaauggacuccugaauauaacgagcucuacaccuuaaaaguggauaugaagagugagauuccuucugaugcaccaaagacacaggagagucugaaagggauccuuuugcauccagagcccauuggggcagccaaaaguuuuccugcaggaguugagaugauuaauaguaaaguggggaaugaauucucucaccugugugaugauucucaaaagcaagagaaggaaaugaaugguaaccagcaagaacaagaaaaaagucucguugugaggaaaaaacgcaaaagccagcaggcuggcccuucguaugugcagaauuguguuaaagaaaaccagggaauauuaggacugaggcaacaccuagggacaccaagugaugaagauaaugauuccucuuuuagugauugucuuucuucuccuucaucuagucugcauuuuggagauucugauacugugacuucagaugaggauaaagaagucucuguaagacauucccagaccauuuugaaugcuaaaaguagaagccauagugcacggucucauaaguggccucggacugagacagaaucuguaucgggauuguuaaugaaaagacccuguuuacauggcaguucguuacggagacuuccaugcagaaagagauuuguaaaaaauaauuccucacagaggacacagaaacaaaaagagaggauauuaaugcagaggaagaaacgagaaguguuagcucgaagaaaauaugccuugcuaccuaguucuaguaguuccagugagaaugaccucagcagugaauccucuucuagcucaucaacugaaggagaagaagauuuguuuguuucugccagugaaaaccaccaaaacaauccagcuguucccucagguaaaaauguuuaagcugaguaaaacauggaaccuauugcauugcauuugugcuuaauuuuuuguuugugucuuacugauuuuauuuaaagggacuaucagguucuauuaacuuuuauuuuuaagucauauaaauuaccaauugcaguauuaaaccaugacucuaaugcuaagauaaaaauuuaaaaaauuucuagugacaaaaauaagucagaguuuuuugggagaauaacccuucauuacuuuuuuuuuucugaaacagagucucacuuugucacccaggcuggagugcaguggcgcaaucucggcucacugcaaccuccgccuccuggguucaagcaauucuccugcgucagccucccaaguagccaggauuacaggugcccaccaccaugcccagcuaauuuuuguauuuuuaguggagacgggguuucacuauguugaacaggcuagucuugagcuccugaucucaaauuaucugcccaccucagccucccaaagugaugggauuacaggcaugagccacuguaccuggccucauuuauuacauuuuauacauauuagauuauauuuuauguauguucuucauuuaugguacacauuuuuuuccuuguguuucuuuaauaugcuugacuguuaugaauacuuuuucagcuaccuguaugauggauucagccauaguaagaacaguucuagucacuaaaaaagacugguuaauuuuuuuuccuuuguuuuuuugaggcagcaucuggcuuuguugcucaggcuggaguauagugaugcagucuugguucacugcaaccuucaccuccugggcugaagccguccucccacgucagcgccucaaguagcugggacuacaggcccacaccaccacaccuggcuuauuuuuguauuuuuuguagagauggguuuugccaaguugcccagguuggucuugaacuccuuagcucaggcgauccaccugccuugggcucucaauauuuuuucuuuaaguacuauauucuuguuguuugcuguuaucauguucuuuauagcugaaaaguaauuucaaguaacuuuuauucuaauacuaggacccagagacuuuuagucucgacagugcauaugauacaucaauuaaaauuggguagggacuauuuccuaucagugcucuugagccugugugcucuugcucaugcgugcugacucucucucucucucucacacacacaguaaaugugauauuuaaguagaauaaguuuauuugcagacaguccugaaauguauguuccauguauacaaaccauccuaagauaaugcaucacuuuuacaguuguaauuuaaagggaguuguugaagugagcauugaagagcugucugaacugagggaaaagauuaauuucuugugaaauuagggaauaggguaaugggccuagggagagcuuucuaaagggcuagcuaggucaugguuucuaauacuaacauaagcuuucucaguuuuaccuuaugucuugccuguuaaggucagggccugcuagucuacuuuuggaugugccauuucuucuucucuucuucuucuuuaugagucccuuucuuuuccaagaaucucuuuccuuuuucaucuguauuuuucucuuuuugccagaacccuaaaccaguaaccuuguuauuaaucuuaggcuuggccauguucagaucaguuuuaccuacacaaauacuuuuuugagaagaguucauuuugaucauguacagccaggugagaggaguguagaauaaccauugccagagauuuccugagaauaagggaaaugaggaguuguguugcuuaauugucacauuuuucucaaguggucagaaugugcauauacuaguuuugggagugaguacagcagagcucaguuugugcucgaagucagugagacaggaugguugauguggagcagaaguucuaaggagcugauguuuauaggggaaugagaauauaguaauugaaugucauuaucagugccagggguucauauagccucaaguauuaaagagaaguccaaacuuaauucauuuaaaaaucuuauuuaauacuuacuguagcguguguguuuuuuuucauugccuuucuuggcagaauuacguuauuuuuaacuacauuauuuucagacacuacccucaaacaugagaaacagaaauccaaaauguugaaaccaaguacauucaauguuuucugguuucuggacaagugauuugcuuuaaacugguuuuaaaaaaaauaaugauuuaauaacauucacacgauauggaauuuuaaaaguaucaauuaaguauaaaauagaaaauaaaaguuuaucucuucuucagauccuccaguguuacuauuaaccagaaguaaucacuauuaguaguuucuuaucuccuucagaaaaugugaagggcuauucaaggauaaauaauguggcucuuuuuauaucacuauguauaguuaucucauucuucuugacauuugcauaguauucccuuuguauggauguuccauaauuuauuuaaucagcuuuugucaguggauauuugcugcauugagcaacauugugcuugcguuuuauacaccuauguaaguguaucuuaaggaauaauuacugaaaguguuucagaggguauaugcauugaaaauguuguuggcuguuguuaccagaaugcccuccaagaaguuugcauuaaauuccucgaugcuaaugucgugaugauaauaaaaauaucuaacacugguugaguguucacucugugccaguaauguucuauuuuauguguauucucauugaauccuuccaguacucuuaugagauggauucuguuaucaucacacucauauuacagaugaagcauuuggaaaaucaguuuggaaugauuuuuuaaaaacuauaguuaaacugaaauauuaaugagacuuagcucuauuaucaagaaaucucagcucuuucaaauaauuaacuuccuuagauucuuaggagauagguuauuuccuagucauauuuugagugauucaaauaaaaugauuuggcaaaaagucuuagcuaauucaaauugguagaacuagaacuugaacucaggcuuucuggauagaguuggaaagucuaaacuuuuaauuugacuuauuuacuacauguuaauaugauuuguauggaugaauggauauuaguuacucuggaacuucugggacaacuuuuucauacaaugugcuuguauuaauccauugucacgcugcuaauaaagacauacccaagacuggguaauuuauaaaggaaagggguuuaauuggcucacaguuccacauggcuggggaggccucacaauuauggcagaaggugaaugaagagcaaagucacgucuuacauggcagcaggcaagagagagauugugcaggggaacucccauuuauaaaaccaucagaccuugugagacuuacucacuaccaugagaacaugguaugugggaaacugcccccaugaauuauguccaccuggcccuguccaugacacgugggaauuauuauaagucaaggugagauuuggguagggauacagccagaccauaucauucugccccugccgcuuccaaaucccauguccucauauuucaaaaccaaucaugccuucccaacagucccccaaagucuuaacucauuucaguauuuacucaaaaguccacaguccaaagucucaucugagacaaggcaagucccuucugcauaugagccuguaaaauuagaagcaaguuaguuccuagaugcaaugaggguacagauguuggguaauuauacccguuaauauuucauuccacauaacuuaugcaaauuucugagcugguuugaauuucuccccagaaaauggguuuccuuuuuuaucacauugucaggcugcaaauuuugcaaauuuuuaugcucugcuuccucucgaaugguuugcucuuagaaauuacuuuugcauauacccuaaaucaucucucucaaguucaagguuccacagaccucuaaggcagaggcaaaaugcugccagucucuuugcauagcaagaguggcccauuuacuccaguucccaagaaguuccuugucuacaucugaggcuaccucugccuggacuuuauuguccauaucacugucagcauuuuggucaaagccauucaacaagucucuaggaaguuccaaacuuccccacaucuucuuaucuuuggagcucuccaaacuuuugcaaccucugccaguuacccaguucgaaaguugcuuccacauuuucagauaucuuuacagaaucaccccacucuguuaguaccaauuuacuguauuaguucauucucauguugcuaauaaagacauacccgagacuggguaauuuauucuauuuuuauuuauuuauuauuuuuuugagacagucuuacucuguggcccaggcugcuggagugcaguggugugaucuuggcucacugcaaccucugccuccuggguuaaagugccugaguagcugggaugacaggccugcaccaccacgcccagcuaaucuuuauauuuuuauuagagacuggguuucaccaugguggccgggcuggucucaaacuccuggccucaagagauccgcugcccaccucagccucccaaagugcugggauuacagguuugagccaccgcacccggccaagacugguaacuuauaaaggaaagagguuuaauugacucacaguuccacauggcuggucaggccucacaaucguggcaggucauugaggagcaaagucacaucuuacauggcagcaggcaagagagagcuugugcaaggaacuuggcauuuauaaaaucaucagaucucaugagacuuguucacuaccgugagaacaugguaugugggaaaauugcccccaugauucaguuaucucugccuggccccacccuuggcaugugggcauuauuacaauucaaggugagauuuggguggggacaaagccaaaccauaucggugcaucaauauuuauuggcuauugggaaaugaacugauggaaaaauguuuuacauuuuaaguauuuuguaauaucuuaaaauacuccaagacccaacaguuguauauaauuaacugacuuuaugucaucaguucauuugugguucuuuuugguuugguuuuauuugcuuuuugagacagucuuaucuguuguccagguuggagugcaguggugcaauuaugacucgcugcagccucaaccuccuugggcucaggugauccucccaccucagccucccuaguagcuggcacagcagcaggugugugcaacuacaguugacuaauuuuuuuuuuuuuuuugguagagacaggguuuugucauguugccuaggcuggucucgaacuccugggcuuaagugaugugccugccucggccucccaaagugcuggauuacaggugugagccacugcacguaaccaguguauuuguuauaaucaacagauuucuggaaaauauuugcuucuugcugucccauuauuaauuggcuuuuaacuuuauuagggauuucuauuauguguagaaagccaaagugauauguuacuuggguuauuagaaagccuguuaaacauuuaguuuuucccaguugccagugaggcugauaauuuauacauucuguuuuguuacugcaauaugucaagaacuccagauauuuaaaauaaccuaacagaagcuagguuugagaauagguguuaauuuuaguaauauauuucuaggaucuauucagagaaccuuacuggaacuaauugacauuuaauaacacaaaaaccuuggguuucccaauuaauuauggauaugaggacuucuuuauacuuuauuaacuuuaaaauuaauagguauugccgggcgugguggcucacaccuguaaucucagcacuuugggaggccaaggcagguggaucaccugaggucuggaguucgagaccagccugaccaacauggagaaaccccgucucuacuaaaaauacaaaauuagccgagcgugguggcgcaugccuguaaucccagcuacuugggaggcugaggcaggagaauggcuugaaccugggaagcagagguugcugugagccgagaucacgccauugcacuccagccugggcaacaagagugaaacucccucucaaaaaaaaaaguagguauuacagauuauaucuccuucagucuucaaggaaacguaaaugucaaauaugcuccuaaauaagagagcuuaagucagucccauuuuaccacugaggagaaaaagaaguuuugucuaucuugcuuugaaauacaaaguuuuaaggcuguuguuaaaauagucauaugucuuauuaacuuauuuacauauaagauauugaaaaaauguuaauuuagaguuagugauuauuacccacauuuccugaaaauaauuuuauucacacaaccaucguagaccuugaugucuugguaauugcuagaaccauuuuuuaagucaucacaauuuuugagagcauaggauccucaucugcuuugugugagguauggcacgcacugacuccaugagugaugcaucacuagaaacuuugucucaaacuacaaauaucauuuuaccuuauauuaggcuuuaaaaaauuaucuaauagcuguauauauauauauuuuccauguguaguccauacuguauugacuuuuuaagcuuuuuuaaaaguuugcuuaaaaagauaacccuuggaauuguagagucccaggaucaggaauuauaucuaaugcugugaauacuucugucccucuuuuuguaaaaguagcauugauugaguuauaguuuuugguuuuaugauuuuauuugggaacuuuuagacuuacacaaaaacagaaauaugcaaugaacucccauauaaucaucaucucgcuucaguuguugacauucugccauucuuaauucauuucuaaccccucuuuuuuuuccuggagaauuucacaaaaauuguagacaucauuuuacucauagacacuucaacacacaugguuuaauucuuuuuuauauauggcaucauuucuguaaacugguagguaguugggucuaaaagcuugauuagguucaaguuuaguuccggcaguacuuuguugaugauacugugugcuuucuguugcgucacaaauugagcuugaucagaggguucagauguugucauucugauccuuccauuauaaaguuccccuucacuguuuucuguaauguuuuuuagcaguuauuaauggucuugcccagauucauuauauuaggggugcaaaauauugauuuauuuuuugagauggaguuucacuuuuguugcccaggcuggagugcaaugacacgaucucagcucaccgcaaccucugccucccguguucaagugauucuccugccucugccucccgaguagcugggauuacaggcacgugccaccauaccuggcuaauuuuuuauuuuuaguagagaugagguuuuuccauguuggucaugcuggucucgaacuccuaaccucaggucaucugcccgccuuggccucccaaagugcugggauuacaggugugagccaccacucccggccuugauauucuaauucuaucauuuugcuuagguuuauuaucugagguucuucuauaaaggaagaacacuuuguucaucagcucauugguuauucugaaauucuguucauacaggaaaggcaagaugaaugcuugauuuucuucuuucauuuaccacuucucagaaugacuuaguuguucuagcagcauccaaagagguuuuuucacuuuugaguaucauuaugaaugcaugaauuuuaguauauuugauggguuucaguuuguugcagucuuuuuauacuuuuuuaaaugauuucaucuuuggccauugggaacaucuucaaacugggucauuguccuuuugaugccauccuaguagucguugauaacuuccuuccucucugguauaucaaguuggugcagauuaaucuacaguuccugccccagaccuagaaacagcuauuccuuuaagaacuccugauuuuuuuuuuuuuugagacggagucuuguucuguugccaggcuggagugcaguggugcgauauuggcucaguacaaccucugccucccagguucaagcgauuccccugccucagccuccugaguagcugggacuacaggcacaugccaccgugcccagcuaauuuuuuguguuuuaguagagacgggguuucaccguguuggccagcauggucucgaucuccugaccucaugauccaccugccucagccuccucaagugcugggauuacaggugugagccacugcgcccugcccgauuuucuuuuauugggaggugauagagacuacagucugggaauuaaggugguuuuugcucugcuggguugccaaugcuuuuggcuuuuuugaauuuaaccuaauuuuuuuuuuuuaaagggacggucucacucuguugccuaggcuggagagcagugguacacucaauagcucuuugcagacuugaccuccugggcucaagugauccuccugccucagccuucugaguacuugggacuacagcacaugccaucuugcuccacuaauuuuuaaauuauauuuuaauuuuuuuuuuagagaugagaucuucuuaacguugcccaguuuggucucaaauuccuggccucaacuuauccuaccauguuagccuccucauuugcugcaauuacaggugugaugugaaccaccaugccuagcacauuuugacuguuuuaacagacaaagcuagaaauguaaagauuuuagaaaaaaauaaaucuuuaauuuaagugaauauuuccacugcaaguuuaggauuaggguuuuuauguaaguuguuguuuuauauuuguauuuguucuuacacugaaaacucugauucuuaacaauauuaaccauugcuuauuugccuugucguauauaugccauaaauacguacacauaagugaacuaguuucaacauaaaaauuacuuuuaauggcaaaaccaccauugcuuuugcacuaaccuaauacaguaauucuaauuaauacaguuuaaguauuuuguuuuguauagugucuuuuugcccuuggccaguuuucugugugguuaugccaccaauuucacaugcauuuagguucauuuauuucaggguuggcuuuuuuaaagauauuuuuaaaaaauuuaauuucgcuuuuuaaauuauguaaaacauuuaccuagcuucagagucaaaacuuuaaaacaagauauacucaggucuuaauuuaguuuugguuaacucuuucauuuuuuuucuucaaaaauauacccaaaauaugacccccuucucuuacucaaaagugucucuugcuuuuuucacuuaauauauacuauuguugggguauacagagauacuguagaggaaugaaaguauauaucuccguauaucucauuucuuuuuauuccuuuuguuguuaagcuucaucauacucccuugcaugguuguaccaguuuguucaaccagucuccuauugaugaacaguuugcagacuuuuuuuuauuauuuuaaauagcacugcaauaaauagcuuuucuugaccccgugcaguggcucacgccuguaaucccagcacuuugggaggccgaggcggguggaucaugaggucaggaauucaagaccagcccgaccaacauggugaaacucugucucuaccaaaaauagaaaaauuagccgggugugguggcugcaccuguaaucccagcuacucaagaggcugaggcaggagaacugcuugaacccaggaggcggagguugcagugagccgagaucuagagauugugccacugcacuccagccugggugacagagugggacucugucucaaaagaaaaaaaaaauuacugcaauaaauagcuuuuuguauaugucauuucauauuuguuugacagugugucuuuggaauaguauucuagaaggcaguuguugaauaaaggauaaaugcauauguuauuuuguaaaauauggccacauuuuucuccauggugauuguaaccauucugaaugcucaccggcaagggugccuguuuucucaaaauccuuccaacagaauauguugucagauuuuaggggguuuuugguccgucugauagcugagaaauaguaugucaguacauuuuaaauuuguauuucuuuuauuuuuuuuaauguguaauguguaucuuuucauauguuuuaaaaacuuuaggucauuuucauuucuuuuccugugaucagucuguucauauuuuuuuuuuuuuuuuuugccuguuuugauaucaggauacuggucuucauucuucuauccauuuuuagaagcuuuuuauauauuagcaauguaaguccuauauaauacacacauuuuucacaaauuaauuaguaguuucuugacuuacauacuuuuaugccaaauuuuuuuuucuuuuuuugagacaggaucucacucugucacccaggauggagugcagcauauugcugccucggcucauugcaaccucagccucccacgcuuaagcaauccucccaccucagccuccugaguagcugggaccacaagugcacacccccacgccuggcuaauuuuuauauuuuuaggagggaugagguuuugccauguugcccaggcuggucuugaacuucugagcucaagugauccacccgcucggccucacaaggugcugggauuauaggcgugagccacuauggcuguccaacauuuuuuuucacaagucauauuuaucaacuuuuauucuuacugcuucuggauuuugaaucauaauuaggaauacuuuuaccacuccaaaguucuagcaaaauuagcccauuuccccccaguccuuguacuuaauucauuuuuaacauuuagagcauagauccauuugguguuuauccuuacguauaauaggaaaaauggaccaaauuuuuuuucaugugacuauacaguuguccccaaaccagucauuaacaucuuuuuccuauugacuugagauaugcuaccuuugucacauguuaaauuuuccacaugcauuugggccuguuuauggaguuuuuacuccgucuuauugcucugucuguccauguacaggaagaacacucuuuuaauuauaaaaucuuuaauguuuuccuagauauuguuguuuguuuauuccuccaagugaacuuuauaaucaguuuguuuacauggagguguuuggggguggggaggucuaugaugguauuuuuauugggauuccauuuguagauuacauuacagagaguugacaucuugggauuuugaguccuuguauuccagaauaugggaugucuucauuuguugaugucuaguuuuguaucuugcagagagcguuuuauguucuuuuaaaaauuauugagguauaauuaacuacuauaaaauucauuuuaacuauuauaaaauucauucauuuaaaguguacaauuuaguaauuuuuuuuuuuuuuugagacagggucucauuuuguugcccaggcuggagugcaguggugcgaucuccgcucacugcagccuccgccuccaggguucaagugauucucccaccucagccuuccaagcagcugggauuacagguaccuaccaccucagccagcugauuuuuuuauuauuugguagagacgggguuuucaccauguuggccagacuggucuugaacuccugaccucaggugaucugccugccuuggccuugcaaagugcugggcuugcaggugugagccacugcaacuggcuggaauuguuuaagugauuuauuccuuggcugggcccugguccugcuuguguuucugcacugccauuagucaugaagaugagauacgacaucuauaaggcuagugagcaggcuccuguagguagguagaggucaaggguguuuugaaugguuuccgguauuugcuauugugaaaaugcuacagugaacauuuggguacaaaucuuuguguacauauauguuuucauuucuguuggaaagauaccaacagaggagucccaaaguagagucauuugcuuauaccuucaguaacuuuaauugugacuguaaaagacgagagcaguggcaaaagcaucugguagcaggaaaaugcuuuugauaguaacuaggcacccacauguuuaguagguaugguaccauggugucauuuaugaaaagaauaugagcuuuagaauuggaauuagcuuugaauuuuaaguguugcuuauuuucuugcaagucacuuaaacuuucuaagcuucaguuucuugaugaggcuagacaugcauaauacuauauguggcacaaaguuugugcucacagauuggaaacugucuuuuuuuuucugguggggggagacagaguuucgcuuuugccgcccaggcuggagugcaguggcgcaaucucggcucacugcaacccccaccucccggguucaagcgauucuccugccucagccucaugaguagcugggauuagaggcacacaucaccaugcccagcucauuuuuguauuauuaauagagacgggguuuugccauguuggccagauuggucucaaacuccugaccucaggugauccaucugccuuggccucccaaagugcuggguuuacaggcaugagccaccacgccuggccauggaaacucuucuuauuguuagcaucauuccagucuuaaggcacagagagacuaaggugaucagugaguauaguggcuaacguugcuuauugcugaugccaagagaaucugugaucucuuaccaggaaauagaaaugggcuuugaagaguuuauaaagaacucucgcagagaaaccauuguuuuuguuaucauuguuguacuacucauauucuuucuggccugguagccagagaaauauguuauuuuucucaugauguuuuaaaagcuauaaacaaccuaacuaaccuuaaaaaaaaaacaauucgaagaaaaucacccacaguccuaccacugucuuagccauacucguuuuuuauccuuuaguauuucuaaauguaaaagauaaaaugaaaauaaaguugacccaguaagaagugaccuauucucuugauuuucuuuuaagucgugcuauuuaauaagauuaacuuuauaauuuuugaaauguuucccuuuuaaaauuuugguuuaaauaacuuaucuuagaaaacacuggauuguagaugccaaaauguugccuguugugaauaugcuuuaguuauauaauuuuuauguauuauguucaaguuaugcauaaaguccuuuuuagaaaaauaaugauguuuaagcaauagaauaagagugccuaagcaagcuauuuuuauacuuuuaguuacauaaucucuguauucauaaaaaguuauauaaauugaauuuucaugcauuagcaaagcuagcuuuguaucauuuaucauugagguuucaaaauguuacauaagccauguaaaagguguucgauaauguuagcuuauuuuuuacaguuuuuuuuuuuaaguguuuccucuuuuuuuuuuuuuugagacagaguuuuuguucuugucacccaggccuggagugcaguggcacgaucuuggcucacugcaaccucugccucccagguucaagugauucuccugccucagccucccgaguagcugggacuacaggcaccugccaccacaccuggcuacuuuuugcauuuuuaguagagacgggguuuuaccauguuggccaggcuggucucgaucuccugaccuugugaucugcccgucuuagccucccaaagugcugggauuacaggcgugagacacugcgcccggccuuaguuuuuccucuuuuuaaaaacagguuuuaaaagaaauuuuguauacagauaaauggagaaaaaucauaaaugaaguugacauauagauauaacuuuucuccaugucgaauugguaaugcccaguuuauggguugaaauaaggaaaguuuuuuaaaaaauaugacuugucguugauacauaaugcuuuuaguuuuaaauguacuuuuaccaccauacuuaauuccauauuuaauaauuugaguuaauuaacaaguaacaugucugcaaagucaaugguuagcuggauuaauaucucaagguuccuuuuguacuucuaccuuaagcugcauuguguuuaugauuaugaagcaagaguuggaaaauaauuuggaaauucaaucuacaauauuauuuuaaauagccacuugggugcuacuguuuuguuguuuuucugccuguaagauauauuugcacuguuaaaaaugcauuuuaccucagucuguguguguaaucuuuaggacuuaaaaaccacuucaaauauuuucacaucucauaacuccuaauaaauguuauguuuucuaauugauaauaacauuucgcaaauauuccagaauauaaauacaauauuauuaaguaauuuuuaaaacguuucuguaaaucagauaaucuuucauuaucuccguuauuuaccagugucugcuccuauuugcugcuuuuuuuuuuuuuucccuuuaauuuuuugagacaggauuucauucuguugcccaggcuggacugcaguggcgccaucaggggucccugcagccucagccuccagggcuaaggugauccucccacgucagccuccuggguagcugguacugcaggcacaugccaccacaccuggcuaauuuuuuauuuuuuguggaaaugagguuucaccauguuacccaggcuggucucgcacuccugggcucaagugaucugcccaccucagccuaccagauugcugugauuacaggcgucagccucuguaccuggccuguucuguucuuuggaguauuguauauucauaugcagaaaagauaaauuuagaccuuuuaccuguugucugacacagaaauuaacaaaguagaucauagaccuaaauguaagaacuaaaugauacaaguucuagaauaaggcauaggagaaaaucucagugaccuuggguuagacaaagguuucuuaaauaugucaccaaaaucacaauccauaaaagaaguugccaauuugaacauuaaaauuagagacuuucgugcuucaaaagacacuauuaagaaaaugaaaaggcaugucacagacugggagaaaauauuugcaaauaguauaucugagaaaagacuuguauucaggauauauaaggaacucuuuauuuuuuauuauuauuauuuugagacacagggucucacucuguuguccaggcuggaguacaauggcacagucucggcucacugcagacucggcccccugguuucaagugauccuaccaccucagccuccggaguagcuuuuguugagacgagguuuugccauguugcccaggcuggucuugaacuccuaggcucaagcaauccacuuaccucagccucccaaaaugcugggauuacaggcaugagccaucaugccuggccaggaauucuuauaauucaacaaugagaccaaaagcucagauuaaacauggacagaagaauagacauuucaccaaaguggcuaauaaaauuaggcuuggcacgguggcucacaucuauaauccuagcacuuugggaguccaagguaggaagaucacuugagcucaggaauucgagaccagccugagcaacauaugagaucucauuuguaugaaaaauuuaaaaauuagcugggcaugguggcagguaccuguagucgcagcuacugggguggcuaagguggcaggauugcuugagcccgggaggucaaggcugcagugagcuauuaucgugccauuguacuccagccugggcauuggaucaagacacuuucucaaacacaaacagacaaaaaccagaguaacuaauaaucacaugaaaaaaugcucagcaccauuaguuauuuuguguuuuuuuuaauuauuauuauguuuugagacaaggucuggcucuguugcccaggcuggagugcaguggugccaucuuggcucacugcaacgugcgucucccaggcucaagcugucuuccuaccucagccucccaaguaucugggacuacaggcaugugcuaccaugcccagguaauuuuuguguuuuuuguagagacaguuuuucgccauguugcccaggcuggauugaacuccuuagcucgagcaaucugccugccucggucucccaaagugcugggauuauaggcgugagccacuguauccagccuacuuauuuuagaaaugguuauuaaaaccacaaugagauaccacguauagccacuggaacaaguuuaaugaaaaagaaacaauaauagguacuggugaggauguggagaaccugaaaccuucauuucccuauugggaauguaaaauuguagagccacuuagggaaacaauuuggcaguuccuuaaaaaguuaaacaaauuuaccauagaaccuagaaauuacauuccuaaguauuuaccuaagagaaaugaaagcacauguuuguaggaagacuuauacaugaauguucauagcuacuuuauuuguaauaugcaaaaacugagcaaaacccaaauguccaucaguggaugaauggauaaaguauguuauauccauaugauuggauacuacucagcaauaaaaaaaguaugaauauugauacaacaaaugaauauauuucaacauaaauacgcugagugaaaggagccaaaaguguaugcaaugugugacuccacuuaacauaaaacuuuacaaaauccaaaccaauucauaaugacagagagcagaucaguuguugcagggguauuggaguugguauaggggaugaugacugacugaaauaggacuugcgagcucuuuugggguuauuggaaauguucuuaaacuggauuguggugaugauuacacuccauaaauuuacuaaaauuagcaaaauguacacuuaaaaucggugaauuuuuuuacacucauuaugugaaaauucuuaauuacagacauuauuuguaaacuguugggugacauuuguauugacaggugauaguaaugaagaagccauucaacaacagguuuguaaaaaauacagcaagaaaagaaauggaggguuacuuuuuuaaaaaccauuuuaacuauuuuuaagcuuauuguucaguaguguuagguauauucacauugggaccaggugcaguggcucauacuuguaaccccagcacuuugggggacugaggugggaggaguauuacuugagccuaggaguucgagaccagccugggcaguguacuaagauccugucucuuuaaaaaacaaacaaacaaacaaaaauuagcugggugugguggugugcaccuguagucccagcuacucaggaggcugaguuaggaggaucacuggagcccaggagauugacggcaugagcgugauugugccccuacacucuagccugacccugucucacacacacacaaaaaaguauauuuacauuuguugugaaacagaucuccagaacuuuuccaucuuccaaaacuggaacucuauagccauuauacaacuccucuuucuccucgcucugacccugguuaccaccacucuucuuucuguuucuacaaauuugacuacuuuagauacuucacauaacuggaaucacaguuuuugucuuuuuaugacuggcuuauuucacuuagcguaaugcccucaaguuuuauuuuguuuuauuuauaguccaggugucuuugauuuuuuuuuuuuuuuuuuuuuuuuggccaccuaguaugccaugaauucacagguuauagguuccagcaguucaggcuccuguccauugguucucacaaagugugcuuuucuggguggagaaugcuggugcuucaguuguaccuagguaccuuucucuuuggcuuccuucuuuuucugaucuuuuuccuucauguguuuugggaagccaucucagcuguagugcuuuauaugcucauuauauacauuaauucuuuuggcaagaauuucguuuguuacagcauugccaacagcaugcuggauaacauuguaacuuccaguuuugccaugguaauauuugugggcauuccuuuuugaacaguagccauuuucuuuuucuuucuuucuuuuuuuuuuuuuuuuuuuugagauggggucucgcuccgucacccaggcuggagugcaauggcgcgaucucggcucacugcaaccuuugccucccagguucaagugauucuccugccuccugaguagcugggauuacaggugcgugccaccacacccggcuaauuuuuguguuuuuaguagagauggaguuuuaccauguuggucaggcuggucccaaacuccugaccucaugauccuccugccucagacucccaaagugcugggauuacaggcgugagccaccacgcccggcccacaguagccauuuucuuuucuuuuucuuuuuuuuuuuguuuugagaugaagucucauucuguugcccaggcuggagugcauuggcgugaucucggcucacugcaaucuccgccuccugaguuccagcgauuuuccugccucagccuccugaguagcugggauuacaggcuagcaccaccaugcucgacuaauuauuguaugagcaguagccauuuucuugaugucuacaacaucgcuuuuucuuguagauuccugugucuguggccaaaggaacaacuccauguuuuccaaaagcccuagagaacaaauuggaggugccucuucuuuuuuccuuuguguuugucaucuuggugaauuauuggaagauggugguuucuggcgaaaggccagauuaaaugguugaauuuuaaaguauguaaauuauaccucaaaaaaacuauuuuaaaaaguagacuuacccugacacuagacucuauaucaaagggguugaauaguuucaaaauggaccguaaaauacguguaauauuuaagagaaguaucaaaaaauauuuuaacugcauuauugagguaugauuaguauacuaaaagcugaaggaagguaguguauauaacuugauguguuuggaaagagcuauaacaccuguaaaaccaucauuacaaucagugccauggacuuaaauccaucaccuccaaaaauuucuuccugucuccuuacuuuuguuuccuuuuuugguuagagcacuuaauguguuauacccuuuuagcaaaguuuuaaacauacaauacguuauugcuaaucauagacccuauguugugcaguaaauuuccaguauguauuucuuuugcauaacugaaaauuagaggagguaucaaaaauuaaugggguaaaaaagauuuuucaauaaauguuuuggugauagcuaguuagcuguggagagacagagcaggauucuauuuauauaaucuuaucuaaugucauaacaaaaaucaguucuagauacaguaauauaaagaauauuaaagacuuggaccaacucuaauuuaauacuuauccaucuucuaaauaaggaugcacuuuccaaguuuagaaugauuuagaaaagaacgggcauuuaaaaaugacaaauuuugcgccuggugcgguggcucacgccuguaaucccagcacuuugggaggcugaggaggguggaucaugaggucaggagaucgcgaccauccuggcuaacacagugaaaccccgucucuacuaaaaauaaacaaaaaaaaauuagcugggccugguggcaggugccuguaguucuagcuacucgggaggcugaggcaggagaacagugugaacccaggaggcggagcuugcagugagcagagauggcgccacugcacuccagacugggcgauugagcgagacucugucucaaaaaaaaaaaggaaaaaaaaaaaaagacaaauuuuggcugggugcaguggcucacgccuauaaucccagcacuuugggaggcugagggagccagaucacuuaagguuagaauuucaagacaagccugggcaacauggugaaaccccaucucuacuaaaaaauuagccuggugugguggugcaugccuguagucccagcuacuugagaggcugaggcaugagaaucacuugaacccaggaggcagaggagguugcaguaagccgagaucaucccacugcacuccagccugggcaacagagugagaaacugucucaauaaauaaauaaauaaauaaauaaauaaauaaaugaauaaauaaacaaaugacaaauuucauaacauaaaacuaaaaagcuacaguguuuuuuuaaaagaauauaucaccuaaaugaaaacaaccuuggaaaaaacauaaagcuauuguaauuacuuugagcuauuaaaggguuaauaucuuauauaguagaauaucuuauacaagaucuauaauauacuacagauauuacaggauaaauaucuauauaagaucuuacaaaucauguagaaaccacugaacaucuguaaugaauacaacaaauccauagaagaggaaguaaacaugcaaagaaguguagauuaaaacagugauuaccauuuuuacuguguguguuuuuuguuccuuguguauuuuuuuaaaaaaccuuuuugacagauaagauuuuuauuuuugcaaugaauuucauggucuucaaagucaaaauaaaaauuucugccuaacgauuagcugacaggaagaugccuuuaaauguuuuuucuuuuuguuuccaggaaguauugaugaagauguuguggugauagaagcuuccuccacuccccagguuacugccaaugaagaaauuaauguuaccucaacugacagugaaguggagauuguaacaguuggagaaagcuaucggugagauuuuaauucuuaguuaaauguuugaaauauuaaauauaaauauuaaacauauuugugcugcagauauuugcauucuuuuuauuuauuuauuuuugagacccaguuugaguaugcauauaucagauuaguggauuuuuuuuuuuuuuuuuuuuuugguaagagauagaauauugcuauguuacccaggcuggacuucuaccccuuggcucaagugauucuccugucucauucuccauaguagcuaggacuguaggcacaugucacuaagccugucuagauuuguccuuuucaaagcaggcugcauuaaacucaccuggagagauaauaaaauaaagcuauauuguugcccagacucuuucccauacuugaacuagaauuuuagagguuagucuuuuuaaaagcaccccaaguauacaaugagaguuaagaguuaaugcucugaauaaacaauaauuuuacuuaguguuuuauaaaauuguguuuuuuaaugauauggagaauugaucugcuuugaaauuuagaugugaauaauacauaaauauuggggaugguaccaaauuaaaaaugaaaaaauauuaagggguauugauguugaaauagcccuuucuguuagaaucuacuuguuucaauauguuacucauugauaccagugaaacuugugcuguuacuguguuagggcacccuaauucaaaacauauguuuugauucuuuuuccuucacucaguaauuuuaucggugcucugaacuaacacauuaaugaaacauccuuaucuguuuuuauaaauaacuggaaaagacauugcccuauugcggaaucacuuugacucucccuccaaaauaucaacuccuaacauugcauucaucuuauacuuuagaugauuauaaguauugguaauaauagcaauaaagaguugcuuuguuacauuugauacacccaacuaauaaucuaacggaugaaucuuaauuuuuguguuggaacgaauuuagaagugcauuugcuuauugcauguuaauauguuacugauuuuaaaaguauauauucauauuucugacaucuguuacaaacacuuagaacaugcuuuuccacuugccauuuuagcaucgaagugcuacuucuaaaggcauggaagugagcauucuauaacauauacuuguuuguuuuaauuuuauauuauuuuccccaacucugaguaaaacugaaaaccaguguuauguaccacaccuauccucugaccgugcauagugcuugguacaacauugacucaauuuuuaugagcuguaaggacuacugaaauuacagaccuauuuuuccuuguaggacuagagaucuuguuuuggacaugguugaugucaagcagaugcauuuaccugaguuaauaggcagugaucuugaaaaagacccacaguguacaugacccauuguuauaucucuuauuguuauuaagagauauuaauuuuguuacuguuuagcuggcuuuuugcccuuuaguuuauuuuacuuaauuauuuauuuuuugagacagagucucccucugucacccaggcuggagggcaguggcgccaucuuggcucaccgcagccuccaucuccuggguucaagcaauccuccucccucagccuugugaguagcugggauuacaggcaugagccaccacaccuggcuaauuuuuuuuguauuuuuaguagagacgggguuucagcauauuagccaggcuggucucgaacuccugaccuugugauccacccgccucggccucccaaagugcuaggauuacaggcgugagccaccacgccuggccuggcccuuucauuuaagagaguauuucuuuguuuuagagucuuuugugucaggauuugacaguugcuacuaaucauaguggccacuaauaccuccuugagacuuccucauacauucauguuuuuuugcaguugcuccaucuaguacaauaugaugcuuucacaaaaguacugcaaaguggaccuauaacuuccuucagcuauuaacagcuucccagagauaauagacuacucagucucaucauagacucuugauuuuucaagaauuuuaaauggugguaucuuuccucauacaaaaccauuuuaucccaagacauggcuaucuuggcucaagcuauaccacaacuguuucugauauguacuauccuauguugacaguggcucgguaauuaacuuuauacuccuucuuaagaauuuuauuuuagaauuugaacuuuuuaaacucuggguucuauaaucguugaaguucaaguugggcugaaaauguugaggccauuuucagcccacuuugaccuuuggaguucucuucuuagugguuaagcacccacccccaaugaccuuuuauauuacagauauuuucuguaaaugcugacaauaagguuauaagcaguuuuauauuuaguuugaacaggagaaagcccuuguguuuuauuggccucaccuuucuaaaagauuuauuuuuuuauccuggagccuuaggacugcauauucuacauauuaucccuguauguccuuaguccaaaucauuauagugaguccuucaaaguauauacaccuguaaguaaauuuagaacaguguaaugccacacacauacuuaaaugaaguuagauguuuaggguucacagucacguguuuuagaagcauaaacuagcucacgcaaguaauauuucuuagggcuaccaaacuaguaaacuagccacaauguccuuaccucuacacaucaggaaaucucccuggugccuguuuauuuuuuuuguuuuguuuucuuuuauggcaauacuagaagcuuagcuugguuuaggacucccaaaggaauguuuugcaaaucuauccugagcuaaacauacaagaccuuguggauauuauuaaauguguaggguguuauuuuuauuccuuuaccuauggugaguaauuuuagcuauuaacagaaaauguaaauaguuuauuauaaccuggguaaauucucaaaaguaaccauggaagagagaguagcauucuugaaacagaauccuguauuuuacacuaaugauugguacaacauaguauuucuuauauucuuaggucaauuaguuuaccgagugccagucaugauuuuuaauuacgauuauuucuuuggagaaaucuuguaugaaaaacuuaacauuuaguaagaaaggcuuauggguuuuuguggugacuaaaaauucuuuauuuauauuuacuaacuuaauauugaugucauuuaaggucucguucaacccuuggacacuccagaucucauuggagccaggguuccaguucucaugcaagucggccacaggagccacggaaccgcaguaggauuucuacuguuauacagcccuugaggcagaaugcagcagaaguuguggaccuuaccguugaugaagaugguaaauugaaguaguaacaguagaaaauuaugaaaggaguuugauaaaaggaaaucucuuaauaugcuagaaacuccuccugcuuacugguaauauauuauuaaacuacagggaaauugucagauuuuuuaaucucguuuuuaauugauauccuaggcuuguaaauuuacauaaaauucuuugugguuauuguuucaauacuugauagcuauuuucucaggaaaaaauauuuuuguaagugguaguuugagguuagcucaaacuaguuuaguuugauuuguaauaaugauugucuuuaacuugccaugaaaaaguagaagcaguacuuuuuaaauauaaacacaaaagcaguauaacugaauuuugaaugacuaauacuggcuguuugaaaugucuaacuuuacuuuuaaaaauuauguuauccuucaauauuaucgguaccuuuuugugcugcucauuuuuuguauuuuauuuuggcuuacagcuguacccaaguaacugaggaaacaaaaccagaguuggaauacagagguuaggaaaagugguagaauuuaggaauauaugaaugaauacauaugugaauuugcccacauauugggaaucaucuugagguauuauuaguuauaucuuaggaaauggucacucauaauuucccaaaaggaaaaugguaagccauauaugaguuuguuagguuugggaguuagcuauaaauugggcaaagaauauaucagguagauggaaagaguugauagguggaaagaguuagaggccauauacaaucagcucuucuaugggcuauuugcaguuuggguggucauaacuuucagaguaucaguacccaguuguuuaugaagagauaacaacuguuugcauuucauucaacaaucucuugguuuuuguuuugaagcacuguaaaugaucuguaagacagucguuaauguaauagggauuaauuaaugauuacucaguuaauuaaauauagggugacuauuuuggaaacuuuuuguguuccgaugugacaccugcuagccaguaaguaggagaaggugauagaguagccuuuuccacauuacaguaaguucaaccagaauuuacacuuuacuggguuaaaaguauuccagugauuaguagaugcucccuuuccccccacuaguuuuucucauuggaaagcuucucucuuauuaaaaaugaaucuaaaacuaaguacaucagaccagugguucucaacuaggggcaguuuucucccccaagugauauuuggcaaugucugcagacauuuuugguuuucacaguuaggggaggaugcuacugacaucuaauggauagagaccaugguuguugcuaaacaucaugcuguucacagugcacaucuccuccccagcgaacaaaaaauugucuagcccaaaauguuaguauugccaagguugagaaacccugguuaaacuauuuacaaauaaacagaaguucuuuucccccuuuuuuauguacaagcaauuugcauauacaagcauuuggacauacuagcauucaaagugucccauauagauucacagguacuauuugugccuaaggaauuagcuuaccuuacugcauuguauagaaagucaacccucucauuccauagcacauuaagagaccccccuucuuuucagauuuaauugucgugacuaugcuuuggauggauuuauuccuaccguucucaauuuuaagcaaccauuuuaaaauuaguucuuugaaacuuaacucacucauaaguugaagucuaccugaaauuucuuuuacuuucugauagaaaaauguuaauuuuuauuagaaagcacugaugaguauuaauauuuacaaaauuuucuuuggaaaacauauaaaaaggcauggaaaggagauuaaaacaguuauuggaaaucauagcuaaugcuaagugauuacucucuguaaggcaucauacgaaguaugugaucucaguucauccuaaugacaguucuaugaagaaaauucugaugcuuucccaguucuacagaugaggaaauggagaaugguuaaauaacuuauuuauauucauacugucaguggugaaaucaguauugcuauccaggcagucuuacccuagaauccauauugugucagacagugugguuuguaacacuguucuggcagcucgugaccauguguacgugcauaguaaggaacuuuuauuuccuuuuacuguuuucuucuuugugauagaucagacaacuuauuuagaagcuaccugaaaaacuguuaaaucaccuaaauuauuggaauaagcauaucgguguuggauuuuuuuaaaaugcaguaauauuuugguaacacgucuguucgauauugcaguuuagcuuugugaacgcuuucuuuaccaaauguuauuagagagcuuguauuuuuaaaguuuuuuuauuuauuaauuauaaacacauuagcuuacauuaaaauauaacccuuuaucuaauuuguuuugaaaugcuaaguugacauuuuguauuuuguagaaccuacuguaguaccaaccacuucugcaagaauggaaucacaagcuacuagcgcuuccauuaacaauucaaauccaucuaccucugagcaggccucugauacugcuucagcugucaccaguagccaaccuuccacagugucagagacuucagcuacucuuacaagcaauaguaccacuggcacuucuauaggagguauguaaaaaagugggggaggggagacuuuuugucauuacuuucguuaggaaaaguauuauuguuuuuaagucuaagauuuuagcuauguuaauaagcggguauucuuacauuauaauaaacuucauauguuaucaagguagucuuuauuauaauuaggcugauuucauauuugaguuugugugcuauauguaaccagaguauuauagcucaaauaagagagcuuggggagaagcaaauggcugacaccaaaagcaugagcaacaaaagcaaaaguagauaaguuggacuucaucaaaauuuagaacuuucgugcauuaaaggauauuaucaagacagugaaagacagccuacagaauggggggaagaaaaauauugcaaauccuuuaucugauaagcacuuuagaauccagaaucuacaaagcacucuuaaaacugcccaacaggccgggugugauggcucaugcuuguaauuccaguacuuugagggguugaggguggaggaucacuugagaccaggaguucaagaccagccugggcaacauggugaaacccuaucucuauuuauauuuaaaaaauaaaaaaguaaaaagaaacaaacaaaaagccccaacccaacagaaagacaacccaauuuuaaaaugagaaaagauuugaauagauauuucugaagaaguuaugcaaaugaccaagaagcacaagaugcucaacaucacuaaucauuagggaaaugcaaaugaaaaccacaaugagauaccacuuugcaccaacuagggugucuauaacacaaacaaaaauagaaaaucaccagcguuggcaaggauguagagaaauuggaacccuugcgaauugcugguaggaaugcaaaauggugcaacugcugagaaaaacacuuugaugguuccucagaaaguuaaaauagaguuaccauuggaugcacuaagucuacuccuuaguuaucuucccaaaauaauugagaauggggaugggaguuuuuaaaauuuuggugauauccauuuucugggguuuuuugguuaugguuuggucuguuggugucauaucuaagaaaccguugccuaauccagggucacaaaaauuuauucuggagcuuucuuuaguuuuagcucuuaucucaagcuaguucuuacguuucaauuagcagugauaucucuggcucucucuuauauccuuuguuuaacugagccuuaaacuaacuuucuuucauuuuuggauaaugguacagagauaggaacuugcuaacugcuuaccaauagggacacuguagacccuguagcuuguggauugacuaaaucaccauuaauaaugaaaccaucuuauauuuucuaucccuuuuugcuuuuaauaauaucucauuuaauucuuuuaauauucauguaauuuacaucuagcagauuagaaaacuacauguggcuggaucaggaaguauucucuccccuggaaaacugagggcagaauugagaaacauucucaaggagauuucccaggaguaucuuuuuuguuuuuuuggcccaggccagucuugaaguuccaggcucaggugauccuccuaccucagucucucaaguagcuaggacuacaggugugaaccacuguacccaggggugucuuuuaaaaacauucucugaaaaaauguaggcagaaaugaaaugggcuuuuauuucauuuguugaguacauacucuuuucuuagcuuguuacuuggguaucuuauauguuauuguauauauuuuaauucuuaaaaaaaaaaaaauccuugacauggugagacucacaccuguaaucccagcucuuugggaggccagggacgcagaucacucgaggccaggaguucaagaccagccuaggcaacguggugaaaccuugucucuuuugaagaaaaaaacaaaacaaaacaaaaaaacagaaacuugcagaaauuagugaggcuuggugacacacaccuuuagugccagcuacucagagacugagucaggagaaucaugugauccugacaaguugaggcuacagugauccucgagggcaccacuacacuccagcccagaugacagaguaagacccuguuuuaaaaaauaaauuauugauguuggcauuucucuuaccauuucagaaaugaagaaaccugagaaguuaaguaccuugacaaaacuguaauaauuuuugaggcagggauuugacuucucauugacuccugucuccuguuguagcuuuauguagcauuauuauuauuauuauuauuauuuuuuuuuuugugagacaggucugacucuguugcccaggccugugugcaguggcacaaucuugucucacugcaaucuccaccucccaggcucaagugauccucccgaguagaugggggaccacaggcaugaccaccacguccggcuaauuuuuguauuuuaguagagaugggguuuugccauguugccguguugcccacacuggccucagucuccugggcucgagcgauccaccugccucagccuccagaagugcugggauuacaggugugaacuaccacccucggccuauguguagcauuauucuuacguacauuuuaugugauacagucccaacuuuauuucagaauauuccaaaaacuuuuauauauaaaucuuuguucauucacaaaucagauuuaauuucugagcaucuuggcuacaguccuaaaugggccucucuuaaggucaauuuccuuccaggacccuauggaacauuaguucaacuauguucuccacaacccguccuuaucuuguaccuuuuugaauauuuccaacccucacauucaagccaucuagcuucacacuuauccaaguuccuccguaaauuuaugguuucgaauccugggcuuucuguaggaaaucaccauugucuugaucaguucccuuucguuccucuaagugccuauuucaaaacacucuccuuuuccucaagguuuucauuccccaggggaaauuuuaaaaaaaugaauaaaugaaaguucuuaagcaugaacuccugcaacuuccaaugccuccauauaaacuuuuguggcucucuaccuguccuccucuacuaauuccuagucuccuaacuccuuccuuucccuuccaguuccuuuaucugugcucuaccucuuauccuuuccuuuguccuuaaccuugcuuuaacuguuaucuuccuugugucuucggcaucuucucugguuucauuuccuuaguacaugcacauguacacuuguuuuugucuguguacauuuaaguguauuuuugucacacuaaacucuuuccucuaaugggcuucugacuccuuucauaaugaauaaacaugaucuuuuaaaaucugacaauugucuccuuuucauaauucauuuucuucccaggacuguguucucauccccccuuucacuagcccauuucauaacuguaaguguugucaccuaucacuaguaugcugaugacucucucuucuguguuuuuugaccacuauauuuguuuuaaacuucuuuuuuuuuuuuuuuuuuuccccgagacagggucuugcuuugucacguaggcuagagugcaggcucacugcagccuccacuuccaggcuuaagugauccuccugcaucagccccacaaguagcugggacuacaggcacacucuaccacaccuggccaauuuauguauuuuuuguagagauaggguuuugccauguugcccaggcuggucucgaacuccuggacucaggcaauucacuugccucagcuuuccaaaguguugggauuacaagugugagccaccaugcccggccauuuuagacuuucauauccaauugcuucuuggacaucucuccuggaccguucugcagucaguucaaacucaaugugccacaaacagcucauuaucugucugaccucuccaugugguccuuguguuaugccuacaugauaucuuauauauucauuuguuuaacacauauuuauugauggcacacuauaugucaggcacuguucuaggcagugggaacaaaacagauaaauuuuuguucuaacagagcuuacccucuaguggauagcaauagcuaacauuuauugagccuauaguguuggccgguggauuugccuauaauaacucugauuuuuacaguaaccaguaaggcagauuuuauuacucuucucauucuacaggugaaguaacauauccaagguuauaugauaguggagcaagaauucaaaccuaggcagucuggcgugguaccucuacuuuuccccuuuaugccaagauuucucaaccuuggcacuacuauugacuuugggccagauaguucuuacagugggagguggggaaaggcugugcuuacaggauauuuagcagcauccuugguuuguagccucuaaauuccaguaacaucaccucccuuccaauuguaacaaccaaaaaugucugcaggcauugccagauacuggggacagcauugcuuuaugcuaugcuagaacccaguguuucuguucuaauacugguugauuuguauccuaaauugucuccaugcuugaugaugagcuuccuuaagggccaaagagcaaguguuucucuucuuggcgcuuagcuacaugauugcaugcugcuuuucccuugugaguugaaauuaaauauagaaagugcuuauugagccaccuacauugugcaagcauguuucugguugcuagagauaaaaacagcaaaagcagaccauaccguaaguuauguuaaaggccaggacuuucauuuucaccuuuguauuauccagugccuuuuguagaucuuuuaccacgacuuuauuauguguaagacuguugaaugaaugaguaauucaugccugccucucgauaauccugcuagaguuacugaaggcacuccuaggaggcacuuuaaccaaauuauugucccuggguuguggaguuaauuucccuaaugcagguucaugauugucucauuuuuagugggcccucuauggguuaauuuuaauagaaaaggaaguguuuuauuuacugaaucauauaucucuguauuucaccucuaauuuaugacaguuuuauuuggguaguaacucucgaaugagaggcuaauugguugucuuuaguuuuggaugcaagccuguuugagaaacaaagagguucuggacuauauauauucaaaaugcucgaaggcaaaagaggacaagcuguuucugaacagauacaugucauauccaucacuuuagugaugguuacaaacucauacccugacuuuuagagucaacguaauccucaaauaacuugguuuguaaaauuaaagugucagaguuggaaggaaccaugaagguaauuuagcguaucccagugagugagcuuaguaucccaaagguuuucaaccuuuuuuuccugaugcaauacacaauaaaugauauugacuuguauaacacuuuuacauagagacuaagauaaaacccugaaaaugcuguagcaaguaaagcuacuguaauaaugaguaauuacuauacauauuauaauuuauaggaaacaguuacuuaauguuggguucagcauagcccuaaaagacuuuugaucauggucaguuccugauaugcuaguuuuaacacuugaccagguuauucaacacauuuggaauacaagugaaugaaaguaacauaauuauagaacugacuuuggaacugcuauuauuuguucuaaaaaguaaauaaucuggccgggcguggugccucacgccuguaaucccagcacuuugggaggucgagguggguggaucacgaggucaggagaucgagaccauccuggcuaacauggugaaaccccgucucuacuaaaaauacaaaaaaauuagccgggcuugguggcgggcgccuguagucccagcuacucgggaggcugaggcaggagaauggcgugaacccgggaggcagagcuugcaguaaguggagauugcgccacugcacucuagccugggcgacagagcaagacuuugucgcaaaaaaaaaaaaaaaaaaggaaauaauuugucgacuuuguuuuuuuguuacaaauuacaauauuuaacauaauucuaggggcaguuagagguuagugucaguuuguauuuuucuuccguccaaguucacagacgcgugaauucuaguucccagguuaagaaccuuuacaaaaggguuugggagauuagcccccauaggccagacuagcagcuuggaaaaaacgaauauacagaaauuuagauuagagcuacuguguaacagagguuagagcacagaccuugaagagaugagaauccggaaaggcaggauaagacauguaagagagggcagagccaggagaauuuuagggaaauuugcugaaucuuaccaagcagagccugaagcaccccccuacccagguucauuuaugugaacccauaauucccuuuauuauuuaagcuguuuugguuggauuuuuauuuuauuuguaaacaagcagaagauuccuaauugauacauugacccagaagagauuagcuagguacuuugagccccauaggagcaggguauccuuacucuuggguacuguaaaaucaaggcuaggacaguaauguuccagaauucuaaggauucugaggagaugccucagaaucagaguaggggguuaaggauggcagcagggcggggcuuuggcuuuaggcucuucacucuuguaauuuaaucagaagcuucaaguuuuaaaaaucucuuuuauauaguuuccauauaauauuuaguuugaggaagcguuucuagguuuuaaaugaauuugaaacacugggacagacuuucagaggauacuuuugcaguucuucugccauagaagaacauaccuucaaaauaacugggcauguggcggagagcauaaucaggacucauguguuuuauacugagaaauuuaucuuuucuaacaaccaugcaaggcaauuuuauuaccacauuuuauagaugaaaaggagguuaaauaacuucccuaaggucacauugcugaaagaaaggucccagauuagaacccagauucauuugacuccauguuucuuuucccacugugugacacuaagucauuagauuacuuuaaagcacauuuuauuuuccaaguauuagagucuaaucauuucuuacauucuauugguucugacuguagaguccaaaggaaggaaaaaagauaauggcccagacaugguggcucacgccuguaauccaaguacuuugggaugcugaggugggcggaucaccugagcucuggaaggagcuuaagaccagccugggcaauguggcaaaaucuugucucuacaaaaaauacaaaaauuagccaggcgugguggugugugccuauggucccagcuacuuaggaggcugaggcaggagaaucuguugagcaaauauauacaauguauauauuuguguugguggauagugagacuucaccagauacacucugacuuggcuggcugugucuuaaggugagauuuuaagaaguacauagcugccugcauuauguaggaaggauuuaugauauuagggguucauggagcucaggggaagagcauuugcuuuguagcauguaguggaaggacucguauuuuuaaacuuuuaaaauacaguuuuacugguaauaaaucauuuacugugccauaggaaaacaugaucuauugccauacuuacacaucacaguaaauaugagccuccugaagaauuuagaguuucaggaaaaucccagugaagaccacugcauaaaaucauaugauguauauguuaagaauauggcacuaucagccggggugugguggcucacgccuguaaucccagcacuuugggaggcugaggcgggcagaucaccugagguugggaguucaagaccagccugaccaacauggagaaaccccaucuguacuaaaaauacaaaauaagcugggcgugguggugcaugccuguaaucccagcuacucaggaggcugagggaggaaaaucgcuugaacccaggaggcggagguuuggugagccaagauggcgccacugcacuccagccugugcaacaacagcaagacuccaucucaaaaaaaaaagaacguggcacuaucacauuauuuacagagauuugaaauuaccgaacauuucuuuaaacauuuauuauuuauaccccauaccuauuuuuuuacacagugauauuucaugauuugauuauucugugcauuuuuuucuguuucaagaugacucaaggagaacuacaucuagugcuguaacggaaacuggcccuccugcaaugccaagguuaccuuccugcuguccccagcacucaccauguggagggucgucacagaaccaccaugcauuaggacauccucauacaaguugcuuucagcagcauggucaccauuuucaacaucaucaccaccaccaccauacuccccacccagcugucccaguuucuccuuccuuuagugauccugcuugcccuguggaaagaccuccacaaguacaagcaccuuguggagcaaauaguaguucugguaccagcuaucaugaacagguauguggaauuugagucagucuuucuuuccugccccucuugucucucucucucucuccuucucccuuuucucucucuuccucuuccuucauuccugucucucucccucccuccauuucucucccugcuuucuucccucccugccucccuccguuuccuuuuuuuuuuuuuaacucccucccauucuuccuuccuuuccucucuuccccuccuuccuucccucucuucccuuuccucuuccccuucauuccuucccucuccuuucuccuuucccuuccccuuccccuucuuccuguuuuagauggcuggaaaacccagcaugagggaguaacuacuugcguuaaaaccaacccaccuuucuuuuuuaauugugguggcuuugggaagaggaaaaaaccccuagggauagauuuuauacacuaaauuaaucacauucuuacacucgaaaauggccuaauuuaguggucuguaguuucuuuuuaauuaagucucugggauuuuuagauggacuaaauuauuacaacuaauugaauggaccagggauguggguaaucaaaacugauacuuaaucuaaaaaucacuuuuuaaaaaggcuuuugauguuuuuaguuaaauacaguuggaucugauuuuugggaucuuacuuuaaacaaauuguugaaacucuaguguccagcuaauucaugaaaaauuggaaaauucucccaguuuuccccuuuuaccuccuacuguagaguucacuauaaccuucacucaucuaaaaauaaacagccuucucauuugcagaccuguagcauguuuucucaggggcagaugagguuuucaguuuauggagaaucaaaaugucagcaaaaaauuauaauuaaguaaauuaguugguauuauuauugaguucgcaaaaugucaacuaguauuaaauuaguauuggcaaucacguggaguaaaagaagucaagcguuccaugcuacuuuaacuuuuguuaugucacuuccauguacgauuaugauauaagucugcguguugcaacucaggaggcugaggcaggagaauugcuugaacccgggaggcuuagguugcagugagcugagaucacgccauugcacuccagccugggcgacagagugagaugcugucucaaaaaacaacaacaacaacaaaaaacaaaagauguaauuucagagaaaaauuguaauuuugacauauacuauuccagaaaaaaagugcugcaaaaaaagucaaagaggcuggcaugguggcucacgccuguaauuccagcacuuugggaggccaaggcaaguggaucaccugaggucagaaguucaagaccagccuggccaacauggugaaaucccauuucuacuaaaauacaaaaauuagcugggugugauggugugugccuguagucccagcuacucgggaggcugaggcaggauaaucacuuuaacuuuagagguggagguuguagugagccaagaucgugccacugcacuccagccugggcaacagagcaagacuccgaaguucguuuuuuuuucuuuuuuuugagauggagugucacucuuguugccuaggauuacaggcauuaagccaccgugcccggccaagcuaccacuuuucuaugucacccgaccuuuccuaaaguacuugccucaucuuuuaaaauuuugaugguaugucuucugggucugacagauuaaaaauaauuaacaagggcugggcgcgguggcucaugccuguauuccuagcacucugggaggccaaaguggguggaucacgagaucaggaguucgagaccagccugaccaacauggugaaaccccaucucuacuaaaaauacaaaaauuaguugggucuguggcgcgugccuguaaucccagcugcucaggagacugaggcaggagaaucgauugaacgugggaggcggagauugcagugagcugagaucaugccaccacacuccagccuuggcgacagaacaagacuccgucucaaaaaaaaaaaaaaaaaaaaggaguuguauucucuuugaaaauacagcugguccuaucaagaggaaguuugaauugaguagaaaauauaauuaaagagauuuuagaugucauuucgguuuugguaacauuucuugguauuaauggauuguccagaccuguccuaucucuugggaacgagggagcaucaagaagaauuuuccaguggauugaaugaaaggaucugcuuggaaguauaacuuuguuuugcuguaaauuugguuacaugaugcuucauaaauauuguaggaaaauggugaagaggugggucuaccagcuuuuccuacauucauuaaagagcugccaaaagucucauuuacagaauauuuuguuauuaauaaaauaauacagcuaguuugagacaucaauuauguauacaacuuuuuauuucagcuugagucaguuguagguaggaucucuuuuacaggucuguucaguguaaaauaaauauaacucguuuacccaccuguaaguauuaguagaaguauuuggacugcaaacaaaacuugagaagaaucagcaggaucacaggcauucaguggugauaauggauuugaagguaaagagagugagauuuuugaagacaacaguuugagacucauguugauguuuguaggacucuaaaauuaaccaaaugcucauaaaauagcuucauauagucuucacuuuagaccuauuuggguacagcagaaaguagaggagcagaagaagcaaacaaaaccugagauuugugauuuuguagauaucuuauguuugagugccagauugugcguagucaaauaaaaauuagacuggcauaccgagaagaugcaguagucauguagauagcccucacugcuugcuuugauaugauauggcuuucaucccuacccaccccugccacaccauccccaccccccaaccccaccccaccuccugcuuuuuuuuuuuuuuuuuuuuuuuuuuuuuuagagaggaucuugccuuguuucucaggcuggccuuaaacuccugggcuuaaguaauccuccugccccagacuucuaauuggcugggacuacaggcauguaccacugugccuaguaguuuaauuagugugaugcaucauuuauaaucuguguaagccaauuauuaugucccaucacuauacucaucuugcuuacccuugauuguccuucgggaauaagaauugaaugaacuggaauugugaagaagaggguucucauuacuguuuuuauuuucccuuuauucuuuaauuuuacccucaguuucuucuaggaauuacuuuacucugggaauguucuuaaucacugacuagagaugaagauaaaaugaaauuuggucaccuucauaagauguugauauucuaguccauuugcuaauuuuagucuaaauaguagggaaaggauuugaaccauaaacauaaauucagucuuaaaacauuauucuuaaaccguauuuaccugcauugaagacauacauuguauuugccaacucaauagaagaacagacauauacuugauuguacagcucaacagaaggagaacagacauauacuugauuguagauaaauaauacaaaagaaaggagcuccuccuuuucucuuucccaacuugaguaucaucacaccccuuuccuuucagcacccagaguuccuuuuguuucuauuauucccccuaaaccuagagcucacugaaauuaaaaagaaugcugugguuccucucgggacuguugggugacuugagccuuugacaaaugcauuacccuagguuuuuucaucuccagccccucagcuuccaguauugcacaguugcuguauauaauuccauauauaacaucagaucuuuaugaucuuucaucacauuuugaaaaguaugguuccacugaaccuaagcaguagguuuguauucaagaauacgaagaaguggccgggcgcgguggcucacgccugucaucccagcacuuugggaggcugaggcaggcggaucaugaagucaggagauugagaccauccuggcuaacauggugaaacccugucucuacuaaguauacaaaaaaaguagccgggcgugguggugggugccuguagucccagcuacucgggaggcugaggcaggagaaugggccugaacccgggaggcggagcuugcagugagccgagauugcaccacugcacuccagccugggcaacagagcgagacuccaucucaaaaaaaaaaaaaaaaaaagaauacgaagaagugauucuugccuuugcuauagaguagaggugaaaguguuuugcuuaggauuuuuccagaugcuuuuggaaggcagugcauaguggcuuacgccugaaauccuagcaccuugggaggcugagacggguggaucgcuugaccgcaagaguucgagaccacccugugcaacauggugaaaccccguuucuaacaaaacgaaacaaaaaaacaaaaauuagcugggcguggggucucgugccuuuaguucuagcuucuuguggguggcugaggcaggagaaucgcuugagccuaggagguggagcuugcagugagccaagauugugccacugcacuccagccuggguaacagagauccugucgcaaaaaaaaaaaaaaauaaaguuuuuggaggaaaauauuacugaugaguggaaguggaaucuacccucugguuuauuucccaacuuaguugaugggcuuucccuaaaaucguauuccuaauacaagcauaccuuggagauacugcagguuugguuccagacaaccacaauaaauacaauaaagugaauauugcaauaaagcaagucacaugaauuuuuuuguuucccaguacauauaaaauuuaauauuuacacuguacuaaguccacugcacagugacauuauguuugaaaaaauguacaugcuucaauuuaaaaauacuucaguuuaaaaauaccuuauuguacauguuucaguuuaaaaauaauucaauuuaaaaauacuuuauugcuaauacauuuuuuaaaaaugccagcaauccucugagacuucagcaaauuguaaacuuuuugcugauggagggucuugccuuaauguugguggcuaugacugaugaaaguggugguaccuaaagauugggguggcuguggcaauuucuugaaguaagauaacaaugaaguuugcugcauugauugacuguuacuuucaugaaagauuucucuguagcacaugaugcuguuuaaugguguuuuacccauagaacuucuuucagaauuggaaucaauccuuucaaacuuugcagcugcuuuaaguuuaugugauguacuaauguaauauauuaaguugaugugauauucuaaaucuuucgcugucauuuccaucuuuuuuuuuuuuuuuuuuuuuuugagacagccucgcucuguugcccaggcuggagugcaguggcgugaucucggcucacugaaagcuccaccucccagguucaugccauucugccucagccucccaaguagcugggacuacaggugcccgccaccacgccuggcuaauuuuuuuguauuuuuuaguagagacgggguuucaccgugauagccacguuggucucaaucuccugaccucgugaucugccugccucagccucccaaagugcugggauuacaggcgugagccaccacacccggccugucauuuccaucuuuuuccuaguaucuuuaccuggagaagauucuaucucaagaaaccacuuuugcugcaguuuuuuguuuguuuguuuguuuaaaugaugugucuggggcccugcaauuuuuuuauuaaaaaaaaaaaaacaaaacacuuccagcugggcaugcuggcucaugcauuugcucccaacacuuuguggggcugaggugggaggaguuaaagaccagucugggcaacauggcaagacucugucucuacaaaaaaucuaaaaauuagcugggugcaguggcacgcgccugugguccuagcuacuugggaggcugaaguugggaggauugcuugagcuggguagguggaggcugcagugagccacguuuguauuacugcacuccacuguaggcaacacagugagaccuugucucaaaaguaaauaaaagagccugggugcaguggcugacuucuguaaucccagcacuuuguuugagaggcugaggcaggcagaucacuugcggucagcaguucaagaccagcgugggcaacauggugaaaccuugugucuacuaaaaauacaaaaauacaaaaauuaggugcgugguggcaugcaccuguaaucccagcugcucgcgaggcugagguaagauaauugccugaaccugggagguggaaguugcagugagccaagauugcacuacugcacaccaaccugggcaauagagugagacaccaucuccaaaaaaaaaaaaaauaaauaaacuacuuucuuugcuccuccgucagaagcaacucauucagcuuuuaucaggauuuacggcaauucaaucacaucuucagguuccaacuucuuauucuaguucucuugcugucuucacgacaucuguaguuacuucauccacugaagucuugaaccccucaaagugugcaugaggcuuggaauccacuucuuccaaauuauuaauguuaauauuuugacugccuuccaugaaccacaaauguucuuaaugacaucuagaauggugacuccuuucuggaagguuuucaauuuacuuuugcccagauugaucagaggaauuauuauggcagcuauagccuuaugaaauguauuucuuuaauaguaagacuugaaaguugaaauuacuccuugauucauagucugcagacuggauguuguguuagguaugaaaacauuaaucuacuuauacaucaucagagcucuuuggugacuaugugcauugucaagaaacagcaauuuucuuuuuucuuuuuugagaaaaggucucacuuuugccaagcaguaacauuuugaaaggaauauuuuuuucuuaguagugggucucaacaguauucuuaaaauauucaguaaaccacguaaauagcuguacugucaucuaggcuuuguuguuuguuaauagagcacaggcagaauagauuuagcauaaaucuuaagggcccugggaauucuggaauugcaaaugagcauuggauuuuaagucacuagcuacauuagacccuaacaagaaucauccaguccuuggaaacuuugaagccagccauugacuucucuuugcuaugaaaguccuggaugacaucuuccaauauuaggcuguuuugucgacauggaaaaucuguuauucacuguagcacuuuccauaaaugaucuuagcuggauuuucuagauaacuuacuguagcuucuacaucagcacuugcugcuucuccuugcacuuuuaucuuauagagauagcuucuuuccuucaguuucaugaacuaaccucugcuaucuucagacuuuucuucugcagccuccuugccucccucagccuucauagaauugaagaguuagggccuugcucuggcuuaggcuuuggcuuaagagaauauuguagcugguuugaucuuccaucuagaucacuaaaacuuucuuuagaucagcaauaaggguguuucaguuucuuaucauuuguguguucacuggagugcuuucaguuucuuucaaggauuuuuccuuugcauucaugacuuggcuaacuggugcaagaggccuagcuuuuggccucucugggcuuuugacaugccuuccucacuaagcuuaaucauuucucgguuuugguuuaaaaugagagaugugcaaaucuuccuuucacuucaauaccagaggccauuaauuggccuaauuucaauguuguugugucucagggaauagggaggcccaaagagaggagagcaggguaauggggaaacaucuggucaggacacacauguuuaucuguuaaauuuguugucuuauaugggcacaguucuuggugccuaaagcaauuauaauaguaacaucaaugacuacucaucaaauaucaccauaacagauaaaauaauaaugagaaaaauguaaauauuaagagaauuaccaaaaugugacacagacacagaguuuccacaugcuguuggaaaaauaacucugauagacuugcuugacacagugucgccacaaaccuucaauuuauuaaaaauaaaacaaaaaaccccgaacaucugcaaagcacuaaaugugccuauaaaaugcaauaaauaugccuauaaaaggaagcagugcuuuaacuuuuuuuauucuuauguuuuugaacaagugaaagcuuugaguggcaaagguaauucaugauuuagucugaaaaaucuuauguccauuguuauuuugaauaauguagauuuguuuauuagcacuuuaauugaauucuugcuuuauacaguuuggaacuuggggcagacaagauuuuuccuagaaccuuaauauuuucaguagugugauaguauguuuucucaaggaguccuaaaguacuagucacaauguugggauaaaggagaauauagaaguaugauuuuuaaaguuucuaagauguauuuguuauaagacaaaaagauuuuaauauauuaaacuuuuguucaucuugugauaaaaucuuaugcuugauuuuuaaaaauugguuuaacuguaaaaccacuacaguuuucacaauccaggauacacuuguuauauucaagauaaccaaguauuuuguuggugcucacugguucuucauacuaagaaucuuccugguuucaaacuaauuuaaagauuauguuuuuuugguuauauuaggaauacuuuuauaauauaacaugaaauauuugaccaaacuuuagaaagauaaaauauacuuccuuuuuaucuagcaggcauugccaguggaccugagcaacagugguaucagaagucauggaaguggcaguuuucauggagcaucugcauuugaccccugcugcccuguuucuuccucccgagcugcaaucuuuggccaucaggccgcugcugcugccccaagucaaccuuuaucaucaauagauggcuauggaucaagcaugguugcgcagccccagccccagcccccuccacagcccucucucucaucaugucgacauuacaugccacccccuuguaaguauauacuuaguggacacaaaaucuagagucaugucaaugaagcauuuuguacuuccuuaugaaauaaccuuuaaucccaguucuuaaauuuuuaguauuuacuuggcuuaagaguaggguauauuuuuucccauguuaguauuauguaauugagguggauugaauggaaguuuuaaggaauuuagauuuguucuuuaguauagcugaagaaaugugaaaguugaguaguauuucuaggcacaguaaaguaaauuuuuaagaauucucaagcaguuagcugagacauaacagcaagcuuugggaguuguaaaaggauuuuuauauucauuugaugcaggcaauuaaaauauaaccaugguugggcaugauggcucacuccuguaaucccagcacuuugggaggccaaggcaggaggauggcuugaggccaggaguuugagaccagccuaggcaacauagugagaccccguuucuauaaaaauaaaauagaaccagccaugccuuuucuaaagaaauugaaauucguuagauaucacaagaaaugauaaauacucuaaggcuauguaacauauuuacuauuuuguuagaucauaagcuaauaaugaaaugaaagcuuaauaaacacuuggcugauaaacaccaaaaauucaugcuggaaaugaaccaggaagucagcaaggaaauuuguguuuuguuuugauuacauggcaagugguaauuuucacuuacauaucuucuuggauuuuuucuucuacuccagucauuuaaaaaaaucugcaucgugcagacgcagcuggaaucaacccagaaucuguacagugaaacuggugauauauuauuuaccuucucaguaaugcaacuuaaaauuuaaaguauaaauuggaaaacauuuagcaaguuuuuacaaagcauugaccaaugggccaauucuuuguaugagcaccagugugaugcauggccuauuuuguaauacuugaugguauucauuuuugauugaucaucuuuuauuugaaauucaauaugcuuaauuuucugccccuccccuuuaaaaauaauauacugaagcaguuuaugaguaaguucauuccuuucaaaauguccuaauaaauacauguuuuagauucauuuguuauauucuaaaacauucagacugugcagucauauaaaaugagaauuuaaaagcuuccucgcacagcuuacuaaucuuaauauaucagagguaguaacuguucuauaaaaacuuuuagaaauuuucuuuguacacauagauagguauaugucuuaccuuuuaaaaaugggaaaucaaacauauucuacuucuuguuuuuuguuuuuaaauuuaacaguauauuuugauuuuugcauauuagcacauaaaaaucuagcucauugguuuuuaauacccccauaauauccauuguauauuaaaucagucuucuguugauggacauuaaaguuguuuaugguugaguuuauguauaguuuaacuuccuagaaaugugauugcuaugucagagggcuaaacuuucagauaaauacuguuaaguuuucucuccaaggggcugcaucaauuuacacaccucauuaggaguguguuaaugagaaugaagguaggaaauuuaaauuguauuauuuucuguuagagacauuuugauaacucuguuuugggcuucuuuuccugaaggaguguguguauucucuccccaacuugcccgugcuuuuaaaaaacauuucccguaugcuuuaguucacgugugaaacaugugguucuuaaaccuuuuuucauccagaaugaacuggggaagacaauauggcauaguagagcacuagcuuuagaauuggauagauucgaguugaccucccagcucugacuaauuagcuuggugacuuuggauaaguuauuuaaucucucuguccuuacauucuuugcacuuguaaaaugggaauaauuccuauuggcuauaaauugugauacuuggauccagaugaauaguuugcuguuucauaaguacauuuauauguauaacaacaauacuuguggaguaagaauaugucucucucugcuuuugaaagguuuguggucuugaugaagugauaaaacaacuguacuugaaaugcuauuauuuaaaaguuuuacuaucuuauuaauaagauguauugagaagauauguaaggccuggcuugguaguaugagcauguaguuccugcucuucaggaggcugaggcauggggauugcuugagcucaggaguucaagguuguagugugcuguuaucacaccugugaacaauccuuguacuccugccuggacaacauagugagaaccugucucuaaaaaaaaaaaaaaaaaaaaaaagaccaggcacaguggcucacgccuguaaucccagcacuuucgggaggccgaggcggguggaucaccugaggucaggaguucaagaccagccuggccaacauggcgaaacccugucucuacuaaaaauucaaaaacuagccgggugugguggcaggugccuguaaucgcagcuacucgggaggcugaggcaggagaauugcuugaaccugggagauggagauugcagugagcugagaucacaccacugcacuccagccugggcgauagagcgagucucccucucaaaagaagaaaaaaaaaaaaaaaagagagguauagguaaggcuacuuacgauuaaucauaaagcaaauggucuacacuguaaagcuaugggaaugcagugaguaaauguuggaauaaagcauaguauuacaucugcaagugauauguugaacgucuaggaaacaauaucaagaacuuuuuuuaacuguugggaacacaaauagaggaagggaaaggguuuuugggaauguggaauaugucacucuuaaaauggucagcaaccuguuuuguuuaaacagugaauuaaagugaugucuaaagaguaguuaaauaaauggacucauucugaaacaaaacuucuugcuuuguaauauuugugaauguuguauaaugauuacacaaauauaaaacuuugcaacuagaaaaaaugcugugaauuugagaaaggauaguuaacaaucauaaaacauaguggauucauuuuuuaugauuaagagcuagcuacugagcuuugugccuucuugaagaguaaagcauugauuugaaaacagaacuuuuagaaaauugguuuaaaaauuugucuugcaacuuuuaaaaauuagauuuguugaaaguuuccuuuaaguacaugcuaacaaggcauacuuugaaaauauaguugaguuauuguuaccuaacuucugcccuugcugaaugaaucaaaagcauuaaaaauugaaaacuucuguaaugaaacuagagaauggcuguuggucuauaucagacuuccaagaacaucuuccaauaaaaugaaauuuguauugaaaucuaagacaaacuuuuuuuuuuuuuuuacaugucaaguagaugcacaucucuaagaguaaggaagauguguauuccucagagagauuuuucagcagucacuuugaaacauaaagauguagaaugaagaaaugguaggagccaucuuauuaaggacuuuacguccauauuugaugggaaacaaauaggucuccuucaccuuaauguagcacaggaauaaugacaugggguagggagagagagagacaguuuggaaaaauguuuacacccuauuaugacagagcuuccauauaugcaaauaauacuuacaagucaauaagaaaaaggugaguaauacaauaggcuaagcauguaaauagauaauucugagaacacauacaagcggucaagaaauaaaagauuuuucucagauuggcauuuauuuuaaaaauuuagugguaauguggggguaaucaggccuucuugugugcuccuuuuuuuuuuuuuuuuuuuuuuuugagguggagucucacucugucgcccaggcuggggugcaguggcaugaucucagcucacugcauccuccaccucccagguucaagcgauucuccugccucagccucccuaguagcugggauuacaggugugcaucaccaugccuggauaauuuuuguauuuuuaguggagacggggcuucgccauguuggccaggcuggucucgaacuccuggcuucaggugacucugcccaccuuggccuccuaaagugcugggauuacaggugugagccacggugccuggcccuuccuguguacucuugauggaaauauuaauuauggcaaccuuuuggaaaggguauuuuuauuaacuggcaucuaaauuuauuuuuuucuuucugucccacaacuacuuacaggaauuuaugcuacagaaaugaucucuauauauguguguauacauguguguaaaugaaagagugagugcaggagugagcauauacacagauauuuaucauagcauuuggguuucuuuuuuaucaguggggauuuugucaguacauuuugguguguucauauaauagaauguugugaagcugugagugaaguuaaacuauaauauauauauugacauaagauauccaagauuauuguaagaagggagcaaguugcuugagcaguugcuugaauacuuuacuugauaaaguauucauaaaaauaaaauacuaauauguuuaaaaguacacuaggaauguauaauagcaauauauguucaacugcauggugccuauguaacauacucaaaauauuuuucuugcagaugccucuuugacaaggccacuucaucaucaagcuucugccugcccgcauucucauggaaaccccccuccucagacucagccuccgccucaaguggauuauguuauuccucauccuguacaugcuuuccauucucaaauaucuucucaugcaacaucucauccuguggcacccccaccaccaacucacuuagccaguacagcugcaccaaucccucagcaucuuccuccuacacaccagccaauuucgcaccauauuccagccacagcaccuccagcacagagacugcauccucaugaagugaugcagaggauggaaguucaaaggaggaggaugaugcagcauccaacguauguuuuacguuuuuaaaaagaaagucaaguuugcuuuuucuucuacuuccauuggucuuuacaacucugaaauccaacuaggcaugguggcaugcacuuguagucacagcuccuugggaggcugagacaggaggauugcuugagcccaggaguuugaguccaucugggcaacacagugaaauacuguuuuuuguuguuguuguuuucuuuuuuuaaaaaaagaacaaagaacagcaacaacaacaaaaaaaaccaugaagucuuuagaaauaauguaacuuguaacuauaagcugggugaggcucauucccguaauccccaguugcucaggaggcuaaggcaggaggauaauuugagcccaggaguucaaagcugagcuaugacugugccacugcacucuagcuuaggugguagagcaagacccuguguccuuuaacaacaguagaaaacaaaagauagguggcugcagugauucaccccuauaauuccaacacuuugggaggcugaggcgggaggaucgcuugagcccaggaguuugagaccagcuugggcaacauaaggagaccucgucuccaccaaaaaaaggaaguagcuggguguaguggcauacuccuguggucccagcuacuggguaggcugagaugaaaggaucgucugagcccagggggucaaggcuggagugcaguggugcaaccauaguucuuuuauccuugaacuccugugcuuaagugauccucccaugaucaugccacugcacugcagccugggugacacagggagacccugucucucccccucuccccaaaaaaguaacuauacuaaauccucauuucacuaagaaauugauucuuugcuaacgagaaccuuccccugccuuucccuaaauuguauguguugaaaaaacaaguuuauaccagguuauuuaguaaaaucugaccaguuuuaccauaugacccaggcuaauuucuuuaugcaaaccaauuaaaaaaaaguacccagacuggucugaugugagcuaaucuuuugucuguguguuucugcaauaucgugugguaaaaaucaguguuaaaauugaugauucugaggaauaagaucuaaagauaucaaagauuugaauguuacuaacgagagggaaggaaaguauuaauagaauuuucagugaaugacagugaaaauauuguacuucaaguuuaugaaaauccuuuuuuuucuuuugauuauucaggaucugauuuucauauucagaucagcaaacuauuggucuaauucugccuacugauuuuuguaaacaaaauuuuauuggaaaacagcugcaguuuuucaguuacaaacaaacugaaaaagugucuguuguuuguggcuguuuccacauuacaaaggcuaagcugaguaguuacaacagagaacauacggccuguagagcugaaaaaauuucccguuuuacccuucacauaaccuguuugccaaacucuugaucuaauuaaugauccagcucucuuguguaacuuuuuguuuuacuucugucauuuaagauuguaucccaaaucucuggcuguugcugccauucuaauauaguaaccuuuuauauagaaaauugccaguuuaacagucuuaucuuccaguaacuggcaaauuguuguuuagaauaaacaugcaaaaucugcaauuguguuaaaaacuaauauaaaauaauuagacuauaaaaaugaaucuuagcuggguaugguggcacacaccuuuagucccagcuacucagguggcugaggugggaggaucacuuaagcccgggaguucaggguuacacugagcuaugauugugccacugcacuugauccuggagcaagauucugccgcuuaaaaaaaaaaagaagcaaaaaaugaaucccugaaacuaaguuguuuuuagugucuucuguuaacugacuuuaggaagagaaaauacaguaaacugggaugcaaaauaaagaguaugaauggagguugggcacauuggcucaugucuguaaucccagcacuuugggaggccaaggugggcagaucacaaggucaagagauugagaccauccuggccaacauccuggcccaucucaaaauacaaaaauuagcugggcgugguggcaugcaccuguagucccagccacuugagaggcugaggcaggagaauugcuugaaucugggaggcagagguugcagugagccaagauugccacuguacuccagccuggugacagagcuagacuuccucuccaaaaaaaaaaaaaaguaugaaucaagcuaaauacacguuuccuagguguguuaacuuguauuacauguguuuugaaaaaaaaugcacaggguuaacauuguuuucucuuaaacuuucauccauuaaaaugguugaaugucuuuacaguauaagaguaaaugaagcaaaauuaagguuucaauguguccugcuuuaauguuuauauacaauaauuuauuugugccugcaacauuugccugggguauuuaauuuuuaaaaauuuuauuuuuauuuaauuccuauuauucuccuauuuaaaauaucacuuguaaagaagguguacaagauaauguuaaaauuacuuuuuccuugggugauauuugaauuggaagcauuggaauaaaugagcaauuagaauuuauggagaaggugaugguuucuugauuuauuaacaaauaauuuuauauguuuuuauaauuuauuauaaaauuuauuuuaugacuaaucuauagauguuuauaguauuaauacuagggauuuuuuucuacauuaagaaaagaaauaaccaauuauucaauuauuuccaguggucuuuuuguguucuguguuuccaggcgggcacaugaacgccccccaccccauccacauaggaugcacccaaacuauggucaugggcaucauauucaugugccucagacuauguccucacauccucgacaggcuccagagaggucugccuggucaguaucuucuuuaauuucaaaacagugcuucacagcuugugguaaaacuauuggaagagaugccuugugauugauugcuuugcagaaggaugauguggagaaaccuaauccccaguuuaacugagacacugccucugggcagauagagguuuggagaggaaagaauaggagcuggggcagggaaccauaucaagcaggaguaguacuuuuuuuagguguuauuuuauguuuaauugaaaaauaauaauuguauauauuuggagguacagcauaguauuucaauacauacauacauugugaaaugauuaaaucaggcuaauggcacauuuaucaccuccaauauugaucauuucuuuguggugaguauauuuaaaaucuuuugucgcaguuuugaaauaaacgguacguuauucuucacuguagucaccaugcugugcaguagaauaucagaacuuacuccucccagcugaagcuuuguacccaucgaccagcaucuccccuuuccucauucaugaccccccacccucuccccagccucugguaaacaacaugcuacucucuccugugaguuuagguuuuuuagaguucccauguaaguaagaggcguggaccuuuuuuccuguucuucaggguuacuaccaaaguugacucccucgacugaucuuacuuuucacaucuucuuuaucugacccccaccuuuguacucagauuugcuccaccacccucaccugccauugacaagggaaauuuagccugccuucuccuagacuuguggucuuuccuagauagguggaagcagauuuucauuagauuaauuuucugaauccauugugugugggcauucauugagaucuugaaccacaaugacuuuugaggcagaacauaaaaugagaauaaguaaaugaagacuuagcauauaacaguuuuaccccuucuaaaauuuuguuugcccuucuuuuauaagguguagaagaguuugcuauucuaaucguccuuaaugucaacaaccaagagaugauaucuagcaaacaaaaacccagagagcaucuguaacauucagauacaccaaaaaaguaaauucuauguuguaugcuccucaaguagaaucagacuuuuaucuuggaagggaacuucguagccauauauuuccuuccuuuguaagaugugaaaccaaguagaaaugcuuugcuccucauugucacaaaauuuaaguuuuuagagcuuucaguucuaaaauaaauuugaaauuauuaguuaaauauuuugggcuaaauuaucuuuccucagcuuuguaaguuaagaaaccuuagauuacuuuuuuaaguguaaacauaacuccccaugucuguugauaaaaaagagacccuaaggaggauuaaacuguucucauccuuucguuagggaacugggaauugaagcuggagugacugcagcuacuuauacaccuggugcauugcauccucacuuggcccauuaucacgcaccuccucgacuucaucacuuacaauuaggagcucuuccuuuaaugguaaaauggaaaauuuucaaaauuuugacauguucuaaaaguuccuuuucuaaguauuuuauuggaaauacuucacuauauuaauauagauguuuuaauagaauuugagaguaaucuuguuagcuaaaauugugcuauaaaaagguauuagauguauuaaaaucugcacguauaauuugcaucauaacauguacucuuaauguacgacaugacaaaaaagugugggguuuuuuguauaccaagauacucuuaauccacugucaggaguauacugugcuucaguuauuuugccguaagugguaauagauccguucugaugcagucauacuugauuuucuuuuuucuuuuuuuuucgacagagucucacucugucacccaggcuggagugcaguaguaugaucucagcucacugcaaccuccaccuccuggguucaagugauucuccugccucagccucccaaguagcugggauuacaggcacgugccaccaugccuggcuaauuuuuguauuuuuaauagagaugggguuucaccauuuggccaggcuggucucaaacuccuggccucaagugaucugcccaccuuggccucccaaagugcugggauuacaggcuugagccagggcacccagccugauuuucuaaucugcagaaagauuauacuaauucucuacaucugauuuaagcagguucagauuuuguaaagugcuaaaggacaaguucagcaaaacauacauugcguuugcuguuuguauuacauacuuguuauauaaaugguacagaaaagggaauaguuuuguguuguuguggguagaggcacugcaggaaagcuuucagagaagcuuucugguacaugugacuucuaagcagacuggauuauggaauggugcucuugcagagguuacagcauguaaagauguagcaaauagcacaagcacugggaacuccaaguaagcugguguuucuaauuuuaggagugagggucaggcagcagugagaaauaaaacuguucuaccaagaaacuggaacucaggaaccauugaaggggaaauguccugaucaaauuuaugauuuuagaguuauuuaaucagauuauaguuagaucaccuccucaguuauguggaaaaauagauguaaaugugggaaaccaguuaggacauuauaguagaagagguaaauauugaugaaugccugaaugaaggcaauuguaguuggcauaaaaaugaugauacacauuugagagauauuuaggguuugggugaagggguuaggugaguuaggucuuggauguacugaaucucuaugaaaguugaauguccaauaggaaguuaagccuguggucuggauuuccaaagauauuuggguuaaagauauguuuugaucugucaguauauggagguaaugaauccauggaagaggauuagguuuucaggaaaaaugugcagagugacaagagggugaaaaaaccuuagagaaugacaauacuguauuuaaaugauaauacuaugcuuugaacaaaggauucugagaacuggcuugaaaaguugagaaacacaguuaaaauaauaucagaaaauacaguuaccacuugaacaaugcagagguuagggguguugacccuccucacagucgaaaaucagaguauaacuuuugaguuccuaaaaucuuaacuacuaauagucuauuguugaucggaagccuuacugcuaaaauaaacaguugaucaacacauauucuguauguuauaaguacgugauaaugauagucuacaauagauaaugauaguuuacaauaaaguagaaaaaaauguuaagaaaauuauaaggaagggaaaauacauuuacuauucguuaagugaaaguguaucauuauaaaggucucuuuccuuauugucuucacauugaguaagcugaagaguaggaaaaggagggauucaucuugcugucucugggguggcagagguggcagaaaaucuacauguaagcagacccaugcaguucaaacccauuuuauguuguucaagggugaacuguaauauggucaguauggugucaucacaaaaaaauaaaguuugaaaaguauugaaagcauuuggcaguagagugguuauuggucuuuugugucagaaugguucaguaauggugagugauguagauggggcaccucuuagauuacguacgguaaggaagugaaaacauggagacagugaauauagccuucuugcuuuauaagcuuggcugugaagggaaagugaaggaaaccccuauuugguuggcaguaauuccaggauuaguagagaauuuagguuuggaaaaacuuaagguauuuucagguuuaagacagaaaaccauuagagaggaauuguuugaagauauugaagagagagaggcuuggugggaaguagugaaguaagcaugacccagggugaacaggugaagggaggagugggugauaaggauugaguucgaauaggagaaaagcucauccauaaaggcuggaggaaagagacuagggaggagaggcuuuucaggguaagugaagauuuagauaauuugggaugcaggaguuccuuuccgauuucuuugaagauguuuaggagguuggguuaucugcugaguaguaaugaucuugguuauaagaaaaguuguaaacaauuuaaguaauaggcuauugaagguuaaaaguuauugcuuauuuaaauucuuuuccacauaugaaguguccguuaaagcuauaaauucugcuuaaaguauguugugauucaguguaggcuaauuaaaaaguaaugucagagauuuauuuauaaagauggaagaauggugcuguaucucagaaaugcccuuuccuaauacucucacuaugcauggcaguuaugaucuauacaguugcugcaaacacugaauuagcaaauaugggacccuugcaaaccucuguucacaacuaaucaguguauaaccuuuuuuauguguguuucugcuuaaagacaacuuuaaaaaauauuguagaaucauuaacauugaacucauagccaacaacacuguaacucaugcgugaaugaaacuuauucucuccauaagguguaugacagccuucuuugcuuaggaacacuagacagcacuucagcucuaugcuugggugccauuuuaaacaacacaaucaccaacaaaaagcacaaaacugugaaaaacguggcacuaaacagucugcaaacaagacacugguuuauaguaggagcucaaauacggcagagcccuguucuaccucagcugggaacagaguugcauguugggcaacugcaauuuuuugccaccggucauauccacgaaugacucugaaagcacaaguguugauuaugggguuacaaguaaauuuuagccugugggucaguucacacauauguaauccauaaauaaugaagauugacuguaacuaacaaaaaauuagaaaacaguguuaaaaguuucccuaauagaaucaagcaaaaaaggcauaggguacuuuggcuguuaggaagcuuaacagaagugaaguaaaaaacuuaucuugaagucgaauuuuguuggaaaauugugugcauuuuuuguuguuguuuuaauaaagcucucugaaauggacaggaucuuaagacaauuuuacucuuuucaaguuugagcuacuaagagccucaggcuuaaguuugggcauuuuggagaguuagguuauauuuuaacagaaaccuaaaccuguuacagaaugcuuaguuggaguuauguauucuuauugaagucaaauuuuaugagcaguugaauugaaaacauugagggucuugaauuauucaauguuaacaguaaaucacaagucuauucuuaaaauugauuuagccuaucucuucuguugaaauagguuccugauauggcaggcuauccucacauccguuacauuucaucaggauuggauggaacaucauucagagguccuuucaggggcaauuuugagguauguaauaaaauaaaugaauauguuugucacaguaucuuuaaugcagauugaguauauauauacuacuauacacaauuguguaggacugcuacaguggcugggaaucacaugugauuuucugauguugcuucugggaguuacagaaauauuuguaaguauuauuaaucuuagggucaaaaguuaccgaaauauuuaaagaugaguaaaugaaaauaucuaauauagaagaauauaaaaauguauuaaaucaauauaaaugucagauauauaacuauaccauuaaaugugguggggaacggaauguuuuugacucagcuaaauuuuuagagaaaucgguagagaaaaagaaacuuaaguaauucccuuuguagcuaaaugucuuguuugaauuuucaggaagaacaaaucauucgaaugggauuuaaaguuuuguugugguuuguuuuuuuguuuguuuguuuguuuguuuguuguuguuguuuuuuuagauggagucuugcucugucacccagacuggagugcaguugcacaaucucagcucacugcaaccugcgccuccuggguucaagcaauucuccugccucggcuuccugaguagcugggauuacaggugcccgccaccacgcccggcuaauuuuuguauuuuuaguagagauaguguuuugccauguuggccaggcugcucuugaacuccugaccucaagugauccacccaccuuggccucccaaaguacugggauuacaggcgcaagccaccgcacccggcccccguuguguuuuuuuuaugucaguuuggaaguuggagucauugugacuuagaacuauuguuugauuugguuccuuaauuuacuagaauuauuucaucuucuccauacauacauacauacugacuuacauaguaccaugugauaauauuguuguaauuuauaaagauaacuuuugcuguaccauuucaguuggcugaggaaaacaugauaaacaaccauuugccuuacugucuaugagaaacauuaagucaggcaugguggcucacaccuguaaucucagcaguuuaggaggccgaggugggaggaucacuugaggccaggaguuugagaccagccugggcaacauauaaacuguuuuauauauauacuuauauauaaguaaccacuugucauguguaaguuuuuuugaacacuguauuuauauugcaaguuucuaaguauggagguuuauuucuuauacaauguugacaguucuguucaaggaauaaucaucuuggcuuuuaccagucauuauauucuucacuuucaggaacugauucauuuggaagaaagauuaggcaaugucaaucguggagcaucccaggggacaauugaaagauguacauauccacauaaauacaaaaagguaagaauuuauucuaugaaacuucuggaguguuacugaaaggcauaaauguaauauauaccuuuuuugaauuuguagacucuagcaaugacauuuuuauugaaguaaugcauacauauuguuuaaaaauuuuggaaaguauaaaaaauauauacuuugcaguuuuuuacucugcagacccuaguccuucuucccagaagugaaaucauaguuaaggauuuagauauucuucuagauauuuuuuagcauuuucuaauaaugugcauauguauauauauuuuugucuacuuuaaaaaaaacacaaaaggagaugauuaccacauaguuugcagauugccuuucaugccaauuagcucccacagaucacccuuauuauuuuuaauagcuuaugcagaauuccaucauauggcaguacuguaauuuuuuuaacuagcaauuuauuuugacggacauuuuauugauguauguuucuucuacucuacccucaguugcuuguauagcauuauacaguuaugggguagacauguuaaauacgugucuuaaaccaugcucaauaccaacgguccccaaccuuuuugacaccagggaccaguuuucauggaagacaauuuuucauggauagguggcagaggggauaguuucagaaugaaacuauuccaccucagauuaucaggcauuaguuagauucucuuaaggagcaugcaaccuagaucccucacaugcacaguuuacaauaggguucacgcuucuaugagaaucuaucgcugcugcugaucugacaggaggaagagcuccagcagugaugcucgcucaccugccacucaccuccugcugugcagccagguacugguuugcagcccagggguuggagacuccuuuauacuauguaaagaauaaucauaaagugugaaaauuacuauucucuguauuuuucaucuauuuucaaagaguauugagguauuaccaguacauucaaguuuucaacuguccaaguuaaauacuguaacuaauguuaauuuaaauggauguuacuugaaacauucacuaauaaaaaaaacuuauuuaugcucaugguaggauaaaaauaguuuauauuguuuaucauucucauuguggauuaaaaguaauagcuuuuaagugaaugaauuucuguuaaauuugauuuugcuuuugaucccaauuauuagagggucuuaaaaauauacuuaauugaugauagucacuuaauucauccauuuauuuaugacagucuuaccugggaaaaaagugcgggugaauaugugguuuuguuuuguuuuguuuuucaaauaaacacagacuuuacucaguuguucaauaaugucaucucuacuaauaagguaacaacugauugguucucacagaggaaacugcacugcaaacaagauggggaagaagggacugaggaagacacagaggaaaaauguacuaucuguuugucuauuuuagaggaaggugaagaugugagguaacuagauauuaauuaucuaaaauccauugucaaaacuguacaugggauuuuauuugaaaaguaaauuacaccgggcaugauggcucacacguguaauuccagcacuuuuugaggccaaggccagaggcucucuugaggccaggaguuugaggccaaccugggcaacauaacaagacucuguuucuacaaaaaagaaaaauaguacaauuauuugcaugugauggugugcaccugcagugccagcuacucaggagacuaaggcaggaggauggcucaagcccaggaguuugagacugcagugagcuuugagcacaccacacugcacuccagccugggcaauagagugagacccugucucugaaaaaaaagaguaaaaguaaacuggaaaccaaauaaagauuacuuuuggcauauacuguuaccaauuucuggcacguagaacuggcuucaucuggcgagugaaacaauaaaagauuaaaguaucuauguuaccaacaugggagugggaaauauacugccuauuguagggccacacaagguuuggccagggaaauuucguagucaaaauugucuucuguaaaucuugcagaaaugagaauuugagaggcuuuggagguccuagaaaguuauaauguguucuucaaaacuuaaacagggauccagauuaguccuaugcagucuguuuuacagcaucuuuuuuuuuuuuuuuuuuuuuuuuccuuuucugggagauggucuccuucuguugcccaggcucagggcagcagucucagcucacugcaaccuccaccuccugggcugaagcgauccaccuaccucagccucccaaaaugcugggauuacaggcguaagccacugcacucggcuauagcaucuuuuauaaacugguuuugucauaaaauuuccucuaaacuaguaggacuauucccuucuugcaccuuuguuguuuagaaaauguuaauauguuaacccuauauuaauuuuaggcauuuucuuuguauaaucacuuaaguaauuguuuucuuccuguucuuuuuuuuaauguuaacauaaugccauaugaaacagguucuauaucauauauaacagaaccuuguaguaauauuauugcccuaauuuauaaggauaacuuugucguaccucuucaguuggcugagaaaaaaauugucuaccauacgacaaauaagguuuuuugcacacuguauuucuaaugaagguuuauaaauuuggaacuuaauugcuuuuacaguauugacaauacuguucaaggaauaauugggauacuuuuuaaggcuauuauuuuaacaagauauuaggaagucugaaaaguguauaaaaacucuuaacaguugcuagaaguagaaauggacacgagucaguaacuuuuauuccacuguuaacacucagauuuaauguuacccuaucuugcuugggggcuuuauuucucaauuucuaauugguaauuuggcaugauguaaacaaacaaaucauuacaucuccuuuuaacuuaccuguuaaacaguagcacaauauuaaguguauauaacaauuauuccgugaaaaaaguauuacucaccuuuaaucaguuauguacuuaaguuuaauguguaaagauauucuugauagaaaauaacauugcacaauaagacauuuuuuagugaggaaaguguaguuacuauauauuugccacaugaauuguaauguuuuugagagagaauuaaaugauguaauaaauauauauuugagauaauauguauuuuuaaagggcauuacaaauacagugaugauuugauuuuuaaaaauauauuugcaauauuaugugacagguaacauacugcuaacuccagggcauuggcagcuccuguaccaaaacaaaacuggaauaauuggcaguguaauuuguguucuuacaguuuuuaagauuuuauauaauuugguccuguagcuuugaaaguuaauuaucuugaucauuuauauauuauauugcccagagugcuaauuuaaucgauguguuuuuuauagaagaggaagaugcuuaguaccuucaaaacauuauugaauuauuacauauauaauuuguuaacuacguacaauuaucauaaaauuaauuuuugcuuuuuguuuucuugccaauaauagacgucuuccauguaugcaccuuuuccaccaaguguguguugaccaaugguugauuaccaauaagaagugccccauaugcagaguggacauugaggcccagcugccaagugaaaguugacaccauguuucagaacucuugcccucccucucauucccauccuuccugguacugcagucaaccaaagauggcaugacuuaccugcgcagauuuggaagcauugaacuuagagugcuggcucugcuauaugguacaacuaaugcuagaccuacaguuuauguauacaguugauuuugauguauuuauaaaagcuuuuuuuucuagauuugacauuuuucuguaucauuuuacuguauuuuugcaugguuccuuguauugcauuucuuugcacauauuaugggcuugugacccuaaacuugcaggcaagguuagcugcuuuaguaaguagaauuuuguggucuuuuuguuuuuuacauaguaccaagccuugauaauuaugaauuuuuuauccauuacuaaccuuuaauuuaaucaaucauguacuuuaguuuaauguauaaagauccucuagaaaaugauaauauuguguauuaagacauuccuuaauuaggacaaaauggcugcuguauauuuacuauauggaguucugaguuaaauaccauccuuaauacugggaacagaauacaacccauauaaaucagaugcaggugguagucacaucaccagagugaucaguauaaauuuucuugguguauccuuuuccuuucaacacagugcagauaagaguugaauauugauaucauacauuuagacugcuguucugauugcauuuaucuuuuuccuacaucauuuagaauuuuauuucccugauucaguuuuugcugcugugaaacagcucugaugaacacuaaauauuaauuucaauuagcuagauuguacauacuugcagauuuaacaaaauuuuagggaaauugaaaaagacauguagaauuuguugucuucugcuaagcacgaaaaguuaagauaucugcuuacauugauuuuguagacacauuaagucaagauuuggaauuuaagucacuggcagguaucugugcauucauagaacuuauaaaggucccaggaucacuuuuaagggauuuuuauuaguuuaaagguaaauaaagucagcugaaucuacaugucucuuguuuuauuucucucuaaacuugaaaacaguaaaucugcagauacugugaggcacaaauuauacugucaaccuacuguugcuaugguuauauacucccacuucauacauuaccaagagucgaucacugauuuaaaauuuuuaauuucuauaguuaagauuuacugcauaauauagaauauaaaguuaaguuaacauacuaacauuucuccuuuggaggaaguuuuaaucuacuucaggaugcauauuauuaucaagauacuuucauauacaggauagccuaauuuuauuuguuuaaauaugcuuaauaugccccagauugcaaaugcauccagucaguaauaucacugucuguauguggaggacauguucccauggaucauaugugaagaugucaauaagcuugcauuaagccaccugcuuuguaaguggauugauuaauaaauaacuuauauuucuauugucuuuguguuucauaauuaguuuuuauaaaaacaguuuacauuaaacaucuuggaauucaacaauagugaucucacucaaauugacauuugcauaauuugacauuuauauucauucaguuaugacuacuugcccuuuucuucauauuaguaaauguuacacuguaguaguugucaauguuaacaggcuucaacauaguaugugugcagauggacgauggauuuaaagagcauaccuuaugauuaaaccgagguuauagaaggucaggggagagugaaggagucagugaccuaugucugccaucuuacuggggaaaagagcaaguagccugucuuccuuuaaguaaguagccuguaauggauguacuacuuugccacuggaauaccccgggucugugccaagggacugaagaaguguaagauggggagaacuguaugucauggaguccucuugacguucccccagauacaaguaaagcacagguggauuucucuauuuuugaauacuacaucagauuuagaugcacgacuaccuguugacuuguuuuauaauugcuacugauuuuuuuaauguaggcaaagcuuuguuacuuugaaauuuauuuaauaaaaguauuugugacauaa

SEQ ID NO: 192066 - RNA, 153668 nt, Homo sapiens
gcggcggcaggccuagcagcacgggaaccgucccccgcgcgcaugcgcgcgccccugaagcgccugggggacggguaggggcgggagguaggggcgcggcuccgcgugccaguugggugcccgcgcgucacguggugaggaaggaggcggaggucugaguuucgaaggagggggggagagaagagggaacgagcaagggaaggaaagcggggaaaggaggaaggaaacgaacgagggggagggaggucccuguuuuggaggagcuaggagcguugccggccccugaaguggagcgagagggaggugcuucgccguuucuccugccaggggaggucccggcuucccguggaggcuccggaccaagccccuucagcuucucccuccggaucgaugugcugcuguuaacccgugaggaggcggcggcggcggcagcggcagcggaagaugguguugcugagaguguuaauucugcuccucuccugggcggcggggaugggaggugaggcacgacugcgagcgccgggggcgccgcgaccacggcggagcggcggccgggccgagcggagcccagucgcgccucgcggcgugcgcgucagucagcccagccggccagcggcgccacucuggcgggccgcgcuccccgcucccuauugucccccgcgccccgaccgcuuucccuucgguggcgggccgaggaggcucccaagccuccggcgaggccuuccccgccccccaccgcccuggcggccccgggaggcgggggucgccucccagagaagcgaagucggggcauccgcgucgccuggugagagcgguggaacccaggcugguggcugcaucccuccagucugcucggcgggcgccggugcaggcagccgcagcgaggcuggcggucucgccguccucguucagcgcucauccugcucaccauuccucccccagccccugcccgguggcggauuccgaaguccucuccgccgccgagacccgccgcgcagacucgugggaaguuguguuguuugcagcugggcucguguauuguucuuuacccggcgcgccgguccugaccgaccccauucugcagaggggccgcccguggaguggcagcagucaucacccgcuuaucugagacuaguggccucgguucuuccuguguccuguguuuggagagagaucacaggaggguguguugguguucuugaaaacauucugucgcccaggggaaaggguuuggucgggagaaggguaaaccauuuggggauguucuuugauuuguaggcuggauugggucucuuagaguagaaguucggucccugggugacccaacuugaagaguuucguuaaacuuucagguggaguagauguacaguguaguuaguggauugucaaaacagugcccccuccccccugcacaugaaagucaaauuugcuaaaagcaugucauuucuuguuucggguuuugaagacaacgauuuuuauuuccgguguguucuaggaccagcugcaucauuuuauucuugcuuaaagugcuuuauuuuagguaagcuuuuugacuugccccagaguaaacuuaaaaaccucaaggugugccuaaaagcaacgauugaaaaaauuugaggaaugcuuuggaugagugucuguagccuuugauaauuuagaaaauaucuauuucauguaauguauuguuucuguuuuuuucuuugccacuuugacuuaugacugcaggaccaaguguauuucuguccuguauucuaccgaguccgagggugguacugcguaggcagacuucuguuauaguuuguaguguucauuuuuuuguuacacguuuuauuuaauuuuuuucaauccaauucaucaagcaagacacacauuauagauuaagagcugauaauagauguuuaguuuuaaaaaggauuaugugcgggagacucucuguuagaggagccuuuuucaucugacauuuguuauuucuguucuaaacguggcuuucaacaaaucguuuuccuaucuuuuuucacuuuuugugauuaaauucaggaguuaagacacuguucucuauaagguaauaaaaaguaagacaaacacaugaggcacuuuacugaguaguaguauacuaaauguucuuuuaaaaauaaugaaaacaguaagaaacugauguagucuuauauuugaagaaaaaacaauugaauaacauguuuguggguuaaaacucuuauacaaaaauuuucuaaauucauauuuccagaguccuuuauugcauuaagcauugguuaaaaggcuaauuuuugguguuuuuguuaagcagaacuuuuucaaaaaacauaagacaaguuuuauuaguuuuauuuuaaaauuaguaucaagauucuagcuuuuggguacuuggagauacuuguaauuuuauuguaacuaugggguauuuuuaucuacuaaucugagcuauuuuuggucacuuguaagaucuuuguaugaugauuuguagacuucagcacauugagauugaauguauuuguuuuagcauaugagagaaaggagaaauuuguguagauuagaaguugugguggaaauuuaacuuaaaauguaaaucauuuucagguaguuaauaaauccuuuuuguugcuuccaccuccccaauuugucagucacuguugugugugaaauuuuucuugcucuguauauuacuaggaugggaagcuggaaggaauaauuaaaguguuuagaaucauaaaacaaacuuuccuaaugguguccauuuccagcacagccccauccuauguuguaguuguaggagcaaaccauguuuuuuuauuuuauuuuuaaaauuuaacugguguguuugagagcacaaaaggcauuucagcuguagcaguaaauuccauaauguuuugguuugaugaaaucaugcccgaaaugaacuucagaguaugauaugucucuuacauuuaaaaaucugauguaagugcuuagcuuuguacauuacugcucaauagaaauaaguuuucuggaaacuugaccagagcuuuaaagguaguagagcuuaagcaguuaaacuuucucugacucugagucggaaucuaccagcaaauaagaauuuaaugaaagagacagacuaauuuugucuuuauccuuaaggaucucugacucuucaucuuuuuaaaacuucaguuugaguccaguuaacuccaucaucuuuuuuaaaaaauguuuuauuuuguuuauuuauuuuaaaaaguagugauggggucuuaauacguugcccaggcuggucucaaacuccucgucccuagcgacccaccuaccuuggcuucccaaagugcugggauugcaggcaugagccacccugacuggccaauuccuugucuuaagacauuuuucuuaacaagaaaaauuuacauauuacauauuacuaggaugggaagccagaaggaagaauuaaaguguuuagaaucauaaaauguaaacuuuccugauggugcccauuuccggcacagucccauccuauguuguaguuguaggaagguaccauugccuacauuaaugguauuuucuguguguauguguacagccucucccagcaggcauggcaggcacuucucugaugugcuuuuaguaacuuguuuaagaucuucaaggauguguauuaucugaucucuuuaaaauuuuucuaaggaccuuaaggguuguagggcuuggggcaaauggaacauuuccaugaugccuuuugugugucuaauacuguguuaggaguuucacuuuucaacaguuaugagagaggggugauaggcaguugaagaaacagacuuggaaauauaauuuuucuagcaucauccaccacuuaguggugaauuggacauucgaacucaagcugguuugaccuuaaacccuaauaagcuuuuuauccauugccccuucaugccuuuuuugaaagcggcuuucauacauuagcucaaagguggccucuggacuaaacuaccuuagagauauguuuuauucacagugucuuuaaguuugagcuaaugauuaacauugaaaaauugggauauuucucagugaaauucauggauuucuggauuuucggggaagacuuggaaauccagauacuagugggcuguauuccuauugugcagagcugagcaguagggcaguagccacccucuuuaaacuggguaugugcuuaccgguuacugcaguccccaucauuccuaaugauacaccuggccuuuuucacucauuuuuguuaccugcuuggguacuguggguauguuguucccaucucugccuuagcuuuaucuuguauagauggcuccaacuuuuaaaaaauguuugacugugaccccuuauccaacuuuuaauauuuuuuugcaauguuuucucuguagucuuaaagauuuguuuaaaaagaacaugguauacacaauacuuuuuauucagcauuagguuauuagauguuuuuuaaaaaaacccguuuucauaauaguagcagcuugaaggucuuuaauauagaaugaucguuacagucucuccacauuucuuuaucuaaauggguaaguaagaaaccauuucuuuuucuacugggaugagaaccacagaaaaaauuaguugagggucauauuaauaaaaaccaauuuaagaauaggauacaaacauaaacucugcuuuugaaauuaaggugaugaaauggaggaacaauaacuucagcaauuagcuacauuuuccuaacauuguuggcagaucagugguucagauaugagaugauguccauauaacaaacucugggaauacacuuuuauuuuuuugagauggaaucucgcucugucacccaggcuggagugcaguggcacgaucuuggcucacugcaaccuccgucugccagguucaagcgauucuucugccucagccuccagaguagcuaggacuacaggugcgcaccaccacgccuggcuaauuuuuguauuuuuacuagagacgggguuucaccauauuggccagacuggucucgaacuccugacuucaggugaucugcccgccuuggccucccaaagugcugggauuacaugcaugagccacugcgccccgcugggaauacaauuguaaauuuuuuguguuuuuguuguuguuguuguuggucuugguuagagaugaggucucacuagguugcccaagcuggucuugaacucuuggcuuuaagcaauucuccaacccuggccucccaaagugcugggauuacagguguaagccacugugccuggccaguuuuggguguuuuugauggaaguuuuucuaaaauguggaaaauuuacuguagacacauuuacuaucuccuuaaaauggacugaauuuaaccuuacaugauugaaguuuaauauggagaacaguuguuauucuggguucuauuguaguuucuguuuuuaauuuuuccagaaaugacugaaauggccugguaguuuauuauuuuucuaaauuuauucuagaugauuguggauuuuauucuuggaucuaguuguagcaauauuuccaacuuuuugguuagguuucuuugcuuucuuguaaacuuugaagauguuaccuucuaauugguuguuucuaguauguuuuauguaggaaaacuaaauaauuauauuugagaaacaugcuugcaugugaaaugaaauaaauaaauucuaaaucuucuguggaaugaaguacaugggcuuuagguaguuuuuucuuucucccugccccccaccccuaccccucaccuuucaauauguauagcuuggcuuuguagaguuuagcauugagguugccuggaucguaacuuucuaaacaguuggaaugaugugguacuaauguguuuugcuaguuacaguuagacagggaagaauggagagaaaaaacugaugaauaaccaggcagguacagcaaauaaaauguauucucauuagguugcagauagaucguguccuagagcuaaaucaugaguacucugguuuuauacuaauauacuagauuauugguauuaaacauacucuaaaauguccaacuguaauauuuucuacaggaauagaaauugugaauuaagaaaaaguguuggccagacacaguggcuuacgccuguaaucccggcacuuugggaggcugaggcaggcggaucaccugaaaggucaggaguucgagacaagccugcccaacauggcgaaacccccucucuacuaaaaauacaaaaaauuagcuuggugugguggcaggcgccuguaaucccagcuacucaggaagcugaggcaggagaaucgcuugaacccgggagguggagguugcagugagcugagaucgcaccacugcacucuagccugggcgacaagagugaaacuccgucucaaaaaaaaaaaaaaguauuuuguuuaaaggaaagucagugaaagguagaugacaggggcuuaugguacugugcugguuucuaguaaguagcuguguuacagcaacuguguuaccauuuuggugauuuuuacauuuguauaaaguuaaauuucuugucugucuuuaauuguauuacauuauaaugguuagaaaaaaauuugcuaaaguuggggcauuguuuuggaagggucuagcuuaaaauauggucuauguggaguaccagaaauguaguuuguguggagaagguugugggcaagggcagucauuggccacugcugccaacacaaaguuucagugagaggccuaugugagauaaauuguggauaggaaaggcugcagacagaaaaacacauagugauuucaaaucugaacccccgccccccgccaccgaagcccaaaaucacaggggcaggccuuccaaauuguaggaaugauuugcauuucauuugguuuuuacacgggcagcucuaugugacaugcugggguaaagaggcccagguuuuuguuguuguuuuguuuguuuuugagacaaggucucuuucuguugcccagguugaaguacaguggugugaugucagcucacugcagccuugaccucugcagcucaagcaauucuccaaccucagccucuccauagcugggaccacaggcacacgccaccaugccugguuaauuuuuugauuuuuuuguagagaugaggucucacuauguugcccaggcuguguuguuguuuucuaaaggaguaauugauuuaauuaaugaucguuaaugcucuuccaagcaacccuaaaaacucugcuuguucugaacaaaaaucuagcagugguaauucuaaguagucuagcuguugauuuuuauauuaggaaaaaggaagcaauguuaaggacaaguggaaaaacuauaauaacccuaccacuuggauuccuguaagggcagugacguugcuguccagcaaugugaagauuuugcguuaguauuaggauagccugacccagcuaguuugcaggaaauagcggugcugagaauauuucucagggaauguagucucccuuugaugcugagugaauucauuuugaagcuacuacagaugcuccuugacucaucauaaguugaaaauaucguaagucgaaaauguauguaauguuggcaacagagaugaugguucaguguaugauuuuucaacuuugugauggugagaaagugauacacgugcaguagaaacuguaaccccauuuaaguuuuaaggagcucuccuccacuuaaugugggguuaugucacaacccaucauaagauugaaaaauacgaaucauaguaaguugguuaacauacauacaguccacuuguacuacugcaaguaaacaaugugagauguauacagugagaacauugcuguuuagucaccaggauuuauuaugugucuaugacuguuaggagucgugaagccacaguauuaagugagaagaaaaguaaaaaauacugaguuuguuggaguaaaugaaaugccaaaauauaaaaauauacuuccaauuauauauuguaguugcaccugaaaugaggauuuguuaagcuugagggacaucagcaagcggggaaggcuuucugagguggaagagaaugacacauaagaugcuuguagguuuacuugccuggaaucgauagucugugucaggaaauaaggagaauugcuaacugggccaugauaaucaggacugauuauucuaggccaugauaacuaugagauagaauauuauggacuguuggguggagucccuguugaggaguuagguuaugauugacaaauugggugauugagucuuggauuagaaugaucguagaaauaaguaaggauagaacaagaaaugacauggaagaaaaacugauaaaacugggcaaauguuuaacgugaaaguaacaaaacuuauagagggcucacucuguugaauuuaaauauuaggcuguuucauuggagugagugugguuuuauaaaacuuugaagaccucagucguugaaguugaaaaugucuuaagauuuugagucuggauagaagcuuauagguugggaugggugucagcgucugggauuuuauuuuauuugcaugcuaauacuugggaacuggauaaaacuuugcauagaucuuuaaucucuggcuaguuauuugggaagcagugcuuuagguagcuggauuauagaaguuuagugaauuuggaguggagauagagauuaguuuaaagauauacuaacacuuuuuuuucuuacuuaaguuggaauuaggcuauucaguucaaaaauaugauugacacucuugauuucaugugaacuaugaacuucuguuuccaagacaaauaggggaaaauaaugcgaucuuugcauuuuaggcaaauuugcauaugugauuuguggagcagaauuugcuuaccaucuguuuuugcuuguauugaugauggcaggacacacgugugcauacauuugaacuuugaauuuagcuuucaaaagaacacauagaauucucuaugauuugaugggguauuaauuuacuaccccuuuuccuaggaauuaagugggauaauuuguaaaagugcuaaagacuuuaaaguacuauauaaauauuauuaaaauuaugucguuuccagaccugcuuucauuuggaaucuauuaguuacaaaauacagauggauaaaaucuauuuuuaguaguuggaauauuagaacaucauuaccaaacauuagaaaauagaauuaaagaaaauccguaauuccuccuucaacacaauuuuaucacuuuuuaauauuaaucauguagucuuuuaaaaugccuauuacgaauuuauaguauuuguguaguucuguauaccuuuaaaaaacuaauguauaguuaauggcugggugugguggcucaugucugugaucccagcacuuugggaagcuaagcucggaggauuaguuuaggccaggagucugagaccagccugguuaacauagcaagacccuguuucuaugccaaaaauaaauaaauaaauacaagaaaaauguaaaguguaguuaaaacgcauaaguaugcaaagcagacacugagauauguauaaguaguaaaaaaugaaaucaugucauuccuguuuauaccauauuuuuucuauuuuauagauauugcuguucuuuuuuuuuuuucuucccuagagacagagucucgcgcugaugcccaggcuggaaugcaguggugcgaucuuggcucacugcagccccugccuucuggguuuaagcgauuuuugugccucagccuccgaguagcugggacuacaggcacuugccaccaggcccuucucauuuuuguauuuuuaguagagacgggguuucaccauguuggccaggcuggccucgaacucuagaccucaagugauccuccuucagccucccaaaguuuugggauuacaggcaugagccaccaugccgagcuuugauauugcuguucuuuauuucaagcuuuauaguuaaguuacugaucugugucuucacuagaaagacaauguuaagagggaaguaacuuuauucuuagucuucauguuuuaggaccuagcacagugucucacucacauuaggauuuuauaauauguguuauuaagacuacagaauuguuaaauacauugcuuaggaaguggacuggacuucuggauacauguuaugcacccguuuucauucagcagauauuggcauuagugaagcagccuucaugguacuggcugucagcuauauuauggaaauagucucauuacaugaaacugaaugucauaaugauuuuuguuaaaauuggaauauugcuguaguaaaauuagaaagugaccuccuccaauuaguacagcauauuaucagaacccucaaauguguauuauaaagguuagguauucuaaucuagcauaacggagaggacaguuuuguugacagcuuuggagauggauuggcacugaugcuuauaaauugguucggaaaucagaauuuaauuuuggcaagaauuuauaaaauuuaagaauuuauuuuuugaaaauauuuauuuauuuauuuauuuauuuuuuugagacggagucucgcucugucaccccggcuggagugcaguggugcuaucucggcucacugccagcuccgccucccagguucaugccguucuucugccucagccucccgaguagcugggacuacaagcaccugccaccaugccuggcuaauuuuuuuuuuuuuuuuuguauuuuugguagagacgggguuucaccauguuagccaggauggucucaaucuccugaccucgugauucaccugccuuggccucccaaagugcugggauuacaggcgugagccaccgcgcccggcccaaaauuuaagaauuuauaaauuuucuugguagcccauaaaauucacuuguauccauccaguagcagaaaucucuuaguaacuccaugaucucuaggagcaguaggccauuuaguagggaggagcccuuuuucuuuaauguagagcaagcuuuggcauagugguucucagcuaggggcaguggcggauguuuugggauaucuuaugggaaaagggugaguuaaugacaauggguuuaagaugaaaugcagggagugggacagauguauaucaaaagugaggugguggcugugugagugugaaagugauguaggcagguugaaagucauacucuauuacugucuguacuugugucuuauuagaaauuguauaaaagauucaauauaacccacagguucagaaaaaaagaauaaaaaaagauuguauaaaagaauuucaaaucagcauagaaaucuuacguacacauuucaauuuuuugauuuuuaaauuguauuucauaaguuagugguauaaauuuaauacauucaauagauuuuaaucauucguguuuucagcccuuuguauauaauuuauaaaagagcuacuuagacuucugagccagcuuguguuauuuuuacuucuuagagacuagcugauuucaaaaaguggguauguugaaauaggcuuuuaauuguagacacucccuccuaucuugaacuuuaacuuguaacuguuagguguagcuguuugcuucuagaagaugauuugacugauuucuagugaaaaaauagguacuggcuuaaguuugaauucacauuguagaaguagcuuuucaaagagugcauuaaaggcacuuaaauauauugcuggaauauagggcaugauaguuccuggaagccuaccuuugucauacaggagaacaguuuuguuagugguauuuagugccugaagaucugagugaauauguauuaucaaauaaaggaagcauuggucaacacaguaugaugccuaugacauguaguugaugacucaguaggaaggaaauauauuuuuauguuggggaaaaaugcuguugguaccucauuuugaaauuaugcaagugaaaagucuguugaaaacaaguugauuacaaguaauuuuuuuugaggaaugcaaauaugccaugcuuagcuuacucuuauauccucucauuuauuguaauugaguuuuucuguaaauaggaagaucuguaauaucaaaacauuauugcagauuuuccucucccauucuuaagauuguauagccaacuuuuuggguauagauaggaaaaaacuugcuuguuauaugauauuucugucucacaccaaggugaugauggugacccacuaucagagaguuauucuuuguuuuuucuccugauguuaaugaaauuuucauuccguauuuuuuugcacaauucuuuaauuuaguagauuggaacagaagauuguaaguuuuggguucaaggauugggaaggaagcuuuugcuuagaaggguacuugggaaguaagaugcuaccuacccauggaauauggaaaaaaaucacaauggcuggcauuuguugggguacuuaaugccaggcacuguuguuagaucauuuuguguaucauauauuaacuuggucuucacagcaucucuaugagauacguguuguuauuuucauuuuauaaaugagagaggaggaucagggaggguuacuuauccagagucaggaaagucaaauaguaguuaucaguugagggaagccagaucuugccuuuacauguaggcuaauuuuacccuuaaagcguaauuuagguucuuuguacuuacaguauuugaagaauuugccuuuuagucagucagguucuuuauagaagguauuuuauuuuuuggaugugaaaaaauguuuacauuugaggggagaaaagcagcuuacagaaagaacacgcauaaaaccauuucaguuuugucauagauaaauauauauguaaucauuuuuagagaacagauaccaauuuucuggguaguaagauucauaaugcacuucugugauuaggaaaaauaauuuuuuaaaaggcggauugguaaauaccaguauccuggcgacuuugagaaaaauuaagggaaauaaaaauacuguucucaaauuguaaaaagggagagcucuccuaagcucuccugugacaaggaggccaaguuauguuuuuucuauuucuuagaaccugcuggucauuuuucugccacucuugcaugugauuuuuugguauuacuuagucuucccccuuaaaaaaaaacuagagaugggguguuacuguguugcccaggcuggucuugaacucccgagcuaaagugauccuccuaaacaaucacuuucgacuucccaaagugcuaggauuacauaaaauuugauaaaggaucuguuuucucuaucucguagauccaaucuaguuauucuucuggcaguuuuacauagaggcuuuuuucgauauacuguguuucuuuuuuuaauucuugaaaauuuuuauacuuucuaaaagauugcagguaugcuaguaguuaauauuuguaugccuuucaccugaauuuaugaaugguuaccuuuaccacauuuacucucuuuuuaauaauauauuauuuuuuucccucuguuucauuugaaaauaaguuguacucuaaauacuucaguaugcuugcauuucauaaaaguaaggacauucugcuacauaacuaaggagauuuuuuucuuaaguguggagauguucaaauuucccauggggcuuauaaguauuaggugccaugugacuguaguauaugcuuuguaguauaugcuuuucagauuucccauggggcuuauaaguauuaaguaccaugugacuguaauauaugcuagcuuuuuggcaacuaaaacugagaacaagaaaguuaaaugcuguuggugcgcuuuucuguguaggugaaauaaaguaacagaagagaaaggagaagacguugacuuugcagaguaacuaucuuguaggguggagcuguuuuuauguaggaauaauagcacaauaacauagccuugagguuacugcaucauuauggccucuucuggugaagauguuaauaaggauaagccuggcuuaacaagaacauguuagaguaggaggaaaauuaaucauccaucaaauagaaagauauuuagcaagauauaauuaccuagaaacuguccuuaguggaagcugucauuuuccauugaugucagauuaguaacauuuuauuguccucuagguuaaauguauuuuauuuucaucauugucagguagcauguauuucuccacuguuaaagucuuuaugugaaaaugccuuuuguaaguauguauaaaaccauuucaguuuuuucauagauaaauauauauguaaucauuuuagagaacagauaccaacuugcuggguaguaagauucauaacgcacuucugugauuaggaaaaauaaauuuuuaaaaggcagauuaguaaauaccaguugacccucugugucugugaauuuuguauucauggauuaaaccaaccacgaaugaaaaaauucaaaaaaugaaauugagucuguacuuaacauguacagacuuuuuucuuguuauuauucccuacacaacacaguacaacaacuauuuauauaggauuuacauuguauuguguauuauaaguagucuagagauuauuuaaaauauacauggguaugugcauagguuguaugcaaauaccgcgucauuuugucagggauuugagcaucaauggauuuggauaucugugggaaguccuugaaccaaccccccagggauaccaagggacaauuuuauuuuauucuuuaucaggagggauaaaauuaggaauuaagauuggcauucuuugaguccuuacuuguuguucguuuuguccugcguagguaauauaucuaauagugaugaaagaaccuggacugggagagucuagcaaguaguaaggaucaggauagaguaggugauaaggaaucggaguaaacgauuaggcagcuuggaacuagggaaucaggaagaucuauaacaaggagagauucccagauacaaaggugagugggucagaggccaagcuguguucagauagagaugggugaauaguuaacauguuucagugagauuugaugauaccacaugcucuaucuauacuuucugagcucuugacugauugcuaaaguuuagaaauaaaucucaguugauagguccagucucugcaugugggaacaggcaauuuugugaugucugacugagguaguaagcaguacaaggguugaagauuagucagggcuccuguggaguaaaccaugcccauuucaaucacuagcuguggaaaucaaggguauauguauauguauauuuuucugucuauaagaaguauauucuucuuuaguauugcauugcuuguuuuccccaucuuagagguagacgucaguuuaguuuuugaaagguuuuugccaugugcuguauuuugauaauuuuuuuucuuuucaguuuuuuuuuuuuuuaauuuugagacagggucucacuuugucacccaggcugcauugcaguggcacgaucuuggcucacugcggccucuacuucccagguucaagcgauccucccaccucaaccccccaaguagcugggaugacaggugcaugccaccgugcccggcugauuuuuguauuuguuguagagauggcguuuugccaucuugcccaggcugucuuuucaguuuuuugucauaucagaaauauggugacuuaccuuguuuaugaugaagguaauucgacucaucguagauuaacaugaaaucauugaaaucaaaguugaguucuuggcacugccuccuguuugcuaugugacacuggguuuguuacauaucacucaaaccucaguuuucuuuaaaaugggcuaauaguucucacuugauugggugguuuaaaugaaaaaaauguagagcaguacagagccuggcagauagcaagugcuugauacauuuuaauuaucaugacauccaauuuauaagcauuauuguuuaauuuaguuaaacaagaaauugauguaaucaggauauuguucuguacaugguaagauuucaggguacauuuaagaaauuaggauacuuuuaaaaauaaaauaggauauauaguuugggauuuuuaauuuuuccccuuuaaauaugugaaaugugaaacuuaaaaaaucauuuaaaaauguuuguuagccagauuuuaaugugaauuugaauauauuggauuucuaaaacaagaaugagaagcaacagccuuaguguaauauuauuuuuauauauauauauauaauguaaugaaaaacuaaagauauucuauuaaagucagggacaaagugaacaugccuacacuuguuauucagcaugguuugguacuccuaguuaguguaguaaguuaaaaaacagauaaaauuauaaauagaugaauaaaagauuuaaauaugcaaagcagaaccaauaaaaggccaagaaagaaaauaaagaauauuuuuggaauuuugccugcaaaauuuaggggcucaugaauccccuauagagguuaugcaguuucucccucaguaucuauggggauugguuccaugaaugcucaagucccuuauauaaaaagguauacuauuugcauauaaccugugcacauccuucccuguacuuuauuuuuguuuuaaaggguuaaacaauaaggccuuuaucugcacaaaucaggguagaaugaggcaggcaguuccaggauuggcugauucggaaacuggcuagacaaauccaucucagcuaccauuguccacaaaaaagggggaccucuggaaauccacagcagaccccaacccaggucuuuugggcaggagcugggucauuuccacacugaaaccacucugagggaggggaugaagaaccaccagguuuuguucacucaccuaguuguagguaaucucuacauuguggauagauggagcaguucaacuucuggcugacagcucacauucagaggucacugucagcucuucucuuuuaugaucaugcuauuuugaacaaugagacaacaucugccaugcacucuuaaggccucuguccagugugaacucuaaugccuaaugagguuaggccuugacuguaugcuuuuuuacauccgcuacacuucuacauuuauaaggccuuucucugugugaacuuucaugugccaagcaagguggaaguuucugcauucccauauuuccugcauacauaaggccuuguuccaucacgaauucucuuauaugcuguaagauaggaauuguggcugaagaauuuuccacauuuacaacacuuagaagucucuuuuccagugugaacuuucuggugcucaacaaaugugucuuuauagauaaaaagacuugucacaugaucugcacucauaaggccuuucuccacuaugaauucucugcugcugaacaagauaggaucuucuaauaaaggauuuaucacauuaagcucacucuuuuuuuuuuuuuuuuugagauggagucuugcucuguugcccaugcuggagugcaacagcaagaucucggcucacugcaaccuccgccuuccuggguucaagugauuuuccugccucagccacccaaguagcugggacuacagguguguaccaccaugccuggcuaauuuuuguauuuuuaguagagacgggguuucaccauguuggucaggcuggucucgaaccccugaccucaggugaucugcccuccucaaccucccaaagugcuggaauuacaggcaugagccaccaugccuggcuuuaagcucauucuuuguaugaccucuuuaaaguaugaggguuggagguggagccaaauaauuucccgcaaucacugcauuuauaagguauuucuuugcugugaauucuucuuuguacuguaaaguaggaguugugacuaaagguuuucuccacauucaccacacuccuaaggcuuuacuccgucauggauuuucuguugcugaacaaguuuaucuuugcaguugaaggcuuucccacaucacugcacuugcagccccuuuguccagugugaaaggccucccuacucucaguacuuugguguggcuucuuccccauugggaggggccuggugcuugaaaacuucaaagcuauucaagaaguauuuuccacccuuccugcuagugaaaaccuucuuugacauguaggaucugcagaucuucacaaacaccaggcucuuuuccuucuagaagauuucugucugcugccucugaaucuggucuagguuacagugaaccagaagucuccaccccaugacucacaugugugugguugcuauucagagaauguuccccuuguccagcuagauggaaaaacgucuuucaagaccaggccgcacaugucauggggugggcuuucugaccugccuuaggaauucucaccugugacacucuuaaagaaacacccugcuuggaaggugcauguucauccuccacuccauaccaguuaccuuggguggggucaccucagggugcuuguugccuucugagccucacugcaaaaugcccucucauacuugaauuuuaauuuuuuuauuuuuuugagacagggucucacucucucacucaggcuggagugcaguggugugaauacggcuaaccccagccucgacuucgugggcucaggugauucucccaccucagccucuugagcagcugggacaacaagugugugccaccacaccuggcuaguuuuuuguauuuuuuuuguuguuguugagacggggcuuugcuauguugcccaggcuggucucuaauuccuggguuuaagcgaucugcccgccucggccccccaaaguguuaggauuacaggugugagccacugcaccuggccccucccauauacuuuaaaccaucuccagauuucuuauaauacuuaauauaaugccagcacuucauuuguguggauucagcauaguacucaguguacagcaaauucagguuuugucuuuuggaacuuuguggauuuuuuuuccccuucaguauuuugaauccacaguugguugaauuccacuaaugcagaacccaugaauacagaggacugacucuaucagugaggguuuuccagagagacagaaccaauaggauauacauauguacagauagauacaugagagaggauuuauuaggggaauuggcuuacacgauuauacagacugaaaagucccaugauaggcagucugcaagcuggagacccuaggaugcugguaguauggcucauuuuagucuuaaugucugggaaccagggaagcugauauuuuaacucugucugaggcugaaggccgcagaggcuggaguccugaugucccgaggggaaagagagggagaauuuucuuuuccuccaccuuuuuguuuuuuuccuggccuuuagccaauuggauggugccugcccacagugcagguggaucuuccccagucagcccaccacuccacccgccagucuucacuggaagcacccucagagacacauccagaaauaaugcuuuaccagcucucuaggucuuccuuaaucuagucaaguugacaccuaaaauuaacuaacacagagguuuguggauuucagguuaguauuccucuuguagaggaaaaaaaggugaauuauaaccaaaggcagaugaaacuaaguguuuaagugacuuaccaaagauuugauaccuguucuguaacauuuuguaggaugaaacuaaguguuuaagugacuuaccaaagauuuaauaccuguucuguaacauuuuguaauacuucgcuuauucaacucugcuguugugugaaagcagagauagaaaauauguaaaugaaugagcauagcaguguuguaaaaacagguggccagcuggaacuggccuuuggguaacaguuugccaacccuucuucuacguuauuuggaaacuuuuucuacucaguauauugccugagacaucaguugagguauuuuuugcuuaaaugguagcacccaugguguaccuaucccuauuaauguauuguuaaaugcuuacauuaaagcaaguguguagaaauaaggauauacagguugaguauccuuauuugaaauacuuggaaccaaaaguguuuuggaucuuuaaauuuuccgauuuugggaauauuugcauuaugcuuacgauuuccuaaugugaaaaucuaaagugcuucaaugaguuuuuuuuuuuguuuguuuguuuguuuuguuuuuguuuuuguuuuuguuuuuuuuuacagagccucguucuguugcuuacgcuggaguacaguggcacggucuuggcucgccgcagccuccgccuccuggguucaagcgguucuucugccucagccuuccaaguagcugggauuacaggggugugccaccacuccuggcuaauuuuguauuuuuacuagagacgguguuucgccauguuggccaggcugucucaaacuccugaccucaagugauccgccugccuuggccucccaaagugcugggauuacaagcgugagccccugcgccuggcugagcuuuucuuuucagcaucauguuggagcucaaaaaauuuuagauuuuggaacauuuuggauuucagauuuuuggauacucaaccuguauagcugcugguagaagucacggaauuucugaaugaagaaagguuacagugcuucucaaacuugaaugugcauacagaucacucugggguagucugggguagagccugagucauuuguggggucaguagaucugcugggagccuaggauucugcauugcuaacacuuuccccggagauaccuaugcuguuagucgcugaaaaacaguuugaauuaacaagauucuguguucagaaaauuguaaaaugcuagauacggaacaagauuuaauuggauaaagacuuaaacauccauaaacacaauuuccagucucagugauaguaguugaaagaacuuguuaguugaacacauagugaguaguaggccuccauauuuucuuuucuuucuuuuuuuuaaaaaauagagacagggucucgcuauguugcccaggcugguuucaaacuccugggcucaagcaguucuucugccuuagccucccaaagugcugggauuacaugugugagccacugcacauggcucauauuuucuuuuauuuuagauucaguguugaauuggaccuucuggucuucuaagaaguucuugaaaauggcuuaguugcuguuuucucaauggauauuuugccuugauguugguuucccccaauguucuuuuaagaccuguggucacugguugucauuuaaucuuuuauuuccccaucucuuacuacuuauguccuauuagcaaacuacaguuauguaggaauauugaaucauuacaggcugcuuaguauuggaaguagguagaauguuaauucauuuauuuuacugagaagauaacuuggaauauuuugaauucucuuuuugauuugucuuuguuuuugauccuggauuuuaaaaaauuuuguaacuuagggaaauuuuauaacuuuuguaacuuuauaaauuuuauaucuuagggaaaaaguaggaaggccagaaacccauauaccuaccacuuugcugcaacauuuuucuuuuuucuuuucuuuuuuuuuaaaaaauagagauggaaucucgcuauguugcccaggcuggucucgaaugccucaccuuaagcugucuucuuuggccucccaaaaugcugggcuuauaggugugagccaccacaccuggccucaauauuuuuauuuaaaaaaaaaucuagucagcuuuauugagguauaguuuacauacaauaaaauucaacaauuuuuuaaguguacgaauucauaaauuuugagaaguauauuuacuuguauaacuaccuccauaaucauagaacauuuauaucaauccaaaaagcucccugggcuauuugcagucaacucaaaauacuuucuaauuuccauuugauuucuucuuugacccaugaacuacuuagaaauguaaauuccuaauauuuggggauuuucugcauaucuguuauuggcuuaauucuccuguagucagaaaacauacucuuagauuuuagucuuuuaaaauuuguggaaacgugcuuuguggccuaggauuaaggucuaucuuugugacuguuccaugugcccuuaaaaagaaauauauucuaucuaucuagucaaguucuuuguguuuaaguuuuuaauaaucuuacugauuuuuuugucugcuuguucagaaaggagugguaugauuuccaacucuaguuacagagucugcuuuuuucuguucuaucaacuuuuucuucacauacuuugaagcuuuuuuuauguacauaaauacuuaggcuuguuguguuuucuucuugaauuaggaaaugucccucuuuaucccucauaauuuuuuuuguuuuguuuugaaguuuguuuuuucagcuauuacuguagccacuccagcuuucuuuggauuaggguuuggauguuauauauuuucccguccuuuuuacuuuaacucaucuuuauuuuugugucuguuagcauauauuuacauuuuccuuuuuuaaaaaauaacaaggcuggcgugucaucucaugccuguaaucccagaacuucgggaggccaagccaguaggauuacuuaauaccagguguuugagaccagccuagacaacauagcgaguccccauuucuacaaaaaauaagaaagauuagccaggcugggcgcgguggcucacaccuguaaucccagcacuuugggaggccgaggugguuagaucacuugaggucaggggucugagaccaaccuggccaacauggcaaaacccugucucugcuaaaaauacaaaaauuagcugggugugguggugcaugccuguaaucccagcuacuggggaggcuuaggcaggagaaucacuugaaccugggaggcagagguugcagugagccgagauugcgccguugcgcuacggccugggcaacgagcgaaacgcuguuuuugggaaaaaaaaaaaaaaaaaaaaaaaaaaaaagauuagucaggcauggcaugguggugcaccaguuuccaguuacucagaaggcuaaggugacuggguugcuugaagcuaggagguugaggguacaaugagcuaugaucacgucaccacacuccagccugggcaaugagugagacccugucucuuaaaaaucaaaaagcgaaaugacagcuuuugccuuuuaauuguuauguuagaucauuuacuuucccuucugcuugcucuuccccuuccccuucgucuucuccuuuucccucuccccuccccuccccuccccuccucuccccuccccuucggagauggagaucucucucuguuguccagguuggaaugcaguggccguucacaaaugugaucauagugcauugcagccccaaacuugggcucaagcaguccucccaccucacucuccugaguagcugggaccacaggugcacacuaauguacucagcuggaucauuuacuuuuaauguaauuauucauauggcugaguuuuaaacugucaucuuucuauuuguuuuccaucuguucauaguucuugucccccucuuuucuugcauuuuucgggaguaauauacuuuuuuuuuuuuuuuuuuuuuuuuugggagacugaggucucgcucugucgcccaggcuggaguguaguggcgcgaucucggcucacugcaaccucugccuccugcguuuaagcgauucucaugccuuagccuccugaguagcugggauuacaugcaccugccaccaugccccauuaauuuuuguauuuuuaguagagaugggguuucaccauguuggccaggcuggucucgaacuccucgcuucaagugauccacccgccuuggccucucaauauaaacuuuuaaaaaugauucaauuuuaucucugcuauuggcuuuaugaugauauaccuguuguauuuuuuagagguuguucaguguacaauaucuauaacuuaucacuguauacuuucaaauaauauuacuucacuucauauggaguauauguacacuguguuucuccucuguuuucuguugugcuguuauuguuacacauuuuaauucugugugucauaaauuccacaguagauuguguguuuaaaaaauguauucgcuuaacuuugaaagagauuaaaaaugagaaaauaaauccuuuuuauuuucuuauauauucauuauuucugucacuuuuauuauuugcaucaguguagguuuccaucugguauuauuccuucuaucugaaaaacuuuaucauuucuauuaauggaggcuacuagugaugcauuguaagcuuugaagcccagaagggcuucguuucaccuccucuucucaccuucauuugugaaaguuauuuucacuggcuauagaaucuuagguugauagaguucuuuuuuucuuguaguacuuuaaauauguggcugcauuuucuucugacuuaacauagagugugcugucaguuuuaucuuuguuccucuguuuauaaaaugugucuuuuuuuucuggcuccuuuagugcuucccuacccacagaugauuuuaagaauuuuuuuuucucccuaguuuuuagucauuagcuuaugacaugccuuuaugugguuuuuguuuauuuauuuauauuuuuaauuuuaauuuuuauuuuugagacagggucucacuuuguugcugaggcuguugugaucauagcucacugcaaccuuggacuccugggcucaagcgaaccuccugccucagccuccugaauagcugggauuacaggugugcaauaaaaaguauuccuggcuaauuuuuacuuuuuuuuuuuuuuuuugguagagacaaggucuugcuauauugcccagcugaucuugaacuucuuggccuugaacaguccuccugccuuagccucccaaagugcugggacugcaggcaugcacuaccaugccuaauuuucuuuuauuuuuuauauucauauaauaaauacgauuuauuuauuuauuuauuuuguuugagacagggucuugcucuguugcccaggcuggagugugguggcacgaucauagcuuacugcagcuuugacuuccugggcuucaagcaauccuccuaccucagccucucgaguagcugggacuguaggcaugugccacugugcccagcuaguuuuuauauuuaguagagacaggguuuggucauguugcccaggcucgucuugaacuccugggcucaagcaauccacccgccuuggccucccaaaguguugggauuauagguaugaaccaccgugcccaggcucuguggcuaauuucacuccacuaguaagguguuauuuuucugaggacuguagcaaugcuccauacauuacaaggucuuucuucucuagaugguagaaauaugaacauuuuccagcccugugugagcuuugaggauuguuuugcuuccuucuacuggugguucauuuuuucugaggcgggaguuuauuuucucacaugcuuagaucaguagucagccaaacccuuagggaacccccacuugagguggcuggagcucucucucuguucagcuuccuccuuucugacacucuggcacauagauucuaaauaccugaucucccugaacucagagguugucucaauuaaguggaaacuucaggcucuugguuucuucucccugucauuuggccuggagacugcuuacaggcaguaagcugggccaguuguaguagaucucacuucauuuguuucucuugucacaucuuuuaucuaguuuucuaauuguuuauggugguaggcuaaauucagucucuauuacuccugaaguagcuagugauuuaauaauuugcauauuuuuuucuuuuuuacccugccucccacccuagaaucugucuagugugaguuauggacaucgugucauuuuacccuuaaauauuuaaaaugaaccucccaaaauuuagaaccuucuccuuauaauaacaauguuguuguacuaaggaaaauuaauaugaauuucuuucuuuuuuuuuuuuugagacggagucuugcucuguugccuaggcuggagugcaauggcacgauuucggcucacuguaacuucugccucccggguucaagcaauucuccugccucagccucccgaguggagacaggguuucaccauguuggccaggcuggucuugaacuccugaccuugggugauccaccugccucggccucccauagugcugggauuacaggugugagccaucacgucuggccaauaugaauuucuuaauauaaucuaagacugauucugcuuugucuaggauuguuuccaaaugucguuuguuuucuucucaauuggauucuuuuucuauuuuccuuuuauuguuucuuucaugguuuuuuucuccaguguguuuuuacaauguuauguucaugguugugugucucuucucuacccaguuauucuuuuugcuaugauauaaagugggugaguuuauuuuuuauuuuuuauuuuuugagguggaggcucacuguuguugcccaggcuggagagcaguggcgugaccuuggcucacugcaaccuccgucucccggguucaagagauucuccugccuuagucucccaaguagcugggauuacaggcgucagucaccacggcaggcuaauuuuuuuuuguauuuuuaguagagacuauggguuucacuaugguuucaccacucuguuggccaggcuggucucaaacuccugaccucaggugaucuacccaccucagcuucccaaauuguugggauuacaggcaugagccaccacacccggcuugugauuucuuuuuucuuuucuuucugccucugagaccaguguauuuuuuuuccgccuuccaaucuuaguuugaggggcugauuauuuuguguuuuauucacguuucugcagucacggggcugugaucauauauaauuuuuuugagaauuccaggacucccauucucuugagauuuuuaaauaagugaauuguguggcaucugagggcuaggggcaacaucagaaguccagugugccaugcuuuccuacauuuucauuaaaauauuauuucauuccuuggcugccuguuugaaagauuauauuauuagguuaugaccaguguuguauuuagcacacugucuugaaaaaagaaaaaaaaaauccucugauuuggcuggguaugguggcucacaccuguaaucccagcacuuugggaggcugaggcaggaggaucgcuugagcccaggaguuugagaccagccuggucaacacagugagacccugucucuacaagaaauacaaaaguuagccaggcauaguggugcgugccuguagccugagcuacugggaaggcugauguaggagaaucaccugagcccuggaggucaaggcuacagugagccuugauagugcuacugcacuccagccugggcaacaaagucagaccuugucucaaaaaaaaaaaaaaaaaaaaaaaguucucaaauuuguagccuuuucaaugucaguuuccauggugguguaaauacucccuucauggcugauuucaagcuacaaacauaauguuacagagcaugaaguugggaagggaacugacacucaugagcauguaucagccaaauugcuuaucuuuuuuuauuugauuucaguucuuuucuuuuuuuuuuuuuugagauagggucucugucaucuaggcuggagugcacuggccguuaucauagcucacuguggccuugaacucuugggauuaagugauacucccucagccucuuggguagcuuggauuacaggugcaugccaucauuccuggcuaguuuuuuuguauuauuuauuuauuuauuuuuacuuauuauuauuuuuugugacagaguuuugcucuucuugcccaggcugaagugcaguggugcgaucuuggcucacugcacccuccaccuuccggguucaagugauucuccugccucagccucuugaguagcugguguuauagaugcaugccaucacgccaggcuaaguuuuguuauuuuuaguggagacggggguuucaccauguuggccaggcuggccuugaacucuugaccucaggugauccacucgccucggccuuccaaagugcugggauuacaggcaugagccaccgugcccggccuauuauuuacauauauauauuuauuauuucagacagaguuuugcucuugucacccaggcuggauugcaauggugcgguuuuggcucaccguaaccuucgccucccggguucaaacgauucuccugccucagccucccgaguagcugggauuacaggcaccugccaccaugcccagcuauuuuuuguauuuuuagcagaggugggguuucaccauguuggccaggcuagucuugaacuccugaccucaagcgauucaccccccucagccucccaaagugcugggacuacaggugugaacuaccacacccggccaccuggcuaauuuuuaauuuuuuguagagacaggggccuuucuauguugccuaggcuggucuugaacuccuggacucaagugauccucccacucuggccucucaaaguauugggauuacaggugugagcuacugcaucugaccugauuucaguucuugaaguuuguucuauguguguguggggugggggcagaggggcagguaggcugcuuuauccucuacccauggcccccuuauuucccucuucauuaaguauuagggaauagaaauuauguaauucaauuucauacauuaucuuaauauaaguuuuuuucccacaguacugagauuacacaaauacugauauuuaggcauaauuaagauaaacauucauaggucuuauauagaagaugauaaugagauggacuugguaacugugugucccggggaaguguuuuuagcuuucccaauuaaacccuaugaaucauguucuaucucaauuacaaagauucagaaaaucauuacucaggucuuuugccagugaaagugaauaguauguugcuuuuauaaaauuugugugugggacagagaaaagaugacuuuguuuaauaacucucccaguagaauuucagcuguguaaaucguugagcuuuugucaugagugcuucagaacagcaauaguuauuguuuuaaguuaucaaaagugacagaauacuuuaucugaacugcgacuuaaaaacuugacuuuuuccugauuuaagcagcagagacagaaauaaaaaccagcuugacgccuuuggugccgaaaaaggaguggaauccacaguucugcaaagccaagcuugugcuauggcaacucagaccacuuaaauccaauucaguaauccaguggaaauuuucaaaaugaaagaaauuauucaaaaguucucauucuuccccauuauugauuucuucuuuuuugcuaaacucaauuauacuacauuuauaaguauguuuaaaggauacagaagaugcauugguauauuugauuccauuauuuagucuugauuuuuaaaaguuccaugcuaggccgggcgugguggcucaugccuguaaucccagcacuuugggaggcugaggugggcggaucacgaggucaggagaucgagacuauccugacuaacauggugaaaccccgucucuacuaaaaauacaaaaaauuagccgggcgugguggcaggugccuguagucuccaguuacucgggaggcugaggcgggagaauggcgugaacucaggaaguggagcuugcggugagccgagauugugccauugaacugcagucugggugacagagcgagacucugucucaaaaaaaaaaaaaauaaaauaaaauaaaauaaaauaaaauaaaauaaaaguuucaugcuaguggguuuuauuaucucuuagacauuggcuucacugaaauuucuuugcuacuugugaagauaguuuuggacucauucuucucaccucucuugggaggaguguguucaagaggagaaggaaguaacucaauaguaguuuaaguugaauuguccuuuuaugccgcucuuugugcucguaagcauuuugcaugcauuuaagguaggcauuguugucuccauuuuacagauuaaaaaaccaccuccugagauuuaaaaaaguuaaauaauuacuuagcucaugugguuauggcuaggaagugucagaauucaacccaguuuuguuuuuucuuccugaauucuuggcuucaguguguguauauuggucugaaaggcaaagugugggagaaggaagaaaaggaggaagggggaagagaugaugaugauggauaauuuauugaaccuugccucuuugguaggcucucuaauauuaauugucacacaugguuuaaaucauuuaaucugugagucuuaagagagagcuacucuaguuucuucauuuuauggacaggagacugaaccugaguaguuuucuauucgaucugggaaacaacuaaugauugaagguagugguauucaaacccagaucauuuuuuuuuauucuaguaaaaaaugcuuaagguaaaauguacugucuuaaccacuucuaaguauacacuucaguaguguuaaguauauucacauuguugucuaacaaaucuuagaacuugaacccagauaaucugacaucagaguuuaugcccuuaaccacauagugcauaaacagaaaauuuaguguuggaucacagaauuuaguguuggauaauagaugaaccauuuuuagacaacuuguuuuauaaaagaggacaauuuaguuaaaaauuuuacuugauuugucaaagaaucacuuuuuuuuuucuucucuugaagauggagaaauaaggauuaaauuuacuuuccugcaugaaaggaaacaaggaaaccaggaaaaauacagaaagacaauuuuuuuuuuucuuugagacggaauuucacuuucguugcccaggcuggagugcaauggcaugaucucggcucacuacaaccucugccuccuggguucaagugauucuccugccucagccuccugaguagcuagguuuauaugcagccaccaccacacccagcuaguuuuuguauuuuuaguagagauaggguuucaccauguuggucaggcuggucucgaacuccugaccuuaggcgauccaccugccucggccucccaaagugcucggauuacaggcgugagccaccacgcccagcgaaacaaugguuuuuaaggcauuggucaucagguagugaaggacccugagaggggaaacaguaagguuggcccuucgauugugccagcuuucugccuugagagauuuauggguugugguacuaugagagggaaccuagguagaguccagggaacuuccucaguugaagagaugaagcugagggucaggggagaccaaaguggcuggaguucacagacagaauaucagggugaagagagagcugcacagaggaucccugagaucugcagaggcuuccacuguaguguucagcagagcucuaaucagcccauauguggaaacuaccugaggcuaaagaaucaucccaaaagauuagauugaacgguaccuggugcucagauagggcuauaaguagugccuuuucuuaccagguagacuggaaaaacucaguucauggagcauuggguagacuacugagauaggucuugccucaguagugggaaauaauuagccccagacugagcacucauucuacauaaauuuguccagagaauugaagaagagguaauacuucucaacacauuuuuuuuuuaccccaauaccaaaacuugacaaagauaguacaagaaaagaaaacuguaagccgguauauacccugaacacagaaaacaaaauucuaaacaaaauuacaguaaauugaaucugacaacaugaccaaguaggguuuaucucaguaaugcaagguuggcuuaacguucaaaaaucaguaaaauuuaauucaccauauuaauacauuaaaaagaaaaaauaugaucaucuuaauagcugcagaaagagcagguacagaaauaagcauuuguucccgauaguuuuuuaacuuuuuauuuauuuuuauacuuuuuauuuauuuuuauuuuauuuuuuauuuuuauuagggaugaagucuugcuauguugaccaggcuggucuggaauuccuggccucaagcaguccuuccaucucagccuccuaaaaugcugggauuacaggagugagccccugcaccugguccugauaguuuuuaucagcaaaaugugaauagaagagaacuugcucagcuugauaaaggacaucuaaaacaaaccuauggcuaacauccaaacuugugugugcgguuggaauuacccucacaauaaguuuuaauaauauauguguuaauauuaaugcagaauucauaauagugcugggauuagggagaaguuguuucauacauauucauagauacuugaauaaucguguuagaacuagaaggggucuucaagaugauacuaauucagaauguuguuuuuuuuuuauaggucaguaugggaauccuuuaaauaaauauaucagacauuaugaaggauuaucuuacaauguggauucauuacaccaaaaacaccagcgugccaaaagagcagucucacaugaagaccaauuuuuacgucuagauuuccaugcccauggaagguaaguaaauuuauugcugacugugucugaaguuccucuauauucaaucuaaguuaaagaggagauuuauauccuuaauuuuccuucucuaaugcaaggucuucauuuggaaauuccauuuccacuggaauuugguauaugcauuaaaaaaugacuuauuuuaaaauggauugcccuuuuauauuguugaggaaacagucaaauuuaaauguuuuugaauuuaugaaucagaucuuacauuaguaaaagauaugucuuuaaagaagauucuguguacauaguuucugacuacuuuuuauauguuuuauggucaauauaucuaucuacuggugccagcagugaagguaacuacuuauaugccauugaauacaucauuuacucaguuuuaccaguucuaaaaugacagcugguagacagauuaccugcuguuuuguucaguucucaaacagaauuguuaagugauaaaggggagucaagggagagagguuaaaaaaaaucacuuauugaguaccuguuguguucuagaugcuuuauaugcauuuucuuguuuaaucuucucaacauccagacagagguaaauagcuuuuuauauccgaggaaacuaaggcucagagaaguuaaauaacuuacacagcacugauuuuaccgagaccuggcugaacaccccuuauuuuuucucuaucuguuagggacacuuacagaaucuuggggaucuuugugaagcccucucugucuuauguguaauuauuaaaucuauuccuuuuguacuuuuuguacugauguaacccugauugauuacuguaguguucacuuccuaauaaguuuccccgcuucugcucuguuuaucaauaaagcuauucuacugcuaugagaugacuuuucucuaaauacuucuuuuuucaugucagcuuauugaucuaaagucuucaauuaaugauuguuagccagauuuucuuaauuugacuuuuaaguuucucuguaaauuaauccuagucuauuauucuaaacuuacuuuguuuuacuugccagcaucaaguguguauuucacccagaaugaucuucuagucugugaauauaccauguaaacuuuguucugugucauuuguccuaaauccugaucaucuuuuaauguacaauucaacuucugccucuuagacacuuuacuuuuuaauuccgucuaaacuuuaaaguuacuuaucugaaucauuggcaucauuugugcccucuuccuuuuuguggguacuucuuauuaauuuuuccauaaccguguuuucuguuccucacagcaggcauccuggcuacuauuugguauuauccauuauauugcacauaugguacacgugcuuaaacauuuuaauggaugaaaaaucagauaauuaggaaugcugugaaacuuaaaguauuuuguacaugaaaauaaaugugucacuuaaauuaauguauuuuccguauuacaaaaguaaugauuauuguugaaaaaauuacuuuuaaguuauaaaaucuucuuuaucugaaggagggaaaaagauuuauuucagggucuuuucuucuagauaaacauuuuaguguauuuauguacuaugaaauuacaagcaaucauuagucuuacuguuuuuaaugagcaucucaaaauauacuuaguauuauuaauuauauuaaucuauaccaaauaugguuugacugccaaaaggaaaagauuuuagcugcuuuuggcuuaaauaucuauuccuauuauauaauuagauuuuuguuagcugugucauguaauucauauugaauaaauggcaaaacuaaaucccuagcuccuuugugugugugucagugagugagagagagcagggaaagcgagagaguuugcaugagugagugggcugccauguaguuguccaaaaaauguuuacugacugcuagugaaaaguuacuuaguauagacugugggugauagaaacauaaaucaaacauagaucucauaggagcaguuagaugugccuguuauuguauaaggcacaugugauguguuacauuacagauaaaaugcuauagauauucaaaggagggagaacuucuugcugaggcacuaaaaaaggaccugaaaccaggaaaucucauguaauguggucucauuuauacaggucauuuuaggguacuuuuuuuuuuuuuuugagacagagucuugcucuguugccugggcuggaguguaaugauccucucuuggcuuauugcaaccucuggguucaagugauucuccugccucagucucccaaguagcugggacuacaggugugcgccaccaugcccggcuaauuuuuguauuuuuaguagagacgggguuucaccauguuggccaggcuggucucgaacuccugauuucaagugauccgcucaccucggucucccaaagugcugggauuacaggcaugagccaccauaccuggcccauuuuagggugcuuuuaacacaaaucugcuuaauuaacuauacaaacuuacuguauuuucuguaauucauccaauuucagauauuuuaguuuauuuucccaauuuuuauauauucacucugucucagaauuucugcccuaaaccguggucauuuuaauuaccuuuuaaaauacuuuacuuaaaaauguaaagggcugaugaucuuguuccucccuuuccuugaaaauaggccuacaaaaugacuggaguaguauaauuacagauuuccugcuaggucuuucuuccucuucuaucgucuaacaaauauuagucuugguacacuguaacuccuccuaacaggauuucuaucuguauauaaauuauuuauuauuuguuaauaacauuuuguauuuuauuuuuauaaauuuuuauuuuuuguauuuaauacgaauauguuuuauuuuuauuuuuagguagauuggcucaacacauaauaaauauaacuuugaaaugacuuugaguuagaguuacuuguagcccagccuauaagauguguacuaucuuguagcccagccuauaaaauuguacugucuuauacauuguggcuagaauuguuuucuguauuucacccuuuaaaaaauaucaaguagaguuuauuuuuuuuauucacauaauaggcuuuaguccccuagaaucugaucaguauacuuuaacacauaauagaauauauuaaauacugugcaguuaacuuagacauaccaagaagaauauacuuggaagggguuuugcuuauacaguugugacuuacauuucuggguaguagcacagcuucuguguguguguguguguguguguguguguguguguauguguauguauaaguauuaaaguaauuuuuugugguuuuuaugucuaagcacaugaacacacuuucagcauggcuuccaaguuuucugauuaacagaguauauuauaugccauguuuacagauguuacuguuaaaugaagaaacguuuauauuuuuccaaaccaaaaguccauucuuaagaauucuauggccaggugcgguggcucaugccuggaaucccagcacuuugggaggcugaggcggguggaucacgaggucaagagaucgaggccaucauggccaacaugguguaaccccgucucuacuaaaaauacaaacaauuagcugggcaugcgccuguagucccagcuacucaagaggcugaggcaugacaaucgcuugaaccagggacacagagguugcagugagccgagaucacgccacugcaguccagccuggcgacagagcaagacuucaucucagaaaaaaaaaaaaaagaaaagaauucuaugaaaagcuguugcucuugaaauaaagcuuaaaguuguuugaaaauaaaaguaccauuugagucagugccauagucguuaaggaaacaacuccaguaauacuuacuagaagauuaaacuguuuugauaauagauauuaggguaaaauacaucucuuagcuuggcugagaaauuaagaaucaguuuucugaguuucagaaaucacugaauaaguucugaugaauuggauugcucacuuagcaaugcuguauauaugucaguuauggcauuuauuuuauuauaacuuuauuuacaugcauauguccucuacuccuugugaacuugaagugcagagugugaaucuuacucaucuuuuugaugucgaugauggucauuuuaguuauauugagugagugaauugcuggacaugguggcucaugucuguaaucccagcacuuugggaggcugaggugaaaggaucacuugagcccagcaguuugagaccagucugggcaacauggcaagauccugacucuacagaaagauuagaagaaacuuagcaaagugugguggugcaugccuauagucccagcuacuugggaggcugaggugggaggaucacuugagucuaggaagguugaggcugccgugagccaugauugugccacugcgcuccagcuugggcgacaagagugagacccugucucaacaaacaaaacaccaccaacaaaacauuuaaguacauagauacuaggaaacagauuuucuucuuaaauauuuuauacucuaugucauccucaucgguaauuguucuuaaugacuaaguaguaagcagauuugucauauugugggaugcaggauuuuuguucgaaauuuguuuucucucaguccucguguucaugugaaagugcgugauguaucagggacugucuuguaauuucccuucucuuguucuuagauaccauguuguccugccguuccugucuuguucuuuuuuuugaggcggagucucgcugugucacccaggcuggagugcaguggggggaacuuggcuuacugcaagcucccucuccuggguucaugccauuguccugccucagccuccugaguagcugggacuagaggcgcccaccaccgcucccggcuaauuuuuuuuuuugguauuuuuuaguagagacggggcuucaccaugugagccaggauggucuugaucuccugaccucaugauccgcccaccuuggccucccaaagugcugggauuacaggugugagccaccacgucuggccuuuuuuuuuuuuuugaaacagggccgggcucuguugcccaggcuaggguagaguggugagaucuuauuucacugaaacucuugccuccuggacucaagccauccucucaccucagccuccugaguagcugggacuacaggcacacaccaccaugccuagcuaauuuucauauuuuuuuuugguagaaaugggguuuugccauguugcccagguucccuuggccucccaaagcugggauuacaggugugagccaccgugccuggccauuccuaucuuaaccaucauguacuuuagcauacuauaauuuccagaaauuuuucuuacgugguuuuuguaaaaugcagguuaauauuguuuauguuuugauucuauauaacauguuggaauaucucuguaucaccuauauugauauaggugaaaauaagaauaaauaucugucuuagauuuaacaaagguuauuaauauagcaugagaaaaacuucauugcaagauugaucgcuuuuauagcuuuuaguaugauucuuacguuguauguauauauauauuuuaacuuaugccuuuuguuugcaccugucauugaagagaagcauaagggaucacuccacucuuucuucuuccuaauagagcuuguaggaauuuucugaaacaccguuucaaagugauaauuaaaaaaauaaguaaaaugaaguaucugagacucuuacuuaaaacgauugucuguuaugauauaguuuaucuuuuugguaggaaguauauauacacuauuauauugaauuauuuuugugguuguauguauauguacguuuaaaccuuuucauucuucauaucuuguuuuccaaauuauguacuuugggguaggcaucuugucuuuauuuucuggucuucucgccacuuugcuaacuugacugucuuugauagaguugguagcuuacagccaccaacuuugcauuugaguaggaagccacuuaguaaagaauuuugugauuuuauauauguauuggaguagucauaaacuggauggagaaaggaguagugugguuaauucagacuaauugacuuuccuucugacuugacaugaaaucuagagauuucuucugagccucaguuuccucauuaguaaaaccuugaaguuuagacaagauaauauuuaagcuccuuuaugcuuuaaaauucuacaaaauauauuaguauacuaaguuuaaaacauuaaaacacuagucaguaauaaaccauauuuuucugccuguguauuuauuuggguaccucaguccauacaucagaaaugauuuuuauguaauaugugauuuguauauaauauagaagaaaccaaaaacuuuccuuaagugcaauauaauuguuuggagaauauacaacuuuauuuuuuucugaauugacaagguaauucuuccuguagccuuaagaguaaauuuccaaacuguuuaaaacaaaugauuagacauuugguuggaaguuuucuuugugguuugggauuugaguucucccuacuccugaaauaugaagguuucaagaauauggcccagguaaccuguaaaaggcauaaauauucccuucacugguucuugccuggaguuggguuagucuggagaugucugugacuuaaucucuguuauaucaugagucagguagcagaaaucuagggcacuuuuaaaucuguagacaaaccagcagacuuugagaagcagagguaagaaucuagggaacacaaaugaaugccugaucauagagaagagcuagggaauaaauuugaaugguguaaaaauacuauuguuauagauguuuaaaaacaaaaauuuaaaaaauacugaugguaguuaaaucucuuccaacaaaauuugagcaaaaauucccaaaggaaaauaauauuuauuuaguaccuacuucgugucagguauagugcaacauacguuaguuaaaguacauuuuacauugcuuuuuaucucaguauuggauuuucuaggauaugguauucuuuauucuugccugauuccgcuuuauacggaaauuaaaaucccaagaaagcuguuuguaaagaaaucugaagggauaauggcuacuugaauuacuuacugaagcauaaggaaaaggaaaagcugaucuguguucauguuauuuuuguaugacuaaaaguaacuaauauugcugacaaaaggguaugugaauuuuauaugacuaaagguuauuaggagcugaucauugcuuugaguuuagugucuuagauauaauuuuaauaugaaauaucaauuuuauuuuccacauuuuuuuccaggcugggguguaguggugugaucuuggcucacgcaaccucugccuccuggguuuaagugauucuccagccucagccucccgaguagcugggacuauaggcgugcaccaccacacccagcuaaauuuuuguauuuuuaguagagaugggguuucaccauguuggccgggauggucucgaucuccuaacaugauccgccugccuuggccuccuagagugcugggauuacaggcgugagccacugcaccuggccuauuuuacauguuuuuaagcacuaaccaggccuuaccuggaagagagggaaugaggguuuuuguuguuguuguuguuuuaaaauauaaacucaacuuucucccuccuccuuugaaaaggguauggaaguaagagcgugaaaguauuuuucuggcuguuuuuaauucuuuggagaaauuguuuccucuaaaagguaaucuaaaacaggcuuauaucugauggcuuauuuagugguguauuuuuuauuuuuuauuuauuuuuugagguggagucuugcucugucacccaggcuggagugcaguggugcaaucuugucucacugcaaccucugccaccuggguucacgcaauucuccugccucagccuaccuaguagcuggcauuacaggugugcaccacgacaccuggcuaauuuuuguauuuuuaguagagauggggguuucacuauguuggccaggcuggucucgaacuccugaccucagaugaucugcccaccuuggccucccaaaguucugggauuacaggcgugagucaccgugccuggccagugguguaguuuuuaaugccagaguuucuagaguuggugaccuagacagugaaugucagaaauuacguauaugccuaguagaaaagccuauauauuguuuuucuuaauuauguuauauuucaugcuaaaauguuucauguucaguuggaucuuuugugagauaaguacccuagcucagauuuuaucuagauucauagucaaccuuggauuuuucuguuguucaagugguuaagcuccuuauaagguuguuguggcguuuucuuaaaggugcagcaaggauuuuaugugacuaaagguucuuuuaauguuuauccuauuucauuauaccugaaaaucuuuuauaguaacuguguugaauauguuuaguuuauugguuugaauaugcuuguuugguguguuuuauuaagcaucagggaaaccuuguauuauaguguaauagcuuuaaacugauuaaaaauucuuuggucaucauauauacaguuccuuuuagauauagcuucugaauacuuauucuucaguuaauuguauuauaaccuguuuaauuucuuaaagucauucuguaccucugcagguugacauacauuuuugauacuuguaugcaggaauaaaguuguuaauuugugugcaucucugaaaucugaaauuauaaucacuuugcacuaguaaguuuccaaaauagucuauauugaaccaacaagucaaauauaaacacaaggucuagcaaaucaagaaucuuaguuaucauggugugggacagauaguuguguuauaugccaguaucaauugccagguugguauuuuauuauuuauuuaggauggaaugaaugacagggucuugcuuuguugcucaggcuggccucaaacuucugagcucaagcaguccucccacuucagccuccugaguagcugggaccauagaugugugccauuaugcucggcuaauuuuuaauuuuuuuuguagauagggcuucuugcuguguugcccgggccggucucgaacucuugggcucaagcuauccuccuaccucagccucccagaaugcugggauuacuggugugagccaccggguguggccucaauuauuuuuuuuuuaucugucaccaggaagauguucagcauuuugccauccugggggcucccuuauauauccuaagcaaggaauuauaguuugaugugacggaaagacuguuucagauuuaaacucugauuuugugugcucuuggucaaguccacuucaucaguuuguuaaauuaguaaauuuaggugauuguuauuuuauacaguugguuuacauuagauaccugaacaguggaagucucccucuauucuuaaauccugucauuguuuuauuguuuuguuuuuguuuuuguuuuuuuuugagaccgagucucgcucuguugcccaggcuggaguacaguggcgcgaucuucacucauugcaaccuccaccuccuggguuccagugauccuugugccucagccuccugaguagcugggaucauaggugcucaccaccacgccuggcuaauuuccauauuuuuaguagagauggcauuucaccauauuggccaggcuggucuugaauuccugaccucaagugauccaccugccucgggcucccaaagugcuaggauuacaggugugagccacugcaccaggcccuuaauguuuuauacauaguaguuuacuugccaauuauuuaauuacauaguugugcgagguuggaaaguguuuauagaaaacuuuuuucuuuucaguagauaaaucaacuuauucuguaaucauguauaauagguguaaccauguguucuguaauuaugccaucaugacagguucuuuccauuggcccuccuuuacgugagacucacguuguuguucuguuugucuucuuacauaggaugaaguuacucauuuuaaguuuuaguuuuacuuuuaucuuccuuaggaacucuuguagauuuguguuuauguauuuuugcuuauuuugagguaauucauuuacuucagggccaucgguuaagccuggaacuguguuuuccuuuuccuuuuucuuguucuuguuuuuuuuuuuuuagauggagucucgcucugcugaccaagcuggagugcaguagcgugaucucagcucacugcagccuccaccucccagguucaagugauucuccugccucagccuccugagcagcugggauuacaggggcacgccaccacgcccggcuaauuuuugcauuuuuaguagagauggggguuuccccuuguuccccaggcuggucucgaacuccugaccucaggugaucuacuggccuuagccucucagagugcugggauuacaggcgugagcuacugugccuggcugagcuuuuuucccccccccaaaguuuauagcccuagaauuucuuuucuuuucuuuuucuuuuuaucuuuucuuuucuuuuuuuuuuuuuuuugagauggagucucacucugucacccaggcuggagugcaauggcgcgaucucagcucacugcaaccucuguguccuggguucaagcgauucuccugccucagccuccugaguagcugggauuacauaugcacgccaccaugccuggcuaauuuauguauuuuuaguagaggugggguuuccccauguuggccaggcuggucucaaacucuugaccucgugauccaccugccuuggccucccaaaguucuggaauuacaggcaugagccaccguaccuggccgagcccuagaauuucuguggaagaugccuggugggguguacauuggcugacucucuacccuuucccccuuccuccucugcagaccuguuccuuucccuuccaguuccucuccucuuccccuccuccucuccuuuuccuuucccuucccuaugauaacuugaaaaaaugacuuuucuauuuuaaaaaguauacuaguggaagauaauuggcucaaaauaauauuuguuguuaauauuggcaacuuaucuuaaaaaauaauuugaauggagacucucucaagcaucuuaauuaggaaggugaaaguuaagaggaaaugaguaucuggaaacaucagaaaugccuuaguuaaguacaguuacuccuaguaaccacuaacccaggccugucauaggccugcuucauuuuagauaugauagaacucuauucaugaacacacugcuugucucugggacuccuggauuacucugauaguaccucgaagcaaggauuuugcccucaaauuuccucucuguauuggcaacguacuucauuaguuggggcuuuaugucccauuaugacuucaguuaaaaggaugcacccuguauuuuguuuucuucugaguauuagaaccauacugucuuuagcuaaaauagcaaccccuugggaaaaggcaacuucuuuuuagucuacaguaguccauccuuguuugcagaggauagguucuagauuccccaaugaaugccugaaacuguggaugguacuaaacccuaaauauauuaaauuuuccuuuacauaaauaccuaugauaaaggucaguuuacaaauuagguacaguaagggauuaacaacaauaacaaauaacaaaagagaacaauuaugauaacuacuguaaguuaugugaauguggucucucucaaaauauguuacuguccuguacucaccuauuuucagaccacaguugacuguggauaacugaaacaauguggguaagaggggacuacucuauauucuaacuauucuaaccuauagaaaguauuucuguauauuaagauguaggagguacauaaccuuccugaaaacuuauggaaugacauccuaacauaauuuauuuuguugcucugcaccaaaggugguucugguaugucuauuauuugucugguuuggauguaaaaugcuuuucuaaagcuugagaaagaaaaaccagcuauuacuacgacgugguaaaacugcauauucagagcacuaagacuagggacucaguaucuguuuggugcauuuuaaaaauuugcuaucauuuguuaaacugauuuuguccuccuauaacuucacuccauucuuuacaauuuuacuacuuagccaaugccaaaaaaagaaucauaauagaaccgcuauaaucaagaugagaaacauaauacuuacugauucauaaaaucaauacagugguuaaaucugaggguaggaaaacauucccaguggaaauaauguucuuuauacaggacaucuuaccuccucaaggaaaucuacaguuuauuuuugaugacgguguaguauauuauaaaauaauaaaaacuaaacuugcugaaagaaacauaguaguggacagaguuuagccauagucuugaaaguggcucaagcauuaaaaaucaaagagaguuuuuugugguaauauuguaaagcacaauuuucagugaaagccaaauuagguuauaauuuuuauuucuauaucuuacuugcauuuguucaguuuucaaagacuugcuggagacuaaugauguuacuuuaagacuacuacaacacuccgcauguguuagcuugacuuuuuccaucauaugcuugagaggcauucuugauacaguagaaagagcaauaugcggcaaccaaauacuagaguucuacuccuaauuuuagucuuacgaccuugagucauacccuuugauuaaaauauucaucgugucuccuuuguacuguuacucugaggguaagaugcaguaauauauguaaaagugcucugaaaacugcaagccucuaugcuguauacauuuaagaagaauguuguaaucucaucauuaucuucacauaccaucuucccaaccaaaucccuugagacuuuaaccauuaugaaacauggccacacaauuugauuuuauaccccagcuuuuuggaaugcagugauuuuuaaaaauuuauuuuuauuguaguaaaaugaaaagcuaccauuuuaaccauuuuuaagugguaaagagcaagauuuuugcccugugguuuccucucuguauugccaaaguucauugguuggggcuuuaugucccauuauggcaucaguuaaaagaaugcauuaaauggcauuaaguacaugcacaacguugugcaaccgucaccauauccaucaucacaaacagaaaguauguacucauuaaacagugacuccccauuuuucucucccuccagucccuggcaaccaacuauucuacuaucugucccagugaguuugcuauucuagguaccucauauauguggaaucauggauuauuuaugacugacuuauuucacuuacuguauuaguccauucucacauugcuagaaagaacuaccugaggaugugagggcaaucuggcugcaacauuugucaccccauuaaucuccagcguucauucgacugaucuggcuggcuagauggguguccccuuccucccucacugcuccaugugcaucccuccugaagcugcaugcuuggucgaagaggacgaccauccucgauagaggaggacuggucuuuggucaaggguauauggguagcugugcuccccugcuagaaccuccaaacaagcuaucaagaacuaccugagacuggguaauuuauaaagaaaagaaguuuaguugccucaugguucugcaggcuguacaggaggcuuggcuggggaggccucaggaaauguacagucauagcagaaggagaaggggaagcagggacaaucucgugagaacucacucgcuaucagaagaacagcaagggggaaaucugcccccaugauccaaucacuucccaccaacucuucccccaauacugggaauugcaguucaacaugagauuuggguggggacacagagccaaaccaugucacucaccauaaugucugaguuauuucacugacuuaugucugacuuauuuaacuuaucaugauguuuucaggguucauccauguuguagcaaaaaucagaguuugguugcuuuuuagggcugaacaauauucuauuguauguauacauacauacuuuaaaaaaaccuauucaucuguuugugaacauuuggguuguuuucauuuuuugucugcuguguugcuaugaacauugaugugcaacuaucugaguuccugcuuucaguuucuuuggguauauaccuacaaguggaauuguuggaucauaugguauuucuguguguuuuuuuuuuuuuuuuuuuugagggaauaccaaauuguuuuccuggaauacagugaucauuauaaggcaauauauacugcaguuuuucugacuguugagucgaagucuaaacaauuaaagaaucugguuguuuucagauagcuuuuuauugagggcuuguuaaaaaacuaaaaagguaguaugugguuggguuguuccugucagcuacuuuuuauuauuauuucaugacauguuauccaacaggaauauugcaaagauuuacauuuuauaaaaugcuaaaauagcauaaagauguggacugucaaacagauuguaguagaauuaaaauuagaaagcuauaauccagucgcuugguuaacggaauaaauuaugucaaauuccugauuauucauuugugguuuuacuauuuuauggauugugacaaucuuuaauuuguucuggcuucuuucuacuauuuaccugccuucugggcucucccucauuccuucuucuguucauguauguuuuagauacaaguuaauuuugauguuaauagaagcagugaauuuugauaugugauuuaaauuugauuuuuaaauuaucugcacugcuacuugacugcauauauacuugagaacugauuuuauaugugguuuuaauccaauuuaaaucaauacugggaauguuuuguaucuuagacauuauuuuguuuuaaaaauuauuuuaaaaaauuuaaauacauaauacuuguacauguuucugggguacuugugauauuuuguuacaugcauacaaugugaaaugaucaauucauagcauuuaggguguccaucaccucaaguauucguuauuucuauguguugggaacauuucaaguccucuuuuuuuaaacuauugugaaauauacaauguauuguuguuaacuguagucacccuacucugcuaucaaacauuugcacuuuuuacuucgaucuaauuguauguuuguacccauuaacaaccucucuucaucuccccucaagccccacccacucacccuugcuagccacugguaucuaucauucugcugucuaccuucaugagaucaacuuucuaaucucacccauaagagugagaacaugggauguuugucuuuuugugcuuggcuuaguucacucaacauaaugaccucuaguuccauucauauugcugcaaaugauaagauuuccuuuucuuuuucuuuuuuuugagacagaaucucgcucuguugcccagucuggagugcaauggugcgaucucggcucacugcaaccuccgccucccuggaucaagcgauucuucugccucagccuccugaguagcugggauuagaggugugcgccgccacgccuggcuaauuuuuguauuuuugguagagaugggguuuugcuguguuggccaggcugguuucaaacuccugaccuugagagauccgcccaccucguccucccaaagugcugggauuauaggcgugagucacugcuccgggccuuauuauuauuauuuuuaauagucaaauuguacuccauuguguauauaugcuacauuuucuuuaaacauuuauccguugauucacacuuaguugauuacauaucuuggcuauuguaaauaguccugcacuaaacaugggagugcagguauccuguugacauacugauuucuuuuccuuuggauaaacacccaguagcaggauugccggaucaugugguaauucuauuuuuguuuucuugagaaaucucuaugcuguuuugcauaguggcuguacuaauuuacauuccuaucaacaguauagaagaguuacuguugcuucacauucucgccagcauuuguuauuuauuaucuuuuuaauaacagccauucuaacugcgguaagaugauauauugugguuuugauuugcauuucccugaugguaaguaauguugagcauuguuuuuuauaccuuuuggccauuucuaugucuuuuucuucuuuauuuuuucaucucaaaggacacaaaccaacauuucugugucuucuuuugagaaaugucuguucauguccuuugcccacuuuuuaaugggauuuuuuuuuaaacuauugaguuccuuguauauucuggguauuugucccuucucagaugaauaguuugcaaauauuuucuucuauucaacaggcuauuucuguuuuuuuuucuugauuagcaaguggucauugauuuuauuuaucuuuucaaaaaaacuugguuuuguuuauccuuccuauuguuuuuugagugucuguuuuguugaauucugcccuguuuuuuuuuuuuuguuuuuuuguuuuuuuuuaaguuggaauuuuguucugucucccagguuggagugcaguggcaugaucauagcucauugcaagcuugaacuccagggcucaagcaguccuuccaccucagccucccaaguaacuagaacuacagggcucugggcuguuuuuuuuacauuuuuuuagggauggggucuugcuauguugcucaugcuggucucgaacuccuagccucaagugauacucccauuuccaccucucagggugcugggcuuucaggcacugagucacugagucaccuugauuauuauaauuuauuuucuucuacuaauuuuggguuuuguuuguucuugcuuuacuaguuccuugaggugcuucauuauauuguuuauuugaaaucuuuccauauuuuuugagguaggcauuuauugcuguaaauuucccuguaagcagugcuuuuguuguaucccauggauuuugguaugucguguuucaaauuuucauucguuucauuuguuuuuugauuucuuccuuaauuucuuucuugaucaguugucuuucaggaggauguuuguuuaauuuucauguauuuguacaguuuccaaaguucuuguucgugguuucuaguuuuauucuuuuguagucugacuugauaugauuucuauuuaaaaaaauuuguugaaacguuuuguuuccuaacauauggucuauccucgagaguauuucaugugcugaugagaagaauguuguguacucuaacuguuguaugaaaucuguaaaugucuuuuaggccuauuugguccaaugugcaguuuaaauccaaugauucuuuguuaauuuuaugucuagaucuguuuaaugcugagagugggguguugaagucuaccaacuauuaugguauugcaguugauaucucccuuuagaucuaauaauauuugcauuacguaaugggugcucuguaguugggugcauauauauuuagcuacuccugcuugcuuuugguuuccauuugcauggaauauuuuuuuccaucucuuuacuuucagucugugugugucuuuacagguaagaugaguuuccuguaggcaacauauagcugagucauguuucuuuuauccauuuagccaaucuuuaucuuuuaaguggaaaguuucauccuuuuacaguuaagguuauuacugguaugugagcgcuuauuccugccauuuuauuaauuucuuguuguuuuguauauuuuuugguuuucuuuggcuuuuuugagaugggcucucacuguguugcucaggcuggagugcaguggugcaaucacacauggcuuacugcagccuugaccuccugggcucaggugauccucccaccucagcccuucauaguugggacuaaagguguacgccaccaugcuuggcuaauuuuuaaaauuuuuuguagagauaggguuuugccacauugcucaggcuggucucaaacuccuggucucaaacuccuggccucaagugaccugccuguuucggccucccaaagugcuaggauuacagaugugagccacugugcccagccuguauauucuuuguuccuuucuuuuucucuuauuguuuaucauugugguuuggugguuuucuuuagugguaacauuugacuucuuuuucucauuuguguaucugcucuaccaguuagcuuuauauuucuguguguuuucaugauggugaucaucaucuuuuugcuuccagaugcagaauuccuuugagcauuucuuguacaguuggucuaguugugucaaauuaccuguuuuugcuuguguaguaaggacuuuauuucucccucauuucugaaagaaaguuuuccuggguguaaucuuggcugccagguauuuuuuucuuuuagcacuuugaauauaucaucccauuuucuccuggccuguaaggauucugcugagaaaucugcuguuagucugauaggaguucccuuguaaaugaugagaugcuuuucuguuauuguuuuuagaauucucucuuugucuuugacuuuucacaguuugacuauaaugugccuuggcagagaccuuuucgaguuguaucuauuugaaggucucugagguuccuauaucugggugucaaaauugcuuucuagauuugggaaguuuucagcucuuauuuuguuaaauagguuuuuuaucccuuuuguuuuuucuuugccuucuggggcacugaaaauuugaauauuuggucacuuuauagugucuacaugucauguaugcuguguuuauucuucuuuauuuuuauguuauuggauuauuucaaaauaccugucuuaaaguugugaaauucuuucuuuugcuugaucuaguguauugaugaagcuuuugaaauaauuuuuguauuucauucaaugaauucuuuacuuccaguaguugcauuucguucuuuuuuaugauaucugucuaucuuuuuuuuuuuuuuuugagacaaggucucacucuguugcccaggcuagaguacauugaugcgaucuuggcucacugcaaccucugccuucugggcugaagcgauccucccaccucaaccaccugaguaguugggacuacagguucacgccaauaugcugggcuaauuuuuuuuuuuuuuuuuuuuagagaugggguuuugccguguugcccaggcuggucucaaacuccuggguugaaacgauccaccugccucagccucccacagugcugggauuacagaugugagccuagcccuaugauaucugucuuugguaaauuucucauucguauucuaaauuuuaugauuucuuaguauugugucuguauauuguaccucacuuagcuuuuuaaauauuauuuugaauucuuuuucugggaucucauaaauuucuuuuucauuggaaucuauugcugcagaauuauuuaggucauauuuccuugcuuuaucauguuucuuggguccuuauugcgcauaugguauaacagucacuucuucccaguuuuuugaauucgcuuucugaggcgagggcuuuuuccugaagauguguuuaugauguugauuggguagggcauuuuggcaugaaucugggugcaugcagugguguagucuccguauaaauuauucggcuguuuacagcguuaauagugucugauuuucucagugauguaggguuugguuuguuaguggagucuguggugaggcuuagcuggggacagguucaccaagugggccuguccuugggccuuagggcaacauaugcuggcacugguguuagcagguccaggugggcugauucuugggccuccagguggcuuacuuggguguugguaggggcagugguuggccaguugggugggcagauucucaggcuccugggcagcguauguggcaugguugauagugggaaaacccucuguuucccagguggucugugcugauaauggcaguggcugcaaugggcugggcaggccagucuccaggccugcagguggugcaugugguuggggaccagcugugguauguaauggcagauugagugggcuaaaucucaggccccuaggagaaguguucacauguuaacggugguggagggggcuggguagaccuguccucaggcccacuaguaauguguguggguguuggcugugguaggcagggguggggugauccccauggccccaguggagugcucgaguggggcccugccacuggggagggaaggguugcuuucaguggcaccagacauaaacauucagcugaugagugggucuuugggccccagguggcagcugugggcaggguagucuguccucaggacacuuguaaagguguaguagcuccacugcuuggggcagcagggucacugccaauaguuugugguuuagcaccaguggcagcagccagcaggagugguggcuuuggguggugggagucuuacagucuaacuuaggccuccuuggggcacaugaaaaugcauagcagcucugcugcugggggcagugggguugcugccagugguuuacacuuuggcuugggggcagcaugggaucacaacaguggcuguagguggggauguaaguggacuccagggauauggagaugccggggcuguuuggccccagggcaggguacagccuuguuggggcugggcucucaaaacgugcugugcucuagcugcuuaggacuaaggaguggaggggaccguucaugagcaguaucaucgugugguccccaggcagcucccuuugucaguaugagaugauuuucuuauuaugaaaucgauauuggccaggugcgguggcucacacauguaaucccagcacuuucccaggcugaaguggguggaucaccugaggucaggaguucgagacuagccuggcuaacauggugaaaccgcaucuguacaaaaguacaaaaauuagcuggucaugauggcagaugccuguaaucccagcugcucaggaggcugaggcggaagaaucacuugaaccugggaggcggagguugcggugagccgagaucgcugcauugcacucuagucugggcgagagagagugagacucaucuugggaaaaaaaaaaaaagaaagaaagaaaaaaagaaaucaguaucaaggcuguaaggggccuacuucaaguguucuuaacuucuguuuuccuucuaaguuguuuaucuagcuuguacuuagacaccuuaauagauacauaaauauuucuuuggguaggguguauagcauacaauguuuuuuuuuguuguuguuuuugagacagggucucacucugucacccagacuuggagugcaguggcgugaucuuggcccacugcaaccucugccucccgggcucaggauucucccauuuuagccucucgaagugcugggaguagcgugugccacuaccgcccggcuaauuuuuguauuuuuauuuuaauuuuugagguggagucucacucuuguugcccaggcuggagugcaguggugcaaucuuggcucaccuuaaccucugccuccuggguucaagcgauucuccugccgcagcuucccaaguagcugggauuacaggcauguaucaucacaaccggcucauuuuguaauuucaguagagaugggguuucaccauguuggucaggcuggucuugaacuccugaccuccggugauccacccgccucggccucccaaagugcugggauaacaauugugagccaccgcacccugcuuaauuuuuauauuuguaauagagacaggguuucaccacguuggccaggcugaucuugaacuccugaccucaaauaucuauccgccucagccucccaaaauguugggauuaccaccaauaccgugccaggccagaauguucguucuuuuuuuuuuagacaagucuugcucuguuggccaggucuuauauuaaaacuuaaauaucuuuuuguagcuuuugcccucaauuuuuuuuuaccauauagaauacuagugcuuucauuuaacagggguuucagggugcaauuuugcugaauaauaaauuuuaaugacgaugcuguuuugagauaguguuuuuauaguaacuguaaauguguaaauaugauaaugauuuuucaaaauaguguguaccuuuauaaacauaauuuauguauuuacagucacauauauggccuagaauuuccuaucaguuugcaaaaguaauuuuaugaaaauacaugauaggcagcaaaaguugaggcaggauacuuguuuguucaggagagucuauuuuuaaguuuguggaguucucauuuagaagauguguugggcuuuguugauuacuuaacagcaguagcuuggguccuuaaggcuuuaaguagaaagccuggaguucuuguaccugggaagcccugggaguuauuuggcaagaggaaugugaguacagccucaaacuaaaagggugccaagacugacgugaaaugaaggaaaagagaaaauagacaauguuuaaaaauguacacaguuuucaagcuaguaaauguaugcuacugaccccuacuuacauaaaauauauucauguuagguauauaguuagaggugcauuuuggcaaauguauauacuuaggcaacugccauugaaaucaagauaaagaauguuucugucguaucacaaaauucccucauuacuuuuuacucuuagucuccacccuaggcaacuacugauuugcuuccugucacuacuagauagauuuugacuguuccagaauuacauaucaauggaauuagacucugcauucuuuugugucuuaacaaaagugcguguuuucaauaguuggcuuuuuuuuuuuuuuaauuucugaguaguuugccauuauaugaauacaucuuucucuuuacuuguugauagacauuuagguuauguucaguuuuuggcuauuauaaauaaagcugcugcuaacauuuguguucaguuauuuguguggauauaugcuuuauguuuucuuuuuucuugaguagaauugcugggucauaagcuuuuuuuguuuguuuguuuguuuuagaugggguuucccucagccucccaaaguacugggauuacaggcacuagccaacucgccuggccuuguuuguuuuuguuuuuguuuugaaagggaguguuguucuguuucccaggcuggagugcagugucgugaucucggcucacugcaaccuccuccuccuggguucaagcaauucucuugccucagccucccaaaucacugagauuacaggcaccugccaccacaccuggcuaauuguuguauguuuaguacagacgggguuucaaacaugcuggccaggcuggucuugaacuccucaccuucagugaucugccugucucggccucccagagugcugggauuauaggcaugagccacugugccuggccugguuuuuauauguuugacuuuguaagaaagugcuaaacaguuuuccaaagugauguugucauuuuccauucccaucagcagugugugaguuccagguacucaacacccuacuaauauuuggagauguuauucuagcaaaggguaugugauaauauauuauucuaguucugauuuacauuucuuuguugacuaaugauguuauguagguuuccauaugcuuguuugccaccuguguaucuucuuugugaaguauuuuuucacauuguuguuugucuuucaaugguugucuuauuauugauuuguaagagguuuuuaaaaagauauuccgaauauaaguucuuugucagaccauauguauugcaaauguuuucucccagacuguggcuugccuuuuuuuuuuuuuuuaaagcuauuucucagcggaaguuuugaauuuuuaagaagcccuuuuaaugaaaaaauuuuuuucuuuuaugauuuuugcuuuuguuucuuaagguagcauugacuaccaaggccaugacaguuuucuucuagauguuuccaguuacaguuuuacauguaagucuguauugcaauucaauuuaauuuuucuuuaugauagagguaagggucaaggguaauauuuuucacauggauauaaauuuuuuagcaucacuuuuugaaaaaccuaucaauucuuugaauugccaugaucuauauauguugagaccuauuuauauauucuuaggucuuucauuucauugaucugucuauauuuuuaugccacuguuugguuacuguagcuuuaugguacaugugcuaagcaagguccauuuacgaggcagaauccauacaguaaauugaagaaugaaauuuuaguauaaagaauuagcucuugagucaccccugugcagccuuggugccgugugcauuuuggacacucagcccaccuugcucucuaguacuuguaagccuuuuccuuucaagaugccugcagagguguaccauggagaaggggagguggcgacuuuugccuuuuaggcagaaauugcccaacucaugucucucauaaucaauaccuucuauuccaacaaggagauuuuccuucaggaguugaucucuaaugcuucugaugccuuagacaagauucgcuaugagagccugacagacccuuccaaguuggacggugguaaagaacugaaaauugacaucauccccaacccucgggaaugcauccugacuuuggucaacacaggcauuggcaugaccaaggcugaucucauaaauaauuugggagccauugccaagucugguacugaagcauuuauggaggcuuuucagucuugugcagaaaucuccaugauugggcaauuugguguuggcuuuuauucugccuaccugguggcagagaaaguagccaucacaaagcacaaugacgaagaacaguauuccuggguaucuucugcugggaguuccuucacuuuacauguugaccauggugagcccauugacagggauaccaaagugauccuucaccuuaaagaagaucagacagaguacuuagaagagaggugggucaaagaaguagugaagaagcacccucaguucauaggcugucuuaucgccguuuauuuggagaaggaaccagagaaggaaaucagugaugaugaggaagagaaaggugagaaagaagaggaagauaaagaugauaaagaaaagcccaagacugaagauguggguuccgaugaggaggaugacacugauaagaauaauaagaagaaaacaaagaagaucaaggagaaauacacugaucgggaagaacuaaaccagaccaagccgauuuggaccagaaacccugaugacaucacccaggaagaguguggagaauucuacaagagccucaccagugccugggaagaccacuuggcagucaagcaauucccuguagaaggucauuuggaauucagggcauugcuguucaucccucaucaggcucccuuugaccuuuuuuagaacaagaggaaaaugaacaacucuguguccaucauguguggaucauggacagcuuugaugauuugaugccagaguaugucggcuuuguccgugguaugguugacucuuaaggaucuuuccccaaacaucucccgggaaaugcuccagcagagcaaaaucuuggaagucauuugcaaaaacauuguuaagaaaugccggcugggcaugguggcucacgccuguaauccuagcacuuugggaggcugaggcgggcagaucaccugaggucaggaguucaagaccagccuggucaacauggugaaagcccgucucuacuaaaaauacaaaaauuagcugggcacaacgccuguaaucccagcuacuugggaggcugaggcaggagaauugcuugaaccugggaggcggaaguugcagugagccaagaucaugccacugcacuaagccugggcgacagaagaaggcucugucucaaaaaaaaaaaaaaaaaaaaaaaaagaagaagaaguggcuugagcuuagcuucucugggcuggcagaagacaaggagaauaacaagaaauuagaugagguauucucuaaaaucucguggcuuggaauccaugaggacucuauuaacuggcgacaccugucugaacugcuguggucucacaccuuccagucuggagaugagaugacaucucugucagaguaugugucuugcaugaaggaggcacagaaguccaucugugacaucauuggugagugcaaagagcagguagccaacucugcuuuuguggagcaagaguggaagaagggcuucgagguaauauauaugagugagcccauugaugaguacugugugcagcagcucaaggaauuugaugggaagagccugcugucaguuaccaaggagggucuggagcuaccugaggaugaggaggagaagaagauaauggaggagagcaacguaaaguuugagaaccucugcaggcucaugaaagaaaucuuagauaagaagguugagcgggugacaaucuccaguaggcuugugucuucacccugccgcauugugaccagcaccuacagcuagauagccaauaugaaguggaucaugaaagcgcaggcauuuugggacaacucuaugauggguuauaugauggcuaaaaagcaccuggagaucaaccccaaccaccccauuguggagacacuacagcagaaggcugaggcagacaagaacaacgaggcugucagugacccgguggugcugcuguuugaaaccacacugcucucuucuggcuucucccuugaggauccucagaccuauccagcugcaucuaccacaugaucaagcuagguuagcuauugaugaagaugaaguggcaacagaggaacucagugcugcuguuccugaugugauguguuccugaggauguguuucacauggaagaaguagauuaagaguuuauaccugcaaaccuugugcccuugcauaguguccccauggcucccacugcagcuuugagugguccugucccaccuggcucucucugcugauaucuaguauuuuuucucuucuguccuugugucuaaggcaggaaacaagggcaucaagccccauucccucucuacuuugacagcagaauuggauguuguauauccuguuuuuuuguuguuguuuauuuuguucugaaaguauguaaaauaaagaauaugcuguuuuuauacaguaaaacaacacaaaagauuaccauuucuggggauuagcaacuaaaagaggauuauuuuucuuggcuuguugugguaucuguaacaucauacuuaauguuacagaguugcauaaaaguggcaagugugaauaucuuuaccuucuucccaaucuuaggagagaagcauucagucuuucaucuuuaaguaugauguuaacuggaguuuguaguugcauuuuaucggguuaaggaaguuccugucucuuccuaguuugcugagaauuuuaucaugaguaggugcugaaauuuguuagaugcuuuuucuguaccuaaugagaugauuuuguggcuuuucuccccuuugaaugcggugaauuacauugaugauuuuagaauguuaagccagccucuuauuacuucauuugcuuaugauguauuguccuuuuuauuuauugcuuuguucaguuuucuaguuuuugguuggauuuuuuuguuuauguucauaaggaauaucagucuuuuuuuuuuuuuuuuggggggggucugucuuugguuuuggaaucagagugagccacauaaaaugaguugaguacucuucccuccuguuuucuuaaaauaguuuuauaggacaucaggggaaccaucuggcccugguauuuuucuuguggaaaggccuuaaaucaugaauucauuuucuucaguagauaggggcuuauucagauuuucuauauuuugugauaguuuucauaauuuguaccuuuuaaggaguuuauuuuaucuaaguaauugaauuuauuuucauuaugcucauaauauuacuuuaucacucaaugucugcaguacuggaaugauguuuucuuuuuuauucuucauugacaauguauuuuuuaaugaucuuuuuuauuggcuguagaauuuggauugacauuguuuuucuuucagcauuaaaaaaguuacuccaauaauuucuagcuugcauuauuauuauuauuauuuuuguggagacagagucuugcucuguggcccacguuggagugcaguggcaugaucucagcucacugcaaccucugccuccuggguucaagcaauucuccugccucauccuacugaguagcugggacuacagaugcacaccaccaugcccggcuaauuuuuuguauuuuaguagagacaggcuuucaccauguugcccaggcuggucucgaacuccuaagcuaaggcaaucugcccaccuuggccucccaaagugcuaggauuacaggcgugagccaccacgcccggccugcuugcauuauuucuaauguuaaaucagcagucacucugcauauaaucagucucuuugauggauuuuaagauuuucucuuuaacgcugauuuucagcagugacugugguguguuuuguggguuuuucuuuguguguaucuuucuugguguuuguugaguuacuuagacuuguguuuauaguuuuaucaguuuggaaguuuuuuaucauuuuaucaaauuuuuuuuucugucuccucucgcuucuuuauuuauuuacuguuugauagguuacugaggcucuggguuuuuuuuuuuuaaacucuuuaucucucuguacaucaaguuagauaguuuuuguuacccugucuucaaguucgcugauauucuuucuugcaguaucucaucugcucuuaagucaguccagugagagagagagauauauauauauauauauauaauuuuuuuuuucauuuuagaaauuauauuuuccaauucuggaaguuuccuccccucucauuccuuucccucucuccucucuucccugucccuccccuucccuccccucuuucgacaguuuuugguuucuccuuauugugcuuauauuuuccccauaauucuuuaacauauuuacaauauauagacacuaaaucacuaaauccuugucugcuaauuccguuaucauucauucucacuuuuuuugggggggacuaauuuucuucuucuuugucacauuucuuuauaguuagugguuugguuuuuuuaccccuuguuuuuuuuaauaguuugugguuuuuaauuggauauuucacauuuugauuaauauuuagugucuuuuugucguuguuuguuuuuuuuaaaauuagagauggagucuugcuacauugcccaggcugauugaaaacuccugggcucaagcaaucuucccaccuugcccucccaaaauacugggacuacaggugugagccacugugcccaccugugucuggauuuuuaaaaaacuuuuaauuuaaaaauaauuguagagucacaggagcuucuacugggaaguccuggacaucuuucccccagucucccucaguguucacaauuuauauaacuauauuacaacaucaaaaccaagauugauauugguacaaugcauagaguuuauuuggguuucaucaguuuuacauguacgugcaugugugugugccugugcauaauucugugcaauuuugucacauggguagucuuguguaauuaucccuacaaucaaagauacucaaugguagcaucaccagacucccuugugcuaucccuuuauggccacauucauccccucccccaucuauaauccuaaacaaccauuaauugguucuccaucuccauaauuagauuauuucaugauugucgcaugaaucguauuaugcaaguaguaucuuugagauugacuuuuccacucagcauaauuuuuuugaaguuuguacaaauuguuguguuuaucaauaguuuguuccuuuuuauuacuaaauucuauccuauuguauggauauaccacaguuuaacuguucguauuuuuuuuuuaaaaaguauggaguuuuguuuguuagauaguugaguaacuuguggaucagcuugacccuuuugagccuuuuuuuuuuuuaugauuaauuaagcagaaauuuuauuuccaagcucuucaaagacuguuacaaacacaaauaauguauccuucuaaaaaagugucccaaauuaaaucagauucacaucaucaaaguaaaacccuugugaaguuaagaauucuuuuagguuguaauguuuuuauguuaguuuuuaaucauuuacaauguucugugggucacauuuuaaacauuuuuaaauauaugaaauucuguauuucuuuaaguacagccacagcuacaaaguagaggaacguaagaauacaaagaccaaaucugcuucauuuauauacacgauggggcagccuaaugcacaucauaacauuaacuuuuccaaacaaguuugcuaagaaucugcucccauaauuaguguuaaaaauaaaacaaucuucccauuuagaaaaaucaagacaucaguugauuaguaaagccuauucuuccucccagcaauuuguacuuucuggucuucauuuaggaauuguaaauucaugagaaaagaacaaauuuuuuaugguauaaauaucuuccaggaacaacaguuuacaaguauucgauuguuuaaauaaacaaaacuauuuuccuuccuaaaauguaaacauccaguaaaugaaacauacaugauauuccagguauagaaaucuuaguaacucacuuaugaaagaggugcauuuugguauguuuggugguaagguuuuuguuuaucuuauguauaaaaguacuugcacaaaaaaacaagcuauuacuauuuaaaacucuauuccuucacccaguuuccucacucaaguagaaacucaugaauuucugugauuuuggcuauaggacggggccacaggaaagggcugaaauaucucuaaaaguuagggaaaaguguuuucuugagacuugaaggcagucauucaucacuuugugcuugaaggcauuccucagcaaacuucucucuuagagucuucagaguaaagcacaggaucuggguucccagaagggguuacuuccagcuagaacacccaccagcagggcauccuugcaggcauucugcauacaguacuguugaagcucugcggcugccugagagacauugauccucuccacgccagccuccaacuugagcugcuccaccaggcacugcagggcgcucgcgcuagccccagaggacaugguggcggcgcugggcuccgagggcccagccuuguuuuuaagcuuuauuaggauagguuugaaguagccuuuauucuaggaauaguuuguuccuauuuccaaggaguggcuuuucuggguucucuauuaaaugacaacaaagucugucuucugugcuugaucacaacuucgauguaucccugucucuuguaagauccaguaauuggucaacuaacagcuccuuaauaguuguuuuugggcccaccuuuguggagucucucuuuaugcauccacgauaguauugagccacagacuacaggugaacgccugugcagauuucuggaguucuuucucauuguugcaccuuccuuuuuucuuaaaucauaguccuucacugcuuguugucuauugucugaaagcaguuguuucauuuauguaacugaaaaacuguauuuuugagguggguaggcaaguccaguaaugguuucuccaccauuguggcaacaaaacuuuuuguuuauuucuaaguuaguaauuugaaagucaaaauugauucaucuguccaaagagcaguaguuuuuguuuugugucuuaagauguuauuuuaacuuacauuuuauuuuuugaauaagaaauaugcucguauguuuuaaaauuuaaaugccacaaaagauauacaaugagguauccuucccucccuuauuucccagucacccacuuuccauucuuggggacaaccauuguuacuaguuuauuguguaucugucaagaaauuugaugcacauucuuauaauguguaucuuacucagaaauucucuacacagaaauguggagauauguauauauacauauauauauauauauauauauauauauauauauauauucuccuucauauucuuguuuuuaaaaaaagguaacguacuauauucuuuuuuguaucuuauuuauuuauuuauuuauuuauuggagauggaguguuguucugucaccuaggcugcagugcaguggcgugaucucggcucacugcaagcucugccucccccggguucacgccauucuccugccuuagccucccaaguagcugggacuacaggcacccgucaccacgcccggcuaauuuuuuguauuuuuaguagagaugggguuucacuguguuagccaggauggucucgaucuccugaccucaugaucugccugcgucggccuccccaaaugcugggauuacaggcgugagccacugcacuuggucuuuuuuuuuuuuuuuuuuuacuuaauauaacuuagaggucuaugauuugauuacauguaaauauuuuauauauuuuuuucagcuuuguaguauacaguuauauggguauacccauaaauacgauuauguaccauaagcaaauuaacuaguucuguuguuacuaaucauguacuauuucaaauagugcuaaggugaauaaucuuucugggcuauuuuccaacaccagcaaccaauucucuugauucuccagacaccaaguggguguucaacaauucagcguaauucaguucucacaguaaauaucuggagcuagugcagaccccacagcuuaagggcccauuccuacaacacugcuuuccacuucagacaccauuuguaaguccugcgccaccuguacuucggaccaccugcuauaaauuggggguucccucaaccuccuccuaagguuagauaauuuguuaaccuggcugacagaacucaggaaaacaguuuacuuacucuugcugguuuauuauaaaggauacaacucaugaucaccuaaguggaagagaugcguaggaaugugggaggcagcacagaguuucugugcgcucucuggguucacuacccuccaaucaacucaguguguucaacccuggaagcugaucagaucucauuguucaagaguuucuauagagcuuaaucuccugucucucccaccucacuuucugggguggagucaguggcuagggcugaaauuccauugcucuuauuauuugaucuuucuggugaccagcucuauuccaaggucaucuaggggccccacucuaagucaccucauuagcauaaacucagaugugagugaaacagacucauuaugaaugagugaagagacaccuaucacugaggauauuccaaggguuuuaggagcacugugccaggaacuggggacaaaggucaaauagauuuggcccucuauaucuguggauucagucagccuuggauugaaaauaauucgcaugguugcaucuguacugaacauguacacuuucuuccuugucauuauucccuaaacaauacaguauaagaacuauuuacauagaauuuauacugugugagguauuauaaguaauuuugagaugauuuaaaguguacaggaggauguauauauacaaauacucuacaaauacauuuguuauauacaaauacuguaccauuuuguauaagggacuugagcauuuuuagauuuugguauccuuggggguccuguaaccaaucccccguggauacugagggaugacuuuauauuuccuucucuuuuuuuuuuuuuuuuuuuuuuuugagauggagccucacuuugucacccaggcuggagugcaguggcaugaucuuggcucacuguagccuccaccucccagauucaagcaguucucuuaccucagccuccccaguagcugggacuagaggugcaagccaccaugccuggcuaguuuuuguauuuuuaguagagacgguuuugcuguguuggccaggcuggucuugaacuccugaccucagaugauccaccugccucagccucccaaaguucugggauuacaggcaugagccacugcaccuggcuuaacuuuauauuucuuauuaugccacauucuuuguaguauggaaguaauuucacuuacaugcaaguauauguaagauacauuucuagaaauggaauucuuguaucaaaggcuauguacauuuguaauuuggauuuuuuaaaccaguuuucccaccauagagauuguaccaacuuauucaugucacaaaugugugaagugacuguauguuuccccauacaacuuuauguuacaaauuuuuauuaaguaauuuaaaaaacaagguucuuauaguacucugcaaaacauguauauguaaaaaaaaagacguaauacuuuguuguaauugucaaaaaaauuaaguagaaauucuauuauguucacaauuauaaaagacuugauauacuuuuaacagaguugaguaauguuagcuaauuuguugccauuuuaucauauaucuccaaugugccagguacuguuaugacuuuauauacguuauaaaaucucuaauauuuaaaguaauuuuacaagguguauagaauuuauauuaccuuuauuucacagacaggaaccugagcuaguaaauucuaggcuuaagauuugauuccaauucgauucuaaacucuagauuuuugucauaucuuuaauuaauuuuacuuuaguauuuugaucuuucccuuuuuuguguagaggacuaaaauuccucugauuucagccauuauccuggucuuucggcauucccaaauugaauuaaggaagauuucuauaauuugcaagaauuagaagccccaggguaaaacaaagagcauacacacuugucuuucugagaagagauguuaaauaccccauauagaugcugcuuucuucuguauuuucuuauuuaacuuguagaaaguaagggagaauagcaaaauagcagaauuacuagagagagaagacaggcagugguagauaauaguaauugggucaggaagccuguuuuaaucuccaaguaacuuauuugcuguuugaauaucuuguuuuaccauguaagaaucagucuauaggcauuuauuuuuaacauccuagacaguuacuguuuaauuuuaucucauuuagaguccuaccacagcuacuaaguugacuuuuagagcagaauaugucuuuaaaaaucuuggucagcguauuucacaaauagacaaauuucauaacaguccacauuuuguagacuuuuuaaaauaaaaaauaauuguuuaaaauuuggaucuuuuuaauuucaguuguucccccuucccaucccauuuuacagacauuucaaccuacgaaugaagagggacacuucccuuuucagugaugaauuuaaaguagaaacaucaaauaaaguacuugauuaugauaccucucauauuuacacuggacauauuuaugguaaguuggaccuuaacagaacccuuuucuuccauuuuuuuuuuucuacacaaagauacucauuuugaaguguaagcaaauauuucagaaaagguuauaaauccagaggagguugaauucauaugaaggguaauggucuuugagaaaugaaguaauguuuggaccuaucuuuacauguauguuuaauagugaauuaugaaauaucuggcuucugaaaggggugaaauuuugacucaguaccucuaaacuguuagaguuuucaaaaguuuuaacgacuucuguaauuuucugauuuuccaaguaagaaauuaauaguaacuuugcuguguuuuauaagaaaacaggaaaagucuaaaaggaaacaguaaagaugaucuuagccaaaaauaaugugacagagucaucuguaggaaaauccucccaaggcccuucuuccucagaaucuauuugcuuuauucacaauucuaacaaauuucucuugcugcaucaaauugaaaaugcauguuggggggcaucaguggcacacuuaacccaauagaaaguuacaucuacuaguaguguugaaagaacagaacaacuauagaagucauaaaaaagcuuaaaaaaugaaaaucuucuggggguguuggagagaggcaaaaugucauuguuuuauaacuguacauuaguaaguacucaagaugauucucacuuaagacaguguuaaacuguuugagauuauuucuacacgagugauuucuacugaaaauaguaacaugaaaaauuaaaugcuuaaagaauuuuuucucauuuuucgauugugccagauaaaugaggcauuucuauacuuaaacuuucucauuuguagaauaaaccuaaucauuaaauucuuuagcuuuuuuguacucuuacaauucuguaaccaaaaugaagcguuuuucaucaguagauuuucaaugucagacuuuaguguuauauugucuucuugauuauuuaucuuucugggcaaauaacuuaguaguuccugcccuuuuucgcuaggugaugagaucaagaaaaguccgaggccguaaaugagauugcagauaaaaaucauguuauuuaggccaggcaugguagcaguuacaccuguaaucccagugcuuugggaggcugaggcaggaggauugcuugagaccuggaguuugagaccagccugggcaguauagugagaccuugucucuaaaaaacauaaaaauuuaguugugguggcacaccuguaguuucaguuagaugggaggcugacgugggaggauugcugagcccaggagguugaggcuacagugaguuaugauugugccacugcacuauagccugggggacagagaggggcccugucuauuuaagaaaacaaaacaaaacaaaaaacuccaaauaucagcgucuugggcucuuaccuccagucuaugauuaauucagaggcaacuaauuaauguuauucuacaacuuagaaauuguggaaguccugauuuuuauuuuaaucagagaaucguaauggguaaauucaagguuuaaagcccucucccucuacuuucacccuuuaugucauuugauuuuggugcucaccuuuucguugugauuauauuaagaaccaaaaguaccuuuuuuccuauuauuuccuuucacuggagaaguguaauugaugggauaguauuacaaaucuuuguccaauaucuuuaaaaguacuguugguauacuuuuguucaaagugcccaugaaauauuugacacuguucuauuuaaaaauguguuuauaggcugggcguggugacucacgccuguaaucccagcacuuuaggaggccgaggcagguggauuguuugagcccaggaguuccagaccagccuaggaaacauagcaagucccugucucuaccaaaaauacaaaaauuagcuggagguggcggugcacgcuuguagucccagcuacuagggaggcggaggugggaggagugccugagcccaggagguugaggcugcacagagccaugagcucgucacugcacuccagcccgggugacagagcaagaccuugucucaaaagcaaaacaaaacaaaacacaaaacaaaccccuaagcauagcgcagaagccaaaaggccuggcccaugcacaauauaucggauggaaaaggagcuuuuuucuugugguaccuguagcaaaauuuucaaaagaugcuuuggaugucuuuauucugaaaguguguauuuuaucaguggguuugcuugcuucuuuuaaguuaauuuaacaauuaauuguuuuguuuuguuuugagacaaggucuugcucuugucacccaggcuggaguucaguggugccaugucagcucacagcaaccuccgccuccaggguucaagugauucuucugccucagccuccugaguagcuggacuuacagacaugugccaccaggcccagcuaauguuuucuguguuuuuaguagagacaggguuucgcuauguuagcuaggcuggucucgaacuccuggccucgagugaucugcccaccucggccccccaaagugcugggauuauaggugugaaccacacugugcugggccaauuuacaauuauugaugacuacugcauacaugcuaggcacucagcuaggugcaaggaaugugguugguaacaaggcagauacucuauuuuucauugcuguuauuaguaauuguauauauuuuaacuaaauacuaguugcuguucacaucucacauucugcuugauauauuuuaugugaaaauuuccauaguaaauuuauauucaagauuuaaccauauauauguguauauauguaugcauguguguauauauauacacacauauauacauauauaugaaugaauuuaacauucaugugcaaauuaaauugucaagaauuuguugcuuucauuaauaggugaagaaggaaguuuuagccaugggucuguuauugauggaagauuugaaggauucauccagacucgugguggcacauuuuauguugagccagcagagagauauauuaaagaccgaacucugccauuucacucugucauuuaucaugaagaugauauuaguaaguacuuaaguuuuaucaaguagccuuuuucaaaaggcauaugauaguuaaaacuguguggagacaaaugaagcauuagcuguuuucuuuccugaguuacuaaucaggcuagaacauaguuuuuacuagcaauugcuauuuaaggaauaguagauauauguaaugaggcaauuuccuugucaguccauugccaguacuacuuugcugauaugacauaacuaauucuguuugaacugugugagucaaccaaaucugacggaacuggaaaucguauauuuugacaucagccagucuguguaaugcuaauaccuuuguguguaugaccuauugaagguagaagagcaucauuacuacuuacauaaauuucaguguggauauuuguguaguguuuaaggaauauuuuagguauuuuuguaauuuuuaaguccauugaguauuucuuuuuagaaucuuaagguaaugacuugacuucaagaguccacguuuaucauggauuuuguucucuaccaucuuuauaugaugauauuuuucuaagaauagaaaauguauuuagacuuuaccuuuuaauucuauuguccguauauccacaguuauccaguuauugggaaugcuucuuugaaguaccacagaaauaaauuucucuaauuuauauagcucuugaauacccauuuauuauuuuuugacuguaauuagacuagucucucaauuuuugccugcuuuccuaacuuggcagcuucuuccuacauacguuuuccuuuguauagacagaaauuuauugucaaugauuuuauucuuaccccuaguaauacacugacaagcauuaaccauuuugacuuuuugcuccaucagcucugacaguuuuuguacuucaucuguccaacugcuuguuaucucugcugcuagauugcuauagaaaauaacauauguauacuagguaggaugcauuuaugauuuuuagcuacuuguuaaaucauaagcucauuaaugcuacuucccuguauuuucauucaccacuauuugauuccuuuuccaguuuuaacuccugguauuucaaacucuaccuuucuuuucaagcucuaagcuaucauccuccuucauaaguaggaauaugaauuccuuugcuuucguuucuuucugcugacaaaauuauuauuuaccugguuugugucuugcuuuguagcuuucuuaguaauuuaaccuuuuuuugcaggguuaccuccccuaucaggguauguaaguucuucagguauaguuucuguuucuuuugcuccuguaauauugcaaguaucauuugucugugcagcaggcuuuucauaaauacuuaaugaaauacuggaauauuuuucuagaauguuuuaucaaaaucaaagaaaaccuuuugaggaaugaaggagaggaaaagcguaaucugccagauuauuuuuuccuuucuaucauauuguaauuauacuuucuccauugcuuucuacuugcuaucagugcccucuacuguauuuguucugccuguuuugacuucuguuauugugccucucucauguuuuccuucuucuguuaucuacuuguguguaguuuaagaauauucuuuuuucccacuuuucuuucuuucuuguaauauaauuguauuuuuugcauauugcauccaacaguaauuuccaaauaucuuaauaggugucaaucuuuuuuuuuccccaaagaugaugaguuagcuuggaggaugaaugacacuggauguuacuugauuuuuuguucuuuuuggcauuuaaaugcuuuaucauugauaucagcuuuuauuuuauacuuguuuaaguaaauauauguuugugguaaggagaacuuuuuaacauucuuuuuauuauuacauaucaguagugggguuagaauuuaaaagcagcaaucuuuaaggugauuuuauuuguagcuucucagguaauugaaauuguaggauaugaggaugggaguacggaaggaguucccuuaaacagaguuuuuaauguuugcaaauuuagacaauuacuugugaaaaacuaccuaaaaaucugucaagugaaccaugguuuaagacaagaaaacauucauguauuagucuuuuauucuaaauaguugcuauauuuauauucuagaccgugguucgcaaauucucugcagagggacagagaguaaauauuuuuggcuuugagagcuguauguuuuauugcagcuacucagcucugccauuguagcacgagaacagccaaagaaacacauaaauaaauaagcaugggugcuuuuuuuaaagaaauuauuauuuauuuaucuauuuuuuuggagacagagccuugcccuguugcccagucuggaguucaguggugugaucauaccucacuacagccucaaccuccugggcucaagugaaccuccuaccucagcucugugaguagcugggacuccagguauaagccacugcucccagcuagcauggcuguuuuuaauaaaacuucauagacacuuaaauauuaauuucauauauauuucauaugacauaaaauaucauucuuuugauuuuuucuuuaaccauuuaaaaauguggaagcuacccuuaguuuucaugucaaacaaaaacagaugggagggcucacuaaauuuaauaauuacuuuaauugguucuuuaaauucucuguguagaauaugacagguucuagaaguaguaguaguagcagcaguaguaagaauaauuauuauggcuuaauauauaccugacaguguauaaaaaucuuuacuugcauuauugaauugaauucucaaaauaacguuaugagauacuggcacaccuauuauucccacuuuauaggugaaggcuuaaacugaggcuuagaaaacuuaugucacuugauuguggaccuccuguucuuuacccugugcucuucugcuucacucauggaagaaagcuguaaauucucacugccuuuacuucaaggauuucuggggcuuuucugaaaucuguaagccucucuaaaaucauacauuugcaucuauugcuguuuuaagccaaacucucuccuuaauauauuuagcaguguuuauuuuauaacuaaauggcaaaggaugcccuuuaauguguauuauuauuuuuauauaauugguuuaaguacuaauaauuuauuuucagaaguaaaguacugcauuauuguaucacugugaauguucuuaauuggauuugguaucguuguauauguuauccuuaccaaaaagaagcaaaugguaggggaggcauacuaaccuuggauauaccuuuugaugagaauuuggcuacccucuucuuaauacuguuuuugcaacugaaggcauaaauguauagaaccaucaugaaaaaugauacugcuauucuccagaaccuuggggaauggcuucugagacuguaccagaacacagggauaguuuucacugaaaauacuuaauaauuucucuagaugugauagugauaaauauauauuguuaucagcuuaaaaugcauacuuauuuaauucuguacuuaguaaaaaacacucucuccuaggacaugguagugugaacaguuaaugacaagguaagaauaccacuuaguccucugccccuuagcacaguuuauuuuaaagaaacugagaaaaacauuguuccauaaacuagaauaguauuguuauuaacaugaacagguuuuaggaauaucugacuauaugacugcuugcaauaauucccuuacaccuuuuuuguguacuaccuauccaagagcuaaaggucugaguaauuuuuuuauucuauacuuauagagaaauacuuaaucuccaaauuaaaaaauauauuuuaauuguauaugaagagcugcagaauaauuuauuuggguuuauugcuuucauuucaaauuuauuauuuauuuuccuuugugggguauagaaaagcccagagagguugaauuugccuauaccuccgucgcccaggcuggagugcaguggugccaucucagcucacugcaaccuccgccuucuggguucaggugauucuccugccucagccuccugugaauagcugggacuacaggcaugugccaucacgcccagcuaauuuuuguauuuuuaguagagacgggguuucaccauguuggccaggauggucucgaucucuugaucucuugaccucgugauccgcccgccucggccucccaaaguguugggauuacaggcgugagccacugugcccggccugaauuugucuauaccuuauaguaguagggcaccccuacuuuagaauguguguuagccauaccuauacuuauuucuucuuucucuugugcuucaaugggaagaccuccuauuucuuguucugaaaaauuaagauuguuaaacuuuauuuuaccauuucaagauggaggccucuucauucauguagaagcuuccucauuuguggaaaugucaggauguugcaucuaaaacuuuuaaaaugucaauuaguuccauauuguguuuuugaaguuguuuucugucacuguuagugacagggagagacaaaaggaaggaauacaagagggaagaauaauugaauugguaaguauugauaauagcuagcauuguuuguaucauucacauauaacaggaaaacuguuuuagaaagcauucuggcuauacuuagguccagucuggagauuggaaaucugcauaagcauauugaguugugacaaacuauguagccaacuggaaaaguugagauguggagugcucugauuguuugacuucugaacucccacagugcauacaaguguauugguuaaucucucuacuauauguuuugaauuuguaugcuuuacuaagcauugauguuagauacugaacuuauuuaagcacagugauaguauuugaaagaaauauaaaaauuuagugguauuguugacucugucuuuuccuuuuuucugaguuaaucucuugggaaguauaaauuaauuuuucuaaacaacucacaggcacagaagccgaaaaguugagaaggccacagauaugggaguuauuuuaagaauaauauuuaauuagaaauguaggauacuaaauuggaaaguuaaaaaaaaaucacaaaaaaagaggcaguggcuggguaugguggcucacgccuguaaucccagcacuuugggaggcugaggcaggcggaucacgaggucaggagaucaagaccauccuggcuaaacagugaaaccccgucucuacuaaaaauacaaaaaguuagccgggcgugguggcaggcgccuguagucccagcuacucgagaggcugaggcaggagaauggcgugaacccgggagucggagcuugcagugagccgagaucaugccacugcacuccagccugggcgacagagugagacucugucucagaaaaaaaaaaagagagagaaagagacagugaggggcuuaauucuuuuuagcagaaucuggaaaaaauaugcuuagacuuuucauauuaugcauauuaugcauuucauauuacguaacguuauauaaauaggauaacaguugaaaauuuuagaucaaguucuuuucugauuaguuauauauauguauguauauguauacauguauauucauauauauuuaucuuaaaacaucaauauaaaauauuuuagcuauaaugaaauacaaugaauuauuucagaaauauaagauuuuuaaaauaaaaaauuguuauuagaagcauuuacagugucaaaaaaacagcugcagcuuuuuuuuuuuuuuuuggcaauuacagagugguauucaguuaagaguaauacuuauuuuguauaagcugcaucagagagaaaugaaggugaaaaacuaccaucuccauauauaacucauuugugcugugcaccaauaagaaccugcuuuagauuuucaugcuggcuuacagcucucauacuguuucaggcaaaguuagugguuauugaaaauaccaccaggaugggcugucuguccgucugucuguccuuccauccaucuguauuuuuuuuucuuuaugcucucucaucaacugacugucaaggaugggcuaucuagagacacauuugauagugugguuaacuguuaguguguuaacuguacaguuuaaaaacaaagccuuaccuuuaaagguuuuucuuuaaaaggagugaguuguguacaggggugcuaaauaauuuauaaacaaggacaaacacugcacuagaaccaacuuauucauuaugaucaucuucaucuuucuucucuuccucauccucuucaucuuccuccuuuuccuucuuauuuucaacuuccucaccuuccucuucuuuuuuuuucagcauugacaucucccuuuuuuuuuuuuuuuuuuuuuuuugcugcaugaggccuuccuuuagcucaguaugcagcaauauccauuucuuaguuuuucuucagcuucacagccuuuucauaaggcugcuugucauaugcaccauauccacaucuuucccaguuucuuugaaacaucacgaauggauagguuuggauauucuccuuagauuuuugggcaguacucagggcaaaaugaaaagacugaaggagcccucuuggguacauugggaucccuaaacuuuuuuguuucuucuuuaggagggauguaaguuucucuuuaauagccauccuugucccccuuugccaugucuucagauuuuccuuucucuuuagcagauacggcuuuccaccucucugagcauuuuuuagaaaauuccgagaaguuaacugaagcaugagugcugcuucuuguucuccuccuggaaguuugcacaaagaaugcauaugaugaccuuuugccucuuggcuucuuaggaucuucuuuuaccaaguuuaguuauuuuuccucagagaagcacagagucaccuagugcacaucuggcugccauuugccccagcacugucuccauggaggucaauguacuguaauggcuaucagaaauacaugauuauaugaaaauaaaaaaagcuuucauguuguaaagcaacuuugaaagucacccuaacaaguaaaauuauauuugaaauuuuuguuuuuucuuuugagaacuaucuuuuauuuuguuuuacaaauaaauugaguaaggaauuuuauaauuuuaguauuguaaaaggcacuagauucaacacucuaaagaugacggaaacugaagucuagaguuauaaaacuugugcaguaugacauggauccaugucuuuuggcugccacuccagugcuuuauuucuguuacauucugaguuaggagaguuuaaaggcugcuaaaaggccaagaacuuaaugacaauagagacaaugacaguaaggauuaaaaaaaaaaaguuauuuuugguaucauugauuuugaaggugagccauauuuacuacugaaaaagcaaauuuauauuuuaggcucacuuuaaaaaauauauauauuuauuaauagagacgaggucucacuguguugccaggcuggucucgagcucuugagcucaagucauccuccugccgcggacuccuaaagugcuaagaugacaggugugagccaccaugccuggccaaggcucaacucuuauaagugaugaguuacagaaaaacuagaagaaauagcauuuaggaguaugugugcguguauguccuagagauacucggagcuaaaccucagccuuucacaucucugauagcauaauucauagauuuauguuuguaccagugaccuuauaagagugccugaggacauugguccaggacucuggcccucuaaaaagcugcuucuaaagaggcauugugagaucugguuuauuaaagacauguuauauucuguucaugauuuauaaauugggggauuagauaaucuccauaagcagucuugcuaucuuguauuuauauuugaacauaaaagucuagaauuuauagauguggauuuuacugguuuuagcuucuagagacuucuuagaaucauuuuuuauaggcaagcuuguagaucuacuaguuaaaacuguuuuuugguuuaauuuguuugcucaagaucauacaaguuaguggucuugguacaugguagggagaaggcacaagagguaauaugucaaagaacugaggcauggcauauauaugaaaagaguuagaaaugaaaucaaggugauauguuagaauagcuuuauaaccuuauacagguaauguacuuuuucuuggucucauuuucuucagguauaaaaugaggguguuagaucauggugcuaauaucucuuaucucuucuaaaaguuaaugguucuaaacuacuuuuccuuuaaaguuggaaauaucuugauugaucauggcugacaaauaaaaaguaaaaauaaaaauauuuuugugcugauugggaaaugacuauauaaaauggcuauucuuguauguaaauuaaguauuuuucuuaaguaaauuaaguauucuuguauguaaauuaaguauauuaagaugaaauguguccaccaccauuaacauuuuuaugaauagcccuucagaucucauauaccauuuuaaauuucauguacaguuauaucuuagaucucuuucugugucaauaaacauagcucuacauuuuuccuuuaaauggcuacauaaaauucugcuguuuccuugauaaauguauuauuuaccagccugccaacuaauggauguauagauuguuuccucuuuuuuacuguuaaaaauugcaacagguaacauucuugcacauauuuucuccccucaauauuuuuaugguuauuuccuuaagauuaauuuccuagaaguagcauugucagacauuugcauuuugauacauauugccagauaucucuuuaaaaagguuacacagauuuauacucuuacaccuauaaauuaaauauugacuuaauaauaccuucauguauagucuguggacacacuuccccaauuacuucacaaaaaugucuccuauuuuuuuuuuuuuaauacaggauuuaaucagggucuacacauugccuuugagugucacaucucuguagucaguauuacucuuuuaacagcuuaauugaggaaaaauugauagcaauaaacugcuuauauauaaaguuuauaauauugauaacuuuugacauauguuuaugucugugaaacuaucauagcauuuaagauaauaaacaugcccaucacccccaaaagcuuucaguguaauucuucucuccucuacuccccgcuacccucuugcacuaaucucuagguuaguuugcacuuucugaaauguuauauaagcacaauuauacauuauguacucuuuaagaaagucuggcuuuaacucagcauaaauaguuugggauucguccauguuguauguauuaaaaguuaauaacuuuuuguugauaaauaguagucuguuguguggauaccaugauuuguuaauacauuugccuguuaauggacauuuugguuggguuauuacagacaaaauuaagguuuuuaauauuaacucaucaaguauuggucgauuaaagagaagauaaauuuugaagaggcaaggggaugaaauaacuacuaaggaccaaaaaaucuugcucuguugccugagcucuagagagggggcauuuggaaacaagacaagcaaaauacccaaagaauuuuaauuuaagcuaguagcauauacagcauguacauucucucuccuccaagcugauaauacaacuuagguguaaucuccuagaauuuuuuccugaccucacaguucuggguauccucucuuuacugcuguuuauguguugauaagucuucccuaucuuuugaauccagugguuuacuggucauugaucauaugacugaccuuugagaggcauggaaggaaaccagcuguugacuggaugaguaaauuaaauucaaccaguguuuaauaaacuguggaugauugccgggagaccuuaacacuugggaaguugguacuuaaaugccaugcuuguuuacaugucagacaccucagcuagacugacagcucuugagagugcauguucuaugucauuuauuuuuguaucccuuuguuugguauauaauaauuuuucuuaauuguuugcuuaauaaauuaaugcaguuaaaaauaacauugacauaugauuaggagauuuauguguacacagcuguuaauuuugaauguucuguauguuauagucaaucuguaaagcaguuaggaauuuagaacacacuuugccguagaaacaauuuaaaguguuagacaauuccucuuuauuguagguggaaugaaggcuaaaaggagguuaugggagccagcaguuuauaggucuuugguuaauggaugaccuuugaaaagaggcauagaaaccacauacuggcugaaaaauuaaauucaacaaguauuuauugguuugugaauauacaggaaagagaauuuuaaaauuuccccugaagauuaaaaaccuucaggggaauuuucaguaauagagagucaaaaugugguaaaugcuauaacaaaaauguuaucaaagcccugggguagugcauacuaccucagugagggagcuuuagggagauuuaggaagacuucccuggggagguggaauuugacuugaaccuugaagauaagggguagacuuuugauugcuagaggagagaaucugugaucacaggagaagccucagcccuauuacucuggcugcaacaauauuucuuuucaguugucacagcuugggaacuaaagaaaggaaaagagauucgcauguucuuuggccuagucacccauucaccccuguguauagcuguauagucccaagucaaauacacguaaauaauggucacuuaaaguuaguauguuacaaguuuucauuccaagugucaguuguaaguuuuacagguuuaacaacugauuaauuuguuaauaaacauuuuuugagugccuaaucuguacaagacacuuuuagaaacuauccauacaauaaugaauagggcaaagguucugccuuaaacacuuuagagucuaguaauucuguuugucauugaucagaauaauaaagcaacauuucucugguugaccugacucccauuauccuuuggcugccaauaguaacccuuucuuucuaaaacccauggggugagaagggacaugucuggcccucuuccucaucucuguuuccagagagaucaguguugugagugcuuguggaaaguggggucauuuucaacuuccuccucuuucuagggacaaucacucugugcuuuucuuaugcccacuuacccucccaaaacagaaauuagacauggggauugggaagacaugagaauugguacccgggagaaacggccucccauccacuggaauuaggaggaagaacauuuggaguucuuuccugucuccaaacuuuucauuucuucucaaaagaaaaaaaaaaaagccuauccuuucuucuacucuccaucagugaauccuuguugauguaggcaacuuugggaauaaaugacgauuuucauggacaaggcccccaccucaugauacucuggauacuaacaaaaauaauuuuuaugcauaauaauauuauucuauagaagucauucuauuuuaaauucaauuaaugcagauuuuuaaaaauuggcuuuggugauucauggcauauuauuggagggauuaccauccaguuuugacuauuagagggucaucucauagccaaggccuuggauguuugcaguuaaguuucugagcugcuagucacauaaggcugagggguacccuguuggagguagugagggugcaaaaagugaguauuuuaugccuaguucuguugacagagaaucugaacuguaaauauuccuccuugaaagaguggaugauugagaguuaacuagagcuauuuccugcuugaguuagagucacaauauauguacuauuuauauuugugucuugaacaacaaaacaaaagcaagaggcuggcagaggaacuggaagaaaggcaauagaucuaaagcugaucuuuguuuuaaauaggccgaauauucuacacccaugacucauuguuugugaaagaauaugcuguuuggccuuuucaggggaacuacagugcauccuaugauuuagcaucucaaugagggcuuauucauuaguugaacaaaggcuuuuucuagaaaugaggauuauauuguuaguaauuuuagagggaaaaugucauuguccauuuuuauaguuaaugugguguccaaggaaaacagcaucuuuuagaaauuuugaaaguauaugggaaaaauugcaugcuugacccuuucuauugggagaguuuugugcugacagaauuugaagcauauauaaauacuguuuuguugcuuuggaaauauuuggaaauuuuuuuuacccuaaguuucaagcuuucaaaaggaauuuauauuuuuaauucgugauauauaaaauucaguuugcgaagaaauaaaacacuaauucuuuuaaaaucccaauguuuuaaguaacaauguacuaaauaaauguuuuuuuuuguuccccuauacauuaauaaccaaugguaagugaguuuuaggguuuugacgaaagauuuuaaaggucacagaacaguuguaauuuuuuccccauugauuauuaagaucauuuugcauaguuucagcuugcauggucaguuuuaugacuggcacuuacugguguggcaaagcaaggacugccugguguuaacuaggugaaugaaauugagaauagacucuggaaauucaguugcuagcuggcauuaaggaacugcuugagguuauagaucaugacuuuugaaugagacuggaauuacuaguuuuucuuuagccucauucagcuucaggaggagcuucucucuuucauaguuacacuucugaaguaaguaagacaccacugcauucaccaucaacucccuucaggggcguugggguggagcacaagggaguugauggugaaugcagugguguaauuauaauaauaauugacugugggauuuaaacugaauaaggaagagaaagaauaucuggugauagacaauaaggugguagcauugguggauuaaagggucucacugauguuaaaggguugauggaaccuagagggaaugugcugaaaagauaagugguggaaagaaaguagaauacuagaaguugagauuaugaagugcuuucaguuaucaauagugacaaguucagaagaguaacuauggaaaugagaaacugagguaggaaaaaaucauuggagaaaagaacugaguguaguggaaggaucaucgucaugaaugaugaaugaugaugaaugaaugaugaaugaugucaucagucaugaugaugagguggugucagagagacugacaguaagucaggaucuaaaaauaaggaaauaagggcaguaaugacuugggugacaacaaaugccuguaauaaguugggguagucagugauacagucacguaacuguaaaacugagcuacuaugagaauagucuuaaugguccuaagggagaaagugguagauaguuguguuuugugaaaugagggguggggaguaucuucccaagaguaggaagaguuuugggguucucuuuuauauuugcuagaguccuccugauggagcucaggaauacugcagaaggauucucuugaccccugccagaugaugguccagaaacauagauauucucuuggugacagccgaaugcaauauauuggugauagggucagaauaaugagugguuauugcccuuuuuuagaauucacaaaucaucuauaugacaaaaagcuaaagaccagugguuuuuauugagggagagcuuaggaaccugcuagguuuuagcauuaaaaugccuagcauaaugccuuuuccauaggugcuuaauaagcauuuaugguuuucauuaguuaagacaguuaaauuuuuacuuguaauucucauuuauaauugguuauaccuaaaugugugauaguaaugacguuucuucuuuguauuuuagacuauccccauaaauacgguccucaggggggcugugcagaucauucaguauuugaaagaaugaggaaauaccagaugacugguguagaggaaguaacacagguaaggauuuuaacacuagcuugcauuuaggaaauggaaaugaauuugaggauguauaucuacauuuaaaauauauguucuaggauuucugaaagacuuaacaccacuguggggaauguuuuuuaaugcucaaagaggccagguaacgugccaauaauaaagagauaggacugagguuugaauacaaauauaugugacccaaaagacauuacaagucuaaaauauacuauccuuuacauguuuuguuauaaaagaaaacaaauguuuuauauaaauguaaauauuuuuauuagcauuaaaauuagagugaccacuugccuugguuugccaagguauuccucauuuuuaacacugaacguugugugucagcagacaaucugguuggucauguuaauaaaaaucucaggacuuuucguauuuuaauuauuuuuuucccuuccuuuuucuuuagucauaggugacagguuauaguuauucaaaacauaaguucaaaaugagaaaacauuuuuucuuuuaugauaaaacauuuaucauauauuuuggacauccuuucuaaaaguaguaugguagaguuauguuucuugagccaugaauauuuguauucagaucuauucuuugaucuguaaaauggcauaaacaauucuguuucaggugggucuuucuaguguuaagugagauuuuauucuuauauguauugaagaaguacauauugaucuucugccauaugucagagacuguggaaaguucugggaauauguggagauuaagaugaaggcuauucucaaaagguuaucguuuaauuggagacacagagaaacaauuuagaguaguaggagaggguuaaguauaggaugauauucuacacacaagaggaauagcuaaucuagccuuauaaguauuugaaggcaauaaucagaccuuaagaauaaguaggaguuagguuagccaugaggauauggaaagacuauuccaagcaggaggaacaguacauacaaaggccaaggagacagaaagaucaguaaagaauuuuuaacaugaggguagaguuuaagaguagauuuuaggagacuaaugagaaguuguuguaguuauucaguugagaagugauaguggccuguacuaauguauuggcaauuuggauagagggguugagauuauagacuguuagauaugauagaauuuagcauggugcuugauaaaauauuaauauacaaaaguagguugcauuuauuuauaccacgaguagacuaccagaaauauaaugaaaggguggacauuguuaauaaugucagagaauauuauauauuauagaauaaauguaacaaagaauuauaagaccuauguaaggaaaaucaaaacuuuauaaaaauauuaaggaagauugauuuuaaaugaauggagagauauaccauauuaaugggaaauaauaauauuauaaaauuaucaguucucccuuuauugauuuguagauucaaugguaguccaauacacauuacaacaggcuuauucacaacacucaaugggucaaaaauguuauauggaaaaguaaggacuaagaagaaguagggcccauuuaaagacgaugaacaggaaagagggaaagagggauuuacccuaggagguauuaagacuugcuauaauaauugagagugugauagcacaaggauggacaaauuaacuagcggaauaaaaaugagugcuuagaaaaagacccaugcguauaugaaacuuuguuaugugguagagaugcaaucucaaauuaguaaggaaaagugaggaccauugaauaaauggauccagaaaaaaauguuuaucuauuugaaaaaagaugaaguuggaucaccauccuacaacaauaaaguccaggcuguaaaugaaguccauauuuacaacaaaaaagucuagauggauugaaguuuuaaaugucuaaaaugaaaacuuugaaacuuguagauuucccuuucaagcugugauagaguaacugauaucuaacuaggcuuucuacaacaaacaacuagaaaaccaaacaaaauauuucaaacaauuauuuucaaacauuagaaaacaagcauugcaggauugauaucugagugaggaaauaaauaucucugugauuucccugccuucuuggcuggagucgaaauuucagauaugacacacagaaggagaucucaagaaggauaaaaacacagcaguguugcugaguugaagaguuagaauuaagaguucaggaagacugaggugucuggacuuacgggcgcaauaccugagaggagagagcuguguugagaaaaagcuccagauaucugcacagguguugcuuuccuugagucuuagcugaauacuaagcugugccugccugcacgggaugaaauucuuugagaaaaccaugagacaaagaaaaacuaccuggacucugugaaaugaacaacugucaaaaacaauacuugggccagguguggugguucaugccugugaaucccagcacuuuagaaggcugaggcagcaggaccacuugaggccaggagugcgagaccagccugggcaaacuagccagaucucaucuccauaauaguaauaauuauuauuauuuuuaauuagcuggguguggugaugagcaucuguagucucagcuacucuggaggcugagacgagaggauuucuugagcccaggugguugaggcugcugugauccaugauugugccauggcaccccagcccgggcagcagcgcgagacccugucucuaaaaaaauuacacuuauuagauaucccaagccgugguaguagcagggcuaaccuagcccuagaguagaagcuacuucagaccugcccuuccuaagcagaaaaacaaaccucaaaaaugucaaacugcuuuucaaauaaauuagcugucugucagagaaaagcucaauaauauuuguuaaaggaggacacuaaguccaguuacucagcaguauaacauucaguguucagcauucaaagaacauuacuagaugacaagaaacugaaaaacgugauucauaauaaggagaaaagccaccuaaauagaaacacaacgucuguuaauuacagauguuaacaggcaaggacuuuaaaacaacuauuauuaguauguucaaagaauuaaagacaugaacacaaaaaggagagaauggaaauucuaauaaagaaccaaauggaacuucuagggugaaaaauauauuaucugagguaaaaaauuuaguggauaggcuuaaaagaaaauuaauuacugcagaacucaauaugaauauacuugaguaaaggaaaauaaaauagacaguauccauaucuaagcacagagggaaaauaauugacguccagcaggaagagaugcagaaaaaaauauuuaaaaauuaaugccuccgaauuuuuagauacuaggaaaaauuucaauucaugguccaagaaacucaaugaaacacgugcaggauaaacacaaagaaaaccauaccaggguauguuacaauuaaauuauuggaaacaccugaaaaucauaaaaaaccauaaaagcaggcagagaaaaggagauacauuuacauacaggggaacaaagauaaguauaacuggugacuucucauuacacaguacaaacuggaagacauagaauaacaucuucaaaguguugacagaaaaccugccaaacuaggauucuauauucagugaaaauaauuuucaaaaacaaggcaaauuaaagaucuuuuuaaauaaaaauugagagaauuugugucuaggugaccuacacuguaagaaacauuaaaggaaguucuucaggcagaaaaagauaccagauggaaacucggauacacacagaagagugaagaacauaaaauaguaacuauauagauaaauauuaagcaguuuuuucucauuuaaaaaaaccuucaagagauuauuaccuaaguccaaauaauaagguauaauggauuuuguaauauacagagaaucaaaauuuaugacaguagugcaaaggacaagagaaagaagaauagaaguauguuucuuaaacaauuugugaagugauguaauuuugacagguaaacugugccgugauaaagauggauauuguaaaccguagagccggggucagcaaacuacggccugugggccagauguuugcuuuuguaaguaaaguuuuauuagaacacagccacaccuauucauugauagguugucuauggcugcuuuuacauuauaguggcagaauugaagaguugugauagagaacaacuacauguuguucaaaagucuaaauguuuacuauuaggccuuuucagaaaaaguuugcaggaauuuccucugcccuuggagcaaccauugaaaaaagaagaggaaauaauuuaacauguuaauaaaauaaaucaaauguauuuaaaaacaguuaagagaaguuaggaagaagagaaaaaggaacaaaaaacugaugggauaaauagaaaauaaauagcaaggugguaaguuuaaaucuaaccauauugaugacugcauuaaauauaaauggacugcugaggugugaagauugcuugaggccaagaguucaagaccaaccuggccaacacagcgagacccugucucaauuuuuuuuaauuaaaaaaauauaaauggacuaagcacguuaauuaagaaacugagaugguuagagugauuaaaaaaaaaagaccaaaugagcguaaaagaaaugcaauuuaaaugaaaagacacaguuuuaacauuuaaagagcuaggugagaugguucacucuuguaggcccagcuugucaggaugcugaaguaggaggauuacuugaauguagaagguugagacugcagugagccaugauugauugcaccaguguacuccagcccaggcugcagagugagacccuauuuaaaaaaaaauaaaaagaaaaaaaagaaaagaaaauagcuaauuguuuuggauuugggucauaaaaugauggaacagaaauuggguuuaguuaauuaugcuaugaauuaauuuauggauccauauucucagaguuuauccuuaaagacagucuuaaaguccuuaagaaaauaaagagagaacggccaggcguauuggcucacaccuguaaucccagcacuuugggaggccgaggcaggcggaucacaagaucaggagaucgagaccuuccuaacacagugaaacccugucucuacuaaaaauccacaaccaaaguuagcugggugugguggcggacgccuguagucccagcuacuggggaggcugaggcgggagaauggcaugaauccaggaggcggagcuugcagugagccgagauugcaccacugcacuccagccugggcgacagagugagacucugucucaaaaaaagaaagagaaaacuucauaacacauuuuaugagggcaguguuacuuugauagucauaccagagacauuacaagaaaacuaagcuacagggcaauauuccucagaaauauaaaaguaaaauuucuuaaaauauuagcaagugaaauccagcaauauauauaaaaaaacacauuaugcucaaaugaaguuuauaccagaaaugcaaaauugauuaacauuagaaaauuuguguaauccaccacauaaacauaauaaaggaugaaaccccucugauuaucucaguagacuaguaaaaaagcauugccaaauuucagcacucaacacauggcaaacuaaaaauagaaggaagcuuucuuaggcuaguaagagcuuuuuauaaaaaaccuacagcugauaccaugcuuaaaagugagagacuaaguccuuuuccuuugagaccaggaauaaaagcuuuuuuuuuuucuuuuuugagacggauucucgcucugucucccaggcuggagugcaguggugugaucucggcccacugcaaccuccaccucccggguucaagugauucuccugccucagcuuccugaguagcugggauuacaggugcgcaccaccacgcccaccuaauuuuuguauuuuuaguaaagaugggguuucaccauguuggucaggcuggucuugaacuuuugaacucaugaucugccugcuucggcuucccaaagugccgagauuacaggugugagcccacugcgcccagccaaggaauaaaaacuucuacucagcauuauacacaaaguccuagccaccauaauaaggcaagaaaaauaaaugaaaggcauacagauuauaaaggaaguaguuaaagguaauacaagaguauaccuagaaaaaguuacuagaaucaauaagcagacuuaucaaggacauaggcuaaaaguugguauaaucagucguauucuauauacuggcaaugaauauuuagaaaaugaaaaaaauuaaaauagcaucaaaauauaaaauauguagaauaaauuuaacaaaauaugugcaagauguguacaugaagaacuagaaaacauugccaagaaaaauuaaagauuaaauaaauugagaaauaaacuuuguuugugguuggaauccucaauguuaauaugucaguucuccccaaauuguucugcagauucagugcagucaguaucaagacuuccaguggacauuuaucuaguaguugacaaacugauucuaaaaguuauacugaaagguaaaagaucuagaauagacaaaacaauuuucaaaaaagaacaaggauggaagauuuaauaguauuugguuuuuaagacuuaguauaaaguuacaguaaucaagauagugucaucuugaccuaaggguaaacauguagguaaauguagcaacauagagaguccacauggucaguugauuuuugcaaaagucccaagguaauuuaaaagaggaaagaacagucuuuucaacaaaugguacuggaacaauuggauauccauaugaaaaaaaaauugagauucaccuguacuucacaccuuauacaaaaauuaacucaaaauggaaaauggaccuauaugccaaagcuaaaacuaaaacuaggaaaaaacauaggagaaauuuuugugacuugugauaacaauuucucaaggcacaaaaauucccuaugaaaaacauguauaaacugacuucaucaaauugaaaaaccuugccucaaaaaacauaguuaagaaaaauaggaaaacaagccacagacugagaaaauguccacaaugucucugauaaaaggcuuuuuuccagaauaguaaagaacuguuauaacucaguuaagaaaaaaaaaaaaacacaaaccccaauuaaaaaauggacagugcaccuggaaagccuuuccaagaaggacaggcacaaauaagcccagacugugaggacuacagugaauacguaacucuucaaugcccagacgugaaccaacauccacaagcguccagaccauccaggaaaacaugacuucaccaaagaaacuaaauaaggcacuggggacaaauccuggagaauggauccagagauaggugaccuuucagauagagaauuaaaaauagcuguuuugaggaaacucaaagaaauucaugauaacacagagaaggaauucggaauacuaucagauaaauuuaaaaaacauugaaauaauuaaaaagaaucaagcagaaauucuagaguugaaaaaugcacuugacauacugaagagugcaucagagucucuuaguaacagaauugauaaaacagaagaauuagugagcuugaagacaggcuauuugaaaauguaaagucagaggagacagaaaaggaauacucuaaaagaaugaagaacaccuauaauaucuaggaaauagccucaaaagggcaaacauaagaauuauguccuuaaagaggagguagagaaagagauagggguaaaaaguuuauucaaagugauaauaccagagaacuucucaaaccuagaaaaagauaucaacauucaaguguaagaagguuaugaagcaccaagcguauuuaacccaaugaagacuaacucaaggcauuuaauaaucaaaccagcaaaggccauaaagaaaagauccuaaaagcagcaagaaaaaagaaacaaauaaccuacaauggagcucugauaaauuuggcagaagacuuuucaauagaaauuuuacaggccaggagagaguggcaugacauguuuaaagugcugaaggaaaaaauuuuuuauccuauagcaguauauucagggaaauagccuucaaacacgaaggagaaauaaaaacuuucccagagaaacaaaaacagauggauuucaucaacaccagacuuguccuacaagaagugcuaaauagaguucuucagucagaaagaaaaggaugugaaugagcaauaagaaauuauaugaugguacaaaacucauugguaauaauaaguacacagaauauuguguaucugugauuaugguauauaaauuacucauaucuugaguagaaagacuaaaugaugaacugauaaaaaauaacucuucaggauauagacacuacaauaaggcaugaauagaaacaaaguuaaaaagcagggggacaaaguuaaaguguaaaguuuuuauuagucuucuuuuugcuucuauaauuaugcaaucacuguugucaucaguuuaaaauaaggauuguaagguaguauuugcaagccucaugguaacuucaaaucaaaaaacauaugauagauacacaaaaaauaaaaagcaagaaauuaaaucauaccaccggagaaaaucagcuucacuagagggaagucaggaaggaaagaaggaagagaaggccgcaaaacaaccagaaaacaaaaaaacaaaguggcaggaguaaguccuuacuuaucaguaauaacauugaaugucaguggaccaaagucucuaaucaaaagacauagaguagcuaaauggauuaaaaaaccccgaagauccaaugaucuauugcauacaagaaacacauuuuaccuguaaagauacacauagacugaaaauaaaaugguggaaaaagauauuccaucccagcggaaaccagaagagcaggaguagcuauacuuguaucagucaaaauagauuucaggacaaaaacuguaagagacaaagauagucacuauauaauuauaaagggggcugggccuggcagcucacgccuguaaucucagcaguuugggaggcugagguggguggaucaccugaggccaggaguuuaagaccagccuggccaacauggcgaaauccugucucuauuaaaaauagaaaaauuagcugggugugguggugggcaucuguaaucccagcuacucaggaggcugaggcaggagaaucacuugaacccaggagguggagguugcagugagcugagauccggccacugcacuccagucugggugacagagcaagacucuguuucaaaaaaaaaaaaaaaaaaaaaagaauauauauauauauauauauauauauauacuauauauauauauacuauauauaauauauauauguauguauguauguauguauguaugcaaagggaucaguucagcaagaggauuuaacaacuguaaauauauauuaauauaguuuggauauuugucucagcccaaaccuucuguugaauuguaauccucagugcuggaggugggaccuggugggaguuguuuggaucaugggggcagaucccccauggcuuggugcuguuuuugugauagugaguucucaugagauuuggugguuuagaaguguguggcaucuucccccacagacacucuugcuugcuccugcuuccagcaugucaugugccugcucccccuucaccuucugcccaugcuuauaagcuuccugagaccucucuagaagccaagcggaugccagcaccaugcuuccuguaaagccugcagaacgaugagccaauuaaaacucuuuucuugauaaauuacucagucucaguuauuucuuuauaacaacgcaaaaauggccuaauacguauaugcacccaacacuggaacacccagauauauaaagcaaauauuauuagagcuaaagagagagagauagacuucaauacaguaauagcuggagacuucaauaccccacuuucagcaauggauagaccuuccagacagaaaaucaacaaagaaacaucagacuuaaucugcaguauagaacaaauggaccuaacagguauuuauagaccauuucuuccaauggcugcagaauacacauuuuuuucuccucagcaccuggaucauucucaagaauagaccauauguuugguuguaaaacaagucuucaaacauucaaaaaauugaaauaauaucagguaucuucucugacuacacuugaauaaaacuagaaaucaauaacaaaaggagucuuugaaacuauacaaucacauggaaaguaaacaauaugcuccugaaugaccgauaggugagugaaaaaauuaaaaagaaaauuggaaaauuucuugaaacaaacgauaauggaaacacaacuuacuggcuaggagugguggcucaugucuguaauuccagcacuuuaggaagcugauguggaaugaucauuugagcccaggaguuugagaccagccuggggucuauaguaagaccuuuucuuugcaaacaguuuaaaaauuagccaggugugguggugcaugccuguagucccagguccuugggaggcugaggcaggaggauugcuugaacccaggaggaggagguuguggugagaaagauugugccacuuuacugcagccugggcaacagaaggagacgcugucucaaaaacaaagaaaacacaacauaacacaacgcguaggauacaguaaaagcaguacuaagaggaaaguuuauauagcuauaaaugccugcauccagaaagaaaacuucaaauaaaugcacuaacaaugcauuuugcaagagcaaaccaaacccgaaauuaguagaagaaaagaaauaauaauaaagauaagagcagaaguaaaugaaauagaaaugaagacaguauaaaagaucaaagaaacaaaaaguuguuuuuugaaaucguaaacaaaauugacaaaccuuuagccagacuaagaaaaaaaaaagaccuaaauaaauaaaaucagagaugaaaaaggagacaucacaagugguauagaugaaauucaaaggaucauuaguggguacuuugagcaacuauaugccaauaaauugcaaaauguagagaaaauggauacauucuuagacacauacaaccuaccaagauugaaccaugauguucaaaaccugaacagaccaauaacaaguaaugaaauugaagcuguaauaaaaagucuuccaguaaagaaaagucugggacccaguggcuucacuguugaauucuaccaaauauuuacaauauaacuaauaccaauuguacugaaacuauuccaaaaaauagaggaggagggaaaacuucaaacucauucuaggaggccaguauuacucugauaccaaaagcagauaaaggcagcaaaaaaagaaaaugacaggccauuaugucucaugcauauugguagaaaaauuaucaacaaaauacuagcaaacugaauuuagcaauucauuaaaaagaucauucaucaugacuaagugguauuuaucccagggaugcaagaaugguucaacguaugcaaaucagucagugugauacaucauaauggaaugaaggacaaaacuuauacgauaauuucaauugaugcugaaaaagcaguugauaaaauucaaaauccuuuccugauaaaaaugcucaaaaaauugcguauagaagguacguaucucaacauaauaaaaguaauguacagugaauccauagcuaguaucauacugaaugggcaaaaccugaaagccuuuuuucuaagauugggaacacaagaaggaugccuucuuucagcacuguuacucaacauaguacuggagguccuagcuagagcaaucagagaagugagagaaauaaagugcacccaaauuggaaacaaagaagucaaaauauccuuguuugcagaugauauaaucuuauauuuggaaaaacccauagacuccaccaaaaaacuauuagaacugauaaacaaauacaguaaaguugcaggauacaaaaucaacguacaaaaaucaguagcauuucuacuguuguuuccagcaacaaacagucugaaaaagagaagcaaucccauuugcaguagccacaaauaaaauuacauaccuaggaauuaaccaaagaaguaaaagaucucuacaaugaaaaguauaaaacacugugaaagaaaucgaagaagacagaaaaaaauggaaagauauucuauguucguauaucggaagaaucaguguuguuaaaauguccauaauuacaaaaggcaaugcaauugcuaccaaaaugccauugucauucuucacagaaauagaaaaagccauuugaaauguuuuauggaaccagaagaaacucagaauaaccaaugcuauccugaggaaaaagaacaaaauuggaggaaucauauuaccugacuucagauuauacuguagcgcuauaguaaccaaacaacaugguacuggcaugaaaacagacacguagacccauggaacagaauagagaccucagaaacaaauugauacaccuacagugcauuuuuuacaauggugccaaaaacauccauugggguaaagacaaucucuucaauaaauggugcugggaaaacuggauauccguaugcagaggaaugaaacuagaccucuauuucucaccguauacaaaaaucaaaucaaaaugaauuaagacuuaaauuuaagugcuccacugugagacugcugcaagaaaacguugaagaaacuccccacuuucauguggacaaaaauuucuugaguaaaaccccauaagcacaggcaaccaaagcaaaaauggacaaaugggaucacaucaaguuaaaagcugcggcucagcaaaggauacgauuaacaaaguggggagacaacccauagaaugggagaaaauauuugcacacuacuugucugacaagggauuaauaaccagaauauauaaggagcugaaauaacucuauagaaaaaaaucuaaucugauuaaaaaaugggcaaaagaucugaauagacauuuccuaaaagaagacauacaaauggcaaacaggcauaugaaaaggugcucaacaucauugauccuuggagaaaugcaaauaaaaauuacagugagauaccgucucaccucaguaaaaauggcuuuuauccaaaagacaggcaauaacaaacgcuggugaggauguggggaaaaggaaaccgccacacacuguuggugggaaugcaaauuaguacaauugcuauggagaauaguucggagguuccucaaaaaacuacaaauagaacuaccauaauccagcagucccacugcugcacaucuacccgaagagauacaucauagagauagcugcacucccauguuuguugcugcacuguucacaauagccaagauuuggaagcagccuaagugucuguuaauagaugaauggauaaagaaaaugugguacauauucacaauggaauacuauuuagccauaaaacagaauuagauucuguaauuugcgacaacauggauggaacuggaggucauuauguuaagugcaauaagcuaggcacagaaagacaaacuucacauauucucacuuauuuguaggagcuaaaaauuaaaacaauuuaacucauggagauagagaguagaaggaugguuaccagagggugcaaugaguauuagagcaguggugggggaaguggggaugguuaacgggcacaaaaacauguuagaaagaaugaauaagaccuaguauuugaaagcacagcagggcaacuauagucaauaauaauuaaauuguacauuuuaaaauaacuaaaagaguguaauuguauuuuuuguaacaaaaaggauaaaugcuugaggggauggaugccccauuuaacaugaugugauuuacacauugcauuccuaucaaaguauuauauaucuuauguaccccauaaauauauauaccuauguauucacaaaauuuaaaaacaaaaaauaaaaaaauuuaauagauaaugggcaaaacauuugaaaagacacuucacaaaagauauuauaaaauauuuuggauuuugaucuggagaaaugguuugaauauguaagacuuuucaguauaaaaaagaugaauauauuucacuauaugaauauuaaaaauaaaagacaccuuaaagugaagacaaguuauaaacuuuguauaaaauuuuaugcuuucacaauguauaaaauuaauaaagaauuguuuuuaagaaguagagaacaacugauuaguacaacuaauauauagcaaccuggccugaaaauaaaaauauuuuaaaaauauauguguauguauauuuccauauacguguuuuguauauuuguguguauuuauuugaaggcauuggaaagauaacaugacugugaaguaguacgcggccaagauuucagaaaaaaguauacagcuagaauggugauacugguauuugguucuaccuuuucuccaggugugucuuugaguuucugaggagguggcugagagacugagagggagaguagaacugugcagacacaugaggcugaggaugaaaauauuguuuaggaucugcccagaagagcuuuugguugggaccuugaaggacuacucccuaagaauaaggguauaaauuauaaaauguucagucucucuucacagggauuaaaguuucacaccacaucucagucccuaacuggauuaaggugauccaggauuacuagugcaccaagccuaacucugcuuaccagaagugaaaguaaaucuuuugagaaaggugucaaucacaacuucacaucaaaucugugguuauccauauacauagccuggcacucaguucaauguaaccaguauaugaacaaacaaaacaacaugauggaagaacaagagagucaacugacaaaggaaaugguaccuggauaagaaaauuaucugacacagacuuuaauauauucaagucauaaagacuaaauuuaaaauuuuagcagaaaauugaaaauuaacaaaagaacuugaugggaaauuuagaauugacaaauguuaacaacaaaaauuaggaauuugauggauuuagauuuggauaguauaagaaaauagagcaaacugcuaagaaaaggauggaaaauacagaaaagagcauaagagaaauagaugauaccuucagaaggucugauauauguauuauguaauugauguccuagaaggaggaaaauggagagucaaggacagguaauggcugagaauuuuuccaauguaacagagagauaucaaacaacacauucauuaagcccuguaauuagggcaggauaaaugcuuuacacugaaaacaauaccauagcacauuauuugagaaguccgaaagccaaagauauaaucuuaaaagcagccggugagaaaaaguuuaaucacucuuaagcaacaguaaacauggcagcucauuucucauuggaagcaguuaaaaagacagaagacaguaggauaugcugaaacagagaaacugccauccucuaggaugcucuacucagaagaauagaucaaaguaaaauuaacacauuucaaauggaauauauaaccaucugacacgcuaaaaguaguuuuuuuccuguugaaaagauugcgggcucaaaugcuaacuuguagaugaaguauugaauaaagaacacauuagauaauuuugaguauugacuguauacuacaaagcacuaauaguaaagacuuguagggugguauauauuuguauguuguguauguggauauagagggaguuaaaauuggagugagaaaaauguaauuuaaguguucugagguucuuuucuaggaacaaguaaauguuauaauuuauauuugauuuugguaagucaaguauuaguaaaauauauaacuaacaagcuaaugggggaagggauagaauaaaaauucaaaauccaaaacaaggcaagaaagaaguuaaagaagacuauugaacaggcaggacaaauagaagauaauaaaauuggagauuuaaaccccaaaauaucuguaauuauauuaaagguaaauggauuaaaugcaccgauuaaaagauaaauauuaucagauuggauuuaacagcaacaaaaccccacaaacuguuuuacaaaaacugcuccuaaaauauaaggaugcagaaaagauggaaaguaaaacagcacaagauguaaacuuugaugacucuaacaaaaauaugucuauuaucagccaaaguagauuuuaaggcaaaaaaaaagcauuacuaaaauagauaugucauaaugauaaaaaguuuaguucuccauuauguuauagcagccuuuaauuuguauguccguaauauuauaacuucagaauauguaaggcaaaaguugacaaaaccggaaggaauaauagaaaaaucauaugauaaauaagagaacaguuguacaaaaaauaaaacccagugaagauaugggagagcugaacuacuugauauaauaaacuugaacaccuuuauguuauuuuuuucugcuuggaacacuuuuucauauuucagacuguuuucuuauuuaaaaccuuucuuuaaauagaauuuucacauuaaagcauccaguuuuuuuuccuuuggucuggaguagaaaaucuuucacacauaaaacuucaccauuagcuaagauaaauuccuuuuuguguggaauaacaugauuguaaauauaaacugcauuucacaaauaacauggauuugaaauacuucucaauguuugagucauuuacaaacuguguaaacugagaccuggagaccaucuaaaucaaaauccugaguggaacaguauucaagguaggcuuuggggacaguucccccaaauguuacacuguuucaguaguguugguacccaucuauaauacaaauuguuuuaaaaauaaguuuuauuguguauauaucagguauauuacaugauguuaugggacacauauagauagucaaaaugguuacuauagugaagcaaauaaacauuuccaucauuucacauaguuacccuuuuuuguguguuuggcauauaauacaaauuuuucauuuuguguauguucacauggaauuauuaagggagaaggaaaugucaaggaagaagaaauugugacuuaaaauucaauuuggguucuauauuacugugccaucaaaaauacuuaagaugauccuuuuagguguucacaaauguuugacuggauucaauagcagugguaauucuuugaagaaauacuuaauugaggccaggcacaguggcuccugccuguaaucccaguacuucgggaagcugagacaggaggauuacuugagaccaggagcucaugaccagccugggcaacauaggaagaccuccgucucuacaaaaaaauuaaaaaauuagccaggcauggugauacaugcuuguagucccccagcuacuugggaagcuuaggcgggaggauuguuugagcccaggaguuuaaggcugcauugagcugugaucaugccacugcacuccagccuggguaacagagugagacucucaaaagaaauacuuggcgggggugguggcucuguaauccuagcacuuugggaggccgaggcgggcggaucacgaggucaggagaucgagaccaucuuggcuaacauggugaaaaccugucucuacuaaaaauucagaaacaaaauuagccaggugugguggcaggcgccgguagucccagcuaugccggaggcugaggcaggagaauggcgugaacccgggaggcggagcuugcugggagccaagaucgugccacugcacuccauccugggcaacagagugagacucugucucaaaaaaaaaaaaaaaaaaaaaaaaaaaaaauacuuagugucuacucuuugcugccaagccuguguuaggugauagcauuacagugaggaucaaacagagauaauuucuucuuuccagaacuuacauucuagugggugaagugggauguggacagaaauuaaauaaucccacaaauaaauguaagguugcacuauguaagagacauugguguaugauucuauggagugguauaauggaugaauugaccuucucgaagucuaaggaaagaaggaagccauuaacaagaucagaagagguagugucagcaugugcaaagacuggcaggagauagacuguguguggaggauuggaaagaaagcuuauauagcuguaccacagacagcuagaguuggcuaauguagggucucuuugugaaguaauguggaaugagaaaagcuggauaguuaaguagaggcuguguaauguugauauuuaggggagcauauaaagaauauugggcuuaaucuuuuagagcaauaggaagucauugaaauacauuauugagguggaugacauauucaaauuugcguuuugaaaacauugcaauauggagaagagauguaaggccauuaguggcuauugguugauuaaacugaucuuacugcaguacucuagguaacaaguaaugguagcuugggcuagagugguggagccagagauaauggguagauaccuuagguauuuaggagauaaauuugacagaacuggaugguagauggguauuagaugugagguagagaagauaucaaaguaguauaagcuauuauacaacuugcuuuagauuuaaaugaauacauauuaaaauacauguuuugaaaauguuuaaaagugaaggaguuccuugaauagauaguaaauaaucuauauggagaagauuaugagacaaagugauuuuaugaacuuuuaauggcagcagaaauaccuaugguguuauauaaagcagaauaugaaauuguuuauaguauguauucuuaauuagauaaaaugauaguauugaagcauacuaauugucagaaaugacuuuuugauguauagauaccucaagaagaacaugcugcuaaugguccagaacuucugaggaaaaaacguacaacuucagcugaaaaaaauacuugucagcuuuauauucagacugaucauuuguucuuuaaauauuacggaacacgagaagcugugauugcccagguauuuaugauuaugcgcuauuuuaguaguucccauauuguuuuauaaugccuauucuuuccuuuaaaaauuuaaguuaguguauucucuuuuugggaaaaaguauguguuuucaguugugaugugauaaaauguguaagauaaguacauggauaacugaaagaccaguugggauauuuuagugucaaaagagagggguaagacaaugauuuccugaaggagaugaugacacugaaguuuagcuuuggaaagagaguugaauuuucauuuguggucuuaaaggagggaaaguuggaggaauccuuccaacuggaaguauuuaauuuuuuuucuguauuuuuauuguauguagcacuuucuaaguuacauuauuauuuguacuugugucuucucaacccucauuaaaguauaaauauuuugagggugcccuucaaaauguccuucguguggaagguacccagugagaauuugaugaaugaacuuuugacucaaaggauuugaaauggagaagauggagguacgacuaguauaaaugaaucauuuugguggugaggaugaacuuccuuuuaaacauguauaaaagcuagguaguucuucccuuaggauuuugaaaaugugaaacuagagcuugagggaaggguagccuugagagauugaauguggaaagaaugaaaccaaaggagaagaaauuggagcuaucuguauauggugaauagguugaggaagagaagcuagugaggaaaacauaauaguaauaagguaggagauuuuguaggauuuaccaaggaacaaauaaauuucaagacaaaauagcgugaauuuuauaaugagcccuaugagcaguuaggaauuucauuagcaguguuuggcagcgugggcuaccuuugaaaugauuauuguuaaugcuuuuacuugaccaucuuguuuuauguuuuauguuuauguuuuuacaauuucuuugaaaauaacuuugagacuauacauacauguuuucacauaaaugguagcaagaguacuuuuuguaaaugaaguugggaagguuguuuacagagugguuuagaagucagaaaguuuaguugggggucagcuagguaaacggauacuuuuggguuuaucaucguuuaucuccuuguagaauuuagcaaaaucugaauguauguuuauuauauuuguauuaucucccuccuuucuuccgcuacuaaaguaagccucuguaaauuuauagggaccuucuguauuuuguucaccacuauauccccagugccuaaaacagugccaagaauauagaaaggggucaacaaaguuuacagaaugugcagcaauagaaggauuaaagucagggaaugacuguguguccugagccaucagggaaguucuuauaaaaauguuugagcugagucugaaggauaaauagagaaggauacucuacgcauaggaaauaugugaaaaggaauggacgugugacguuguaggauuggauugaggaaacaaaauuuuuaugugacugaaacaagaguauauguuuaggccaguugugguggcucaugccuguaaugccagcacuuugggaggcccaggugggugggucacuugaggucaggaguucgagacgagccuggccaagauagugaaaccugucuuuacuaaaaauacaaaaauuagcugggcauggugguaggcgccuguaaucccaguuguuugggaggcugaggcaggagaaucacuugaaucugggaggcagagguugcagugagccgagauugcaacacugcacuccagcgugggcaacagagcaagacucuugucuccaaaaaaaaaaacaaaaaaagaaaaaaaaaaaccgcaaagaaguaugcauguuuauuguuggccagaggagucuggaaaagaaaguagaaucucccuucccagcgcagcucacuaaucuuuuuuauauuuauguccaguauauaauguugacauuuuaaaauuugaauguggcaggacaugaauaauuacugauuuuggaaauggaaauuuauaaucuuuuucauauuucaacauugccucuaaaauguucuuuuuuuuaaaucauagauauccagucauguuaaagcgauugauacaauuuaccagaccacagacuucuccggaauccguaacaucaguuucauggugaaacgcauaagaguaaggaacuuaaauaguuaaaaacacuuaaaaagugaaacaguccagacuauguuuacacacacacacaaaagcuugcuuuuaauuuuaucuuuaugaauuaaguaguuuaguuuaauuguaucuguugaugcaguuuuuuacuccuggcauuuacacacccacacacacacagauacuuggguuuaugauuuaagaauuaaauguauaaggucuuaauccagucuacaguagagguaaaguguguauucagucugucugauuaacauauuauuaagaaagcucugacccuucaauaacuauggcuauagugcuugacuuuuccccaauuaucccucaguuuccuaaaauuugcuuugugcaguguuuuucacuguauguuccauuugguguuccaggggagaaaaaggauaaauacaguguuuaaauaaaauuggaaguuggaaaaacccuuaguacuauaaucuucuugaaaauucacaacucacaguaacauauaucaaguuuugagaagucuuucaggaaagaaacccauauuuuucuaaauuuuugaccaugaaacuuuuuuuuuagaaaaaauauauuaacaucaacagauuccaaaauacuuuaggcauuuugagaaaagcugauccggagccauagggucacguaguaugaguucuaauguuauaaauuacagguaaauaaauaaauauuaaauuacugacaaauuuaggcuauuuuuucaaaagauuucugaauauucuaaauauauauguauagcuuuuaaagaaacaguauuuauaugcuaaauaaacaaccgaacuuaaaaaaaaaucauccuuucacaaaaguauuugccacaggguuccuuaauauuuaugcuuuccuauuuuucuucaaaugugguuggauaaaaugucuauacuagagaaguuuaguauauacauucagccacauagcuguagguaguccuuaaauuuagaagcagugugauuaaaucuuaaauuggauuuucuuaaggugaaauaugauuuauugauuuacaguauaagaauuguucauaauuaauugcuuucauguauucugugaacaauauaaauccuuaaaugagcaaguaacagugauaagagguauaaguguugcuguuuaguaggcagagcaauaaaaugcaaguaaugaaaaguagagagcaccugaacacauuuuagugacgcaccuuugaggaaaaugauauguauuaugaagaaaugcauguauauaaguaaaugaugugguaguugguuguuuuuagaccuuaccucuuauuaaaacuuuaguaaaguuuuaucuguugaagauuguucauaaccuauuaauuuaaaauuucugucagcuauauuaauaauccauuuaaauauagguaauuaaaauuuaaaugcaauuuguuuuuuuuuuuugagaaggagucucacucugucgcccaggcuggaguucaguggcgcaaucucggcucacugcagccucugccuuccaguuucaagcgauucucccaccucagccucccgaguagcugggauuacaggcguccacugucaugcccggcuaauuuuuguauuuuuguagauacaggguuucaccauguuggccaggcuggucuugaacuccugaccucaggugaucacccgccucggccucccaaagugcugggauuacaggcgugagccacugugacgggccuuacaugcaauuuuuauuuauagccaguauuagagaauuacuaggaaauuucauuuuuauauuuagugggagaaagccaucuacagcaugucuucaagcauggacuaucuguaacauacagugugcuugcuuuugaauuguuuuaguguuaaauggccguaacugauuguuuuucguuaauuguuaauagauaaaccagauguucugaaaucuguucuuaagcaguugcccucaaugguguuuuugccucccugcuucugagccucuugguuuuacuggagaguacaggucauaaagagaccuguagcucuuguuguaucaaccauuaugucauccucuuacugccaacauuuucaaacagacugagguuugccuuucgguaaaaacauuuacuuucauauuguaauuccuuggcuuaccuggggaaagccaaaucguucuaggacuucagaggagacacacaggucucugaaaggaugcaggggcuaauaaauaaaagcuuuuguuuaauagaagucugguauuagaacagauuauucagauucugaaggaggaaccugugguaggaguauaguagcuaaguaucaaaagaaacauucuggaagaacucagcuucaaagaguaaaagaagugaguuuaaauuagcaaaauucuugcccacauucaggaaaaaaaaauaaauuugcaguuaguuuggcuuggcucaugugacucucuaggcaaggaaaaccaggaaaaugauuugucugcugaacugacagucuuggguuugauaccuauuuuauauucuaguaauuaguuaaaauacaggguuuuauauccuuguaagugucaccauauguaggagauuaggacuaaaggagacuuguucagagaauuaaauuugaaaaacuauacuuccuuuacuaaagguuuugaaagcaaaacuuguuuuuucuucccaaguguucaguguucaggaaucuggugaauacuugcucagaaauuuaacaucuucaauuuuaauuucccuaccuagccuuucuuuuuuauuuguuguuauuguuuugccuucugugaucagcucagggaugugggcagugggaacaaccuuagaagccuuaauucaggccugauuuccaugggagcauauuguccagguguacgcagaagaaggugagcagacauucacacuaaagcucugcuaacauuaauuacuuacuaaauuauuguuuuggauuuuagaucaauacaacugcugaugagaaggacccuacaaauccuuuccguuucccaaauauugguguggagaaguuucuggaauugaauucugagcagaaucaugaugacuacuguuuggccuaugucuucacagaccgagauuuugaugauggcguacuuggucuggcuuggguuggagcaccuucagguaguuuaucauauuaaauaugucuuaacuuacuacuugaaacaaaggggaguuuucagagaauguugaauuuucaaaguauaggagaaagugaugccuguauaauauccuaauuuaugcuacuugaguuaggcaagacucauaagcauaauguaaaagccacaauagaugaaggagcuuuuuauuuugaaacgcauacagggaaauauccugauuccugacauuugaauggaccaaaugaaauaaauaauuuuaugagaaaaagugguaauucugaaacccaaagggaaauuuaauuuuuccacaaaaguuaauaaauguuauauauuuauuaacuuuuuuccccuccaaaauaggguacuuagaaucaaaagaggaaaacugugucuugcucucucuucuguagugagauaaagaggagagaaauccucaucaagaguggcagguaaaaggaaaagaaagccugccuuuauuauuuuauuucuagccuuuauuuuaauaaaagggaagcacugcaugaaagagauguaggcaggaagccccugguacccacaacuccauugacaucaucaccuggguucauacucugccgagucucugccuuagccaugaaagcuauugucauugauaauguugggaugggacaauacccuucccauuacaguggggguggaguguuguggaggagcugugauuuacuguauaaguucaguugccuaguuuagaaauccaaauuuauuaauugaaagaugaguggaaaggaccccaggcucuuugaauauaaauugugccaaguagaguuuaaucaauaguauauuaucuucugagcuauauacaacagauucuccuucugauacuucauuucuauguuuuuuuuuuuaaaaaaaacuucugcuuuauccagaguaagagaagcuuuuguauuccuauucuuauuaguuuauucuuugauuuguuuuguauauuuuaagaucuuaaguagugcuguauuuuccuuuguauuucuuucuccuuuuuuaaaagucaguaucuuaagucaauacuuuuacaauuuccauagcuucuuuuguuuuucuucuauguuuuaaaauguacucaauuucaugaugucauuuuaaaguauaaguuuaugucaugggcugcauauuaauagugcaguacuuuuggauauuugucuuuuaugauaaucuguacuuuuuuguuacuuggauuagucagcagauuguacagcucacucuuuccuaugauuuuucauguucgaaacuuucauacucugaaaccucuuugccccuucaaugguuggaugauuuuaucacaaagucugugauuucuucucccuauucauuaguaaguacuacuaaaaacucagggucucauaugauuuuauuuguauauuauccauuaauacaguagcugugaagucucaaacaagugguucuccaagugugauccauggacuagcaccaucagcaucaccuaggaacuuguuagaaauauaaguucauaggcacuaccccggucucuugaaucagaaacuauagauguggagcccaacagucuuaguuugaacaaguucucaaagugauucugaugcacagugaaguuugagaagcaccacauuaauauuuuugucucuaaagcuugcucacaaaaugccuccuggguaagugaguaugugaucuuaaacuaaaaacuuucugccauuuugcauuuucaguuacagacuauuguacuuaaggauguaaugauucuguaggaauuugguaaaauucuuccuaaaucuucagauauucucaugucuuuagauucagcuacucauuuuguuguaaaaaguaagcuuuauuuuuuagagcaguuuuagauuuacaaaaaauugaacagauuagguauucucaaaucuccuuccucccuccccugacaguuuugaggaguacugaugagguauauuuuagaaugcuccccuauuuggaaucugucugauguuuuccuuaugauuaaacuguaguuauggguuuuugggacacucaguguuuaugucucauuguuugugauauuuggaucaccauuugugaugcugcucauuuuccugagguggggagaguucuggauugaaaaugguggggcauguuacuuguauuuucuuuuuuuuuuuuuuuuuuuuugagacagaguguugcucugucacccaggcuggagugcaguggcgcgaucuccgcucacugcaaccuccaccucccggguucacgccauucuccugccucagccucccgaguagcugggucuacaggcgcccgccaccaugcguggcuaauuuuuuauauuuuuaguggagaugggguuucaccguguuagccaggauggucucaaucuccugaccucgugauccgcccgccucuauuuucauuauuagggucuucuuaaaggugaaacaagauacuuccuguguacuucaugagcaaaaauauggugauuggcaaccagaauagaaaacgaagacucccguugucaacuuuguauccccauuuucccccccucugcuuuuuuuccuuuuauauuauuaucucucuuucuuucagacauuagauguccgcuuccauuacucuauguuaaacccccaacuucagcucuuggaagccaucuucuaagagcugcuggggaggggcuaggcaggcacagaagaauagaggccauagugggaaagaaaagggaucuuuguuccuuugguccaacuuuuucgaguguagguuaccugccuugaaauaacacugccagcuucuucacuugucuuugcacuuacuacuagcugaacugaguuucauauuugacauuuuuuuuuuuaaaacaaggaauguuauauauuuauucuugauuauuucaauacccuuaugagguguagguauuauugucucccuucuacagaugaggaaacuuguguucagaaacuuugugaccaaccuaauaccacacagcuagagguggaacaggaucuggaaucuggaccuuuugacuccagauucaguucauuugguaauuauauuacuagguauuuuauauauauauaaauacaaucuacacacacacacacaguaacaucuuagccuuuucuuugauguuucaaauaagaagcugaaauguuuucugcuucuuaguagagguuauacauugguggaaucuguuuucuucuuucuugagagagaagaguuauaaaaucauacuaagcuauaauauuuugauauaauuuuggguaauugucauggcauaaugggaagagcaauggacugagagcugggagacaggauucuuguguguuuucugucuguaaauucaggaaaaucauuuugcuucuggcuguuuuuucauuguaguucugucuuugcccuucuuuugagucuucauguuucuaccuauaggucuuaucaguuaacugaaugaacauagucucaguucggcuuggucguugaaugaggcuggcuuuggaauucaucucuacaguuaguccugaaaccuucaguacuccucuauuugugaagaacaucuuuugaggcauuucauuugguagaaauagucucuucuguuuucuuuagauuagauguuuuaguuugauauuacauauuaaaauuugagagcguacagaacuuaacacaggguucucgggauaacccacagcuuauugaauucuuaacccauaguuuaaaaguauaacuucaaaugcugggaaaauuacaucauugaaauauugcaauaggacacuugcuauuggcauuuaaugcuugucuggaucccuuggauauuuaacaucuuugaucccuacccauugcaugugaguagugcucuccagacuugaaagccaaaugccugugcucucacauuuccugguaucacuugugggaguauuacuauggucugguccagaauuauugcuuacauuaauauuguaugaucagcaugcuacuauuaauuuuuggccuccucacaucaaaacuguauuuauggaauaugucaagguaucauauuacucuuguauuuuuuucuaagacuuuuuuuuggggggugggguggagugggucuguuuugaaguuuaggacagauacucuaacuuuagcucucaaacuauccuguagauagaaaauugucauuauacuucuuuguugcuuauugaauccuucaucaauaauuacuuuugacccgaauugaaaacguuucacccuucucauuguuauucacaacuuauguauuugucagugauaaauauauguauaguaaaaucuuaaauuuaaaauauauagcaauugaguuugaguuaaugguuuagcuguggguauauaugauaccucauuacugaguuuucuggcauaucaaaacuaguugcaguauuuaaaaaaauuaaaccauaacuuucagaguuacaaauaguauuuuauuucuuccuguauaaucaaguuacuccaacauaugcuauuagccugcaacaaauauuaaacuuccuuuuuuuuuuuuuuugaaacgaagucucgcucuguugcucaggcuggagugcaguggcaugaucucugcucauggcaacccccgccuccuggguucaaaugauuccccugccucagccuccugaguagcugggauuacaugcaugcaccaccucgccuggcuaauuuuuguaauuuuaguaaagaugagguuucaacauguugguuaugcuggucuccaacuccugaucucaggugauccgccugccgccgccacccaaaguguugggauuacagacgugagccacugcgcccggccauuuuaaacuuucauauaagcgauaaucauaaagaccaaaagcaguuguuuaagaaguuaggcaauauauaaauuacuauauuucagaauaguauauucuaauuuauguauacucuucucuuaaauuagccagacccuaaaagugcagaaaaauguauauuaucagagauuuaaaaauaugccuauuuacuuuuuuuuuuuuuaacugauaaagauuugaaguguggagucuucuaugcuuaauucaaguuugacaguacugcauuggaccaauuugcacaugacaaaucuucacuaaggcaggauauuaauuuacuauuuguuuaaaacuaugcuguguguacaauaauuauuauauacagaauacuuauuuauauauuuucugguuuccagaaauaaugaugugcuucucaggacugagcuccaaaaguagaacuagcuugaagaaaauauauuaaauucucacaaauuauuugguauuuucucucuacucaguugucaguguagaaaagguauuaaauuuugaauaucauaaaaguucucaaccccuugcuggguuaaauuugcaugugacuccagcuauuuguccggccuauagucucaggucacucauuuuaaugugcauauacaucaccugaggugggcagaguucuggauugaaaaugguggggcauguuauuuguauuuucuuucuuucuuucuuuuuuuuuuuuuuuuuuugagacagagucuugcucugucacccaggcuggagugcaguggcaugaucucugcucacugcaagcuccacuuccuggguucacgccauucuccugccucagccucccgaguagcuggggcuacaggcaccugccaccaugcccugcuaauuuuuuguauuuuuagcagagaugggguuucaccgagauguucucaaucuccugaccuuguguuucuuugaaacacauuuuucuuuucagcuuucugaauuuuaacaguaauucaaauuuguauuuuguugccauauauuuauuauauuuaaugggagcaaggcaacagucguaguauaaugcuguucuugcagaccuauuuugaauugccuucuguuacaugcuuuauuagggauucuaaauacuagacuuguuuuugaaguggggagaaugggaaggggaggagaagcaauauuagacuuuuuuuaaaugguuuaguaacuuuguuguaacuugucuauagaaagcuaauuagagcaguuaucguaauacgcuuauccauuugauuguauuucuuuuaaaaaucaaauagggaaaacuuuaaguauaaauauaaacuaaauaacuucucacugaaaaucuuauaauaaaguuaauuaaaagaaaauaugaucuuaccaguguaaugucuauauaaaggcaugaauugaccagaugguuucugauuuuccuauuauuauuuuucugauuucucuuaauugauuuuagcugugaaagcacugucauuugcuguuaaauucuaaagucccuguuaaugaauagaugaaguacaaaaugauaaaaauauuuaaguggaaauaugguuuuucuuuuaaaauuugauaguguccuaaagacauacuggaacaaucauaauucaguuuuuaauuuuuuuuugaagauuucaaaccugcggaaagguugcaagaauaguauggugaaauucuucuucuuuuuuuuuuuuuuagacagagugucacugugucgcccaggcuggagugcaguggcacaaucucaacucauugcaacuuccaccuccuggguucaggcaauucuccugcccgaguagcugggauuacaggugugcaccaccacacccagcuaauuuuuguauuuuuaguagagaugggguuucaccauguuggccaggcuggucucaaacuccugaccucaagugaucugccugccucggccucccaaagugcugggauuacaggcgugagccacugcgcucagcaguggugaauucuugauggauuaaucaauuauuaaccuuuugucgcauuugcuuucuaucucucccuuccuucccacccaucuucucuuuuuccuucuuuccucuacccccucuuuuuuuuuuuuuuuaaccuucuugacaugauuauuuucuauuuuuacaaauacauuguaugucauaucucaggacagggaaucaugugcucaugugccucacugcuucuuguagaagugacuuucucagaaucuucuugaggauauuuuguucaacuuucauuuaacuuaaaucauaagauuucuuuuuaaaagaugaaaggauguacacuuugacuuaguguaaauacugauauauucaaauugaaaggaaauguaaauauuuguuuuccuaaauuaaugggaauaacauuugggggacauuuugauugugaagaacauuuuguaaaggcuguguacucaguccugggaguuucuuucugaaugucauuaaaacuuuuauaugaagugacuucuuagucuuggaccaaagaaacuuuugcauaugugauacguuugaguaccaguucuauuuuagauuaaaauauaaaauguuuucauuuaauauagcauguauuaccuuuuuggggguaaggggaaacagauacuaauuuagccauuuuuuuguucuggauuaggaagcucuggaggaauaugugaaaaaaguaaacucuauucagaugguaagaagaaguccuuaaacacuggaauuauuacuguucagaacuaugggucucauguaccucccaaagucucucacauuacuuuugcucacgaaguuggacauaacuuuggauccccaguaaguauugucuaauuauuagcuuaaaaaauacuuauuagucuaauuuuuauguugagugauuuauuuaaaauucaccgugaaaacaaauguacuuacgaguguuuaguuuuuaugucagagcacaguaauguauuugaccauacugaaagggaggaagauagaauguuugugguuaaaguaagaaaaguaagcauaacagugcuagaauucugugaaggcaagggauuucaucuggcuuauucagacaaaauaucuauaucuccuggcccuagaacaaugccuaguacauaauguacucaaauaucuuuugaaugagaaucauuauucauuguuuaaaaguacauuuugaauguucagcaaauugugagaaauucuuuuuuuguuuuguuucuguuaaagcauuuuuagggaaugagauugauauuuuaaaaucuuuucucuacuguggaaugagauugauaauuuaaaguauuuucucuaccguggaaugagauugauauuuuaaaaucuuuuauuaggaaaaaauucuaacauacacaaaaguagaacaaauagugcaacaaagcguuauacgcccaugauucagaacagggaucagcaaacauuuucuguaaagggccuacuaguaaacauuuuaggcuucaggggcaguguuugguuucuguuguacagucuuuguugcuuuuacaauuuguuaaauauggaaaagccauucuuaguuaagccauauaaaaacaggcugcuggcuacuuugucaaccccuaauucagagccaauaauugugaagauuuugacauaucuucuaucuguauuucuuuuucuuugcuaagguauuuaaaggaacucuaucuauccuuacguauuucaguacacauuccugaaaaaauagacauuuucuaauacaacuacaaugugguuauuacaccuaacaaaauuaacagcgaucuuugauauuaucuaauauccaguccauuauauugaucuuuuaagugaccuuaaagaucaguacaacacagaaauaugaaauacugaaugauacucugucuuugugauuuugguagagcuuauuaaagauaacauuuugaaaauguacacuugaaaacuguauguaaauucauuuuacuuucaccuuaucacuugcaaaagugcaaauuuuuaugauuuuaaaaauaaguugucuacuuguagcuuaaaauccccaaaugcacuucucuaauuuuucccauguuuguaaaauaggugccaucucacuaaguugcaagucuuucuucuucuacaucccaaucagaaauugauagauuauuauuaauguucuuggauaagguauuuaaaaugugcuuaaucucuguaacucuugacugcuuuugugaucuucucuuaaaagaguacuuggaauuuuagagaugagcagagaauuauuguucauaguugauuugcauuuucaagagcagauaaguguccucucuucuccccaagucaucuugguuccaggccuuaccaggggaauuuuaguacuccuccagcuacuugucuggccuuuagucccaggucacucauuuuuaugugcauauacaucaccugagaaucuuaaaacacagauucuuuuuuaguaggucuuugauggggccugaguuucuguauuucuaacauacucccacauaaugcugcugcugcugcugcuggugcucaucugugaaccacacugcaguagggaaucuagaccauucucuuuucacuucuuguguaaucucuuuccuaccuagcugccagugagauguuuuuauucaauuaauguuauauuauuguuuaauggagaaauugguucacacucuuugccuaccacgcucaaucguaccccauucuuuugcacauguuguuaauucugccaucuguauccguaguagaugguugucuucaucuguuuuguguuguuauaagggaauaucugaggguggguaauuuauaaagaaaagagguuuauuuggcucaugauucuguaggcuguacaaaaagcauggugcuggcaucuacucagcuucugguaagggccucaggcugcuuccacuuaugauggagggcaacaggugcuggcaugugcagagaucacauggugggaguggagguggugggagcguggggucaaggagagaggagguacuaggcucuuaacagccagcucuugcagaaacuaagagagugagaaugcacucacccacccaccuccaacccuucaggaagagcauuaaucuauugaugagggaucugcccccaugacccagaccucucuuguuaggcccacuaacaacuuugggaucaaauuuggggggacagacauccaaauuauacaaugcuuaauaaauauuuguugaguaauuuaauaguaagaucagccagaaucauaaacaccugaaccugucucccuuaacaucuuuaucugaaaucucuuucucucuuauacguuuguaguaaugucaauguuacuuuuucugagugguucacauuauuucuuaaauguauuuauccuaucugaaauauuuauugugcaccuauuauaaacugcuuuauaaacuuuguuguaggaaguuguaaucauaaaugagacaaaguuccugucucucagggugaaaauucuaauauguaccuacucucaccagauucaccuucauguaaauacaguucuaauaaugccacuucugcuuacuaacucacuucuacuacuuucuaauauugcugauacaauuuccuuaucuuaauguuugggguguuugauaauuugggguuuaaguauauuucuaguguuaucucuccucaucugucaaauuaauucacagaccuuuaaaacuuuccuccgcuaggaagucaguuccuucccaugucugccuguugaaaucuugauccguguuguuauaugauguaaaugaauauggcccuuaauaaaaauuaagaaaauaugaccaucauaguuuuauuuauaauaccaaaaaguuuuaagcagccuagauggcccuacaguaugaaaauaccacggaaugcucugcagucauuuaaauaccaaguuuugcagugcucauuuuauacuguuaagcugaaagaaagguguguauaacuguacacauggaggguagcuguggugacucacaccuguaaucccagcacuuugggaggccgaggugggcagauugcuugagcccaggaguucgagaccagccugggcaacauggcgaaaccccgucucuaccaaaaauacacacaaaaacaauuagcugggugugcuggacugcaccuguagucccagcuacucgagaagcuaaggucggggaggaugacuugaguccaagguugcagugagccaggaucacgccacuacacuccagccugggggacagagugagacucugucucaaaaaaaaaaguuauaacuguacacaugguauaguccaaauuuuaaauuaaaaugugauacagcuagauauaagucagauaggaaauagaucaaaauuuuaauaguuauagugcaugguagauuaugauugaauuuuuauuuaugcauuuuuguuuucuuaauuuucuuucuuauaguuagacaaauuuuucuguuuucuugucacaaagauuauaguuucuuagugaaacgcuucucuugauuugaacucugaauacuugugcgaguccagucaagauggccuuuauguucuguuuuguguuuugcuuauucaugugcuuguuuuauucguuaucugaggauggcaaauagcuggcaugcuugcuuacaaccuguuuccccuucuauuccuguuaauggugaucuauuguaauaucuccuggccuaguaaaauaauaauugacuagcaauaucuguaauggauuuaugcagcagcaagucagacuaagcaguuaugucaagauuugcuaucauuuaaaaauagaagguaagugccuugaaggcuagggauaauacuuuucucaucuuuauauuuuuauauuuuagugccuccuuuuauagcacuggacauucauuaauauuuacugaauugaaaaguggcaagauauucugugaugacaucaagaguuauacagaauugggauuuuuuucuuuccuuucuaaaacucuaaugcugagaauaauucuagugcuacaccuuuuucagaaacugaguugaauuuuauagguugaaaacauaaagcaagauaauauuggugaauaguauagaguugcuaaaugcugcaucuagauucagaagaaaggcaagagguaucaggaagaauaaaggugauaguagaggacacauuuuuuaauuuaacaguugccucagaagagggaauagaaaaugaaaguaacuuaguugggcucuaggaaaaaacagaacguccuugggcagucuuuuucuuucuugagagugggguuguuggguauuuaaaacaagauuuuaauuaaauagcacaauuacucuaguguccaguguuuuuugccccuucugauguguucugaauuguuugaggggcauugugaggguuguuuuagugcauauccccaggaugguaggggcugcugggaucugguaguaguguucuguugcuuggucucauaagcauuacuuugagaaaauucagggagcuaugcuguauguaucugacucuucaauaaaauuuaucaaaaccgaacaccacuuaugugcauuuauauguuacguguacacagaacucuguuuauuuggcaaagcaguauuuugguuuuaucucuaggcuuuuaccauuuuucauuuaaaaauauaucauuguguuucuguuccuagucagcauuuuuacuuaccuuuccuauauauuggcuauuaaguuagcugucuuagauuccuguucuguguguauuuagccccaugucagucucuugauucuuuugucuuuccccaccucugucuucucugaacuauucauaacauguaauuuaacauauguguuagagacuauuuaguaguuuuaaaguaguuuauuuuacuguuacuaguuuuaaaaguaugugagcuuauuuuuaauagacuuuuaugacagucuguccucaauucuagucccugcuuacaaagcuauaaauuguuauggcuagaccuccacugauuuuccuccuuuucuaagacagugaccccuaaaagagcaaauucuuuuccuacucaagguguaaaacaauuguaagauccuuuuuaaaggagaguccacaagcuuccauuguuuuccugaugagaacauuacguuuaaucaguugaccugaaaaccuuauuuuacuuccuguuuauguaacuuuauauucuuuuugacagcaugauucuggaacagagugcacaccaggagaaucuaagaauuugggucaaaaagaaaauggcaauuacaucauguaugcaagagcaacaucuggggacaaacuuaacaacaauaaauucucacucuguaguauuagaaauauaagccaaguucuugagaagaagagaaacaacuguuuuguugguauguauauuuuccuaacguuuuguuaugaacauuuucaaacauucagacaacuugaaagaauucuauagugauuacugacauacccaccaccugcauuuuacuauugcuaacacuuugcuguauucccuuuaucucguuauuucuuaaucuugccaucucucaauucauguuuuauugcaauuuaaaguaaguugcagccaucaguauacuucacaccuaaacauuuuagucugcaaaucauuaacuagaguucaauauuguuuauaguucuuuuucuguuuucugcauaagugaaaugcacaaauuuuaagugcaucauuugaugaguuuugacagaugcauuuaccuuuguaaacuaccuaucaagauacaggacauuucugucaccccggaacuuucuuuuaucacccuucccaaucaggcucugucccaacacacccucagaggcaaccacuaucugauuuauuucacucuacauuggcuuugucuucauauaagugaaaguauacaguuuauacccuucuguggaaggcuguuuaacucaguauacagcuuugagauucaucuuuaguauuauacuccuuuuuauugcugaguacuauuacguuguaugaauauguccuaguuuguacaucuacucuccuaucaugaauaccuuggauuugggcuaaugugaauaaaguuacuaugaaauuauuucuuauuuuaguaaaauauauauagcauaaagugugccauuuuaaacugauuuuaaauguacaguucugugacauuaauuauagguacaauguugaaugugaauguaaucaauuacauucacucuucauuugcaaacuuuuucaucaucccaauggaaauucuauaaccauuaagcaguaaugcucugucuuccccucagccccugguaaccucuaauccacuuucugucuuuaugaauuggccuauucuggguaucucauguaaguggggacauacaauauuuguucuuucgugccuggcuuauuucacuuagcauaauauuuucaagguuuaucuguguuguagcauguaucagaguuccauuccuuuucacggcugaauaauacuccauuguauguauagaccagauuuuguucuuccagucaucuguuaugucuuucuugcggcauugaacauacucuaaauauuuacuuuguauuaggguuuuuuuguguguguguguccuuguccuauuucacaagaccauagguuucuuuaggggaaacacugaggccuauucaucuuuguacauuaagagcacugaaagagggguuaaacaugugacagcaaaggagaaagaauucaggaagauuuccagauaagcaugggauuuuguuuuuaauugaaauuuuauugagauaauuaauagauucacauacaguucauaagaaguaauagauucccuguacccuucacucaguucccuccgaugguaaugccuugcaagacuguaguacaauaucaugaccaggauguugauauugagaaaauccauagauacuauuccaauuucccuaguuuuuuuuuuuguucucauuucucuuuguauguauuuagcucuauacaauuuuauuacaugcguagauuuauguauccaccaucacaaucaagaaucagaacaguucugucauuacaaggaucccucauuguuuuauaaccaugcuuaccucccuucuguugucccuuccuccccccugcuacccuguucuccauauguaaaauuuugucacuucuaaaaaaguuauauaaauaaaaucagacagcauacaaccuuuuggaauugccuuuucucacucaacauaauucccuggggauucaucuaaauuauugccuuuaucaauaguucguucuuuuuuauuucugaguaguauuccaugguauguauguacugcaauuuguuuaaccauccauuugaaagacaucugggcuguuuccaguguuuggcuauuaugaauaaagcagcuguaaacauucauguacagguuuuuuguauaaacauauaaguuuuuacuuugagauaaaugcucccaaaucgaauugauggaccauauagcaauugcuuguuuugcuuuguacaaaacugccaaacucuuuuccaggguggccauacuauuuuauguucucaccagcacugcacaaaugauccaguuucucugcauguucacaaccauuuggaguuuucacaguuuuuuauuuuagcuguucugaugggcgugcugugauaucucaugguuuuaauuugcauuucucugguggcuaaugaugcugaacaucuuuucauguacuuauuggccauuuauaaaucaucuuugaugaaaugucuguccauguuuuuuggucauuuuagugaucauuagugggacuuuuuucuuuucuuuggaguauugagaauucuuuauauagucuagauacuaguccuagauacugguuugcaaauauuuucucccagucuguagcuugucuuuucgcccuuuucacaguucuuucguggagcaaaaguuucacauuuugaugagguccaguuaaucaguuuuuuauuguauugauuggcauuaucuuuuucuuuuaaaagggcagauugaaauuacaucuucaaucuucaaaaacugauguuaucauuuuuguuauuguuauugucagugguuguuuuucuaaugcuucuuaauguacagguacauuaagauucuucauuuguaaacuggguuuucacaguaaaccuucugaaauaaguugacuuuuaaaaauguacauauugcuuuguagguauuaacaggaaagaaaauuuuuucuuaaauuauaacaaaauguguaccuauuauaauuuuugcauuuaaacaguauuuuuaggccagacagaguggcucaugccuguaaucgcagcacuuugggaggccaagacagggagauugcuugaggccaggaguucgaaaccagccuggccaauguagcgaaacccugucucuacaaaaaauuaaaaaaucagugaggcaugguggcgugcgccuguagucccagcuacuugggaggcugaggcacaagaaauugcuugaacccaggaguuggagguugcagugagccaagaucgugccacugcacuuuaaccugggcaacagagcgagacucugucucagacaaacaaacaaacaguaccucauuguuguuuaaacuguuagcaaauaacuaacuugaaguacuaauuuuauaugaaauaaaaauuaauauguaguaaauaauguauguaacauuuucugacuucguuauuuguuuucuuauaaauuacgugucaugugaauuauaaaauuauuacuagacuuguaaaaaucauuauucaccuaguauauaugugcagaugcauguuucuaguuuuuuuuguuuuuguuuuugcuuuuuuuuugagacagagucucgcucugucaccaggcuggagugcaguggcacgaucucggcucacugcaaccucucccucccagguucaagcgauucucaugccucagccucccaaguagcuggggcugcaggagugcgccaccacgccuagcugguuuuuuuguauuuuuaggagagacgggguuuuaccauguuggccaggauggucucaaucucuugaccuuguuauccaccugccucggccucccaaagugcuggcauuuacaggcgugagccaccucgccuggcccccccuuuuuuuuuuuuuuuaaauuucacuuuaaguuccgggauacaagugcagaauguguagguucauuacauagguguacgugugccauggugguuuacugcaccuaucaacccaucaucuagguuuuaagccccacaugcauuagcuguuuguccuaaugcgcucccuccccucaccuucuaccccuggacuggcccugguguguguuguuccccucccugugugcaugugcucucauuguucaacucccacuuaugagugagaacaugugguguuugguuuucuguuccuguguuaguuuucuggguaugauggcuucuagcuucauccaugucccugcaaaggacgugaucucauuccuuuuuauggcuguguaguauuccaugguguauauguaucacauuuuauuuauccagucuaucauugaugggcacuuggguugauuccauguguuugcuauuauaaauagugcaugcuucugguuuuugagaacgaaagagaugguuuaaagugaaacagggaugaagcuucgaugaccuccaagauuuuaaaaaauagucgaugugguuaagaaugaacuuucugcuuucaucuaggccagucuggcucuggagagcaggugccuccacagcaacaucccugggggcccugaaaucaggguucagcuaggcuccuaugugcccugagggucuggguucccaguccuguugccaaguggcuuugucccagauccuuucuucugggcugaugugagugcauauguuugugccaagcuucuguuuuauauugcacauauaaauaaaggaagauaauuuaccauaaagaaauaauuaucugaauauaaagccagucuuucuagaacauuuuugauuuagauaggccucauguggguuuccuguguugagauguauggguuccuguguugagauguauguguucccuucuacuuauucaauucgcaacuuaaagccuguacaaugacuguuuuccaugucgauuugguguaggagaaagaaaagagcaccagaucguagaccuagaaaacccuagauauagucuguguuuugccuauacugggauauauggucccuagcaaguuacagacuccuuggaaguuaguuuuauuuccuagaacauuuaaggcauuugauuuuuaucauucucugcaguugcuaaagcucuuugauuuuaugaucuuacaaagaggagcauuucuauuccaauuuuaaauuccauugacaaaaaucaaagaacuuuagaagacugcugaagaaauuuucuaaaauuauucacuaugcuuagaugagacugucuaaucuuaaucaaccaagaucuggcucaauaccauuaaggucugugagaauacagaagauauaaauaauacauguuuguucccuuaaggagcuugguuuaguucagcagcaaaacuaauguacauaaaaaaaauuaccuacugauuguauuacaaucagcuaaauagaaugugggacauuucauagacaaaaucacccaacuucuuuaacagaucaaugguguaaaaauaaauaaaaauggagaaaucuauuacacguuaaaagaacauaagagaccugucaaaaagcaaccaugaggggaggaguugggguuaggggaaccuuggguuugaaacuugauucacagcaacaaauuguaaagagacauuugaggaaaauugaacauggcuuggcuguuagauguuauuaagcaugcuauuaauuuuguuagauaugaucaugguuauuaugguuagguuuaaauaagaaaaaaacuuuaugucauagugauacauucugaaguauuuacagggacaauaauauguuaggugggguuguuuuaaaauacuccagaaaaaaacugugggaguaagugagacaagaacagcauauuguuguugauaguuguuaaagaugagugauugguacaugggaauucauuguacauauucuuuuauuacuuuuagguguguuugaaauuuucuguugcaaaaaaaggcuuaauuuuuuuuuuuccugguuagugaagcacuaacuugguuuguauuugugugauaugaauagaacagucaauaaagcucaauguagcauggccuaaguugcaaguuacagcuucuagaagggacccucugucaaauccucucacuguacagauugagaaacugaagaccccaagauugcauugcuaguuaguagcagacccccuguuagaauuaggucucguaauuuccagauuccuaguuuguucuacuuauucaucaaaguuuuccuuuaucccuuuguuaugaugaucuaaagaauuugugaauuuuaaauaaaauuaaugugugcacacaaugcuuacuuugucuuguuuauuuuccucagaaucuggccaaccuauuuguggaaauggaaugguagaacaaggugaagaaugugauuguggcuauagugaccaguguaaagaugaaugcugcuucgaugcaaaucaaccagagggaagaaaaugcaaacugaaaccugggaaacagugcagguaccuugcuaauuucagugauguuaacauucuuguaaaguuaccucaaugcaguuaugacaaauuuaaaacugagauuaagagaugcauaugguuuugaaacuuugcuuuuaucuguuguuuguuuucuuuuucugaaguaguguugguuacugcucuguuauuggcagauugaacuacuuuuuuuuuuuuuuuuuuuuuuuuuuuugagacagggucucgcucuguugcccaggcuggagugcaguggcaugaucucggcucacugcaacuuccaccucccgggcucaauugauccucccaccucagcccccugaguagcugggacuauaggcaugugcuaccacacccagcuaauuuuuguauuuuuuuuuagagacagaguuacgccauuugcccaggcuuguuuggacuacuuuuaauaguaauuuguguggugaauguuaacaaaaggacauacucaaaggacauacuaaaaagaauccuaaaaaauacauauucuuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaauacauauucuuuaguuacuuauugugaaaauguaacuaucuuccauauuuuaaaaaucuuaacuuuaaauauuuaguuaauguggaauccauuuacuuuucuaacuuggcaaguuauaacuauuucacuugucaaauuuacuuugguagcaguguaagcaauuguuugcacaauacuuuuuuuuuuuuugagauggagucucagaaaaaccugucacccaggcuggagugcaguggcaugauuucagcucacugcaaccucugccucccagguucaagcaauuauccugccucagccuccugaauagcugggacuacaggugugugccuccaugccuggcuaguuuuuuguauuuuuaguagaguugggguuucacuauguuggccaaguuggucuuggacuccugaucucaagugaucugcccaccuucgccucccgaagugcuaggauuacaggcaugagccaccgcacccggccaguucaauauguuuuaaacggcuggucuguauauccuaguuugauuuuaguaugaaaaugggagagaaagcgauaaauuaacuaaugugugauguaacugaaaaaauacugauaaauugccuaauauuaaauccauuuuccauuguagccuuuuccuaaaggugaacagggcaagaauguggaauguaguaugcuuugacuauuaaaaaaaaaagucgcacacuuuucuugacuguuuggcuuaguagcuuccuauuccuuuuuuuaaauuuuuuuuuuugagauggagucuugcacugucgcccaggcuggggugcaguggcgcgaucucugcucacuacaagcuccgccucccggguucacgccauucucuugccucagccucccaaguagcugggacuacaggcgcccgccaccacgccuggcuaauuuuuuguauuuuuaguagagaugggcuuucaccuuguuagccaagguggucucgaucuccugaccuccugauccucccgccuuggccucccaaacugcugggauuacaggugugagccacugcacccggccccuauuccauuuuuaauugauacauaaugauuguacauauuuaugagguauaugugauauuuugauacaugcauacaauaucuaaugaucaaaucaagguaauaaggauauuuaucuccucagauauuuaucauuucuuugucuugggaacauuuuaaaucuucuauuuugaaauuuacaauuaguuauugcuaauuguaguaacuuuacugugcuaucaaacacuagagcucauuccuucuauguguuuguacccauuaaccaaucucucuuuauccaccucuccacuacccuucucauccucuuguaacaccauucuacucucuaaccucuaugagaucaacuuacuuugcucucacauaugaguaacaacaugugcuguuugucuuucuaugucuggcuuauuuuauuuaacaugaugacuucuauuuccguucauguuauugcacaugacaguauuuugcucuucuuugugaccaaauauauaccaccuuuucuuuauccauuugucucuugguggacacuuagacuaauucuguaucuuggcuauugugcauagugauacaguaaacggggcuguagguaucccuuuuauauacugacuuccuuuucuuuggauguauacccagcuggaucauauaguagaucuauuuuuaguuuuuagaggaacuucuauaccaguuuacacaguggcuauacuaauuuauauucccaccagcaguaaacuaaugguuccugaucucugcauccuugccagcaucuuuauuuauuuauuuuuuugaucauuuugauaauggucauuuuuacuggguguaucucacuguggcuuugauuuguguuucccugaugauuagugauauugaacauuuuuucauguacuuguuagcaauuuauaugucuucuuuugaaaaauguuuauuuaggucauuugucuacuuuuuaaugagauuauuuaguuuuuugcuguugaguugaguuccuuguacauucuaucagucccuagucagaugaauaauuugaaaauguuuucucccauucagcagaucgucucuucacucuguugauuguuuccuuuucugugcagaagcuuuuuaguguguguaacccuauuugccuauuuuugcuuuuguugucugcaguauugaggucuuacucaaaaaucuuggcucagaucaauguccugauaucuuuucccaauguuuucuuuuaguaguuucaucguuucaggucuuaaauuuccaucacauuuugauuugguuuauguauguggugagacauaggggucuaguuucauuuuucugcauauagguauccaguuuucccaucaccacuuauugaagagacuguccuuuccccacugaauguucaaaaaucaccucgaaaaucaauuggcuguaaauauauagauuuauuucugaauucucuauucuguuucauugguuaaugugucuguuuuuaugucaguaucaugcuguuuuaguugcuauagcuuuguaguauauuuugaaauuagguggugugaugccuccagcuuuauucuuuuggcuauuggcuucugugguuucauaugacuuauaggauuguuuucucuuuaucugugaagaaugucauugguauuuggauaggcauuacauugaaucuguagauugcuuuugguaguauggccguuuucacaguauuaauucuuccaguccaugaacaugaaauguguuuuuuuuuuuuuuugacuuguucaguuucuuucaucaguguuucauaguuuuccuucuagaaauuuaauaaacucaccuccuugcguuuauuaaacuuacucuuuuuuuugcagcuauuauaaaugagauugauuuucugcuauuuucuuguauauagaaacacaacugguuuuuuaauguuaauuuuguauccugcaacuauucugaauucauuuaucaauucuaagaguuuucaguggagcuuuaaggguugucuauauauauaagauuaugcugucuacaaacaggaacaguuuggcuuccuccuuuccaauuuggauguccuuuauuuucuucucuugccuaauugcucuggcucagacuuccauuacuauauugauaacaguggugagaguggacauucuugucuuguucuaguucuuuuuuucuuacuuauuuuaccuggugaucaggaaguauuguugggaaacuuuuuuuuaauuacugauucaaucuuguuacuugugauugaucuguccagguuuucuauucuuauuucaaucuugguaaguuguauguguccagggauuuauuaauuaucauucgguuuucccauuuauuggcauauaguuuauuguaaugguuucuaaugauucuuuguauuuuugugguaucaguuauaacgucuccuuuuuuguuucugauuuuauuuggauauuuuuuccuugucuaguuaauggauugaugauuuuaucuuuccaagaaaccaacuguucauuuuguugauauauuuuuauuuuauuuuuuuauuuuuuuauuuuuugagacggagucucacuuuuuuccccaggcuggagugcaguggugcaaucucggcucacugcaagcuccgucuccuggauucacgccauucuccugccucagccuccggaauagcugggacuacagguaccugccaccacgccuggcuaauuuuuuuguguuuuuaguagagacgggguuucaccguguuagccaggauggucucaaucucuugaccuugugaucuguccgccucggccucccaaagugcugggauuauagacauaagccaccgugccuggccugauucuuuguauuuuuuuagucucaauuuuguuuauuucugcucugaucuucauuauuucuuuucuucuacuaauuugggguuugguucguucuugcuuuuuccugauucguugaggugcauuguuagguuguuuaucuuucuacuuuuucuauguagacauuuauugcuauaaacuuccgucuuaauauugcuuuagcuguaucccauaguauuugguauguuguguuuuucuauuuucaguuguuucagagagcuuuuaaacuucauuuuuaauuucuucauugacucauugguuguucagaagcaaguuguuuaauuuuuauguguuuguacaguuucuaaaguuccccuugugauugaucucuaguuucauucuguuguguucagaagagauacuugauaugaucucuguuuuugaacaucuguugauaauuguuuuauagccuaauauguggucuauccuggagaauguuucaugugcuaaugaaaagaauguguauucugccacagcuguuggaugaaauguucuguaaaugucuguuagaucuauuuggucuaaaguauaguucuaauccaguguuucuugauuuucugucuagauuaucuguccagugcugagaaugggcuguugaagucuccaaccguuacuuuauuggaguugaucucucucuuuagaucuaauaguauuugcuuuauguaucugggugcucugguguucggugcauauagauuuagaauuguuauaucccuuugcugaauggaacauuuuaucacuauauagugaucuuuuuugucucuuuucacaguuuuuuuuuggagacagggucuugcucugucacccaggcuugagugcaguggcaugaucucggcucacugcaaccugcgccucccggguucaagcgauucuccugccucagccucccuaguagcugggacuacaggcauguaccaccaugcccaacuaauuuuuguauuuuuaauagagacgggguuuugccauguuggucaggcuggucuugaacuccugaccucaggugaucugcccgccucggccucccaaagugcuggcauuacaaaaugagccacugugccuggcccucuuuucacaguuuuugacuuaaaaucuguuuuaucugauacagguauagcuagucuugcuuacuuuguuucugguugagugaaauaucuucuucuguuccuuuacuuuuagucuauauaugucuuuagagguaaaaugauuuucuuguaagcagcauauagguggaugugucauguguuugggaggccgagccgggaguuuugcuugagcaggagugcaagaccaaccuaggcaacauagugagaucccauuucuacaaauaaaugaauacauaaguaauuuaaaagcuacagagggagaagagauuaaaauaggcccauucagccagguugugucuuuuuaaguagggggauuucauugguguauauucaugauugauaucaguaggugaggacuuccucuuaucauuuugauaauuauuuucugguuuuuuuuuuuuuuuuuuuuucuucagacggacucuugcucuguagcccaggcucgagugcaguggugcaaucuuggcucaccacaagcuccgccuccuggguucacgccauucuccugccucaggcucccuaguagcugggacuacaggcgccugccaccacgcccggcuaauuuuuuguguuuuuaguagagaugggguuucacuguguuagccaggaugguuucgaucuccugaccucgugaucugccugccucggccucccaaagugcugggauuacaggcgugagccacugcacccggcuguuuuuguuuuguuuuguuuuguuuuugcauauucuucuuucuuuuuuucucucauuuagcauugugguuugguaguuuucuguagugguaacauuugacucuucuuuuucucauuuguauaucacaguggccuguauuguacagcuuugugguaauggcgguguugguguacguagguuguuagcauuauaauucuguguguuuucacaauggugauuauugguuuuuuuugcuuccaggugcaggaaucccuugaguauuucuuguagggucagucuaguggugaugaauuuccuauuuuugcuugugugggaaagacuuuauuugucccucauuucugaagguuaguuuugcuggguauagacucuuggcugcuaauuuguaaacuauccuucagaaaugagggacaaauaaagucuuauagauucuuggcugccaauuuguuuuuucuuucaguacuuugaacauauuaucccauucucuccaugccugugaaauuucugcugagaaaucugcugcuagucuaauagaugcucccuuauaugugacuugauacuuuccucuugcuguuuuuuuuagaauucucuauguccuugacuuuugacaauuugacuauaaauccucaaggaagacuuccauuuucagcuauuauuuuaauaaauagguuuucuuuuuuuuuucuuucuuuuuucuuucuuuuuauuuugagacagagucuuaacuucaucacccaggcuggagugcagugguacaguuugagcucacugcaaccucugccuuccaaguucaagugauucuugugccucaaccuccugaguagcugguauuacaggugcgugccaccaugcccagcuaguuuuuuucguauuuuuaguagagacgggguuucaagcuccugacaagugauccaccugcuuuggccucccaaaguguugggauuacaggugugagccagugcaccccagccaaaacaaagguuuucugugccuuuuuaaaucucuucuccuucuguagcuuuuaagugauugauugauugguugcagagaugggcuuucacuacauugccuagguugaucuugaacuccugggcucaagugauccucccaccucagccucccaaaguucuggcauuacaggcaugaguuacugcacccaaccuucugcagcucuuauaauaugaaaauuuauucacuugguggugucccauaagucuuauagacuuucuuccuuuuuuuuuccuuccccuaaaugaguaauuucaaacauucuaucuugaaguucagagauuuucuuuugcuugaucaagucugcuguugaagcugucuauuauauauuuuuauuuuauucacugaauucuuaagccacaggauuuuuguuucucuuuaaugauauuuauuacuuuuuugaauuucucauucauaugaauuguuuuccuaguuucauugaauuuuuuaucuauauuuucuugugucuuuucccucaaaucauuauuuugaauuccuuuuuaggcaauuuauugauuuccuuuucuuugggaccuguugcuagagaguuaauuauguuccuuugguggugucauauauauuuguuuuuucauguuucaugagucccuguguucaugucugugugccugucugguggaacagucgucucaucuaaauuuucuagagugacuuucauggagauauacucucaccuguagcuaggucuuagugugcuggucgggaaggguguggugcuucuuuuuccagguaggugcagugguauagucuccaugcagcuucuucagcuguauucaacaucaucaauaacuguaggcaccucaguggucugugcuguagaaguuugugguaauggaugcuggugguguagguuguuaauguccucaguggcaacgccuuuuggggcccuccuauucucauuuuucccauaauggugagacuuagccaaggggaucccucuuggugucaggucugacauggccuacgagcaccugcugcggugcuggcuuccaguugcggaugcguagaguaacuguggggcuggaguucuaggcucaggaucucacaaaccuauuaugguacuugugucuugcagugcauguuuacugucuggcaagauugaauguagguugccuauagcaccaggaucugugacucuggguuacucccuagcaccuugggcccagcgggccagucuguagcugggauuauacacuuugugggcaggguauagcccgggcuuggguccagggaagaggugcucuggagauuugagcccagagcacagugcauggcaguaauuucggagccugagccaauaggacucagugacgaguugggucaccggggauggaggugguggugagucuagacccugggaugguggggcuuggugguaucccaaagucugugagaccaggugcagcaacagcaaguaccucagaauguucaagcacagcugucauuugggcccuagggggcagggaacagcacagugaugacuacuguggggagaagggugucucagcagcucagacucuagggggcuagucuagcuccagggaagcagggugcuagaguuguuuggccuguaggcauaguaucccaguucagccacugauauuucccugggaugugaguuacuguguuggcuuagcccuggaaugcacagcuccucaacuuggccaaggcauuauuaccugaaggagcaaugugcugcuuuaucucauacccugcagggugugacuuuucuguguaggcccaggcacuguuucuuugggacacacggcuccaccagugcacuguuuacucaggagggcggugugcgguuucaguuuuuugaaguuguauaccaguaacauacuuaucauuuaagugaugagacuuaggauuuaaaaauugguacuaugucuaauaauguggaucuaaucuaauaucuaauaguauauagggaauaacuagugauuuacuuuguuuaaucacuuaauguuuccucuaguccaagucaagguccuuguuguacagcacagugugcauucaagucaaagucugagaagugucgggaugauucagacugugcaagggaaggaauauguaauggcuucacagcucucugcccagcaucugacccuaaaccaaacuucacagacuguaauaggcauacacaagugugcauuaaugggguaagcauuuaacuauauguuuuaaaauuuaauuuuagaaaacuuguuuuucagaagaauuauugaugcuuaaagcuacauaguuaaaguaauuaaucuuggucucuguuuaaguaauauucccucacaaaaccaugaauauauuauguggcauucaauuagcuacuaauuugucuuucaucuuuccauguacaugugguugauauucucuagagaaacauaguuguacaacucggcaugugauuugucuauaauauuuaaguuuuauaaaauaauauuucaguagccuaaauaaaagaacucuuuggucaucuucucugaauaucaaaccuucaaagcuuuuguggcugaauaucacuuugcucuacaggaaaaaaauuuaauuuuucuuucuuuauagaagagccguaauaaccaacauaaaaucgauccucaucuaaucucuugcucugcuuuuauuucauuuuuuuaaguugccauugcuuuaaaagauuuacuaucuuucuuggauuuacuguuuuucaaauuuuuucaaauguauuuauguaauucaguuuugauacucaucucuguuuguuuuucacuuucauuuccauuuaaauauuuugacauuggaagcucauacuugccugucuguuacuauaaaaaauagguuugacuguauagggauuaaacaauuugucuuuuauuuuucuucuagcaaugugcagguucuaucugugagaaauauggcuuagaggaguguacgugugccaguucugauggcaaagaugauaaagaauuaugccauguaugcuguaugaagaaaaguaaggcuuuuaaaaacacaagaguauaaaauuugccucaaacuauuauuuucuccuaaauuuuaaguguaaaacuuugaccuacaguuuggccagauaauuuccagcuaaaucuguccucuugaggagauuauaaauguaacguagcauugugucucuauuauuauggucucuacaauguuuuaaaaaugauaaacuagacaaaacguugccagcuuuacagcaguaauuuacauaaacacuguuagacuuuaagucaucguggacacugagucaagacuugcugguugcuuguuuacauuguaacauuuaauaugaauuacugauggcguuacccagccuaacuagagaaggucuguauaacauguuaugguaaugauuucaguuuuuuuucccucuuuguauuugcacaacuggaaaucugaucuucaacuuauauuugaaucugaccuucagcuuauauuuggcauuucuuuuccaguggacccaucaacuugugccaguacagggucugugcaguggaguaggcacuucaguggucgaaccaucacccugcaaccuggauccccuugcaacgauuuuagagguuacugugauguuuucaugcggugcagauuaguagaugcugaugguccucuagcuaggcuuaaaaaagcaauuuuuaguccagagcucuaugaaaacauugcugaauggauugugguaaguauguuuuuuauuuacaaagaaaacuuaaagugguuugaucuuaauuuuacuuggccagaagucaucaaaguuacgagaaaacaacuuaacuauuuauauuagaauuacuuuauaugaagauuuuuaaaguucuaauauuucugguuauuauuuccuucugaagugaucagaaucauguguaucauucauagauugcuuaguaggugaugggagucauucuguuuuaccgugcuccuuaguucaucuccuggauggguuacuucuuuuggugcauauuauuagggcauuuucaugggacuuaaaaaacauuuuuuuuuguuguuuuucaagacaacuuauuugcccaaaucguggacuaauuggugauuuuuccugaucuuucaguauaaucucugggucuuuaucuuguuuguaauaggaaauguugaacagaauaagaucagauacacagccuuuuguagaucuacuaaugauuauggauguucauccagcaguaauccacugaacgcuuauuuuuaagcccacauaucuccaaguuguacaaacacagaauuaccugauguuuucuuaaaagauugucaagauugacuaucucaacuuaaguguucaugcuuuaaaagugauaacauuaaaauaucuauaggaagcuugcaaaugauauauuugagaaugugcuauaauugaacugaauguaguuugcuuuggaaauugacuuauaacucacauuccccuuucucaaauuaguguguauguguguguguguguauguauguauguguguguucagaacuauggaugccuuaaagcacaaaagauguuguuugugugggaugucagccuuuuuuguacucuucuaauaacauucuagaguaaaaauuuuauaguuaaccccagcauuuaaaaugauguuuaccguuccuaggacacauuaggauaugugguuuuuagauauguaaugaucauggaguagaaggauuguugaaauuggauuuaggagaucuaccuagguuucaaaccaaauacuugagcaguugacuuaacuuagguuuccuuaaaacauguuacucuuuuuuuaaauuccugugcuuguugcgugguaaguucuaguaaauaccugucaaacugaaguugucuucugguaccauggugcaguggaaagagcacauguuugagaaucacguaaggauucaaauaaucuuucugguguuuaucaauucugugacuucaagcagcuuaccuuucuuggcccuucuuuauuuucaacucagcuauuuuuuuuucugauugucucuaauaagaaaaguugaaauuugguauacuugucugcuguagaagacaguguauacagaaaacgaaaggagaucucagaauuacauucuacugaguauauauugugcuagauauuuuagauuuuugggguacuaagucauaucuaaacauagcauuuuuuuacuuuucucuguuaucucuaauuuucacucauuacauuauuuagaauuucaaaagcccauuuauuuucacuuuaaaaauauuuaauagacaugaucuuuuaaguauuuuuaagaccuuuucuccccauauuuuagaugugaggauuaaugaaauguuucacaaugaauuggcaacaugaaguccuuucuugugcucuggaacuaauuaaucagacacuuucaaguucauagacguugacuuuaagugugugugggauagaacaugccuuuauuuuauaucauuguugacaggcauaugccagucuuucgaauagcaugcucauaaugugugaagaguaccgcuaggcuguuggugcauuugugggcauuaaccacaucaagcaguaagauaauaaacaucuggucuuuacaaguuacuugucucauuugcuuaugugcauaguuuacuugcauaccgggauuuaucauguuagggaagugcccuuccaguuaguaauacagauuaucaggaugcucuuguguaagaagcugugaaagaagugagggguuaguuucacuacuuuccuuuccaguggugccugguggcguuuugucuucuuucuguguuacacuauggcagcuuuucuccucaugcaggguagaguaggaagaaccuuaacaauuuagaacuucagggcauggguuauugacugcugcuacugguaccacggaagugauacuuucuuuucuguguugacaacuauguuuugauuuuuccaaauacauuuacuguauuugcugagugccuacuguguguuuggacaggauaaaaugauaaacauccuuuggauuuaucaaagagucaucuaguucuugaaacauuuaagagcauucaucaguaaaucuguugagaccuuauuucagcaucuccuuuucuuuaauuagggauugagggcauugguaauucauuuccaguuucuucuauaguugauguguucugauuuucuguaucuuucauguuagguuugacauuguagaaaacuaccucuuaccuugacuuuuauuguucaaauguauuguuguguuuccccuccuuuuaaaaaucauugccugaugauuuuguggcuuuuuucuuuuuaacuuguucagauuuaucaggaguuuguauuuuuguauugcuaauuuaucaagagucaaacacauucucauuuuaaaauuaguuucugcugucauauuuugcuauaauuuuaugcaucuaaguaguaaguaucugguauucuuuaugaaugaaagauuuagagcacuguuucccaaaugcuuaacagaacacuaguuccauuagauguucugggccuucaauggucaaaugaaucuggaaaacuacuccauacuauagaccuuucuuggagauuugugagaagaccugcaauaaauaaaucguuuaaacuucauuuuccaaacuuaccuaacccuagaaacuuuuaugaugaaaagacuaaguccuaaauauccuuagaugucauuuggaaaaauauugauuaauagcaguaguucucaauccugauuguauaccagaaucacccuaggguuuggacuaauuaaaucagaaucucuuggguuuaaguaucugggucuuuuaaaacucuccaguuaauucugaugaggagccaggguuaagaaccacucaucuagaacagggguuggcaaacuauggcccaugggccaaauccagcccgugccuauuucuguauggcucagaagcuaagaacgguuuuuacauuuuuaaaugauugaaaaaaauuuaaaaauuaucaaaacauucuuuuaaaaaucauaugaaauucaaauuucaguauugauaaauaacauuuuauaggaacauggccacacccauuuguuuacacauugucuuuggcugcuuuugcacuuugaguagcugcaacagugacuguauggccccacaaaaccucaaauguuuaucugggcuuuuaugggaaauauuugccaacuccugaucgagagcggugaucucaaaguguaggccugagaagcagcaucagcaucaccugggaacuucauagaaaugcaaauucuuacguuccauuccagacccacugagucaguaggugauggugcgugcuaauaguuugucugccauuuuuuucagucucugugauaugugacuccuuuuuaaaaagacuuguaacagaaauuuuccauuuuaucaucuugauauguugaaaauagaaggugguuucauugcuuuguggaacagaccacauagcauagcacuuaaugaaacuuuaacaacaaagauauaaugauauuguaagguuuucagcauauagugaggacacaguauacauuugcuagaugaaugaagcagauuucucaaauguaauaauuuauauggaaaagaguaaaacuugugcauauuaacuuugaaacuggaauguuuucagguuccuguuagugguauuuuaucuuacuugcccagguugagcuuaaaguaaccaaaaguuuaguagcaaguugcuuucugcuuggcagaucgcuguugcugcugcugcuagugguggugggaguuugaaggauaggaggaguauauauucaaagcccagacuauaguauuaugucuucugaaaaauugaaaggaaacuuucugccccuauagggaugacauaaucaguaucauggcaaggagcucugggccccacauggucuugugacccaugggaaguccagaaugcauuugcugagagugagcguuguugaacacugcaguauucauugaaaggaucauaugguugacuuucuggaggucuuuaagaacaguagauuaucuuaugucugaagagacuugagugcaugucuucccuguccucgcucaugcacuuuuuuuuagaugauacuugcuuugucauuuuguuaccauauagguucuuuuuguuuauauuuagauuaucaaauuaaauacuauuguaauuaauacauaauaaauuagacuauuuaauuuugacuuuuuacuuuauuauuggcuauguuuaagugccuguauugaacaucaucucucuuuuucuuauguagaauuauuuucugaguugagaaacuucuugaguuuuugaaaaaugguuggaugucuucucuuugucccuaaaguuuugcuuaacacccuugucucugggauauaagacccuggcacucaguuuacgcucaguaaauguucauugaaugaaugacagcuccccuuucuuucagacuaacaggugggcaauuugugaucuuuucuuuugagagaaaugcauauuuuacauuuacuacccuaguuaguauuccuuucccugauuuuauaguauauuuaaaggggauagcauguaauuuagcauuuaacucauucuuuuuuuaaaaaggaaaacuauaaagguggccguacuuacuaauauuuucagaugcacuauuuauuuuguuuaguuuuucuuacugucuuuugucuauugccauguuccauuuccccacacgcuaaauucacaaaagcuacuaucauuggcacuaaaacaucucaagcauugggcuugugagauacauaguuaccugaaaaaauuuagaagaaagccaggaacacugugcuagaaggaacuggaaguucugaagggcuugagugccauauuuuauuauacaucuguugaucuaaacugcgacuagguucuuuuuaccuuuguuuucuacaguuuuaaccacuacuaaaucugggcuuucugucuccaaucugccucucuuacugccauagcguguacucguauggcucuuuauuuaaaucuauaggccagguacaguagcuuauaccuuuaaucuuagcacuuugggagguugaggagggaaaauugcuggagacuagcaguugaagaccaaccuggacaaucuagcaagaccugugugugcaaauaaauaaauaaaugaauucgcaggguguggcggcauguaccuuguagucccagcuacucaggaggaucaccacagcccaggagggcaaggcugcagugagccgugauugcaccacugcauuccagcuugggcaacagagcaagauccugucucuuaaaagagaaaaaaaagaguguguagguacuaaaaagacuaucauuaaauauauccaaaccaguuuuacuguccuaucucuguuguaacggccuugucacauuauuuguauguguuaggcaaucuggaaguaauaaaugagcuguuaguuauguuucaaggucaauauuuaaauaaugacuuacuuguaauaacuaguucaacagguauuuuguuuguuggguagguacugagguaauaggauauaaguccagggagcucacaggucaguuugggauagagaagacaggccagagaaacauaucuucagucugugugcuguuuucacagaacugggagaaccuauuaggaaaagccuuuaaggagauaacgccagagcuaaguucuuuguuuauuuuuauuuuugaaauggagucucacucagccaccuaggcuggagugcaguggcguaaucucggcucacugcaaccaccgucucccagguucaagcgguucuccugucucagccuccugaguagcugggauuacaggcaccugccaucaugcuuggccaauuuuuguauuuuagcacagaugggguuucaccauguuggccaggcuggucuugaacaccugaccucaggugauccacccgccccggcuucccacagugcuaggauuacagacaugagccaccgugcccggccaagcuaaguucuuaagaauuaguagaaguagagaguacagaaauauuuuauggggacagagcaugugaaaaagucacagaaguaugaauuuugcaaaacauuuuuuucuacuuuuuuucuuuugaaaaguuugauuauucuuuuuuuaguugacaaaguaauacauucuaaaguaggccuuuuuuuuuuuuuuuuuuuuuuuuaacccuggacccccaaucuuucuaggauggauuucuuguguauucuucgaaacugucuauaccacuguaaggauauuuacuuuuuaaaaagguggaaucauauacacuuugcuguacuuuaucgugugcucaaguuuuugcuuuugcuuuuuuuccucucuccuacauaguggucuaucuuggaaaucuuuggugggaagcauucgaagaaggguuugacaugaaggaguaacauggucaguuccauauuuuagguagccauaacacugauggccauauuuucauaaaaaugaaaguaaagaugaaggaaggaaauauauugaagaugauaaugacuuuaggaagagaagugugucuccuguacccaacuugcccaucaucgugagaaagcuaguaggaaaacucuuaagccuuuguacucauggauuggcucacauuagagguguuaccacuuccccagcagguguuuggaaauguacgguuguugucagaguaacugaaggggcucuacuggcauuugaugguugggggccagggaugcuaaacuuucugcauuacucaaaauggucguguacugcuuugacagacugaggguggccuucuacccugucuugcgauaaguagcaggucuguuauuugaggaugaauaaaaacaaaaaacaauaggagucuauggaauaccuauauaauaaaggaaugggaacaucauccuaaagacuaacaaggagagcagagcucugaacacaauuuuuauagaaaacaaaauaaaacuuaaaaaaaaaucuggcagucucaagaaguggcuuuuagaaaguagauuguaaaguuuuaaauuccaagccagauucagcccugucagcauguuuuguguauucuacacauuguuuuaagaaauuucucacaaguuugccagcauuuaaaaauagauuuuaaauaaaaauucggauauauugcuucucuugaaaaaucagaucuuuaagcaguaagguugaauugcauuccaccuuaccuuccauguaagcuuuugaguuugccgucccugcaauaacaagcaaugugagggacaaccaugauacaguuuuuacagauugaacaauaaacaugaaaauaaagagaagaaaggugucugugggacucuucuguauagagaucuaaucugagaauuaaauaagacugagaaaugacacucaaguguaaaucauucuaaguuugauuuuaaaauugaauauauauaugaauaugugugugugugcauauauauguacguauguauauaucucuuucccuuuuuuauucccucuccuuuuuugaagcaguuaauuccuaaagccauuaggugagcccaagcaagguaggcauccacgccaaaguuggggagcuauaguggcacagagcagaguguuggaagcugaccagguucagaaggugugggauggggaacacuaccaguaugggguuucagagcccaagcagggugagaauugcaccccuguggaggagugacuggcaugggaugucaagagugcaaguaggaugaggaaggugucuacauaggaaggguaggacuaaaagaaaccagggcucuuuggcagguuccaaggcugggguagggaaagaacaggauaaaucuggaacuucuuguugggccagaaaguaagaaagugcucaaagaaugaugaggacauguccaaaaaacacaauaaugucaguaauugauuauauauuuauaaaaaauaggaaaccaugagggaauaaauaaaugaauacauugaaaguuugaugaagaacaggauauuuacauacuuccaaauuaggucccuacaaaauuuucauugucuacaaaagagaaacaagaaucaugguaaaauuuggcagauaacaccuuaauccagugaucaaguuaacaucagcaguaaugaaauaaaaaucacguguuacuugauaggaugcagcgagaacacagcaucugugauauucuuaccaaagaugugugaccugaauuugaucacaaagaaacaccagaggaacccaaauugaaggacauucccaugcaaaauaacugcccuguaaucuucaaaaguaucaaggucauaaaagccaaggaaacacuggaauuuuuccaaaucaaaggagagaaaagaaacaugguggcuaaauauagcacacgauucugaacuggauaguauugggacaaauggcaaaaccugaauggggucugaggauuaaauguuaguaauguaucagcccugauuuccugauuuugaugauugucuuguuaucuaggaaaccacccuuauauuguagaaauuauaugcuaaaauguucaagaguaacagcauggugcuagcaacuuacucugaggugcuuccagauuuuuaaaaguuuuucuuuuuuguuuuuguuuguuuguuuauuugagguggagucucacucuguugcccaggcuggagugcaguggcacaaucucggcucacuguaaccucugccucccugguucaagcgauucuccccccucagccuccuuaauaguggaauuacaggcacccaccaucauuccuggcuaauuuuuguauuuuuaguagagacgggguuucaccaugugggccuggcuagucucgaacuccugaccucaggugauccacccgccccggccucccaaagugcugggagccaccugggagccaccgugcccggccucagguuuuuaaaagguacuuggaacuuuugaauuguacuugcaacuuuucuuuaaguuugagacucuuucaaaauaaaacaaauguuuagaaaguaggaaaggcuuuguguacacaaagaaaaaguggcuugggauauuuugcuacaacaugccuuuuaauuuuagcauuacucucauuaaugcuaaaauuagcauuaguauuacuuuaauuauauaaacacugcuggaaaaacuaaacaguguagaaguaguacccaguuuguuguaagucccuaagucauagacagucuucuuaaaugggaguuuugcuggaaacuauuaguaguaauuauauauguuacaguaaccuguguuaaauaaauguaaagguucaguuuugaagcuguaaauauuuuguaugauguuuauuaguacauguggucuuaaaacaaaguuugaauauuuggaauugcaaaauauaauuuaagacuagacacaguaauuuuccuauaaauuuaucaauaauuuuugaagguuuuucuguuuggcuaauugauuuguuuaauauaggucagguuaaaauagaaguuuugguuucuucuaagacgggaugaacuuugccugcugcuaaaauauguaucuucuuccacuuuucauauuuaaaaagauagccuauaaacuaaugaauacaauaaagauauuauauauaauguaaugaaaacuaauguauauaaaaaguaauuucauaacuaguccgagucucaaauuccaaaugaaauaaaagaggaaaagggugucucaaagagauagaauuucagucuuaacuuugauaauuagaaagcaauguagguuaaagaguaauuuuuaaaucuauucacuaguagaauuuaaagcaaguuacaugcuuucuaagccauggaaaguauaaacgcaaucaaaacauagucuauaagaguaagaggagauccuuuuguaguucauaagugugaugauuggguuugcacacucauaugugagaugugccuuccucaaaccuuguuagggcauuggcacauuauccauuugagggagaaaaaagaguaaggggaaaaaacaaaggcaauauuuaaaccagaaaauauuuaauaacaugggaaaaugcaauauaacuauaugcaagaugaccccaguuuuguauuuguguucauguguaugacaaauguuguuauauguaaagagacuaaaaaaaaucagauugagcgguuuccucuaugagaugaaauuaugggugauuuccauuuucuccuuuaaacuuuuuuuuauauuuaaauaauauauaugugcaaauaucuaacauauguauacaacuccuaaacaaauguucuuuaaaaauuacaauauacuguguucuauucuauguuuuauauacuguaaaagauacucuaaaauauuuuguaguuuuuuuuuuuucaguggaaaaaucuguuuauuucuaggcucauuggugggcaguauuacuuaugggaauugcucugaucaugcuaauggcuggauuuauuaagauaugcaguguucauacuccaaguaguaauccaaaguugccuccuccuaaaccacuuccagguaagaauauuugagcaagauacauauuuauguaacucagaauuguuuagcagguagaauugaauuauaaaugagucuguaguaacuaauguuacaguacuuucuccguaagaaugggauuauuggaugaaugauuuaguugauauuugugugcuuuuugucaauccaaucuggccagugacugcuaaguuaaugcuaauuuaucugagugucugaaaauauuuagaacuagaaauuuuaaauuuugcuugguauuuguuuucuuguuuuuuuuuuuuuaaauauauucuaacauauucccuugccaugauuauggugaacuacuuuaaaauuguugaucuuucuauucuaauaguugugcuucucauauuguuguccuucauuccuccuuccuucccuuccaucuucccucccucccgcccucccuuccuucuuuuucuuuuuucuuucucucacuguguugcccaggcuggacuuacuccugagcucaagcaauccuccccacuuuagccuccuaaguagcugggacuauaggcgcgugcacugcacccagcucucuuaucguuuuuaguguuugugcucuugaaauauuuucuggcacauaagcuuauuuucccccagggugaugcuuguggggacauacagaucccagucugugggaaagucuuagaguagaggauucauucaucaaauaagcacagucaaguauucuccauuccugaaaacaacucuuuaguucuggucuccaccuuuuaccucucagggagacauagcaugaggaagaacccucuuuagaugagcugugggcauuggaaggagaaaaggacaggaaauaaacccuucguauuguuuaguucccucuguuuaucccuccccuucuccaagguauucguagcuauucucuacaggugugaggacagacauugucucagggcagcagcaggggagagccagaacuaaaugacagcaguucccucuccugccgcucucagacuucucauaagaugucuugccucaggcaaauccacuaccuuauacaaaguaguucaaaacuagguuucuuacacuuuuucucuguuuucccucaguuguucaccugcauuuaccugucuggggcaagauggcccaguagucaugcuaggacaguaucuuagugagaguuagaggaaauuugauuuuuauaucauugcuuuucuuaaguucacaauguuaguuagcacucuggaacuuauguuaguauuuaaggaaguucuaagggccacaugacacuuuuuagaugcuguuaccaauuguggucuuauucagugaaacauuuuauguguauguugguuucauuuuaagugaauagcaccuuuaaaaacuuagaaaacuagcugucauuuauugaacccucacaaaaaguguuaaacauuuuuauaugaauuauauaaucuuuacaacaggcuauauacguuaauuaucauccuuguuuuacaguguaggcaucugagucucagguuaaggcauuugcucaaagacacuuaguaauucccucauauggauucuguccagaaucugugauauuaaucuggauuaaucuaauacuuguggcugcugagcacugaauuguugcuaguuuccauugaaaugugcuguuuuaauuaacauacauaccagacuuugaagauuuaguauaaaaaaagaaauauuuuguuaguaauuuuuguauugauuauauauugaaaugauaacacuuuggcuauauuaauuuaaauaaaauaaaaaauauuauuaaaauuauuucaccuuuuaaaccuuuuuuauuguggcuaucagaagauuuuaaauuacauugauggcccauauuauuggacagcacugaacuaaaaccuuucuuauugaaacagcagcuuugcuuuuaaagauuaaaaagcucaugauaaauaaaucugcuuugcuuuuauuuguggcucacaggcacuuuaaagaggaggagaccuccacagcccauucagcaaccccagcgucagcggccccgagagaguuaucaaaugggacacaugagacgcuaacugcagcuuuugccuugguucuuccuagugccuacaaugggaaaacuucacuccaaagagaaaccuauuaagucaucaucuccaaacuaaacccucacaaguaacaguugaagaaaaaauggcaagagaucauauccucagaccagguggaauuacuuaaauuuuaaagccugaaaauuccaauuugggggugggagguggaaaaggaacccaauuuucuuaugaacagauauuuuuaacuuaauggcacaaagucuuagaauauuauuaugugccccguguucccuguucuucguugcugcauuuucuucacuugcaggcaaacuuggcucucaauaaacuuuuaccacaaauugaaauaaauauauuuuuuucaacugccaaucaaggcuaggaggcucgaccaccucaacauuggagacaucacuugccaauguacauaccuuguuauaugcagacauguauuucuuacguacacuguacuucugugugcaauuguaaacagaaauugcaauauggauguuucuuuguauuauaaaauuuuuccgcucuuaauuaaaaauuacuguuuaauugacauacucaggauaacagagaauggugguauucagugguccaggauucuguaaugcuuuacacaggcaguuuugaaaugaaaaucaauuuaccuuucuguuacgauggaguugguuuugauacucauuuuuucuuuaucacauggcugcuacgggcacaagugacuauacugaagaacacaguuaaguguugugcaaacuggacauagcagcacauacuacuucagaguucaugauguagaugucugguuucugcuuacgucuuuuaaacuuucuaauucaauuccauuuuucaauuaauaggugaaauuuuauucaugcuuugauagaaauuaugucaaugaaaugauucuuuuuauuuguagccuacuuauuuguguuuuucauauaucugaaauaugcuaauuauguuuucugucugauauggaaaagaaaagcugugucuuuaucaaaauauuuaaacgguuuuuucagcauaucaucacugaucauugguaaccacuaaagaugaguaauuugcuuaaguaguaguuaaaauuguagauaggccuucugacauuuuuuuuccuaaaauuuuuaacagcauugaaggugaaacagcacaaugucccauuccaaauuuauuuuugaaacagauguaaauaauuggcauuuuaaagag

SEQ ID NO: 192067 - RNA, 80429 nt, Homo sapiens
cgaagauggcggggcgaagucugugucucacggucaguucaacuccaggcuccuggggagcgucuggguuccggcgacuaggacgccuaacuuccuuuaacuucgggucugaaagucuguggcucuuuuacagagaagcagcguuccagggacuccguucccgccacccguucagcaacccucuacaccuggacccgaccuccucgccuuggaggaagaauauaaguaagaaauucggcgguugaacuuuuccuucuuucuuucaucugaaugaggcugcuuacaaguacuuuuuucuggagacuggcuggaucuucgggaccacucacucugcagcauucccuucucgucaucucguucaccugccguuuauccuuucuuugucuuugaucugaguaguucgccugcguauuagaagauauuugaagugggcgaaaauuuagcccaaguaagcauguuguuuaauuuaaaacguagcccaaguaaacagcaagauacuguuggaaguuauuuggguagcaggaauugccacgaauaguuaguucacuugauaguuuagguuauuucgcuuaauaucaaguucauagaguuuaccuuguguaaauuuccuuuagguugguuucuaaauugaaaggaugcuucccacugcaaucagaauuaccauucucguucaaauauuccuuuucuuaucuguucucaguguaauuacaacuauccugacaacggugcuuucauucuuggcccauucuacuccucauccccaaguuuucacacagcagccaguguaaucuuuuaauuugaucuaccaugccuuugcuuaaaauucuacaguaguuuccuguugcauuucaaaagcucugaucgauguggcuccuccugccuccucuauuugaucuuauucccucuuccccuuuucccccuaaaacucuccagcuucacuggccuuuuaguuccaaaaacucuuccagguuuucuuucuaucucaggaaagagacagucacacacgccuucaaccuguaaugugaguggccuuccuugaccaugcuaaguaggcucccuuguuggucuuuuucauugucucagugauuuuucuuucuaauuagcauaauuuguuacaauaaauucauuugugaauuuccuuuuugucugucuccacuggacuguaaguuccaagggcagaggcgaugucuguuuuauuugccaucauacauacccuuauaaaaaagugccuuuuaacaacucccuuccguuuuaauauaaaauaacuagauuaaaauuuggaaauaguuggcaguuuguaucagaggguuaaacuagaguuaucguaugaucuacauaugaucuauaagcauauuugaaauuaaaacugaaagguacuguguuuaggugaacuauacacagaccaauuuaccacagcaaguaggaagauaaucauaucuucuucucucugaugaaaugggccgauuaucccaguucaaaaguguacuuaagcaaauuaaucuguuuucuauauauaguucuuuaucagcuaugccucaaucaaaacgguuauuuucauuaucauuaaccauauaguauuaaauaccuggauuagguuuauuuguucaguuauuugagaguguauuuugcaccugguucuggugcauccuuagggauacaguccugcuuaaaaugagaaauauacagggacuauuauuguauucuagcacgaguuacuuuauaaaacgagauagcuaaacaguauuauaugguggccaguuguuacuuguucuguuaucuguacucugaguugugcacaucugaagcauaugaacagaguaacucccuacacuaccugaaucuucuagaauacuucugugucauguagaagaguaaaaugucuggccaucccuguaagcaagaauaugaaauuauaacaguaugguaucuguuuugccaccuguugucuuggcauugaucauuagaaugcuacuucccagggaccucaauccaaaaccuuuugcaguucugcuucuguuggaggaaauaaucacuguccgaaaggauagacuaaggaagaugcuaaucgcucaaguggauagauuuuucaagcuucauuccuguauuauaauaccagauagcuaaacaauaagauaacauaauaacugguagggcaagcccccucauaaaucgcaauuacauuggauuuacagauuaauuuguagagaacugacuuauuuaugcuauugaauuuuccacgaauaugauacuucuccauuuauggguuuuuaccuuuaauaguguuuuaucauuuuacuacauaaaauucuugcguauauaauuugcuucaagguacugaauaguugcuauauaauaaguggaauuuuuucuauuuucuaauugguuauaaauguagaauuuuuagauguugaugcuacaucugcguuuauauacacacagaucuucaguccugcugaacucucuuauucauucugugaauucccuuggauuuuugaugaagacaauuauaugcaaauuuugaucauuuugucccuugauaauucuccuacauucucucuuuuucucuguuuaggacuucccgugugauauggaauagaaaaagugauggugagcuuccuuguuuaugauuuugagaagcccacuuuuaauaaucacuacauuugagguuugcucuaggguuuugguagauucuuuuuauuauguuuaaaauucuuccccuuaauuccuaauuugaaugaguguuaaauguaucaaaacuuauuuuuucccuaauuaauucagcuguugguauguucuuuuucccuccuuuaauguuuuaacauacugaacuacaaaggcagguuucuuguuuuccuuuaaagacugcuagauuugauugcuauaauuuuauguagguuuuuugcaucuaugaacaaaagugaaauggguguuguaguuuuucucuacuucuuuuccuuucuguuuuugauaucaguaucauucugucuguaugaaagaagccgaauaguuuuccuuuuuugauucuuuucuuggaagcuuuuuauaauuagagauuuucugcccuuugauuaaaauugugaaacugucugagucuaguguucuuuuauucaaggggauucuuuuugucuaugcauuuagcuucuuuaaugauuagauguacuauuucuagaauaguuuuugguuauuucuaaaauaauuuuuuguucuagaaaaguguucauaucauguauguuuuaaaauacauuagcauaaacugagucuauggugguauguuugaaaucuugacuguauccauaaccauguacaccccuccuuuugguagcuuuccaauauuguuuauuuuugucuuuuucuuuuucuaucaagcuuccugggagauuuaucuguuuuauuggucuuuucagagaaccagcuuugguuuucuugcuaaucugugcuauuuuaaaauuucauuaaucuuuacagaaauaaagacaaaugaucucuucuaacugggguggauuaauuuuuuguuuuuuaguuuauuuaccucauuuauuguuuuucuuauuucuuaauaaauauauuuagucuuuaaauuucucuccaacuguagguuaacuauauuccaggacuuguuuugauguauauuucuuuuaugguuauuuaguucuaaauauuauacgauuuucauaguaauuauuuagaaguguguuuuuuaguuugcaagcacauaggguuguuuguuuacuguugucuaguuuuuauuuuucugaguauguaugugacaaggucuugcucugauguccaggcuggagugcaguggugugauuauggcucauugcagcuuccaccuccugggcucaagaguucucccaccccagccucccgaggagcugggacuacaggcgcauggcaccaugccaugcuaauuuuuuuuuuuuuuugagacagggucucacccuguugcccagacuggagugcaauggugugaucucagcccacugcaaccuucaucucccaggcuccugaguagcugggacuacaggcaugugcuaacaugccuggcuaauuuuuguauuauauuuuuuguagugaugggguuucgucauguugcccaggcuggucuuuaacuccuggucucaaaugauccaccuuccucggcuucccaaagugcugguauuacaggcccagccuaguuuauuuuaaauugcauuaugauuagagaauugaugugauauuaaguuuuuaaauguauugagacuuauuuguggccaagugcuuguucacuuuuuguaaaaguucuaugcguucuuugauagaaaauguauuuauuauuuguuggcuaaucuguuuuauauuuguucuucaugacaucgguauccucaccuuuuuucuuguugcagcuuuauugguuucuguuagaaguguauuaaaaaucaucaauuauaauuauaguuuaaaaaaauuccuuauaauguggccauuuuuguuugggaauaucuuguuugacuuauuuaaaucuucuugauucauuauuaugcagugucuaucuuucuucaucccuuuauguucaaacuuuguaugucauuuaucaguaagagcauucuuuuuauaaccagucugauaauuucugccuauuaauaagugaauuuaauauauuuacauuauuacauaacuugaaguugucuuagccaccuuauuuuuuauauuuucuauuaugucuugucuuugguucuugucugucuucugcuggauugaauggguuuucauuaugucuuuauuuuuagugauguggaaagacguuagaaugcuuuaacuugguguccucugucuuuuaaauuagauaauauuuuacuuuguuguuuugaauacacccacacccaguuaaucaucaauuuuuuuauagucuguacuaauuuagauuuaucauguuuucagauaucuucauaauucuuuuuuuccagauucaauuuccuccuuccugaaguguagacccuuuauuacuuuuugugaaaaccugagucuuaaacucuccagucuuuuugaaaauuguuacuuugcauuuauucuucaauuacaguuuaucugaauguaauucuagauggccagcuuuuccuucucagcccauuaaagauauccuuauauugucuguugguaauauaaggauagaaauguuagaaugucagaaauguuaaugagccaucugcugucagcuuuuuagauaauuaugcugguagacuauuuuucucuguuguuuugaaauaaugauuugguaguuuagggaguacucucuuuaaaauucuguauuuucacugugauguauacacagguggauuuguuuucuuuauucuucaugagauccaugucuucaguuugggaaauucucagcauuagcucuugaaauacugucauucucuccucuugggauuucuuuuuuucucuuuuggagacagagccuugcucuguugcccaggcuggaguggcaguggcacgaucuuggcucacugcaaccuccgccucccagguucaagcgauucucauuccucagccuccccaguagcugagauuacaggcaugcagcaccacaccuggcuaauuuuuguauuuuuaguagagccgggguuucgcuauguuggccaggcuggucuccuggccucaagugauccucccuccaccucccacugugcugggauuacagaugugagccacugcacccaggccucucugggauuucuuuuauaacuucuguuaaguaggaacauaacaucugucuucaauggauguuaaccugucuuuuguguuuuuauccccuuguuuucuguaucuccuuguaggugauuuauuuauaucugucuucuaauucacucauuccuucuaugcccauuaugcuguucaacauaucugucaaauuuccuugaguucuuaauuucagugacuguguuuuucauuuauguaauuuauauuuggaucuuuuucaaauucagcauucuuuuaugauaaaaucuggcucuugccuaauguuuuucuaagugcauuuuuuuuuuccaaauuaaugcuaauuuuaaaaucuuuuuuuaauuguuauauuaucucuuguucuuauaguauaaauuuucccuuuccucacaucugcugauucucucuuucaguggcuuguuucuuuaugcaauuuguuaccuuucugaagucaucuuuagcaguuugcuuuuugagagaguccuauauauucuagaugaguaaauguuccuauagggugguuuucaauuuaccuuuacuaguuucgaguuuugauugauuccacgucagcuuucuucuauuuuaaaguuuuuccaugguguccuuguaucaccuagauaagaugaauuuggacuucccucuuguuuguuuuaauuacucacaagagaaucuuuucuaccugugguucuaguuucauuucugcucaccuaagguuguggguagaauuuuuguagucuguguuucacagguguaucccuucaugacucacauacaucagcuucuagcuuuuaagcuauuuuggcuucuguuccuguuuguugcucucacuuugaauugcugcuuuauucuuaguaccagggcauuucccuugccugaguuugagcuuagcaauauuuccuccauuacauuuuaucuggcauuuccauggauuuagaguagcauagucuucucagucaucuugguccacuauauuaauuggaaacuuaauccuugugauuaaguccuuguuagggaaauuugaaaaaucagguaauggcacuuuaaaggcaccuuuaagucuuucuuagauauuuuucuuuugaccagguaauccuaagauauaaaaauauuucuuaaagcuucagacuguuaaaggauaugguacuaaucucccccccuuuuuuuuucccuggggguggagaugguguuuuguguuacuucugaaucccaugucuaagaaaaacaagauaucuaauuuuuaaaauccuuaacaugucuccuucacaaaaccucagaagauccuagguggucuagaaaugugacaucucaacaggagaaaaaaguuauaugcuuuugaauauauuuauuaugguguuaaccuuuaaaagugaaaaggggacuuaacaauagggacagaguucaguacauuaucuuaauugcaauuuaaucguauagcaguuuaacaugcuucuaaagauuacgugaagauagauauuccuuuuauauugcugugggaaaacaguacaaaauuguguguaugcuauagaugaaaauuggaagggaauauuaaaaauaaaaauggaugguggugguaggauuaugggcaguuuuucguuuaaaaacaauuuuuuucaauaauauugucauccuugcagucuuaauauaggaccaaguaaauaguauuucuauucuugcuagauuccaaguagaaugaaaaaucauaauuaaaaaaggagugacagguagaggucaaaauagucaccuuuauuuccgaggaagcuugauauuaaaguauguaucugaggugugagccacguugggucugcucacuaaaccucacauuuagcuccccaguuauagcaauaccccaaaccagagcaggucucccccauaccgugcccacuucugcccacauuagagcagggccugucucuggagaagcaagguuagaauuugcauucuuugcagguaggcuaauaacgaggagguggugaguggaacagaguugaacucacccagcuuauucuucccaaauauauuagauaaguuacgucacuugaaauuaauagagggccacagaaaggcuaauacuuaguguuugaguuccuacuacaaggaaggaggaaucauggggaguugaggauaaguucuuaauggcuguguucauuuuagaguaagaaugccauauguauauuuuggcauuuguugauuacgucacuugauaacguguaauugcugaaguuuauuuuuuauuuuuguuaagaucuucaguauaucccaauuauuuucugcuuuuaggcguuuaaaugcagaauugcaggcaaaaacagcugacgugguucaacaagcuaaggaaauaauaguaaguauauguacaauuauuaauaauucuauauaaaugcuaguuuuuuaucuuuuucauuugauauaugacauauauacaaaacacuagccaaagcauguguguucaguucaaugaauuauuacaaauugaacaugaauauauaugcauagguauaggaauguauauauguauauguuuuuaguaagcacacauuuucuaaaagccacugaaaaaguacuuuccauuuagauucuccagucaucuaaauucucauuauaaauucucauuauuaauugauagaauagagcaacucuccuuagaggaguagucuacuuuaaaacuuuuaucaguucuuaguuaauuuugauucuuacuuucuauccucccuaugccccaaaauggaguugauggaagcagggaaggaaaccuaggcaauauuuuaucuucaugccuuauacaaauccaugauuauuuguuaguuuaggaauaagaaauguaucauauauaacauuucaaguaauauauuuugauaaugguuacagauuuguauuuuauaauuuauaauuagauguuuuacuaaaaauauuuauaauuaaauuuauacuuauauguuuuacuaauuuauaauuaaauguuuuacuacaaauauuuuuauuucaucuuuuaguuuuugccagugucugaaaagcaggaaaauacuuguacaaaaggaccccacguuauaguagaaugacagauucauuacguuuucuacucagagagcccuguaaaaagaaucucccccugcaaauaaaaaacagaauagaaaacugggauaagcuaggaaagggguuggggaauggauuccuaccccugcagaagcaaacaauauaagguuucucauauuuaauuuuuauuuacucacuuucucuuuuuaaaauuuuuaauguuugugguuacauaguaaguguuuaugggguaaaugagauauuuugauacaggcaugcauuguguaauaaucacaucauggaaaaugggguauccauccccucaaguauuuauccuuuguguuacaaaaaauccaauuauacuauuuuaguuaauuuaaaauguacaauuaaaugauuuugacuauaauaaacauguugugcugucaaauacuagguacuauucauucuuucugacuauauauuuuuuuaccuauuaaccauccuuaucucccaccccugcaucccccauuacccuucccagucucugauaaccauucuucaacucucuaucuccauauguuaaguuguuuugauuuucagaucccacaaauaagugagagcaugugaaguuugucuuuuugugccuggcuuauuucacucaaugacuuccaguuacauccauguuguugcaagugacagggccucauuauuuuuuauggcugaauaguacuccauuguguauauguaucacauuuuauuuaucgauucaucuguuaguggacacuuugguugcuuccagaucuuggcuauugugaacagugcugcaacaaacauggaagugcagauaucucuuugauauauugauuucugggucaaaugguauuucuaguucuagaucccugaggaaucgccacacugacuuccacagugguugaacuaguuuacagucccaccaacaguguaaaaguguuccuauuucuccacauccucuccagcagcuguuguuuccugacuuuuuaaugauugccauucuaacuggugugagaugguaucucauugugguuuugauuugcauuucucugauagccagugauggugagcauuuuuucauguguuuuuuggccgcauaaaugucuucuuuugagaagugucuguucauuuccuuugcccacuuuuugaugggguuguuuguuuuuuucuuguaaauuuguuugaguucauuguagauucuggauauuagcccuuugucagaugaguagguugcgaaaauuuucucccauuuuguagguugccuguucacucugacgguaguuucuuuugcugugcagaagcucuuuaguuuaauuagaucccauuugucaauuuugucuuuuguugccauugcuuuugguguuuuagacaugaaguccuugcccaugccuauguccugaaugguaaugccuaaguuuucuucuaggguuuuuaugguuuuagguguaacguuuaagucuuuaauccaucuugaauuaauuuuuguauaagguguaaggaagggauccaguuucagcuuauacccaaaggacuauaaaucaugcugcuauaaagacacaugcacacauauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucacaagaacaaaaaaccaauugcugcauauucucacucauaggugggaauugaacgaugagaacacguggacacaggaaggggaacaucacacacuggggacucuuguggggucgggggaggggggagggauagcuuuaggagauauaccuaaugcuaaaugacgaguuaaugggugcagcacaccagcauggcacauguauacauauguaacuaaccugcacauugugcacauguacccuaaaacuuaaaguauaauaauaauaaaauaaaaaaaagauauauugauuuccccucuuuuggaccuauacgcagcagugggauugcuggaucauaugauaacuuuaguuuuuugaggaaccuccaaacuguuuccuuuguaguuguacuaauuuacauucccaccaacaguguacuaggguucccuuucucuacauccuuaccagcauuuguuauugccugauugccugucuuuuggauauaagccauuuuaucagaguugagaugauauuguaguuuugauuugcauuucuuugaugaucauugauguugaacaccuuuuuuuaugccuguuugccauguguguguuuuucuugagaaaugucuauucagaucuuuugcucauuuuuaaauuggauuauuagauuauuagauuuuuuuuccuauagaguuguuugagcucccuauauuuucuacccuugucgauggguaguuugaaaauauuuucucccauucuguggguugucucuuuacuuuauuguuuccuucacugugcagaagcuuuuuaacuuuaugugaucccauuuguccauuuuugcuuuggugacuuuugcuugugguguauuacucaagaaaucuuugucuacuccaauguccuggagaguuuccccaauguuuucuuauaguaauuucauaguuuugagaucuuagauuuaagucuucaauacauuuugauuugauacuuguauauggcaagagguaggggucuagucuucuucuucugcauguggauauuccguuuucccagcaccauuuauugaagagacugucuuuuauccaguguauguucuuggcaaccuugucaaaaaugaguucacuguagguauauggauuuguuucuggauuuucucuauucuguuccauuggucugugugucuguuuuuaugccaguacucagauguuuugguuacuauagcaccauaguauaauuugaagccagguaaugugauuucucaaguuuuguucuuuuugcuuaggguagcuuuggcuauucugagucuguugugguuccauauaaauuuuaggauuguuuuuucuauuucugugaaaaugcgauugguauuuugcaagggguugccuugaaucuguagauugcuuuggguaguauggacauuuuaacaauauugauuuuucuaauccaugaacuggaauaucuuuccauuuuuuuguguccucuucaauuucuugcauugauguuuuauaguuuuuguuguagagaucuguuacugcuuugguuauguuaacuccuagguauuuuauuuguggcuacuguaaaugggauuacuuuuuuauuuauuuuuuagauuguugacauacagacacacuacugauuuuuguauguugaucuuguauccugcaacuuuacugaguuuaucauuucuaauaguuuuugguggagucuuuagguuuuuccaaauauaagagcauaucaucuguaaaugagguuaauuugacuucuuccuucugauuuggaugcccuuuauuucuuuaucuugucugauugcucuaguuaggacauugaguacuauguugaauaacaguggugaaaguaggccagaucuuaaaggaaagacggucaguuuuucccauucgguaugauacuagcugugggucugucauauauggcuuuuauuauauugaggucuguuccuuuuauacucauguuuugaaguguguuuaccaugaagggauguugaacuuuaucaaaugcuuuuccaggaucaguugaaaugaucauaugguuuuuguccuucauucuguugauaugauauaucacauugauugauuuguguauguugaaccauccuugcaucccugggguaaaucccacauggucaugacaaauggucuuuuuaauauucagcaaacugaauucuguuugcuaguauuuuuugaggauuuuugcaucaauauucguuagagauauuggcauguaguuuucuuuuuuugaugugucuuugguuuugguuucaggguaauacuagccucauaaaaugaguuuggaaguauucccuccuccuccaauuuuuggaauaguuugaguugguuugguauuaguucuucuuuaaauguucgauagaauucgcagugcagccaucagguccugggcuuuucuuuacugggaaaauuuuuuauuguggcuucagucuuguuacuuauuauuguucuguuuaguuuuggauuucuucaugguucaaucuugguggguuguauguaugugucuaggaauuuaucuguuuccucuagauuuuccuauuuauuggcguauaguugcucauaguagccacuaaugagccuuugaauuucugcauugucaguuguaaugccuccuuuuuaauuucauauuuuauuuauuugggucaucucccuuauuuuguuagucuguuaauuuugcucaucuuuaaaaaaaaccaacuuuuuguuucauugaucuuuucuuuauuucaaauucauuuauuuuugcucugaucuucauuucuuuucuucuacuaauuuugguuugguuuguucuugcuuuucugguucuuuaagaugcauugcuggcuggaugugguggcugauagcuguaaucccagcacuuugggaggccaaggcacgugacucacuugaacccagaaguuugagaccagccugggcaacauggugaaacuccaucucuaggaaaaauacaaauuagucagaugugguggugcacgccuguagucccaacuacuugaggggcugaggagggaggauuguugagcccaggaaggucuaggcuguagugagccaugaucaugccacugcacuacagccugggcaacagaguuucucucuaucucaaagaaacaaaaaaaaaaaaagaaagaaagaaaaaaaaagaaaagaaagaaagaaaaagaaaagaugcauugcuaagucauuuauuugaaguuuuuguucuuuuuuguuguaggcacuuacagcugcauaaauuucccucucaguacugcuuucacuguaucccauagaucuugguauguuguguuuucauuaucauuuguuucaagaaauuucucaguuuccuucuuaguuucuucauugacccauugguaauuuaggugcauaucaucuaauuucuaugucuuuguauaguuuccaaaguucugguuauuaauuucuaguuuuauuccaugugaucagagaagaugcuugauauuauuucaguuuuuaaaauauuuuacaacuuguuuugugaccuaacauauggucuguccuugagaaugauauacaugcugaggagaauaauguguaucuguagucuuuggaugaaauguucuguaaaugucuauuggguccacuuguucugcagugcagauuaagucugauguuuguugaguuucuuucugggagaucuguccagugcuaaaagugggugcugaagucuccagcuauuacuguauuguggucuagcucucucuuuagcucgaauaauauuugcuuuauguaucugggugcuccaguguugcaugcauuuauaugcaaucauuauauccuguugcuggauugaccucuuuagcauuauauaaugaccuucuuugucucuucuuacauuuuuuguuuugaaauuuauuuugucuaaguauagguucuccugcuuuuuuuuuuugguguagaauaucuuuuucuacccuuuuuauuuucagucuauauauauaucuuuauuaaguaaaguauguuucuuguaagcgacagaucauggggucuuguuuuaucauccauuaaaccaguccgucuuuugauugaagaguuuagugcauuuacauucaguguuaauacugauaagggccuuaauccugucauuucauuauuuguuuucugguugucuuguggcauuccuuccugucuuccuuuuauugaaggugauuuucucuugugguauaauuuaauuuccugauuuuuauuuuuuguguggucauuguauguuuuuuggcuugagguuacugugaggcuugcaaauacuaucauauaacccauuguuuaaagcugaugacaacuugacgcugauugcauaaacaaacaugcaaaaagaaaacuaauacaaacucuacacuuuacuuuuaucucccuaguuuuuaacuuguuguuacuguuucugucuuacuguacugucuaugaguuaaaaaguuguuguaguuauuauuuuuaauuggcucaucauuuagucuuucuacuuuagaguaguuuacacucaauuacaguguuauaauauucuguguuuuucuguauguuuacuauuaccagugacuuuuguaccuucugaugauuucuucuugcucauuaacauccuuuucuuuuagauuaaagaacugucuuuagcauuucuuguaggacaggucuaguguugauggaaugccucaacuuuuguuuuucugggaaggucuguuauuaucuuucauguuugaaggauauuuuugcuggauauacuauucuaagguuaaaaucuauauuuuuuucuucagcacuuuaaguaugucaugccacucucuccuggucuguaagguuuccacggagaagucugcugcuagauguauuggagcuucuuuguauguuguuuguuucuuuucucuugcuguuuuuaggauccuuucuuuaucuuugaccuuugggaguuugauuauuaaaugccuugaggcagucuuuuuuggguuaaaucugcuugguguucuauagucuucuuuuacuugaacauugauaacuuucucaagguuugggaaguucucugauauuaucccuucgaauaaacuuucuaccucucucuuucugccucuucuuuaaggccaauaagucuuauauuugcccuuuugagccuauuuucuagaucuuguaggcaugcuucauucuuuuuucuuuugucuccucuguauuuucaaauagcaugucuucaagauuacuaauucuucugcuugaucaguucugcuauuaagagacucugaugcagccuucaguaugucaguugcauuuuuaacuccagaauuucucgauucuuuuuaauuaugucaaucuguucguuaaauuuaucugauagaauuuugaauuccuuuucuguuacuuggguuucuuugagcuuucucaaaacagcuauuuugaauucacugucugaaaggucacaugucucuguuuuuccaggauuggucucuggugucuuauuuagcucauuuggcaaagucauguuuuccuggaugaucuugauacuuguagauguuugucacugucuaggcauugaagaguuaaguacuguagucuucacagucuggguuuauuugugccagucuuucuugagaaggcuuuccaguuauuuaaaggcacuugggcccccugcccaauaucacuaggguuuuugcagacuuguagaggccuugguggucuuggauaagaucugaaagaauucucuggguuaccagacagagacucguucucuuccuuuauuuucucccaaacaaauggagucucuuucucucugugcugagcugucugaaacuagggguguggugaugcaagcaccccugugcccagcaccacugggauugugcuccgucagaccugaagccagaacaguacuggauguugcccacaaccugcuauaaacacuaccuggcuaccaccuauguucacucaaggcccuagagcucuacaaucagcaggugaugaggccagccagguuuguguccuucccuucaggguagcgaguucccccaggcccuggguggguccagagaugcugucugguagucagagauugaaguuagaaaucuuagaaauuuaucugguguucuaguguuuuguggcuaagcugguacucggacuacaacauaaaguccuuccugcuguucacuccccuuuccacaggcagaggagccucuccuuguggucaccaccaccaccaguccauagcaggguucugccaggccacugcuaguguucacuuaaagcccaagggcuuuucagucaggucguggugaauguugccaggccugggacucacccuucaagggagugggcuccccucuggcccugggcaagucuagaaaugcugucuaagagucaaauccuggaaucaggcaccccaagaguccacguggugcucugcccugcuguggcugugcuaguucuuaaggugcaagacaaaggccccuuuacuuuucccuuugcuuucacaagcagaaggagucuuucacuguagccacuacaacugggaaugugcuggaucaccccugaagucaguaugucucagagcccaaggcccauggccugcuauuaauaccuugguauugcugcugguuauuuggggcccaaggucccuuuauuuagcaggugaugaaugcugucagaacuggguccuucccuucaaggcagcagauucccucuuggcccaggaugugucuagaaaugucauuuaggagcuagggcuuguaaugguggcugcgugacucugccuggcacccuguuggcugucuuccauggccgaggugguauccgagaugcaagauaacauccucuuuacuuuuuguucuccucuccuuaaacagaaggaaugagacacuuuuguugcugugaacugcacugccugguguuggggaaggcauggcauaagcaauccuuuagugcccugguugguguuuuccuaggucacaauuggugucucccuaggugccagccuaguccucuggcucugagucaagcccagcacuaggauuugccuagaaaauggagccauuguauccuagacugcccuucaaguuuaccuaggaccccagagcacuuuggccaguaguggcaagacuugcugacaaacuggaguucugacccacaggaugggugauuuuccucuggcuauagcugguccagaugcuuccuccaugcauggguacucaaagucuccgccccgcaugacuuugcucuccacucugacagggcagcacugaguucaaugcacagucgcccagucacugugcugucccuccccuaagugcacagacucuucaggcugcacagccacugcaggagugagucaggaagggguggugucagcuuuuuaagucucuccaaccuucuucaaugccucuuucaaugauaugaaguuaaaaccagguacuguguuugcucaccugauuuuugguucuugugaugauguuuuugugugcagguaguuguuaaaauuugguguuccugcagagggaaugaauaguguaggcuucuauuccacccucuugccucacuuucauuucuugaugugucuuugccaaaagcuuuuaccccugauacuucacuuuuagcaucuucacagucuucucaacauugaaguuuuuccugauuugagacaaauuuuucuacccauuuagugaauuuauuuuuuaaauuucuugugccuccuucuaauuucugcuguaugcuguauaagcuggaagacucuaaagggcuggggaaacuggaguuagaaauauuauguaaaggccuugauauucuuacauuuuccccuuaggauggaauuuuuuaacccagaacaaaugaaaggugcaacuaguguuauagaccuuaucuucauacuauagcauuuagaauuccgugccuuuauguuauggaaaccuuggacaauucugaaaugaugaauguucagagaggcacuugaauauaucuuaaugguuugguuuuuuuucuauaugauauauuaccuaucuuuacucauuuaagagagaucggcaagaaguacgaucuaggccuguuucaacacaaaugaaaucaugugaugacgaagaugauuacaguuuaagguaaguaucuuaaauucucaagcaccuucuuuuaaaaggauguacauggaucguuauguaagaucuuuuuugcaugcaaacauugaaaaaucuauaauuugaagaauaauguauauauagggggcuuauaccaaucagacacagugcaagcccuuuaucucauguaauuuucaaaauauuauuuugaaauguauauucuuguccucauuuuuaaaacuuuagagaggaaacaggaaaaguacauaaucgaugugaauaaaacuaugaaaucauauuguagcagacggaaugaugaucaccaaacauuccaagucucuuacaguugucauugggcuaugaacagaaguuuaguuaaucucuuccaagccaaaacagacaaaaauugguguguggaccuccaaaugacuuuccagccaugaagaugaguaaaauuccaauugguaaaaucuccuagccuggugucugggugaccguguguggaccauguagaaaaaaggaucuuucuucgucacuacugcugcauugaauggguuaagccacuggaauuuuuagguuacuauccugcuuaucuuugcuaauguugaaauugguauugggaauggaaugcugcauaacaaaaauucagaaguguggcauuaccuuagcaguuaggugggagccagcaaggaaacugauauuggaggcuggaaagauaaaggauuaauauuauguaguggcaaugaauuuaguaaaacuaucaucugugguaaauugggaggcacaacaggugucuaaugaacuuguucucuggggaaagaggcugaaacacaauaucaacaguauguccuguuaaagagacaaguuugggaaacauuuggcugauuuguaagcagaaauaaaagggaauaccugauuaucuaauucagagucacaaagauuuacgaccaugauuucuuugaagagcuuuaugguuuuaacucuuagauucagguucuuugauccauuuugaguuaauuuuuguaugugguauaagagucaaccuccauucuuuugcacauggauagccauuugucucagcauuauuuguugagaagacuguucuuuccccauugaauguucuuagcacuuuugucaaaaaucaguugacugcagacauaugguuuuauuuuuggacuuucauaucuguuccauugaucuauaugguugucauuaugccaacagcacacucuugauuacccuuguuguaacuguggaguuguggaguaagcugguuuuagaccucaagaauuacaagguaaaauugagaaaaucuguaaggaacaaaagccuaucaaaauucaaccuugagacaaauaucagacuaaacauguggacuucaugacuacugauacaauuuuucaguggauuaaggcuccucaaugcaaggaucagauuaaauggcacauagugaaacuuuucauuuggguaaaauggcccauggcaaagaccuaacuaaaguuauagucucuccuuagaagcuugacaguguuaaaguaacccauuuuuaaauugagaaagagaggucaggugaagaaauaaauaaauaauuagucuuggaaagaauuguaggugauguaauggcauguagaacuggcugaaauuaaauagggaagaaacccacuaguuugggggaaaguuuuaucagcaaagaaacucuaacaauggacuauaauuauuucuggcuuuuaaaauauuaaaacaacuauggguaccccgccuuccaguauucuaagaucaagaaguaggcuauaagaggugcauagcccuacaggguuuagagacaaaagagaagcuuauuacugacauggcaguauauuuggcucaugugaaauauugggacauuauucauuuauucaaaaauaauuauugcaugcgauccaguauuucccuuccuagauauuuacccaagagaaauauagacauauauccacgaaaaaaccugcaugugaauuuuuagaucaauuuuauucauaauuaccaaaaccuggaaauaauuaaaauauuuaucaauugguggcuggauaaacaaauuaugguauauccaugcaauggaauacuacuuggcaauaaaaagacaugaacuacuaauagaauaacaacauaguugcuaagugaaagaagccaggcuaaaaaacguccauaaucuauguuuucacuuauuugaugcucuggaaaaggcagagcuuuagggacagaaaucaaagugguugucuggggcuugaguaggaguuaggggacuaccaaggaacacaagggaacuuuuugagaugguggaaauacucucugucuuggugguuguggugguuaugugaccauauacauuagcuaaaacauauugaccuguauauguaaaaagaguauauugugugauguaucaauuauaucucaaaccugaaaaaaauaauuuuugaacacuguuagugccaguucuagcuacugguauuacaguggugaguaaacagaccugaucuugcuuccaagaaguuaauauguguugcuuuugaguauuuuuuaaguacaucaauuacacauuuuuauauuuugauagacauauguaugcguacauauaccaugaaaccacuuaucuuuauuauauguaauacugugauauucuaugaaaaauagauauuuaaguuaucaaaauuccaaacuuuggauuauacauaagauuagacaugauguuuauccaguaaacuaaagaacugaaaugaugcuaacaacagaugaugauguugugaugaugacgcucuguuuaccuaucaguuuuuuuuuaaugcaacuguuugaacagauggcuuuuaccauguaaaacauggcauuuguugaucaguugggaauuccugaauaugggagauaauucuauaaagaaaccauucauuucagguuggaacaaugauauuccaccuaaauaauuauaauuaggaagaauauauuuuaauaggucuucaacacccaggaugacucugucaaaaaaugugaugggaaaccagaguuuaauuuccuaauaacguaguauacguauccuccagucugcuugaagcaugguuuaccauacaguuauuuccaucauauuacaaacagacauuucauggaguuaaacaaaaguaagaauaccauacuauagcuuacuuuucaugaaaauacacuagcaaaguaauaucacugugaaaucugauggagacagauaacccuuaaaugucuuuuggcugauauguaugcauguauguuggggaauggaaugaaagguacagaaaauguacuaaaaugacaaacauuaauuuaaaaugaggaagauuaaagaggacacuuaaaauuuguauaacauuuggaaacauuuucaugucauuugugagaaugauuuaguuucuguaauuuuuaacauauuuugaaagccuuuuuuucuucccagagguauuucuaauaguuaagagguuuauuuaucuaaguauaucuuuguauuuaauaugaaaaaauuuaugcauggcuagcuaagugggaggcaucugauggaaaauaauuuuaguuguaugucuucuccaaugguuaggaguucucaggggauauaguggaguuuuuucauagcaauaauggaugcuaacaugguauguuuucagagauauaaauacaaugcccaagacaauggguuaggcaaacuuuuucuguaaaggggcagauagcaaauauuuuuagauuugugggcuguauagucuguuguaccugcuuaacuuuaagguuguagugugaaaacagccauagauaauacauaaaugagugaguggguggauucagccugugggccauaguuugcagaccuccauaaacacuccuuguuugaaacuacaaauauauuuugaaaaccuuguguauaaaaaugaauugcauuuuacguguauuuauucaugcacucaacaaauacuuacgccaguaguaccuggcauauaaacuuuuaaauugacuaggcauagaauauugaacaaggcagacgugauuucuacccucauagaguucacaauauaaugaggaaaacaggcacuaaccagguguuuuaaguggauuaaaagaacaguaacauugagugggcuuacaauaaaaagcccuguggugaauuauuuguaaaauggguaauugcuguggauagcccacaauuacucuuuaugauuuccauucauuaaaauuuuugcuacauuuuccuacuagaauauuggcauuauaguguaucuucucaaaggugaauuauuuaaccaaagcauuuuucuuguuuaugguacucauucaaaauaaauuaacauguggguaacuagaauuauagcaaagucuguuugauuguugaauauuuucccuuucaaauauaauuguugaauuucauugucucagcucagugucaucuauuauuaauguauaauguuuauuuuuggccuguagaggucuguuaccaucugaagggauaguucaucuucauucagaaacuaagguaugaaaucaaacuuucugugaaugcaauuauauucuguagaacuccggauauuuuuuagacuuuucuuagacaaagcagagaagggguaugacucaacagaaauagaauaugaaccuugauacucagagggaugcauuugugaagugucccucauaaacuaaauggaauccuuuguugucucauaauuucacugaauaauuuggagguauaguggaaaaaauguuaggugaaaugacuuuguaaacugaggcuuauuuuuuuuuccugacgcuuaaaucuaguagagagaagacuugaaaaagaaugauacucauauacaaagaaggugauuugaaaaguuuguuuguucauuuaaauagugacaguguagagaucacucuuccagguguagaacauagugggaucuauguuucccauccauggagaccuaagccaagggaacuguauaccugaaggccacgggaggucugccuggggaauaauugguucaugaggagaacuaaauucugugagucagaacguccagauuuauucaugacauuccacuggcuagcugaauaccauugaaucuuuaggacucauuuuccuuauacuugaauuucuugguuuugguguuaucuaggucuuuuccagcuauacaguugugauauucuugaaaacacauuuuugguaauuccaugaaaauagcaaauagcaguuuuucuguguagcaaaauucuauguguuacagaauugcuuucuuuggcaaaugauuagacucuaauuagucaauacuuucaauucuuuucauguagccaaagaccaaaaacauugauccuguaaacaagguucaaaacaaauuacacucugcaaauaaaggaaggaaaacaaauucaagguauaguauaguuuucaaaguauuucuuuuuuuuuaguuuuguaauucacaauaccaucauucuuaauuauuaagcucuguuuguuuuuccagaucuuuuuacacccuaaacauuaaguuacaccacauauaucuuauccacauucaguaauuuagaacauuuucuacucaggaauguuuugcagcaguuaacaaauauuuuauauuguucucuuaagcaaaauugcuaaaucuaaaauuuuuauaaauguuauuucuagugaguuauucucuuagaacugugacuacaacuggguuuuuuuuuuaaucucugccuaguucucccaaauaggcucaauaguguaguuuuugaguauuugacaaaaugcauauauuauuuugucuguugagcuacagaaugauuuggcaugcucuaaauaggacuauaauauaauuauaauuuacauuuuguuguuuugggugagaaagaauucaagacgguucuuaguauuauaagcauaaaaagggacccaagaugcucccuaggauaggaugccuucuagaaaagguggaggauuggguugcaccaaccaucuucaguaaguuauuaaauuuauuugucuauuacuuacccaggcugaucauuguauuguaauucuggaaaaaucuuuguucacuuuugugucuuaauuguuuaaauaacuuuuuuuuuuuaauaaaagggauggaaaaaauagagugaagugauaaggaacagaaauuaacuauacaauagauugaagaaaagaacauacaugccacauacaugcauauauaacuggaaaggguuaucuuuucagacuucacauuuuuuuaaaaaaaguugauuuuucaaauagaauucugaagaucaagaccuacuauuugauagcacaauagggugacgauagccaauaauaacuuaauuauauuuuuaaaauaaagaguguaauuagauuguuuguaacucaaacaaugcuugaggggauggauacccccuucuccauaaugugcucauuucacauugcauuccuguaucaaaacaucucauguaccucauaaauguguauaccuacuguguacccacaaaaaauuaaaaugaauugugaagccuuugcuuauguuuuaaaagugaacuuggcuuucagaaccauaaauuuguugaugugucaaugaauuaggccuggacuauuccucagugccuuuagaaaugaguuugauuuugucugucuucuccuuuucauuaaaaaaaauucacauccaacuuuuugguuaguauugauugugguuaagaauguguuucuuuggguggaaaaaauguuguuugauugagcuauuagcucuucacucuguaauucuuucucaagggguauuuuucuuugcuguuuguagaauuauggccaggaugaugucaguuuguacaguuuuucucuagaagcguguaaauuuaaaagucauaggcuggauuugaccuaggaggccaagugcaauacucuuaguuuugguauugccuuauuuggaagcaaagucuauaccaucuggccucauaaagccuucucuagcucuguggucacaugauucauaaaaaccaaaaaucugcuaagucucuuguaauauaguccuugaaaguaucacauguagauuucaucauaaauuuaaaauguguaauaguagucucuuguaauauaauccuuaaaaauaucaauuacagauuucaucauaaauuuaaauuuauaauaauuuugaucugcuuauuuggguaaaaggcauauauccugucuaccuuuccuauuuuguucauauguacguauauacauacauauguauuuaauuuuuauuuuuuaguguuaaauugaaauacucugauguccaaacugccgacgauguugccauuccagaggauuucucagacuuuucccuugcaaaaacaauuagcaaaauugaagggcaacuggaggaagaaggcuuaccugaauauauagaugauauuuuuucugguguuaguaaugacauuggaacagguagauuuucuuuaguuuuuuauuuuuaucuuuauagcacaguuacuuagaagaagaaaucuuggggaacuauuucuuccauuuaaaaaaauguauugugaugucuugguuuguuucagaauuaucuaguaggaugugguggagggaggaaugaaugggauuauagauuaaauaaaauuggccaugggucagucauuguuaaagauaggugguggguaaaugagguucauugaacucgccuacuuuuauguuucauauuuuccauuauaaaaaguaaaaauaaaaaagacuauauuguacugauuugauugaauacauuucaacuuaaguuaaaauacccauugcuuauuguuaaaauauuaaaaaaguuuuucugaauuuuuucauuuacuguuaauauauuuuauuuauugcauguuaaaucaacacaugcaaaaggacaaaugaauugacauugcaucagguaaaacaaucaaaugaguguucuaaugaauauaauuuuucuucuuauuaacucauucuuugcauaucacuagaauaauaauacuaaauuuugaucaacugaaaacauuaguaaauuuaugaggagccuccuaugcuauugaaacaaaaaaguaagacaauugaguauauaugaacuaguuacugcugaacuauaauacaauuaauugugacuacaggcaagccacuuagccccucuguaauagcaguuuauucauuugaaaauuuaguaguuuguauuagaugaucauuaaguuuauguauuagucuguuccugcacugcuauaaagaaauaccugagacuguguaauuuauaaagaaaugguuuaauuggcucaugguacugcaggcuguauaggaagcauagcaguuucugcuucuggggaggccucaggaaacuuccaaucauggcggaaggcaaacagggagugaggcaucucacacggugggaucacgaacaagagacgggggaggugcuacaugcuuuuaaacaaccagauuucaugagaacucacuaucaugaggacacuacuaaaagggaugauacuaaaccauucaugagaaaccacccccaugauccauucaccucccaccaggccccaccuccaacacuggggauuacaauucaacaugagauuuggguggggacacagauccaaaccauaucaguuuaucuuuaaaauucucugauucugugaaaaaucauaauuuauauguauaauaauuauuguguuacuaaucacaaguagggagcaguuuucuucugcacuuacuauauuuacugaucuaaucaagcuuucuagggcuaguuaugguaagggaagguaaauggagcaguaaguugccuuuaggucucucuaagaugcuuuagaggaugugaugcacaggcauugauuguuccucgguagaggaacauggucccaugucccauggcccuguuagaacuuugccucccuguguucccuuuuuaguaucacuggccuaggugucuucucuuuugggagaauuuucucuuauuuuagaugauugcuuggaaugguuugguuaugugugggagaaaaagaccaagagguaauuugggagcacagauuacuuuguaagauuaaagcuagggucgaguggggagcagaguuuaguacugugggccuccagacaugggagcacucugcuccuugaguuagaguugagguagaguuacuaagguuagaguuagggagaaaaagaaaugggaaaagucaugcuuuccuauuuuuucuucccucuuucccucagaggccaacuacugucaacuucacccuuuuuaauuugucauuucccucuacucccuacucaccuggaguuacaugagaggcugguaggagaguugaggccaaagagaccuagguaggguuagagccaaccauaauucaucagcuccaugauaacacugagggcacuuaaaaaagcuggaaguguguauggagauguuuuaugcucugcacgucacauguguauggcuuagugagauuuguccuaaugacuucucagagcaguuccaaguguuuccucaagauaaauuccaugaugguaaggguuguuuuauaauauuccuacuaugccauuuugaacaaaucacugaaugacuuaugagugaguucuaaguucaguuuucacuuuauuuacuuuaugggccuauaaacuucaaagauuuacugcugauauuauugaauaaugaacuuuugcuggcaguaaaguaccaaagauagauccugaagguuugugggagaaagcuuagacaguaagguauuaguguauuucuuugcuucaaagacacauauacuacauuuuaacugcucagaaauugggaucuguguuacagucaguggcauuuuguaaucacaguggcugcacugaagcugaguuuugcuagagaagauuuauguuuguuucugccaaacucucagggacauuacugaccugagaacacuuuaaauaaucugauguaguuuggaccacccuggugcgugugaauuuagucugcaaacuuaugugaauacuaccugugauuucuuucuguugaguggauuuauucgucauugaccuuuucauuaggacuguugaguaccuauagugcccccuaacagauaucuccuauuugacuccccaucuugaguauuuucuucuuuauaaaguaauggucugucuuacaauugaugucaucuuagauucagcaaaagacaguaaauauaauuauuuaaauucacagaagcacagaucagauuucuaaaggccaaacuccauguuaugcaggaggaauuggauaauguuguaugugaaugcaauaaaaagguaaguuuuaaaaaccucuuaaaaggcucuaauauucaaagauauuuuaggagcaauuucaauuacauuuuuugaauuacuuuauuuagauauaaaucauaguuaaauuuugaauucaaaaauuguauauaaguacugaacuuuauucugagauguugaauuuucacagagcugaaauaucuuaaauucuugcuacaauuagaauucucuauauuagucuuacaaauguaguguaagcuauuaaaugcaaauaaaacauuugacuuccauuuuugaagauaaaaauagacuaauuuguuuuucaugaaacguguauaaauaucaaagaacauaugaaacgucuuuuuuucugcuuuguuuugauaacaaaucuuacauauuuuuucacauaaucuauaacuuuauaacuauaggaggaugaaauucagaauuuaaagucucaaguaaaaaauuuugaagaagauuuuaugagacagcagcgaacaauuaauaugcaacagucucaaguagaaaaauacaaaacucuuuucgaagaagcaaacaaaaaguaugauggauuacagcaacaguugucuucaguagaaaggguaauuauuugguauuuuuccuaacuuaaugccacagauacaagaaaauuauuaagguuacacauuuguauagaugccauuuugacaguucaguuauuuuauuaguauuuacugaaaacucuuuccccuuacauagaauauuuuuaacaacuuuauugagauguaauucacccuuuuaaaguaugcaauucaauggcuuuugguguauucauagaauugugcaacuaucaccacaaccauuuucauaaucccuaaaagauacuucauacccuuuagccaccacacccugacccugcuccccucaaucccuuacagcccuaggcaaccacuauucuauuuuaugucucaauaaauuugucuauucuggaaaucacauauacguggaaucauauaauauguggucuuuugugacugacuuuuacuuaagauauuuucaagguucauucauguugcagccccuaucaguauuuuauuucuuuuuauuggcaaguaacauucuguuauauggauauaacacauuuaauuuaucuguuuaucaguucguagcuuuagguuauuuggguuguuucuacugucugacaauuuuaaauacuuugaauauucauguacaaguuuuugugugcacguauguuucuauuucucuugguuauauagccaggaauggaauugcugggucauauggaaauccuauguugaccuuuugaggaauugcugacuguuuuccaaccugccuguaccauuuuacauuccuaccaguagugcaugaagcuccuaauuucuacacauccucaccaacaucugcuagauuaucuuuuugauuauagccauacugcaaguguaaaaggguuaccucauugugguuuugauuugcauuucccuaauaacuaaugauguugaacaucuuuucaugugcuuauuggcauuuguauauuuucuuuggagaaaugucuguuaaggucuuugcccauuuuuuaaauuggauuugaaaaaauuacugaauaauaagaacuuuuaaguucuuuauguguuuagauacaagucccuuaucagguauauuuugcaaauaguuuuccccuacaguggguugucuuucacuuucuuuaugguacucuaaaggcacaaaaguuuuaaauuuugaugaaguccaguuuaucuaauauuuauuugguuuccugugcuuuuggugucauauuuaaggggagaauguauuuuaaauaaacuauccuagcuuauauuagugugccauugugaaaauaaaaauauacuguuugagauugcuuuguaaaauguagugacgauaagaauuauguaauauagcauaucccgagauuuaguaagaaaaugugcccccuuuauuaguacccuuacauuucucguuuguauggucauauuuaaaaacccugcuuuuuaaacauuuuggucuuguauaauuagcuuuaucuuguaauaaauuuuaauaucaaaaucacuuagacaaaauuuauaugcaguaaauucacacuuuuuaguguacaauucuaugaguuuugacaaauguaugcaguaauauaacuaucacuauaauugagacauagaacaguuccaucagccccccaaaauucccugugaauuuagugaaggccuucccuaauuccaccaccaggcaaccacugaucuguguuugguucuuaaauuuuggacuuuucccaaaugucacauaaauagaaucgcauuggauauagacuuuugaaucuguuuuuuuuuuuuuuuuuucaguuagcauaaaacauuugauaugguuuggcuguguccccacccaaauuucaucuugaauucccacuuguugcgggagggagccggugggagguaauugaaucaugggggcaagucuuuccugugcuguucuugugauggcgaaaaagucucaggagaucugaugguuuuaaaagggagaguuucccagugcaaacuuucuugucugcugcuaugugagacaugccuuuuacuuuccaacaugauugugaggccuccccagccauguggaacugugaguccaauaaaccucucucuuuuguaaauugcccagucuugggugugucuuaccagcagcaugacgaugaacuaauccaguaaauugguacuaguagagucaggcgcuacugaaaagauaccaaaaaguguugaagugaccuuggaacuggguaagaggcagagguuggaaaaguuuggagggcucagaaaaauacaggaaaauaugggaaaguuuggaacucccuagagacuuguugaauggcuuugaccaauauacugauaaugauauggacaaugaaauccaggcugaggugaucucagauggagaugaggaacuuguuaggaacuagagcaaaugugacucuuguuauguuuuagcaaagagacugguggcauuuugucccuccccuagagaucuguggaacuuugaacuugagagagaugauuuaggguaucugguggaacaaauuucuaagcagcaaagcacucaagaggugacuuggugcuguuaaaggcauccaguuuugaaagggaaacagagcacaaaagguuggaaaauuugcagccugagaaugcaguggaaaagaaaaucccauuuucugaggagaaauucaagccggcugcagaaauuugcauaagucuugaggagcugaauguuaauccccaggacaauggggaaaaugucucccaagguaugcagaggucuucacggcagcgccucccaucacaggcccagagaccuaggaggcaugauugguuuugaaaugugaggacaugagauuugggagggucuugggguagaauaugguuuggcuguguccccacccaaauuucaucuugaauucccauguguugugggagggacccagugggaggucauugaaucacaggggcaggucuuuccugugcuguucucaugagagugaauaagucucaggagauuugaugguuuuaaaaaugggaauuucccugcacaagcucucgucugccaccaugugagaugugccuuuaccuuccagcaugauugugaggccuccccagccaugugaaacugugagugcaguaaaucucuuucuuuuguaaauugcccagucuuggguaugucuuuaucagcagcaugaaaacggacuaauacaacauucaauauuuaucccuauuauaguccauuccuuuuuauugcugaguaguguaaacuaugaaugaauguacuucaguuuguuuccccacucaucuaguaauaaaaguuaauuauaguauuuaauagucugaacuuguguuuccaguaugguagccacuuaccauauguggcuaaauugcgaugugcuauaacuauaaaguaaaaaucagauuuugaagaauucauguaaaacagaaugaagaauguaaaauaucucaaaaucucuuuaauauuuuuuguauugguuauauguugaaauaauauuugaauauauuagguuaagugaaauauguuauuaaaauuaauuuuaccuguuuguuuuaccuucuugcaguggcuacuagaaauuuuguaauuacauauguauucuguauucuauuucuauuggucuaagaaauauauauaauuggucuaaagggaaaaagcuguagugucuaggggaacauccauguuuuaauuugucaugacuuuaccauuuaccguuaugcacccaagcucugucacaucacuguucuagucucagauaaucuugaaaccuugguuauauauuugauucuuuucauguucuuggccaucauguccaauccugugcaauuuuucuuccaaauguuuuucauucaucccuuauuuucaguucccauuuuguguccauuuuccauuucuuauccauuguauacuguacuuugucaguagauuaauguugccaaagggugacauugauuauacuuuucccuuuguagggggagaauuuuuuuuucccuuuguauggggauaauuuuuugagugccauaugccagacaaaaugcauuuuauagaaacggaaacugacuggccaggcauggugguugaugccuguaaucccagcacuuugggaggccaaggcagguggaucaugaggucaggagaucgagaccauccuggcuaacauggugaaacccugucucuacuaaaaauacaaaacagugcccuucuaagauggccaaauaggaacagcucuggucuguagcucccagugugaucaacgcagaagacaggugauuucugcauuuccaacugagguaccugguucaucucacugggacugauuggacagugggugcagcccacggagggugaacugaagcagaguggggugucgccuuacccgggaagugcaagggguugggggauuucccuuugcuagccaagggaagccaugacagacuguaccuggaaaaaugggacacuucugcccaaauacugcgcuuuucccaaggucuuagcaaccggcagacaaggagauucucucccgugccuggcuuggcgggucacacacccacggagccuugcucacugcuagugcagcagucugagaucgaacugcgagguggcagcuuggcugugggaggggcaucugccauugcugaggcuugagcagguaaacaaagcggccgggaagcuuggacugggcagagcccaccacagcucagcaaggccuacugccucuauagacuccaccucuguaggcagggcguagcugagcaaaaggcagcagacaacuucugcagacuuaaacgucccugucugacaggucugaagggagcagugguucucccagcauggcguuugagcucugagaauggacagacugccuccucaagugggucccugaccccuguguauccuaacugugacacaccucccaguaggggccaacagacaccucauguagguggguaccccucugggacgaagcucccggaggaagcaucagccagcaauaucugcuguucugcaauauuugcuguucugcagccuccgugggugauacccaggcaaacaggguguggaguggaccuccagcaaacuccaaaagaacugcagaugagggaccuaacuguuacagggaaagcuaacaaacagaaaggaauaggaucaacaucaacagaaaggacaucuacaccaaaaccccaucuguaguuaccaacaucaaagaccaaagguagauaaaaccacaaagauggggagaaaccagagcagaaaagcugaaaauucuaaaaaccagagcaccucuucuucuccaaagaauugcagcuccuuuccagcaacagaacaaagcugcauggagaaugaccgacgaguugacagaaguaggcuucagaaagucaguaauaaacuucucugagcuaaaggaucaugauguucuaacccaacacaaggaagcuaaaaaccuugaaaaaagguuagacgaauggcuaacuagaauaaacaguguagagaagaccuuaaaugaccugauggagcugaaaaccacggcacgaaaacuccgugaugcguggacaagcuucaauagccaauuugaucaagugaaagaaaggguauuagggauugaagaucuaauuaaugaaauaaagugagaagacaaguuuacagaaaaaagaguaaaaagaaaucaacagagccuucaagaaaaaugggacuaugugaaaagaccaaaucuacauuugauugguguaccugaaagugauggggagaauggaaccaaguuggaaaacacucuucaggauauuucccaggagaacuuccccaaccuagcaagacaggacaacauucaaauucaggaaauacagacaacaccacaaagauacuccucgagaagagcaacaccaagauacauaacugucagauucaccaagguugaaaugaaggaaaaaauguuaagggcagccagacagaaaggucggguuacccacaaagggaagcccaucagacuaacgggagaucucucagcagaaacccuacaaaccagaagagaguggggaccgauauucaacauccuuaaagaauuuucaaucuagaauuucauaucuagccaaacuaagcuucauaagugaaugagaaauaaaauccuuuacagacaagcaaaugcugagagauuuuguucaccaccaggccugccuuacaagagcuccugaagaaagcauuaaacauggaaagaaacaacugguaccagccacugcaaaaacaggccaaaugguaaagaccaucaaugagaagaagaaacugcaucaauuaaugggcaaaauaaccagcuaacaucauaaugacaggaucagauucacacauaacaauauuaaccuuaaauguaaauaggcuaaaugccccaauuaaaagacacagacucgcaaauuggauauagagucaagacccaucagugugcuguauucaggagacccaucucaugugcagagacacacacaggcucaaaauaaagggauggaggaagaccuaccaagcaaauugaaagcaaaaaaaaaaaaaaaaaaaaaaaacagggguugcaauccuagccucugacaaaacagacuuuaaaccaacaaagaucaaaagagaaaaggccauuacauaaugguaaagggaucaauucaacaagaagagcuaacuauccuaaauauuuaugcacccaauacaggaacacccagauucauaaagcaaguccuuagacaccugcaaagagacuuagacuaccacacaauaauaaugggagacuuuuacaccccacugucaguauuagauuaaugagacagaagguuaacaaggauacccaggacuagaacucagcucugcacaaagcagaccuuauagacaucuacagaacucuccaccccaacagaauauacauucuucucagcacaucacacuuauucuaaaauugaccacaaaauuggaaguaaagcacuccucagcaaauguaaaagaacagaaaucacaacaaacugucucucagaccacagugcaaucaaauuagaacucaggauuaagaaacucacucaaaaccacacaacuacauggaaacagaacaaccugcuccugaaugacuacuggguacauaaugaaaugaaggcagaaauaaagauuuucuuugaaaccaaugagaacaaagacacaacauaccagaaucucugagacacauuuaaagcaguguguagagggaaauuuauagcacuaaaugcccacaagaggaagcaggaaagaucuaaaauugacacccuaacaucacaauuaaaagaacuagagaagcaagaggaaacaaauucaaaagcuagcagaaagcaagaaauaacuaagaucagagcagaacugaaggagauagagacaugaaaaacccuucaaaagaucaauuaauccaggagcuggcuuuuugaauuuugucuaucaacaaaauuguuagaccgcuagcaagacuaauaaagaagaaaauagagaagaaucaaauagacgcaauaaaaaaugauaaaggggauaucgccacggaucccgcagaaauacagacuaucaucagagaauacuauaaacaccucuacacagauaaacuagaaaaucuagaagaaauggaugaauuccuggacacauacacccucccaagacuaaaccaggaagaaguugaauuucugaauagaucaauaacaggcucugaaauugaggcaauaauuaauagccuaccaaccaaaaagaauccagaaccagauggauucacaggcgaauucuaccagagguauaaggaggagcuggaaccauuccuucugaaacuguuccaaucaauagaaaaagagggaauccucccuaacucauuuuaugaggccaacaucauccugauaccaaagccuggcagaaacacaacaaaaagaauuuuagaccaauaucccugaugaacauugaugcaaaaauccucaauaaaauacuggcaaacugaauccagcagcauaucaaaaagcuuauccaacaagaucaagucggcuucaucccugguugaacaaggcugguucaacauacacaaaucaauaaauguaauccaucacauaaacagaaccaacaacaaaaaccacaugauuaucucaauagaugcagaaaaggccuuugacaaaauucaacagccuuacaugcuaaaaacuuucaauaaacuagguauugauggaacauaucucaaaauaauaagagcuauuuaugacaaacccacagccaauuucauacuaaaugggcaaaaacuggaagcauucccuuugaaaacuggcacaagagaaggaugcccucucucaccacuccaguucaacauaguguuggaaguucuggccagggccaucaggcaagagaaagcaauaaaggguauucaauuaugaaaagaggaagucaaauugucccuguuugcagaugacaugauuguauguuuagaaaaccccaucgucucagcccaaaaucuccuuaagcugaugaggaacuucagcgaagucucaggauacaaaaucaaugugcaaaaaucacaagcauuccuauacaccaauaacagacacacagccaaaucaugagugaacucccauucacaauugcuacaaagagaaucaaauaccuaggaauccaacuuacaagggaugugaaggaccucuucaaggagaacugcaaaccacugcucaaugaaauaaaagaggacacaaacaaauggaaggacauucuguacucauggauaggaagaaucaauaucgugaaaaugggcauacugcccaagguaauuuauagauucaaugccauccccaucaagcuaccaaugacuuucuucacagaauuggaaaaaacuacuuuaaaguucacguggaaccaaaaaagagcccucauugccaagacaauccuaagccaaaagaacaaagcuggaggcaucacacuaccugacuucaaacuauacuacaaggcuacaguaaccaaaacagcgugguacugcuaccaaaacagagauauagaccaauggaacagaacagagcccucagaaauaauaccacacaucuacaaccaucugaucuuugacaaaccugacaaaaacaagaaauggggaaaggagucccuauuuaauaaaugguguuaggaaaacuggcuagccauaugcagacagcugaaacuggaucccuuccuuacacguuauacgaaaauuaauucaagauggauuaaagacuuaaauguuagaccuaaaaccauaaaaucccuggaagaaaaccuaugcaguaccauucaggacauaggcaugggcaaggacacuucaugacuaaaacaccaaaagcaauggcaacaaaagccaaaauagacaaaugggaucuaauuaaacuaaagaccuucugcacaucaaaagaaacuaccaucagagugaacagccaaccuacagaaugggagaaaauuuuugcaauccacccaucugacaaacggcuaauauauacagaaucuacaaagaacuuaaacaaauuuacaagaagaaaaucaaccccaucaaaaagugggcaaaggauaugaacagacgcuucucaaaagaagacauuuaugcagccaaaagacacaugagaaaaugcucaucaucacuggucauuagaggaaugcaaaucaaaaccgcaaugagauaccauuucacaccaguuagaauggcaaucauuaaaaaguuagcaaacaacagaugguggagaggauguggagaaauaggaacucuuuuacacuguuggcagaguguaaauuaguucaacugugguggaagacaguguggcgauuccucaaggaucuagaacuagaaauaccauuugacccagcaaucccauuacugaguauauacccaaagauuauaaaucaugcuacuauaaagacacaugcacacguauguuuauuguggcacuauucacaauagcaaagacuuggaaccaacccaaauguccaucaaugauagacuggauuaagaaaauguggcacauauauaccacggaauacucugcagccauaaaaaagggugaguuuauguccuuugcagggacauagaugaagcuggaaaccaucauucucagcaaacuaucacaaggacagaaaaccaaacaccgcauguucucacucauaggugggaauugaacaaugagaccacuuggacacagggcgggaacaucacacaccagggccugucuggcgcuagggagcuggcagggggauugcauuaggagaaauaccuaauguaaaugacgaguugaugggugcagcaaaucaacaugauacauguauacccauguaucaaaccugcacguugugcacauguacccuagaacuuaaaaguauauuaauaaaaaaaauuaaaauacaaaaaagccgggcgugguggugggcgccuguagucucagcuacuugggaggcugaggcaggagaauggcguggcgugaaaccgggagggagcuugcgguaagccuagaugucgccacugcacuccagccugggugacagagcaagacuccgucucaaagaaaaaaaaaaaaaaaaaaggaaacugaguuuguugguuaagcaaauuacccaagguuauauauagguaguggcagaacaggauucaaacugugucugacaccaaagucuguguuuuuucaacaaaucaugucauucccgaaucccccaaaauuaaaugaacguaaguaccaucuauuccaaaaucuuaucacucuuuaagaguuuaauacuugagacuucuaguucacaaugaauguacuaagcaguuaugauacacuggcuaucugaaggcuuuuauaaaagcuuccauuggaucugaacuuuccagcuugcaucccuaucuacccugccagauagguauaauaauucucauggguuauguagccaugagaacucaagauugaaucauucucugcuaagucucauuuuauaucucuauacaaacaaaucucgguguacaguucacagaaaaugccagagcuugagugugauggacuugcuuuuauaaaucugcaaaagccaaccauuuuuaaaauuauuauguaucacuuaagcugcuaaugcuaacagauggaguuuucugaaauacaaaaacagaaagcauuuuacuucagcauuggauuuuguuuuucuguuagugauuucuuuaaaaucaacuuuauugaagaauaacaaauacaauaaaacauacuuguuuuuagcuuauaauucaauaaguuuucacaaauuaauauucccucauaacuacuaccauaaucaagauaaugaaaauuuauauuacccuuccagaauauccuuuguacuccugccccauaaaucuccaaccucuaacuauggcaccaggcagccacugagcuauauuuuuucacuacaaauuagauuuuccuuuucuaaaauuucauacaaaugaaaucgugaauauggacuuuuguauaucuggcuauuuuucuucagcauaacauuuuuaagguucaucaauguuuuacauguggugugguucauuuccuuguauugcuccauauuacuuauuuauggauaugccauauuuuguuuaucugaucaccaguugaugugacauucaauuuuuuucuagugugggcuauuaaaaauccacagugaauuuccauguacaaguauucugugugaacacguuuuuauguauaccaaauacuuaggaguggaauuugugaauuuuauggaaaguguaugcuuaacuuuuuaagaaacugcuaaacuguguuccacagugauuguaccauuuuacauucccacuagcaauauaugagaauuagaguuacucuguaucaucaccaacacuugggauuauuaucuuuuuaauuuuagccauucuagaggagaaguaguaguaucucauuguaguuuaauuuguauuuccuuuauaacuauggauauugaacaucuuuucauguguuucuuggccguucauauaucuucuuuugcgauguauuuguucaaauuuuuugcccauucgaaaauacuaaguugcaaauucuuuguuuaccuauguaauuccuuuauuagaagaauauauauuuugaauaguuucucucaauccgacuuggauuuauuuucucaacaguguguuucaaaagacagcaguuuuaaauuuugaugaauuacaaaauguuauuuucuuguggcuuuugcuuguuuacccaaaauauuacuuucuugugguuggugcuuuuuuccccauucuaucuaagaaaucuuuauccacuccaaagucaugagacuuuucuccugauuucuucuagaaguguuauaguguuuguguguguguguguguaucucaaaaucauauauaaauugaccuguaaucuauuucaaguucauuuugugugugacaaggaucagaguucacuuuuuugcauauggauaauacaguucuuuccucauuugcuuaccauggcaccagugaaggaaaugaauuggcuguguuuauguaugggucuucuuugaacuauucuguuauauugauauaugcauuugauauaauucauuaggaaagucaugugcacuggaguuuucuuuuggaaggauuucaaugaccaauucaguuuauuuaauggauacaagucuauucugauuuucugcuacuauuugagucagcuuugcuaauuuauguuuuucgugguauuuguccacuucaucuaagucagauuuacuggcauaaauuuguacauaauauucuuguauuauguuuauuauauuuauaauaccuguaugauguguaauaauggccccucuuucauuucugauacugauaauuugucucuucugucauuuauucuuaaucaguccuacuuuaaauguauuuacaaaucucagguauaaugcauuugcuacccucacuuucugagaagucaauucccucucccacuuuuggagaugauuauuaaacaguuggucuuuuuuccucaacuuuccaacaccccuuccaaccuccuuauucuuggcucaugacuuugcuuccuuuuucauuaaggaaacagaaucaaaagauaacuuuaucauccuuucacuaaauuuacaaccucgcugccucuauaccacuccccacuccaguuaaagugaauuaguaccucuucugucuaaagcugaccccugcacuugugcacuggauucuauauacucucuucuacucaaggucucugcacuggcaauuguccuuccucuugcaaaaucaaauuuacucuuaucagauuauacucauuaguguacagacauuucauagaaucauucauauaucuauuuuaaaacuucuuuagaucuuacaucuaccuccaguccuauaucauugcuccccuuuacagugaagcuucccaaaauuauuguuuauacucagugucucuauaccucaugugccauuuucuccugaaaauacuuuugcuuaggcuuccaucucuacccugccauugaaacuacucuuaaaaaggucaccaauaauccacacuguaguugugguccauuguacuuggucaguuauuccucacaugaauuuauaucucagcaauauuugaaauaguugauuacuccuuccuugaaacacuauuaauuuggcuucuggagcaccacaaucaugauucucccucauuuuccuggccuuacguaguagagugcccaagucucuucucugucuauaucuaauccuuagauuaucucauucaguuccauggcuuuauauaccaucuauauauacguugaucauccucacauuuuugugucuugcccuuaccucuuccuuucugcccacuugauaucucuauuguguguuaaacuucacauguccuaaaggaagcucuugcuucccugcccucagcaaaccugcucucuuccuucucccugucuuaguaaaaggcaucacccaauuguucagucuaaaauugaagagucaucuugaucuguuuuccuauauccagauccagcucaccaacaaguccugucaauucugucuucaaaauacauagaauaaaccacuucucaaaacauucauuacaucuacccaagcccaagccacuaucuuuuauuuaaacuauuauaauaaccuccuagauuggcaguaccacaguggccagaguaauccuuauaaaauuuaagucagagccaggcgcaguggcuuacaccuguaaucccagcacuuugggaugccgaggcgggcggaucacaaggucaggagauugagaccauccuggguaacacggugaaaccccaucucuacuaaaacuacaaaaaauuagccagcgugguggcgguugccuguagucccagcuucuugggaggcugaggcaggagaauggcgugaacccgggaggcggugcuugcagugagccgagauugcaccacugcacuccagccugagccacagagcgagacuccgucucaaaaaaaaaaaaaaauuaagucagaucaucacacacauacacauaugcauacacacuuaaaauccuccaaaggcuucccgugucacucagaauaaaauccaaauuucuaaguaaagcuuacaagguucaccuaggcuuguccugcccacuucucuuaucaaaaccuaacacugugccuaugucacucggcugaaaccacacugaccuucuaggugauuuuugaauauauuaaguggauuccuacuacaggaucuuugucuucauuguucuuauuaucuggaauucuuuccccaagaucuuuauuugauuauuuuauuuuuuuagagagaggaucucacucuguugcucaggcuggaguacaguggugcaaucauggcuuacuacagccuugaccuccccagcucaagcaauccuucugccucagccuuccaagcagcugggaccacauacauaugccacaauguccagcuaauuuuuaaauuuuuuuguagagacaaggucucccuguguugccuagacuggucucgaacuccuggguucaucuucccacauuggacucccgaagugcuaggacuacaggcgugagccacugugccuggccucccuaagauuuuuacuuaaaucauuaccucacuucauuuggaagacuucccugaccacuuuauuuuaaauaguuuuacccuucccucauuguucugucccuuuacccuuuuuuucuugauaguccuuaacacugccagauauuacauaugucuauguguauauauguguucaucuucugucucuuccucuagaaugcaaaugucaugagaggaggaacuuugguuaauuugugugcccaucauauagaauaguauccugcauguaguaagugcuuaauaaauguguugaauaaaugaaugaaaccuauuagguauagauaauauuacucacaauuucagauauggaaaugagucuaccacagcuggcagguuuucugauuccuaguccauucuuuucuaccuuagccacuuguuucugaaaccauaucugauuauuuauuuauccucaucugauuauuucuuaucugaauuucuguggugcuucguguuauucccagagcauuuacuacauuuuguccucugcuguggcugaugcaugccccucucuuuucuuacucucccccagugccuuuuaugaaugcuuuaauaaucaugagagagugguacaucauuuccucuugaagcucacaguauuugaauuuuaauguuaaauuugauuuucuuagguuuuuuuuuuaaaaaaaaacuaaugugcaacucaggacuucagauuuuucgugaaauuuuugucuagcaaccuguaacuccuuaaauuuuuauaacaguagaaauuuguuuaguggauuuacucauauagaaaacuuuacuuccuacuuuacuauucuuguggcuaucauuuuucccccacaccucccaagaagagggcaguauugauucagggauaggggacaucaugugguacaggaugguuuucauuuuccugugaaauagguuacaaagucaucagcaggcaagaggggaaagauucauuucuauauucuuaagaaggaagacugaaaugaggcagcaagaaauguggacuuuguagcuaaugagaaucuuugccuuuucuaugugaacagugagauaaaucaagcuagcucuuccuguagcuaccacccacaaagcugugaagaaggcugugauagcagaugguauccauacacaguuugauuuguuuagaaaccuacauaaagagcagcauguguuuuguuuuguuuuuccccuuaauuacucagagccagggagaccaguuuuuaaauaaaauguagugauauagccaggaaaaaauuauaaaagaauauagacaacuguauuuuuaacuucaucauuucaacucuauaauauuuauugaguaucuucucaauuuauugaguaaggcucuggacuaggccuuacuuuguaggggauauaaagaagaguggguuuaguauuacaaaauaaguucaguuuaacuaacguguguuagugucuuuuauaucccacugaagugcugaguauacagaaauuaagacaguucuuuucuucaaggagcuuaaacuauagugggggaaauaaaguuaagggauaguuucaguaccacauagcagauaugaugauaaaugucucucaaggugcuauacaagcuuugaagaggguacuuaauauaaucuggguggauaaugaggauuagaaaggaaauauguccugggagagcuaaugcccuagaguacaaaucuagcugagucaguaggugcuagcuaugugaaaaugagugggcagagaucagggcaggaggaagagcacaggcgaagacugaggcaggaaacaccauggcuguuugggagagauccaguuacugcugguauuacugaaaguaacaucuuuggcaggagaugaggcugguugauuaugguggaguuaagaguuuauccucuagguucauguuucuucagguguuggccuguugacucucugcaacagaauauccuaggauguuugcagaaauauaagacuaaacucaccccaggauguggaaaauaaucuauaagaucuguuguuucuacuuagaauugggauuuuccuauagggcuauauagaauguugugcauuuaaugaauauauucugaaaagauuuacuuugucagguauacagaaaaacaguggagaguuucucuuaacauuggucuuuuugggagguucccaagagaagaaauacaguuauaaugaguuguuuauaaaauagaggacagguauacugugucuugagucaauaaagagagagaaaauuccaaacgaaaaguaauuugaaagcccgguucacaacuacauuuuuuaggauauauuucucuaauaccaauuugaggcaagaauuccuugagaccucuaacacuuaguguucagccucuacccccaagcguguguguguguguguguguaaaguuugagagaaagcaaggaauauggauauggaagauacugcaaaaugauaaagggggaaacuaugauauauuuauaaauguuccauaaucuuuuuuacuauacaggaauuagaaaauaaaagaagacugcaaaaacaggcugcaaguagucaaagugccacagagguucgcuugaauagagcucuagaagaagcagaaaaguauaaacuggaguuaaguaaauuaaggcaaaauaacaagguauggaaaaauugaauagcuuuuguagugaucccuuuugguaacuacuucuuuuaugaacaugucaaaaauaauacuuaaauuauaauucuugaugucaugcugaacauuucucuuuucagaagaaauauauucauuagcaguauacacauuucuaacauguuaggaugauaugcuugucugucgccauuauugggugauggcacaacucuuuggaagauugauuucuucaaccaguuuuaucaggugcccauauuauaugucagacacuuuucuaagcucuuagaaaaaguuguuuaaaaaaaguaucuuuuguaucucaagucuuuuauucuucucugaaccucaguuuucuaauagauaaaguaaggcucuauuuuacagggcagugguucucaaacuugagcauguaucagaaucucugggagggcuuguuaaaucacauugcugggucccauccccagaauuucugauuuaauaggucuggagugaggccugagaaauugcacuuuuaacaaguucccagguaaauuauuguaaggaucaccguaacuccagugucuagccaaugcuuggcauagaauuagcauucggugccuuaaauaucuguugaauaaaugaaaguucaaauaccaauguucaugaaaccccuuuguaccuucuauaaauauugguuacuuuuugguucuguauugaccugaaaggguaauaagugauauuaccuauuuaauaauuuuuaaauucuauuuaauaauuaaauauuuaauauuuaauaauuaaauaauuuaauuuauuuaauacuuaaauaauuuaauuuauuuaauuaaauaauuuaauaauuaaauaauuuaauaauaaauuauuuaauuuaauaauuuauuauuuaauaauuaaaacaauauuuaauaauuaaaacaauucuguuuaauaauuaaacuauuuaauaauuuaaaaauuuuaauugugguaagcuaacacauaagauuuaccuucuuaaacauuuuaagcauauaguucaguaguguaacauagauucacacuguuauacaaccuauccaugaacucuuuucaucuugcaaaaacugaaacucucuaccaauuaagccacuccccauuuccaccucccucuagacccuggcaaccaccauuguacuuucugucucuauaaauuugacugcucuaggaaguaaacgucaguagaauuauaccauauuuguuuuucuuuaacuggcuuauuucacuuaacauaauguuaagugacucucauaauuaaaacaauauuuaauaauuuaaucaugacuuggauaaugaaauuaggaaccaccuucauuauauacacagauaauacauuuuggauuaaguuaguaacacuuaacaggaauagacugaaagugaccuugauacauccucuaacauguuugagaggcaaauaugugccguagugauuacagaguuuuaagaugucgucugugagauaguuuguuauauggucaggucauuuucauauucaggggccaucaaugauggcauaacugggauuuauuaauagaaguuauuacaugaacaaguuaggaagucaucuuuauagacucaccaguaauuagcauguuauucgaguauuauuuccaauuuggugcauuuuacagggauuuugaagaaaaugaagaauaaccaccuagguaucaggauuuccuaauuguuguagauuugaccucuauauuguauuaguucacauauuaagaaaacagaaggaaaaugguuucaugaaacagaugacucuccauauucuagccagccauuuuguuuuauuuuguuuuaauuuuuuuuagguuuguggguacaugugaagguugcauagguaaacaggugucauggggguuuguugcacauauauuucaucaccuagguauuaggcccaguacucaauaguuaucucuucugcuccucucccuuuuuccaccuuccccacuucaaguagaccccaaugucuguuuccuucuuuguguucuguaaguucuuaucauuuagcucccacuuauaagugaaaacaagcgguauucgguuuuguguuccuacauuaguuugcuaaggauaacugccucuagcuccauccauguucccacaaaaaacaugaucucguucuuuuuuauggcuacauaguauuccaugguguauacguaccaaauuuucuuuauccauucugucauugaugggcauuuaguugauuccauguccuugcuauugugacuagugcugcagugaacauuugugugcaugugucuuuaugguagaaugauuuauauuccucuggguauaauaccaauaaugagauugcuggguccaaugguaguucugcuuuuaccucuuugaggagucaccguacugcuuugcacaaugguugaacuaauuuacacucccaccaaguguauaaguguucccuuuucucugcaaccucaccagaucuguuauuuuuugacuuuuuaguaauagccauucugacuggugugaggugguauuuaauugugguuuugaugugcauuucucugaugaucagugauauugagcuuuuuuuucauacuuguuggccacauguaugacuucuuuugagacgugucuguucuuguucuuuccccaccuuuuaaugggguuguucuucucuuguaaauuuguuuaaguuccuuauagaagcuggauaucagaccuuuaucagaugcauaguuugcaaaaauuuucucccauucuguagguggucuuuuuacucugccgaucauuuauuuuucugugcagaagcucuuuaguuuaaguagaucccacuugucaguuuuugcuuuuguugcaguugcuuuuucugucuuugucgugaaaucuuugcccguuccuauguccaaaaugguauugccuagguugucuuccaggguuuuuauaguuuuggguuuuccauuuaaguuuuuaguucaucuugaguuggucuuuguauaagguggaaggaaaggguccagcuucagucuucugcaaauggcuagccaguuaucccagcaccauuuauugaagagggagcccuuucccauugcuuuugucagguuugaagaucagacgguuguagaugugcggccuuauuuaugggcccucuacucuguuccauuggucuaugugccuguuuuuguaacaguaccuguuuuuguaccaugugcuguuuugguuauuguagacuuguaguauaguuugaagucacacagugugccuccaacuuuguucuuuuugcuuaguauugccuuggcuauucaggcucuuuugugguuccaugugaauuuuuaaauaguuuuuucuaauucugugaagaaugucacugguaguuugauaggaauagcauugaaucuguaaaucgcuuugggcaguauaggcauuuuaauaaguguuccuaucagugagcaugggauguuuuuucccguuguguuuucucugauuucuuugagcaguguuucguaauucucauuguagagaucuugcaccucccugguuagcuguauuccuagguauucuuuuuguggcaaguggggaugggauugcuuuucugauuuggcucuugguuuggcuguuguuaguauauaggaaugcuaguaauuuuuguacauugauuuuguauccugcaacuuugcugaaguuguuuaucugccaaaaggagcuuuugggacaagacuauggggucuucuagauauagaauuacgccgucugcaaacagauaguuugacuuccuauuuggaugcccucucuuuauuucucuugccugauuccucugguuaggacuuccaauacuauguugaauaguguugagagagggcauccuugucaugugacaguuuucaagggaaugcuuccagcuuuuguccauucaguauaauguuggcuguggguuugccauagauggcucuuauuauuuugaggucuguuccuccaauaucuauguuauuuagaguuuuuaacauaaaggguguugaauuuuauugaaagccuguucugcaucuauugagguaaucgugguuuuugucuuaauucuguuuaugugauaaauugcauuuauugauuuauacauguugaaccaacccuguaucccaggaaugaagucuacuugaucaugguagauaagcuuuuugauuugcuccuggauuugguuugcaaauauuuuguugaggauuuuuguaucaguguucaucaaggauauuggccugaaguuuucuuuuuugguugucugucugccagguuuugguaucaagaugaugcuggccccauagaaugaguuggggaggagucccuccucaguuuuuuggaauaguuucuguaagaaugguaccagcuuuucuuuguacaucugguagaauuuggcugugaauccacugggucccaggcuuuuuuugauugguaggcuauuuauuacugauucaguuuuggagcucauuauuggucuguguagggauucaguuucuuccugguucaguccugggaggguguacauguccaggaauuuguccaucucuucuagguuuucuaguuugugugcauagagguguucauaguaguuucugaugguuguuuuuauuucuguggggucaguaguaacauucccuuugucauuucuaauuguguuuauuugaaucuucacucuucuuuacuagucuaccuaguggccuauuuuauuaauuuuuucaaaaaaccagcuccuggauucauuuaucuuuugacugguuuuucaugucuugauuuccuucaguucagcucugauuuuuguuauuucucaucuucugcuagcuuugggguugauuucuucuugcuucuugaauucuuucaguugugaaguuacguuguuaauuugagaucuuuauaacuuuuugaugugggcguuuagugcuaugaauuucccucuuaacucucccuuagcuguguucuagagauucugguauguuauaucuuuguuguuauuuucaacuuuuuuauuucugacauaauuucauuauuuaccccaaagucauugaggagcguguuguuuaauuuccauguaacugcaugguuuugagugauuuucauagucuugacuccaguuuauugugcugugguccaagaguguguuugguaugauuucguucuuuuacauuuguugaggauuguuuuuuguccaauuauguggucaguuuuagaguaugugccauauggcacuaagaagaauguauauuguguuguuuuugggugcagaguucuguaaagguaucauauccauuugguccagugcugaguuuagguuccagauaucuuuguuaauuuucuaccucgaugaucugucuaauacuauggagaguugaagucucccacuauuauugugugagagucuaugucucuuuguagguuucuaagaacuugccuuaugaaucugggugcuucuguguugugugcauguauauuuaggcuaauuaggucuuacugaauucaacacuuuaccauucuguaaugccuuucuuugucuuuuuugaucuuuguugguuugaaacguuuugucugaaauuagaauugcaaccccugcuuuuuucuguuuucuauuuccugguagauuuuccucuaucccuuuauuuugagccuaugagagucauuaaaugucagaugggucuucugaagacagcauaccauuugagucuugcuuuuuuauccagcuugucacuccaugccuuuuaaguggggcauuuagacuguuuauauucaagguuaguauuaauauguguggauuugaucgugcuguugugcuguuagcugguuauuagguugacuuguuuguguaauugcuuuacagugacauugaucugugugguuaaauguguuuuugucuuagcugguaguggucuuugcuuucuauguuuaaugcuucuuucaagagcuuugguaaggcaggucuggugguaaagaguuccuucaacauucacuuaucugaagaggaucuuauuucuccuucacuuagguagcuuaguuuggcuuaauaugaaauucuugagggcuuuuuuuuuuucuuuaagaauauugaaaaauuagcugggcgugguggugggcgccuguagucccagcuacuugggaggcugaggcaggagaauggcaugaaccugggaaguggagcuugcagugagccaagauugcaccacugcacuccagccugggugacagagcgagacucugucucaaaaaaaaccaaaaaacaaaaaaacagaugugauccuuguagcugugcaccuaucuuauaaugaaauugaauguuuagauaauccaugaagcaacaccuagauaauuaucgaauuuagauaaucuaucaaagcuaaggugcaacugcaauaaaugcuguggaaaguauauggugcuuugagcaaguaaccaagccaauaaaugccuuuuuuaaaaacauccaaugagcauuuauuauaacacaacuggcuacuauaguucuuuugcauuuccauguaaguuuuuagaaucacauuuggaguuuugauaggcauuguguugaaucuauagaucaguuuugggaaaauugacaucuuaauagcgucuuuaaagucaugaauagagaaaaucuguuuauuuaagccuucuucaauuuuuccaagcagcuuuuauauauauauaguuuccagaauacagguuuuacacacuuuuuuuucaaacuuaucucuuaguguuuccguuuuuugauguuauaaauguucuuuaaauuccaguuucccauuguuuguugcuauaauggagaaauacaauuuauguuugcauauugagucuauauccucaacuuugcugaacucacuuauucuagaagccuuaggauuuucuacagaccuuuucuguaaaggaccaacuaguaaaugcuuuggcuuugugggcuacauauggucccuuguguauucuucacugguuuucuuuuuuaaaauuuauuuaacaccuucaaaauaaaucauuuuuaguucacaaguuuuagaaaaacugacugcaguuuccugagagaucuuaccaggaauggauguugaauuuugucaaaugcuuuuucccguaucuauugaaauuauauuuuucuuuuuuuagucuuucaaauguuaaaacaaccuuguauuccugggauauauugcacuuggugauggugugucauuaucucuuuuauauauuauugguuacuuuuuugugaaugucuguauacaugggaacauagugcuagucuguuuagucuguagucuugauuuaguuuucuuauacauuauuuucaucuuuagguuuuuugguuugaauuuguuuugguuuugguuucaggguaaugcugccuuuauuaaaugaacuuccaaaucauucuucuggagaagcucaacuuucagauaaguuuuuguaggguugguauuauuuuuucuuugaaugucugguagaguccacagguaaagccgucugggccugagguuuucuuguggaaagauuuuauacuucaaauucaauuucuuuaauagauacagaaguauuccuuauagaggcuauauuuuauuguguuuugggugcuuacaucugucaaggaaucuguucauuucguuuauguugucaaauuuacuggcauacaguuuuuuacacuaguuccuuauuguccucugaauauuccuccuacauuccugugggucauuccccccucucauucuuguauugguaauuugugucuuuuuuacuuuuucugaucagucuuacuagagguuuacuaauucugguuuuauugauuuuccucuacugauuuuuuauuuuuuuuauugauuucugcucuucuauuucuuucccucuccuuacuuuuggguucaauuuguucuuuuucucuuuucucuuuuuuuuuucuccccuagacagagucuugcucuguugcccaggguggagugcaguggcgcaaacuuggcucacugcaaccuccgccucccagguucaagcgguucuccugccucagccuccugaguagcugggauuacaggcccccgccaccaugcucggcuaauuuuuguauuuuuaguagagaugggguuucaccauguuggccagacuggucucgaacuacuaaccucgugaucugcccgcuuugaccuccuaaagugcugggauuaaacagaugugagccaucacgccuggccucuuuuucuaauuuuuaaaauggaaguggagacuguugauuuguacgcuuucuucuuugcuaauauaagcauuuaaacacuguaaauguuucucuaugaauuuccuuagcuacuucccaccaaauuugauuuuuuguauuuucauuuuuauucuauucagaauacuuucuaauuuucuuuuuuauuuccucugagccaugacaaacuuuacgaguuugucauuucauuuuucaaauacuuagggauuuuccccagauaccauucuuacugauuuuuaauuccauuguggacagagaaugcauuugguuuuauuugaaucacucuaaauuuauggauacuuuuuuuuggcccagaauaugguuuaaauugggaaauauuucaugugcccuugauaggaaugugcauucuguauuuguuagguggaguauucuauaaaugucaauuaugucaaauugcuugauaguguuguucaauacuucuguaucuuauguauuuucugugucccuguucuaucaaugaucaagagagggguacuaaacucugaauagaacugugaguuugucuauuuucccuuucagucuuaacaauuuuugcaucauguauuuugagacuugguuauuagcuauauuaauacccaguaucuaagaagauuguuaaauccucuugaaugaauugaccucuuauuauuuauuuauauuuauuuuuguugcugcauucugauacagguugaguaucccuuaucagaaaugcuugggaccagaaguguuuuagaaaugcuacaguggacauuucaucuuugagaaucaugucagcacucaaaaaguuuuagauuuuagagcauuuuggauuucagacuuuuggauuagggauacucaaccuguauuaccuuuguuugauauucaugcaacucaagcuuuauuuuaguucguguuagcauugucuugucuuuuuccauucuuuuauuuguaacuccuuugugucuucucauuagcagcaucuaguugacuuugcuuuuuaaaaaaauccagucuccagagugugauguuccccuuccuguguccauguguucucauuauucaauucccaccuaugagugagaauaugcgguguuugguuuuuuguucuugcgauaguuugcugagaaugaugauuuccaauuucauccaugucccuacaaaggacaugaacucaucauuuuuuauggcugcauaguauuccgugguguauauguaccacauuuucuuaauucagucuaucauuguuggacauuuggguugguuccaacucuuugcuauugugaguagagccgcaauaaacauacgugugcaugugucuuuauagcagcaugauuuauagucccuuggguauauacccaguaaugggauggcugggucaaaugguauuucuaguucuagaucccugaggaaucgccacacugacuuccacaaugguugaacuaguuuacagucccaccaacaguguaaaaguguuguggggaggggggaggggggagggauagcauuaggagauauaccuaaugcuaaaugacgaguuaaugggugcagcacaccagcauagcacauguauacauauguaacuaaccugcacauugugcacauguacccuaaaacuuaaaguauaauuaaaaaaauaauaaaauaaaaaaauaaaaaaauccaaucugacagucucuuuuuaauugaggugcuuacaccauuauauuuaaaaugauuaauaauaugguugggauuaacucuauuagcuagcuguuguuuuaguuggcccguauguuuucuuucccuucuuuuugaauugcuuuuuuaaagauuccauuuuaucuccuuuauuagaucauuaucuguacuucuuuguaugcauuucagcauuuguuauauauauguuuaucacuguauaccuccaaguaauauagcauuuuaugaauaauuuaagagccuuuuagcaguauacuuccauuaccccccacccuuucugcuauugucauauguuuuaucuauaaacucuacauuguuaauuuaaaaauuuuuaauugugguaagcuacacauaagauuuaccuucuuaaacauuuuaagcauauaguucaguaguguaacauagauucacacuguuauacaaccuauccaugaacucuuuucaucuugcaaaaacugaaacucucuaccaauuaagccacuccccauuuccaccucccucuagacccuggcaaccaccauuguacuuucugucucuauaaauuugacugcucuaggaaguaaacgucaguagaauuauaccauauuuguuuuucuuuaacuggcuuauuucacuuaacauaauguucucaagguugaucaaaguuguagcaugugucagaauuucauuccuuuuuaaggcuuaauaaucauuguauuuacauaccacauuuuguuuauucauccaucaguggacaguugagcugcuucccaaccuuuuggcuaguaugaguugcacugcuuugaacaaggguauacagauaucaaugucuccuagagaaaagugaaaugcuaguuccuugauguguaaagucagguugauuugaaaucuucuuuccuaauguaagcauuuacaacuacaaauuucccucuuagcagugcuuauacucuguccuauaaguuuugguguauuguagcuuuguugucauuugccucaugauauuuuccaauuugcuuugugauuucuucuuugaccccuugguaguuugaguguuuuguucaauccccacauauuuguggauuuuccaguuuuccguccgcuguugauuucuaguuugaaucaacugugauuggaaaauauacuuuguaugacuuauaaaauguggggaauguuccaugugcacuugagaaaacuguauucucuuauuuuuuucguuaacaucuuauugagauacaauucauauaccaugcaacccacuuaaaauauacaaauaaguuuguuuuuaguagucacaaaguugugcaaccaucaccacaaucaauuuugcaauuuuaucaccccaaaaagaacgucuguacccauucacagccacucuauauucccccaacacccugcaccacauucuagcccuaggcaaccacuaaucuacuuccugucucuccauauuugucuguucugguauaugauuauauuuuuucuuuauuauuucaaucguuuugggggaacaggugguguugguuacacagauaagugcuuuaguggugauuucugagauuuuggugcacccaucacccgagcagucuauacugaacccaauguguagucuuuuaucccucucacccuucccccacaagucccuagaguccauuauauccuucuuaugccuuuguguuagaggacuacucuuuaugucucuuaaaucuaauuggucuauaauguuguucaagucccuuauugcuuuauuggucuuccauccggugauucuauugauuauuggaagugggguauugaagucuacuuuuacuauagaguagucuuuucuccaagucugucaaugcuugcuucauauauuuaggcacuuuaauguuugguacauauauaauuguaucuaucuucuugcugaacuggcccuuuuguuuggcccauauguucuuauauaauguccuucuugguauguuuuaacaguuuugacuuaaagucuauuuugucagauauuacuguagucacuccuguguucuuuugguuacaaaauuucagauuaucuuuuuccaucuuuuuaccuuaaaccuaugcauaucucuggaucuaaaguuaguugcauguagacagcauauaguuggauuuugguuuuuaaaaauccauucuuccauucaauuuauuuugguuagggaguuuuguccauuuacauuuaaaguuuuugggaggucuguugcuguuuguucacaauuuuauguaugucuugaggacuuuuacccucucauuuccuuccuuauugccuuauuguuuaguugauuuuguguaaugaugcaacuucaaucguauauaaagacucuacuccuuuucagccccugcccuaccuuguguuacuggugucacaaauuacaucuuuagguuauguacccauuaacaaagauuuauaguauuuuuuaugcuuuugucuuuuaaauucgaaaagaaugaaaagugaaagaaugaaaagugaguugucaaccaaaauuaaaauaauacaggccuuuauauuuguccaaauauuuacauuuacuggggaauuucauauuugcauauagcuuugaauuauugucuaguauccuuuuguuucaacuugaaggauuuucuuuaggauuuuguagggaaaauacagugguaaugaaguuccucagcucuuaucuaggaaugucuuaauuucuuuuucauuuuugaaggacacuuugcuggauguaguauucuucuagguuuuuuucuuucagcccuuuaaauauaucauccuacugacuucuggccuguaaaguuucugcugaaaaaucugcugauaaucuuacagaugcucccuugcaugugaugagccauuuugucuuguugcugucaagauuuucucuuugucugacacucgacugauuaaaaugugucuugcugugggucucuggguuuauccuacuuggaguucauggagcuuuuuguauuuguguauccauuucuuuccuuaaauuuggcaauuuuucagcuauucuucaaauaaguuacuugucuccuuuucuaucuaagauuacacugauauacauauuggcccacuugauggucucccuuagcugcuguucacuuuucuucauucuuuuacuuuuggcuccucugaccugcucauuucaaaugaccugucugaaagcucacucauucuuucuuauaccuguacagcucugcuguugaacccuucaagugaauuuuuccauucaguuacuguauuuuucagcuuuagaauuuguuugguucuuuuuuguaauuuuuguugauagucucauuuuauuaauauauagguacccugauuucauuuaguugucaauauucuccuucagcucauggagcauauuuauggcaguuauuuuaaaguccuugucaaauaagugagaagccuuuguuucuuuaggauacacuucuggauauuaauuuuguuccuuuaauaugguccauguuucccuguuucuuugaaugucuugugaucuuacauugaaaaacggguguuugaaaaaacagccacuucucccagucuugcagacuggcugcaugcaagcaaagaccuucacuaaucagcaugguguaaagucuugagguccucucaaaccuuucugggguugugucuuuccugggccuguguguuuuaauuccaguuuuccauacacacggcuucuuuuaaauguccuaauuaccuaaaaaucucacuacuucuucucagagauuuagaugcuguauuuuauuccucugcccauaauuuuuugccaccagguuccugcaguucuguggacucacuacaccucucacauucagugguaccaaccaccuguuuccgcagcuuccaaccugauauccaaaugaugcagcuguucccaucaguacugagucaggcaagacagauagcagucccucaggcaggccccagaaaagccagaauguugcaagcaagucuacucuuuucccuccauuccaagggaagaacugggaauuggguggcuucuuccugacugugcugugccagggaggauguggguaaagggugagcaaaacaccaugacauuuccuacugcuuugaauauggccuuuucuuaguuaggcagucucuugguugcugcugcugacugacugauugguuucuagagcucucccaaagcuauuuuggucuguguaucauauagucagucuuuuaauggggaagcaaaggccuggagcuuccuaauccaccauuuugcugacaacacucuuaucuuuuaaagagguguuuuuuuuuuuuuuuuuugaaaagguguauauauauauauauauauauauauauauauauauauacacacacacaaacacacacacacacacguauguauacauaagauuacacauuacuauuucuuuuuucuccaucuuuuuuauguguguguacagagauucacauuuccuucugguaucauuuuccuuuuguaugaaugacuuccuuuaaucuuucaaguauagaucuuccuaaacguaaugauuucuacugacccuuuuucugcuuugcccaaauugcuaaagagcuuauccaguccauuuuuaccaagauuacaaacuuggucucccgcuugucaugggaaguggguaaauucucugcuuagcuaaaggccacagccauuuccuuucacagguaccuaggagucucacccucuaaaugguauuuagaugucugccaagcauuugagggaaauacguaugcauguuuugagggcucuguuuuucuagaauuuuguaccaccuuggcagcccugcucucugacuccucaguccaauaagacuacuacuuuuugcuugaguucuuaccucugugaacccacaaacuggaaagugcuuuuagaagaagcuaguugaauguggaucucaaccaguauuucugcucuuucaaggaucauaucgcuuccaguuucuacuuauuauugauuacucaucuacaccuucaaauauacuuuuuaaacguuuuuaaaauguuuucaaauauauuauuuuugaaaauucauaaauccagaguuuauguugguucaauacaagcuacuuugccauuacuggaauuagaacugaguuauuuuaaaaacauuuuuuaaaaaugggaaauaccugagcaugacuaaaagcuaucaaauuccaguaauucgguaauggaaagcaauuuuuaucuacaaaaauuuuauauuucaguuuaagaaaguacuuuuuauuacuguugugaugauagucuauaauucuuuccauugaggcuguauauuaaaaauauauggcacuuuuuuuuccuuguguaggacauagcaaaugaagaacacaaaaaaauugaaguguuaaaaucagaaaacaagaagcuagaaaaacaaaaaggagaauuaaugauaggguucaagaaacaguuaaaauuaauugauguuuuaaaaaggcaaaaggugagucuaucauuaaaguuaaaucaucauauuauuuguaacuuucuuacuaaaaaauuuagcauuuuucacuuuagguauguuuuugacaucuuuacgcacugaacuucauauaaaaugcaucauacauaugaaaucauaugaaaucuaacauuuauagugagauauaugugucaucuaagcaaguggauauuuucacauaaguaaguuaguguagaaaaugggacuggaaaauacaguauagguacuucucaacuacagaaaguaccaaauuaaagaaugacuauuaggggacuguuugccucuucaaaccuuagagcgaacaucacuuccaaaccacuauugcugcuuucucuaaaaauucauaguucugacacuuuccuucuuugcaaaggucagguauuuaaaauauuauagaauuauuauuaucuuaaaaguaaguugguucaguacuacuguuggacaauaccauuucaaauaucaugcuuauuggaauuaagaguauacauuccuacaacagaacuuauauucugacaauauauuauccacacauuuuuacaaacuuccuguuguuugguggccuacucuuaauacuaaaucagacaauauugauuuuuuuuuuaacagaugcauauugaagcugccaagaugcuaucuuucacugaggaggaauuuaugaaagcacuugaauggggaaauucauaagugaucuacuucaguuagucucuaugacaguaugugauggauacccauuuuacuuauuguagugguuugaauuauuuuuauucuucauaaguaauauauuugauuaugaaagcaaaauaauuucaaagaauucccuuuuuagauuuaggagauuagcuauuagcucuuuuugaguuguuuuuuaaguucuuagcgugacaauuaagcacaucagauaauaaaauucuugacucuuuucauuuauaauucuccucccuuacaguagaccaaaaaagaugcuuuaaaagaaaauuccaaauauuuauuucccuggcuaaaucaaguaaguaaaguucguaaacacagacagaaggcaguucacuuugggguagaguucuguauuagucaagguaaauauacugucuugaggauggggaugcaaacagugcucuguaguguuguagaaaucggauuuugaaauuaucaguacaaaaauaacagcuugauuaaaauuaauuuguaucugauaauuguuuacaaguuaugaaauucagugaugauuuacaaaauccaaacagacaauggauaccuaaugccacugaacuguaaaacaaaaguuaugcugacaucuagugguaacaugcaaaaaaucuaugcuuuacccaauuuugaugauaucauuucucuucacaaauuucacuccuuuguugauauacuuuccugaacucuucaccaagcagaucaauaucauccucuuuuuuaaauacucccuacgagaaaaauacuuuguggguuacuuuugaauaccagaauauuucacuaaaugcuuuuaagacugacagacauaagauuaguaaaguuaucuccaagguaaugaaaucuauucaacagauuaaugaaacuuuaaaaaaaucaauacuuuucaaaaaauaagacuuuacauauauauugaauauuccuagacugacccaauuuucugauuuaucagcucuaguguaggagcuuuucauaggaaucugagcucuucuacaaguucuacugcuuggauuaccuagauaggaaggcacuucaucuauacuguacccuacccuuuucuuuaaauagcucuauaauaugauauaauggugagcuucaguagauucaugcaugggauuaguucuucaugccucaguucuauggcuaaucagcaaacagucaaucuugcagaaaagaauccagguuuggaguuaagccauuuaagcaaacccuuuggaauucuucacuguucuauuuuucuuuuccccuacaguauacugcaaaaggcucuuuaaaacaaaauuaaauauuuacuuaaauugcaaucuaaagaauaaagaauuuuagggauaacugaagucauuuggcaccauuaggaccuaaaggauaaaggucauuuuuggauaucaaguuuauuaaucccuccugcugccuccacaauuauuuccucuacaaaaauaucaaaucccaaagaaagacauuccuacaauuuauaauuuaguuuaugaaauguauuaauuacauauggauuuuaucauuaauacaucauuuuguauuccuuaauccuuucuaaccaauuagacuaucaaguccuguggccaggcaguaauuaccuauauaucuuuuuccuuccuuagcaccagagugaauauaauaaaauaaauaugcacuugauucuacugaauaaaauaugaaauggcauuucuauagcugaaagauggcgaucuuauuuauaugagucuagauguuuauguggccuaugaaacuguuauuacuuuuuuaagacaagacggggucucacucuguugcccaggcuggagugcaguggcaagaucaugggucacugcagcuucaacuuuccaggcucaagcaaucuuccaaccucagccuccagaguaucugggacuacaggcgugcaucaccacauccaguuaacuuuuuauuuuuuguagcaauggcaucuccccauguuucccaggcuggucuugaacuccugggcucaggugauccuccugccucagccucccaaagugcugggauuauaggcaugaguugccaugcccagccaguuacuauuuuauuugaagucacagugugucucagguauacauuaaaauucacuaucuucuggaauuuuaaaaaucaaguuuaacuaguuauaacuuccuacuguagagcagaucugucucaagcucaguucaaccaugugccuauuacugguguuaccagugacaauguuuucauacacauucucaucuuuggcauguaaguacuacaguucuaggguagucucaagcucaguucaaccaugugccuauuacugguguuaccagugacaauguuuucauacacauucucaucuuuggcauguaaguacuacaguuguucuaggguagcuuuagauuuccuacacuaaaaggggagaaaagaaacucuaaaauacaaacucaggccaggugugguggcccacccagcacuuggggaggcugaggcagauggaucaccugaggccaagaguucaagaccagccuggccaacauagcaaaauccuguccuuaccaaaaauacaaaaauuagcugggugugguggcaaacgccuguaaucccagcuacucaggaggcugaagcaggagaaucaccgggaggcagagguugcaguaagcugacaucuugccacugcacuccagccugggcgauaaauaagguacaaauucaguaaaucaagcucauacaucuaauaaugugcuaagaccaaucauuuuagauauacugaaaugggcccagagagguucagugccuggacaggaggaucccauugcugcuucauaaccgagcaagaagugagcaaaaccaaggcacucuaaaauccaaauaccauguuuuuuucacuauuacaggucaugaagauuacaacuugagauaaaucucacuuacuuuagggagauagccuaguaaguuuguagcaugcucuuuaagaaguuuuagccuuucuucuucaauaauugcauuaauaaauccuugccgccuuugcugcaacugccacucuucuaguucacguugcuggaaaugcagaucaaauuuuguuaucacaaaguacauuaaucuuauacgaaguuuucaaauaaaacuacucaugcaaugaauuagauaaaauugaugaacuauuuaugacacuaaguucaaaagauucuagauaauauauauuuuuaaaauauauauuuuaugucuguacacauaucuauguauuuuuuacugucauuauuccuuuaaaauuacaaggaggcaaacaaauauuuucaggaaagugucuucauuaccaagggaaaaaauauucaaaggagugacugccuaauacaguaaauauuuacugaaugcuuaccauauaccagaugcugaagaguuuacaguguaaaacaaaaaauagugaauaaagaagaucagaaauaucuaaaggauauuuucauauauauauauauaaagaugauaugaagcaugagaauuccacuaguauuucuuaggaaagugcucacucuuaaauaaucacaucaaaauucugggccauauagaaaagaugacuugaacuacgugaaagaacaguaaucuacuaagccacuguuaauuugagacuguacuugcauucaaaccuaauucuaucuuaauucauccauuccuuauaaagaggagauacaggaaaguucuguaauguuacaggggaaagcaaacuugauacauuuuuguccaaugguagagucuacuuugggcuaaugcagauuuuccuaagaaggaucuggcaggccacauucaauguuuauccuaaaaagaaaaauuuauaguaaauuaaauuguuuaggcaguuacgaaaucaacuuauccauuuaggacaaauucugaauagcuuugguguaggaaacuaccuccugggaaguuucagauuuugucugaccguaugauuuucguagagguagacagaauuacagauaccuauuuaggaaugucucugaaauccaaaaaacaugguuagaccuuauaggauuguauaaugaguuucaucacgaagaucuguccuugacuuggggccagaacaaaaauguugcccaaucaaacggacaaaacuaagccgacagcuucauauugggaacauuuauaagucuuuaaaaauuaagacaaaaauuauuuguauaaguaucuaugcauuagguggcuuuaucugauuuccauuuaguuuuuagucugauuucuaguuaguugucuugcuaacuuuuccaggagcuuucuccuauccaaguacuaaccaggccugauccugcuuagcuucugagaacagaugagcuccaaucugaaauauaacagcacuuguauucccaugaguuucucauauuugaaacaucugcauuauuuugacuccuacuuuguauaguuuuaaaagaagucauguaagucucacuuagucuuccucuaaauucuucucuuccuaccgauuuucaaaacaccuacauauuauccauuugguucuuaaaccacaaaaucuagugagacaauauaaguauuuaguuuuacggaugagacauaaauaagucaauguauccaaagccaaaaacuucauucccucuccaacacuuaaaucuacauuuccaacuaguaaucuuccccugggccaccaaaucauuuuggguggacaaaauagaauuauuugcacccucaaaaucuauuucuuuuccucuauacucuuuccuuaggaugucacccagucacccauuaaagauggaagugacacauggacacagggagaggaacaucaucacacaccagggccugucggggggugggggggacaaggggaagggagagcauuaggacaaauaccuaaugcaugcagggcuuaaaaccuagaugacggguugauaggugcagcaaaccaccauggcacauguauaccuguguaacaaaccugcauguucugcacaugcauccuggaacuuaaaaauauuaaaaaaauaauuaaaaagauggaaugacaguauuauuuauuagggguagccuuaagucuucucucacccuagaucucacuggucaccaagccccaucaauuccguauccuuaacaucucucggguggaucccuuaucuauuugcauggguuucaccacuugucacugggauuauuauaauaacuuacuuacugaucucccuaucuccgagcuuacucaucucuuaucuaccuucaaugcucucacuugaaucgucuuucaaaguacagaucuuaauauacagcuuuucaaucuucaguggcuucccuuagaaaagcccaccuucuuaaaauagcaugcaggguguucaugaucuguuucucucucugccauaccaaaacauccauagcucuauaaccuauuaucacauguacaugacauauuuauaauuacuuuuuauauauuuuucuuaaccaagaccauaaauucauaagugacauggacuuaguuuuauuuaccuuuuauguucucaauaccaaccaguguuuagcacauagaaagcaucaauaaauauuuucuagaagcaaaaauggucagaaaauuuauauauauauuaguaaacauacuaacauugucuggcauauaaagcuucucaguaaauguuuaguggaugauagaugagcuauugcuguuuaaugauaaugaccaaaaaaaccccacaacuuuuucuuacuuugucugcaaggaauuguuggcgacgcucuucaauaaguuuuuccacagcccuccuguguuccagcugcuucauucuuuguuucugagcauucauuaauucuauucgaucauccucagcaaauuuagcuagcauaguuuuucuaaaguucuccucuuccucuuuugcagccuguagcacuaauuccuucaaggccauuuguucuucaaaaucuugcuucaucucuuuuugcuuucucaauuucuuuucugcuucuuccuaaacaauacagcugaaaguuaauuuaguaacuauuuccuuacaccagauuuauaaggaaagagugauagaguuugguuaaauuuaguauuacaauaugaaaucauacaaacugaaaaaguaaggcuuuucaugauaacuuuguccaucccuuuaaaacuagcuggauaaagaauaugcuuacauuuggauuguuuucuguuacucaugaacaaauuuuaauuuauauuuaccaucuuguuucucuacucagaauuaacacguaacugcuuuggaaagagcuguuacaaaagccuuuuuugcacaccugaguuuauucaucuaaagucuaugguaacuaugaaucauucuagaaucuugcuuacaaaagcuguccaaaccacccauaaguauuuuucaguuuccaaccuccuccucaaaaucaaagcugcacuuacccaucucuagucuucuaauauucccuucauucuccaaaauucucuaaaauuuaaaaacaauuaucuagcaaugacaaucaguacuucuuuagggaaauucaaauauaguuggaacaguuaaguccuuuccuauaagcuuuuauuuucugaacauuuuauuaugaaaaauuucauacauacuaaaaaauauaauuuuacaauggucacucacuucuaaauaauucaugggccaaagagggaaugccaaggaaaauaaauacauuguaguuaauaaaagugagacagcaaaauuugugagaugcugcuaaagcaguucugagaaacauuuauagcacuaaauggauacauuuaggaaaauguauauauauagcacuaaaugcauguauguaggaaaagucucaaaucgauaaucuaagcccccacuucaagaaccuauaaaaagaacuguaaaguaaacccaaaauaugcagaaggaaaaacauaauaaaacuguagaaaucaauggaauuaaaaauagaaaauagacaauuauuggugaaacaaaaggcugguucuuaaaaauuaucagugaaauggacagaccuuuaacaaggcugaccuagaaaaaaaaaaugaaugaauaaacaaauaacuaauaucaggaauaaaacauaggauaucacuagagacccuacagacaucaaaaggauaauacaggaauacuacaaauuauuauacacacauaaauuuggcaacuuagaugaaauggaucacuuccuugagaaacacaagcuaccaaaacucaccaaauaugaaauaagguaaucugaauaguccuaucacuauuaaggagacggaauuaauaacuuaaaauuccuccaaaauaaaaccccaagucaggaugguuucacuagaaaauucuaucaaauauuuaaaaaauuaacacgaauucuacacaaucucuuccagaaaacagaagaggaggaaacauauccccauucauuuuaugaagauaguauuaccccgcuaccaauauaaaaaauuacagaccaauauuccucgugaauauggaugcacaaauccuuaacccaauauuagaaaaauagaucauacauuaaaagaauuauucaccaugaccaaguaguguuuauuacagggaugcaagacugguucaauacucaaaaaucaauguaauauacuuggcuaaagaagaaaaagucauaaucauaucaguagaaaaaaguguuuaaccaaggauauccaggaauugaacucaguucugcaccaagcagaccuaauagacaucuacagaacucuccagcccaaaucaacagaauauacauucuucucagcaccacaccgcacuuauuccaaaguugaccacauaguuggaaguaaagcacuccucagcaaauguaaaagaacagaaauuauaacaaacugucucucagaccacagugcaaucaaacuagaacucaggauuaagaaacucacucaaaaccgcucagcuacauggaaagugaacaaccugcuccugaaugacuacuggaugcauaacgaaaugaaggcagaaauaaagauguucuuugaaaccaaugagaacaaagacacaacauaccagaaucucugggacacauuuaaagcaguguguagagggaaauuuauagcacuaaaugcccacaagaaaaaucaggaaagaucuaaaauugacacccuaacaucacaauuaaaagaacuagagaaccaagagcaaacacauucaaaagcuagcagaaggcaagaaauaacuaagaucagagcagaacugaaggagauagagacacaaaaaacccuucaaaaaaucagugaauccaggagcugguuuucugagaagaucaacaaaauugauagaccgcuagcaagacucauaacaaagaaaagagagaagaaucaaauagacgcaauaaaaaaugauaaaggggauaucaccacagauccaacggaaauacuaccaucagagaauacuauaaacaccucuacgcaaauaaacuagaaaaucuagaagaaauggauaaauuccuggacacauacacccucccaagacuaagcugggaagaaguugaaucccugaauagaccaauaacaggcucugaaauugaggcaauaauuaauagccuaccaaccaaaaaaaguccaggaccagauggauucacagccgaauucuaccagagguacaaggaggagcugguaucauuccuucugaaacuauuccaaucaauagaaaaagagggaauccucccuaacucauuuuaugaggccagcagcauccugauacuuuggucgucugucauccugacagagacaccacaaaaaaaagagaauuuaagaccaauaucccugaugaacauugaugcaaaacuccgcaauaaaauacuggcaaaccaaauccagcagcacaucaaaaagcuuauccaccaugaucaagugggcuucaucccuggaaggcaaggcuauuucaacauacacaaaucaauaaauguaauccagcauauaaacagaaccaaugacaaaaaacacaugauuaucucaauagaugcaaaaaaggcccuugacaaaauucaacagcccuucuugcuaaaaacucucaauaaauuagguguugaugggacauaucucaaaauaauaagagcuauuuaugacaaacccacagccaauaucauacugaaugggcaaaaacuggaagcauucccuuugaaaacuggcacaagacagggaugcccucucucaccacuccuauucaacauaguguuggaaguucuggccagggcagucaggcaggagaaagaaagaaaggguauucaauuaggaaaagaggaagucaaauuguccuuguuugcagaugacaugauuguauauuuagaaaaccccauugucucagccccaaaucuccuuaagcugauaagcaacuucagcaaagucucaggauacaaaaucaauguacaaaaaucacaagcauucuuauacaccaauaacagacagacagagagccaaaucaugagugaacucgauucacaauugcuucaaagagaauaaaauaccuaggaauccaacuuacaagggaugugaaggaccucuucaaggagaacugcaaaccacugcucaacgaaauaaaagacgacacaaacaaauggaagaacauuccaugcucauggauaggaagaaucaauaucgugaaaauggccauacugcccaagguaauuuacagauucaaugccauccacaucaagcuaccaaugacuuucuucacagaauuggaaaaaacuacuuuaaaauucauauggaaccaaaaaaggggccacauugccaagacaauccuaagccaaaagaacaaagcuggaggcaucaugcuaccugaauucaaacuauacuacaaggcuacaguaaccaaaacagcaugguacugcuaccaaaacagagauauagaccaauggaacagaacagagcccucagaaauaguaccacacaucuacaaccaucugcucuuuuuuuuuguuacaaaaaagacagguuuguuacaaaccugacaaaaacaagcaauagggaaaggagucccuguuuaauaaauggugcuggaaaaacuggcuagccauagguagaaagcugaaacuggaucccuuccuuacaccuuauacaaaaauuaauucaggauggauuaaagacuuacauguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuuccgcacagcaaaagaaacuaccaucagagugaacagccaaccuacagaaugggagaaaauuuuugcaaucuacccaucugaccaagggguaauauccagaaucuaaaaagaacucaaauuuacaagaaaaaaucaaacaaccccaucaaaaagugggcgaaggauaugaauagacacuucucaaaagaagacauuuaugcagccaacagacaagaacaggaaaggugaugucuacucucaucacucuucuucaacauagcacuagccaguggugcuggaaauuuuagccagcauguaaggcaaggaaaggaaguaaaaaguauacagaucagaaaggaagaaacagccuguagcucugggcagaagacaugccugacuauguagggaaaaaaaauccuacagcuaacaagugaauucagcaagguugugagauacaagauaaacacaaaaauaucaauucacuagcaacgaguacacggacaccaaaauaaaagcuaacauuccauuuacgauugcucaaaaaaugaaacacuuagauguaacaaaacacguacaggauuuguaugcugaaacuagagaauccugaugaaaaaauucaaagaucuaaauaaagggagagccaaauuguguucaugaacuuaauauagugaauuuaucaauucuccccaaacugauauucaaauuuaauucaauaccuaucaaaaucccagcaaaaaauauuuauagagacaagauucuucaaaaauucauauggaaaggcaaaggaacuagaauagcuaaaaaaaaaauuuuaagacuugccauauagcugcaguauucaaaacuguguaguauugguggagggauggauacauagaccaacagaacaaaauagagaccacaggaauagacccauacaaacaugccaacuguguuuuaagaaaggugcaaaagcaauucaauguuggagaaacagccauuucaacaaaugguguggaacaacugaacuaaauccaauggcaaaaacuguauuuaagucucaucguuuguaccaaaaauuaacucaaaacagaucacagauugaaauguaaaauggaaaagcauaaaaaaaaaaaacccaaaaaaacaaaacacacacacacacacaaaccuuuaggaaaaaaaaaaggagaaauucuucaauaacuaggcgaagaguuucuagaguugacacagaaagcaugauccauaaaaagaaaaacugauaaacugaacuucauagaaauggagaacauuugcucuaagaaaaaucgugcucuaagaucauguuaaaaggaugagaagauaaagcuacagacuagaagaaacuauuugcuaaccacccaccugacaaaggacuaguaucuagaauauaugaagaacucucaaaacccaacaauaaaugaacaaacaacccaauuagagaaucagcaaaagacaugaagaacuauuucaucaaagaggaucuuacaccaaagaggacagcaaauaagcacaugaaaagauguucagcaucauuagucaucaggaaaaugcaaaauaaaacuacaagguaucacuacauggauauuuaaaaguggcuaaaauaaaaaauuguugagcuucugaggacagaggagaaaaaaauuaaaaaauaaacuguguuaacaccaaaugcuggugagaaugcagacagacugcguaacucauauauuucugaugggaauguuaaaugcuacagcuguucuggaaaucacuuuggcagucuguuacacagcuaacaugcaguuaccacaaaacccagcuaauacaaucuugagcauuuauugcagagaaaugaaaauugauguuuauacaaaaaccuuuaccugaauguuuacaucagauuuacucaucagagcuaaauauuggaagcauuccaaaugcccuuuaaugggcaaauggucaaauaaaaugguauauacaugccaauggaauguuacucagcaaaaaaagggaacaaaugaucaauacaagcaacuuggaugaauuuccaggaaauuaugcugaauaaaaaaaagccaacuugaaaaaguuacauauuguuugauaucauuuauauaacauuccugaggcacauacuuuuaaauuuauaauuaaagguuuauccauguuuuagcaugaucagucugucauucuuuuaauagcugaauaacauuuuauuacauggauauacuauauuuuguuuauccauuagacauuuggguuauuucuacuuuuggguuauuucuacuuuuagacuauugugaauaaugcugcauaaacauuuguguauggguuuggguagacacaggcucauuaauuuuuaaccauucuuuuuucuaauauaugcauuuaaagauauaaacuuuccucuaagcacugcauuaacugcacgucacauauuuuggaaugcuguuuuuugaaucauuuaguuugaaauauuuuucuaauuuccaauauuauuuauuccccuuuucucauugcuuauuuagaaauauauuguuuaauuauaauauauuuaaggagucugcagguauauuuucauuacugauuuuuaauuuaauuccacuguagucagaaaacauaucugguauuauuuaaaaccuugaaaauuuauugagacuuccuuuauguccuagaauaugaucuaucucggugaagguuccauguuugaauggaauuuguguucugcuguuguuggguggaguauucucuaaaugucaggucaaguuuauugauauugcuuucaauacgauauccugcgguucugacuaccuagucuauagauuaaugagaacugugcauugaaauaccauucuggacauaggaccuggcaaagauuucaugaugaagacucaaaaagcaauuguaacaaaaacaaaaauugacaagugggaccuaguuaaacuaaagaguuucuucacaggaaaugaaguuaucaacagaauaaacagacaaccuacagaaugggagaaaauauuugcaaacuaugcaucugacaaaggucuaauauccauaauaucuaaggaacguaaacaaauuaacaacccuauuuaaaaaauagacuggccaggcacgguggcucacaccucuaaucccagcacuuugggaggccaaggcagguggaucaugaggucaggagaucgagaccauccuggcuaacacggugaaaccccaucucuacuaaaaauacaaaagaaaaaaauuagccgggcaugguggcgggugccuguagucccagcuacuugggaggcugaggcaggagaauggcgugaacccgggaggcauagcuugcagugagccgagaucacgccacugcacuccaaccugggcgacagagcgagacucccaucucaaaaaauaauaauaaaauaaaauaaauaaauaaaaagaaaaaauaggcuaaguacaugaacagauaccucucaaaaaaugauauauauguagccaacaagcacaugaaaaagugcucaauaucacuaaucauuagagaaaugcaaaccaaaaccacaaugagauacuaucucacaucagucagaauggcuauuaaagucacaaaagaauggaugcugacaagguuguggagaaaaaggaaugcuuauacacuguuggugggaauguaaacuaguucaaccacugugaaaagcacuguggcgacuccccaaaaaaugaaaacagaauuaccauuugauugcuggguuuauacccaaugggauugcuggguauauacccaaaggaauauaaaucauuuuaccauaaugacacaugcauguguguauuuauagcagcacuauucacaauggcaaagauauggaauccaccuagauauccaucaaugguggacuggauaaauaaaaugugguacauguacaccacggaauacuacacagccauaaaaaagaacaaaaucauauccuuugcgucaacauggauggagcuggaggccauuagccuaugcuaauuaaugcagggauagaaaaccaaauacuacaugucuucacauacaaguaacagcuaaauauugaguacacguggacacaaagaaggaaaacagacacuggggccuacuugaggguagacauaggaggagggugaggaucaauaaacuaccuaucgaguacuaugcucauuacuugggugacaaaauaauguuacaccaaauccccaugacccacaaauuuaccccuguaacaaaccagcacauguaccuccugaaccuaaaguaaaaguuggaaagagaaaaagaaaaaaaaaaaaaucuugaacucugauuguggauuugccucuuucuccuuucaguuuuugucaguuuugcuucauguauugugaagcuuuauuauuuagguucacacgccuuuaggacuaugacaucuucuagaugaauuuacuguauuaucaugaauugcuuguccugaaguugacuuugucucauauuaacguagcaacuccaaccuacuuuugacuagugucuguauguuacguaucuuucaccauccuuuugcuuuuaaaguauguaucuucauuuuuaaauugugauuacagacaacauaguugcaucaugcuuuuuaugguaaguuuauaaauugaugccugagucuaucuuuuuagccagcuugaaaauuucugucuuuuaacuguaguauaccauuuacauauaauguaauuaccaguaugguuggauuuaaauguacuaucucuuuucugcuucaucucaaaauuauauucuucucuacauuaaucauucuuuccauuucugaaacuuacuuuuagcuugcucuuauauauuucagcuuguucuuccugguauaauucuugucgcacuuguuccaaaucuucacguugccgcagcauuucuucuaauuucugugucaacuauuaaauuuuuuaaaaaacauaaauauuuauaggauccaaauucuguaacuaauauuucagaauuuuacuaguguuaaagaagugguuauuuuaauaccgcauucugaagcuguagccuuuucuccucauuuucuugaacuuuugccauccgaucuucuucucuuugcugcugcauguuagcaaacucuaugauuuuucuguuuucuucuuccaucuccucacguuucuuuuuucuccagagagccugcucuuucugaaacucuucuauauaccuucgcauugcauucauuuuuucuaacuuuuguuguuuuucccugaaaagcaauaacaaguacagauuuauaguaaacaauaaaauauaaaaaaguaauuucauuuuguucauaauaauguacagaaaaacacuauaguuuuuucauucgugcaugcaacaaacauuuugaaugcuuacugugugcuaaauauaaugucagguaugaauuuuucuuuggguagaauacugugauagucuccucuaaccuauuaaugaaguuuuaugcaucuuauuucauaaaggcuacaaucuguuaacauuagcuuugcagcacucuauacuuaagcugucuaccaaaaaaauuuaucagaauaccuguccucugacauaugauaugggcauauauaagaaaaacaaagguuuaggucauucaaucacuucagcauuuauuaaucaucagauaauucauuuauuaauuaugcuaacggagaugagaaggaguuggucccaauuuauguuuucauagcuaguauuuauugagcacuuacuauguauuaggcacuguucuaggugcuucaguuccucacaacaaaccugugauauaucuaaaguaaacauuuagacauguaagaaaguuaggauaaacuuacaacugaucuucuucauagaucuuccuaacaauuucaucaaucaugaguuucucuuuuagcagcugcucauaagcuuccugcuuuuuuuuuucuuguucuucaaguuguuucucuaagucaagauaguacugugcuuucgcuuuguuucguuugucuucugcagcauucucuuccuuuauuauucucuuguguucuuccaucaugguuuuggcuauuucagcaucacguuucuguuauuaaaacaaaauugaucuuuccguuuucaaauuugaacauaguacgauaguauauuuuacaccaauguuauugaauauuauaaagucuuuuacauaaaauaaauuuuuucaucugucuagguuaaaaagcaaaaguaaguuauuauuaccugaagggugugaacaauaagucagacccuaaagcagcuuuccuaucccuucaaguagcucucucaggacaauaccugauaaggauuauuaauaacuccacauucaaaaaacaaugaauacaauuguaaguaguuucuuaauaacuauuuagcugcuaaagcagucauuaucuuauuauucuauuuauaaacugagcuaggcaauuuucaucguuuuuagcuucauuguuuaucagcugcuauuuaaagaugguacugccucuuucuuacaggucugcuauuaaauggcuuugagcagcucuuaaguuucuccuagccuaaacuuucuuuccugccauuggcccuugacguuuccccuuucugauuuauuaaaggcccuuuaucugaaaagaaucacagaugcuacugugccuauuuucuacagcuuuuaauucacucaagaccauucccauugucaagagacaaucuuucuucuuggauggguuaaaccccuuauuucuuuugagcauuuuucaaaucauuuaauaaaauaaguuuuaaaugaaauauacugaggcaauuuuuuaaacuacgcuuuacuuuuaugaucacaucccgaaugauggaauggucagcagcaucaaacauaaagaguaaacagauuaaaauaugaauacugaaugucauuccugacgucacugaagccuuuaacauauacucugauaauaugacuugaccaaaaauguuucugauuaucuucuuuguacaugcuauacuaaauucuuuauuaaaaaaugagaugacaauaacauuuauguguagauuaccacacacuuaccgaaaacaauguucucauuuuacagauaagaaaacuaaggcucagagaaaaagccaaaacuaguacuugcaugacaccuagucaaguccuaguaguauucgacuuucauuuuguggaucaauuuuuauuuggaaaauagcagcaauucucguaggagucagauuaaaacgucuacaacuaccuugaauaacuucaacuaucaggauaauuaaaacugcaaaccacugga

SEQ ID NO: 192068 - RNA, 152753 nt, Homo sapiens
auggcagaggaacaacaacagccgccaccacagcagccugaugcccaucagcagcuuccccccagcgcccccaacucggggguggcccugccagcccuugugcccgggcugccagggacagaggccagcgcgcugcaacacaagaucaagaacuccaucugguaagaggauccuccaucgcucgcgugaaaaagcccaggcacauuucugcugcaaaguggguggggggcggcgggcggggggagcggaggaggaggcugaugcauucauugaauguggcuuuccccagucgggugcacauuuguaggaucucuggaggugugcggacuuugcaucaaucagccccugucuucuuagcuaaaaaaugcuuuuaccccuuccucaauugugagugcagauaaacaaguuuuuugguuuuauuuuuucacucauuguaacagaaauaugggucgaaauuaagucauauugcaugaugguggcaugaauuuggaacuggagaaugugaaauguguuuacuccuuuuugcagccauagaaggaggaagaaguguauugugaauuuucaccaaacagauacugugcguaagaauauuaauaugcagcacaaaaccuaaugugucucuuccuuucaguuggguuagcugcuauuucugaauguuuuugccucccuuauccuaauauuaaauuucuuuuucagggaguuuauucuuugcauugauugugaagaaagugcuuuuuuaguauaaaauauuuuaagaugguaguuuacaacaaagugguuuuuuuuuaaauuaaaauauagggaaucaaaugucuugccauuuguaugucuuuuuaaaagaaaccauugauggaauaucuuucgcuauuuuacuuucuuguaugaaaauuuccaauauuucagcauuaaacuccuaaagucuagugggaaucuuuuaauaauuaaauacacuaaguccauccacuguuagagccauugcaauauucuuugaacaugaacuugcauuguuuuguaggaugcuucauuaacugccuuuuuuaaguguagcaauauuuuuuaaauggaaaguaauauuuggaauuuggucuaagauugcuuuuaauagaaguuuaaaaagaauuuuauaugguauuuuaaaaagccuugauuuugaaaauggaaaugaaaucuuugcagggccaucauugaauaugaguacuaaaauaucaaaacucauuuucucauuuugaaaacauaucguaaagcaacuggcguugcaugaacaguauuugcacauuuuuaaagugacaauuuuuaaauacaagauuuagguuaguuauauaguaauuuucauuauuuucuuggcaugcauccaugccgucaugaugcugauaugaaguaggucagugcaggcuuuaauaguuucaucaacaguaguuggcaguugaguaucuugcuuucaguuuuaauuuuaaaaugaaguuuaaauauuuuaaaggagaauuuuuuuggcuuugacaauagucauguuguggcaacuugaauaggucugauagauaugauuggggugugugugugugugugugacagaaagcaggcuuuauucuucaauggauacccucacccccuuuuuaaagcuauaauuuaaaagaagagauggugaauaucuugcuugccaucaagguuuucacaaaaccaguguguauguguguguguuuuuaaccucuaguaacgugacguaacuuuguguuucugaaaucaucauuaaauugaauuaagcaccuugguuuuacauucagaugugggaaauccaaguuaauggacuaaaaucuuuuaagagagacaaauuuuaaaaguugaaugaguaauguauauuuuaauugauuaugagaacaagaggggaaaggaaucuucacuuuauaguuuuaaaauaagugaguuguggaggcaacugacugaaauguuugaauaaugaugauagucgagugcacuuuuuggcaaauaauguguaaauuuaauuuuuuuuuauauuggcacauccauuacagccuaacugcucugacuuuaacaugagaaaaacuucugaaguagagugcacuccaguuuuugguacuugcucugaaaaaauaaugggcagcaaacacgugaaucccaaaauaugaaaauuuauauuuuuguuuuaaaauuguaaugauacacuuauuggcaucuaaugaucaacuuuagaaauccuauuugcaaaaaugauuuuuauauacuuaaaauuucggaauaaacaacauuuguagauaauaaacaaaauuaguaaauauacuuaauagugucauacccccugcuccacaagaauggauuuauauuauucaucaagugacuauguaaaauaaagauaucaaaagugaaaacuccuuuacuaccauauauuccuaagaaauaguauauauguauuaaaucauuuuuaauagaugauugcaguuagauauuucacauuuuugagacaauaauauuauuuuacaaauuauuuuaucaccugauaauauucugagagacuaucaguuuuguacuacuuccugaaucauccuuuggugccauuauuaaugagaguuuaaaauuacacucaaaagaaaugugacauuuaaaaauuaucaaauggguuuugcauuugguuuaucauaguuucuaaauuacugggcuugcauaucacaaacaagucuguacuuguccuccuacucuacaaauauaaauauaguaugugauguaggccuuuggacaauaaguuaucaguucauaauuuacucuguuuauuaaacugaaauaugguuugauaaaaguaugugcauugaaauaucaggcauuaaaugagucuggaaaaaaagcauucaaaguugaguggaaaagaguuggaaauauauuuuaaagguaauuauagaaaauaagguuaguacaaaauugacaauguuguuauguuucuauaauaugguuaugaauaccuucaaguuaacucuagguuaacaagcuugcauguuucuuacccuuacucauucuuacuccauagacaaaagguccaaaucacugacacuauucacuagaaaggagauuucuuaguaggcaugugcuuuaguauugaauaugcuguaagguuauuuguauuuucuaaaaaguagaauuccaaaauuagcuuuuuguuguuaaaaaaaaaaaaagaaaacuaguaacccauguauuuuuaccuaaaacaaggccacaacccaaccuaacugcaaacuucuuuuagcuuaaauuguaccccucuuugguuacuucaaaaaaaaaaaaaaaaaaaaaagaaauaccaaagcaaguuuucccuuccucuuaucucucagugucuucguaguuuagugaaaauuuuuuaguguaagcaacaguaaacacauuuacuaaguccuuuuauuuaccuuuuuaaggcaguuuuacuugaaacccugauagaauaaaauugcuguggaaaaaauaggauugagaugguuucugccuguuugugaauugagaucauaccuacaugagugggagugaauaacauauuugcagugaggcuguaacauagauacagguugaucaucccuaauccaaaaucccccagaauucaagaugcuccagaaucugaaacacuccaaaaucccaaacguuuuuagugccacaagugaaaaauuccacaccugacuucauuguaucacacacaaaauuauuuaaaauauuguauaggccaggcgcgguggcucacaccuguaaucccagcacucugggaggcugaggcgggcggaucaccugaggucaggaguucaagaccagccuggccauggugaaaccccgucucuacuaaaaauacaaaaaauuagccgagggugguggugcccaccuguaauccuggcuacucgggaggcugaggcaggagaaucgcuugaacccaggaggcggagguugcugugagccgagauugcaccauugcacuccagucugggcaacaagagcaaaacuccguuaaaaaaaaaauuguauaaaaauuaccuucagguuauguguauaagguguauaugaaacauaaaugaauuucuuguuuagacuuggguuacaucccuaagaugcucauuacacauaugcaaguauuccaaaauccaaaauaauaaauuggaggcacacuaggcgcaguggcucacgccuguaauccuaacacuuugggaggucaaggugggcagauugccugaguucaggaguuugcgaccagccugggcaacacggugaaaccccgucucuacugaaauccaaaaaauuauccagguguggcaucgugcgccuguagucccagccacuugggaggcugaggcaggagaaucccuugaacccaggagguggagguugcagugagccgagaucaugccacugcacuccagcugggcgacagagcaggacucugguucaaaauaaaaaacuaaaaauaauaaauaaauaaauaagucggaagcacauaugaucccacgcauuucagauaagagauagucaacuuguauuaaacuuguaccugaaaauucaaaagaaauccugauguuuuauuuuagaaaauauuccaauacugcauuuacucaaauuuagggauucuuaaaagaauuuguuaucaauuacuguuuuuauuucuguaacuuuauuugcaggcaagaccucauaagccucuucuuaaaacggucauauaagaucuaucguuuugcccacuuuauggaaagagauaaacaaugacagaagaccuauaagauucuacugauuccuuauuagacccuggaaaaaaugcuggggucagaguuccuuaucuuuauucaauccuguaaggcauacauacuucuguaucugcuauauuuuaggcugaagauuauaauaaaaguagaauuauauauaugaucuauuuuggauguuuucugaauucuaguuaaaacccaaauugaacaauuuuguuuuacuuucuuaugaugaugacaaucaacaucuagauauuaagugauuaaucucuuguuuccaucuuaguuacagggagcuguguuuggugauccagaagguuuacauagugaugccauauuaguucugauuacaguccgccauccuagaaugcagugguucaguuuuauucuugguuuuugaaucagguaguuuauuaacucuguugagaaauauuguuccuucagcuacaguggaaaacauguacuauaaauucauaacuuuagaguuuacuuuaacugaaagucuaugauuuucauuuugcuuuaaaaauacagaccgacuagcacaucagcuggcuuccauguauuuuugauuaguagguugaccuccuaccuacccugaguuuagccugucuucaauaccaagcacacaaaagacuuaagaugcauuuugcauauccguauugaggcuagcugugucccaacaugguuucugguuccagaaggaaggcaguuccuugcucuccuaugauuuuaaacugauaaaauugucuucccuauugacaaaaguuaauugcaaguuaagcaauuccaagccuguugauuuucuugucuuguuuagguuggguaguggauauguacauauuuaaaugauugaccaauuugcucucuccauugaaaggugucuugaaugaugguaugugcaggacugauuugguuuaugucuaacuguaaauuuuugguauuaauuggggaaaaugagcuucauagugguagaaaagagagaagugucuuguuaugaaagaugcauuggauuaagaauuauguugcauuacuuuuuccauuagaaaauaauauugcaugcuaaaauugugcaaaugaaaauuaaaauaagccuuaucauuuacuuauauuugaggacuuuaagcaagaagaguuuguaaguacuuaaaugaguaucugcuauauacaaaguaugccagagacuggcauuugaggaaugcccauucacuuguaauauuaaccuuguaaaauugaccuaagcaaaaauaugcaauaaaacuucucuuuuauucaguuaggggaccaggaaaagaagugacaagugucaagguaaugcacuguggaaaaaguagaccuuaguuuccucauuuacaaaaugagagauuuuuacuaagugaccgugaagguuccugagauucuaacacuguuacuaaaucaauauugacaacaauaauaaaaccaaaagcacaaugaaagacuaauauaauuaauuuaucauaggcaaucaacagaacauuuucauuggaugaauuauuaggauuugucaguguuuccuuggguguuagcugaggaggacuugcuuauugcuaccuugugcaaggguucuguuaugugagauuaacugugcaaaucuuuauugagcauauauuacauuuaaaguaguuaagagcuguuuauugugcaaaaguaaggcuaugcaguaauccugguuguuggggaguuuacuaacugcugguugagagauuguaguagggaggcuguuugugugcugcuuuuguuuugucuucuuuauaaagagauguuuaaccuuaucccauaauaguaauguaauauuuuaaggcagugaaugucauauuguagauucaauuauauaaauaagaaaaguauguacucuuucagaauaauuuagugcagaguugagcuucacagcuauuccucuucaucuaggauagauauuuuaauaaguaaucgugacagaauguucuuuguaaauuauaaggaacaugauaguaagaugguuauucuacaucucugagcaaaguagaccacucuuguccagugccuccuauucuaccauucucuuucuguuuagucuuuuaguugcuuucucuucugcuuuuuggaggguucuaaguucgaguuaaagaugagaagcaugggccaauaggaggaagaaucuuccugccuuggguaggauaauaaaauaaggaacaauaaacacuaaggccuuaaugcacuuacuugcugacuaugagauuaagauauuuggcacucaacccacauaaauaaauaccuuaaaacaugauuuuucuuuuuuugcgacuguaaauaggcauuuacuuuuucuauuucacuaacuguaugccuccuauuuauaagacaaaauagaaacaugagguuugguuaauuauguacaaccucucuaucaggcaucuauuaccguagcucauauauauauaacaaaaaguugugugggaggugaaauuuucuauuuccucguaacugagcacaaacugaaaaauucugauauuccuuacuauuugagucuugcuuuuuuccugagugcagaaagugaaagaucagaaagugacagauuccaaucuguuaugucuuggauuuuugggaggcaugaguccauaugguacacacuaccaugucuuccaaauagccuuaucugaaauaaaaaaaauaaauuaucugaacccauuuguugucuaaauuugaauagcaaagguuuagauagcaaaggauaccuuuacacccauuccaacacgggauuagcaaauugauuggaacuugcaugcuaagucugauugauuagugauauuucuagcaagggcaugggaauaagaaguaaugauacacaugcccuauaauugccacccuuuuucuuuccaaaaucaguaauuuuuaauuugagcucucuuauagaugaagcauuacagcaauggcuaucuuggggagggagagucacuagggcuauugucuugccauuuaugaugccuaguuuuaagguauaaaccaagcauggagagcacuugguuuguguguuuuucuguuuuucuguggcuuuucuguuuugagcaccuguauugucaaguagcuacaagaugagaacagggcacuuugggaggccgaggugggcggaucaugaggucaggagaucaagacuauccuggcuaacauggugaaaccccgucucuacuaaaaauauaaaaaauuagccagucacaguggcggggccuguagccccagcuacucaggaggcugaggcaggagaaucgcuugaaccugggaaaagcaggggcugcagugagccaagaucacgccacugcacuccggccugggcgacagagugagacuccaucucaaaaaaaaaaaacaacaaacgagaacaggggauuacuguaugaacuggcugcuucaauuugcacuauccauaacccuuuuucuuugcuuccauuaucuuauuucucuacuuacguaugugcuggucuggucccauuaccugcuaccuuaagaauguuguuucugcugauauaagugucuaacuuuaagauccagcuugugaaacaugucucacgaaccuuucgucaacucccaggggaacaaugaucugaguuguguaauuuaauuuuuuucaguaguuuagacuggccuuuccuaagguaaguccauuuuagugaguuuuuacugaauuuaaaugaaacacucucauuuucuaauauguaaaguugauaggaauuuggagauugaauauaucugaaacaaaguaaucacuugcagaaucaguagucuacaauaugacaguaaaauauguuauuucuauauggcaacaccaagaacuuaccauuguuuuugcaguaagcaugaaauuuaaaaauuuaauuggaugagugucacuucagugacaucuugcuuagaguaaaguuggugcuucugggaaccugagaaacguauuccaacaagaugcuuuaguuaauguaagugaaucacuuccguaauuugauugcagucauuacaucuauuaauaagauauaucaaagcaaucuaugaucaaaauuuaacugucauauuauuaaaugcauguccuuuuuucugaagcaggagccacuagcaagcagcauuuuaggcagauucuacauguacagguuuuuaagaagucagaaggucaacgauaaauucugaauuuauagaaucauguagucagggaaaacugaauucaguacacauuuguuuuaaugacugccacauacaaggcauaaaaagguuaaaaaaguauaagacauucuuaccacuuuaaaacauucacccucuuuugugggagacucaucaauugaguuuaucaaaaguaaguuuuguuaaaugcaauaauggcguauaagcagugguauaaacaaauacagaauuaggugagggagagauucagugaggacauaauauuuuuacugacaaaauucaggauaguggccuuaaugaaaaaucaagggaugggcuauaaauccaaacacacuuaacaguauacuuacuuggucauuguuaaucucacuagcagaaauuagauucagaguuaugaugacagugagcuuugccaauaaugugaauaaauagaggaaaauggcuugggagaaaauuugcuugacuaaggaauaggauuuccacuaacuaaucacaauccucucauguuaaguuucgauguacaaguagaagaaagaauauaaaguaauaguagagaagaaaaggaugugagcugggugggaacuggagcagaguaccagaguacagguugccacaaccaaugucaccuuaaacuuggccuuucacaaccacgauuuuucuaugccuuaguaccuugccaccucaaauugcuuucauuuacucucauuucauuuacuuucauuucauuacucauuucaguuacucuaauucuuuugauaguagauaucacuuuuccuucuuuccaucagucuggcagcauugguuucaucuuuuauuuuucucucauccucguguccaguauuuuaacaaguuucccaguuugcaguguagcuuaaauuucuccuugucuuccuauuuccacugcugauaugguuuggcuguguccccacccagaucucaucuugaauuguagcucccauaauucccaccuguugugagagggaccuggugggagauaauugaaucaugggggcaguuuucccccauacuguucucaugguagugaauaaaucuaaugagaucugaugguuuuauaaagggaaacuucuuucacuuagcucucucuuucucucuugucugcugccauguaagaugugccuuucacuugccaccaugauugugcggccucccugccacgauuaugaggccuccccauccacauggaacugugaguccauuaaaccucuuuuuccuuauaaauuacccagucucggguaugucuuuaucaacggugugaaaacagauuaauacaguaaauugguacugguagaguggggcacugcuguaaagauaacccaaaaauauggaagugacuuuggaacuggguaacaggcagagacuggaacaguuuggagagcucagaagaagauaggaaaaugugagaaaguuuggaacuuugugagaaaguuuggaacucccuagagacuuguugaauggccuugaccaaaaugcugauaauaauauggacagugaaauccaggcucagguggucucugauggagauuaaccuguugggaacuggguucuugcuaugcuuuagcaaagauacuggcagcauuuuaccccugcccuagagauuuguggaacuuuuaacuugggggagaugauuuaggguaucuggcagaagcaauuucuaugcagcaaagcguucaagaggugacuugggugcuguuaaaagcauucaguuuuaaaaaggaaacagagcauaaaaguucagaaaauuugcagccugacgauguauuagaaaagaaaaaccccuuuucugaggagaaguucaagccugcugcagaaauuugcauaaguaacgaggaaacaaguguuaaucaccaagacaauggggaaaaugucuccagggcaugugagaggucuucauagcagccccucccaucacagacccagcggccuaggagguaaaaaugauuucaugggccagucccagggccucccugcucuuugcaaccuagagacuuggugcucugcaucccagcagcuccagccauggcuaaaaggggaaaucuuuacguagauuucagaggauguauggaaacagcuggauguccagacagaaguuugcugcagagguggagcccucaugaaaccucugcuagggcaguguggaauggaaaugugggguugaagccccuacacagaguccccacuggggcacugccuagcagagcugugagaaaaggaccaccauccuccagaccccagaaugguagauccaccgauagcuugcccugcacaccuggaaaagcugcagacacucaacaccagcccauaaaagccgccaagagaggcuguauccugcaaagccacaggggcggagccgcucaagaccaugggaacccaccucuugaaucagugugaccuggaugugagacauggagucaaaggagaucauuuuggagcuuuaaaauuugacugccccacuggauuugggacuugcauggggccuuuagcuccuucguuugaacaauuucucccauuuggaaugguaguauuuauccaaugccuguacccccauuguaucuaggaaguaacuagcuuuuugauuuuacaggcucauagguggaagggauuugccuugucuuggguaagauuuuggacaguggacuuuugaguuaaugccaaaaugaguuaagacuuugagggacuguugggaaggcaugauugguuuugaaaugugaggacaugagauuugaggggggcaggguggaaugaaaugguuuggcucugcccccacccaaaucuuaucuuaaauuuagcuuccauaauucccauguguugugggagggacuuggugggagauaauugaaucaugggacgauuuucccccauacuguucucaugguagugaauaagucucaugagaucuaaugguuuuauaaggagaaaccccuuucacuugacucucaucuucucuugucugccaccauguaagacgagacuuuugccaugauuguaaagccuccccagccauguggaacugugaguccauuaaaccucuuuuucuuuauaaauuacccagucucagguaugucuuuaacagcagcaugaaaacagacuaauaugacugccaagaccauaauucaguauuucaccaugucauuccuggauuauuacagcagcaacauagcuguucuguguccuuguccuuuuuccccacugcacuaugcuguauauugcagucaaaauaagccuucuugcuauucaccagcauucaacauccacuucagucccucaggcaucucacuguuugccuuauauucugugauccuacuuuaauuccugcuuuacaucuuuucuguuuuacaucauuuccuugucuccaaacccuauuuaauuacaucuaguagcugggacuacaggcacccaccaccacacccagcuaauuuuguuuuuguauuuuuaguagaguugggguuacacuguguuagccaggauggucuugaucuccugaccucguggucugcccaccuuggccucccaaaaugcugggauuacaggcgugagccacugcgcccagccauuuaauuacaucuuaaucauuguugaagccauagcucaaguacucugaaacauucguuagcuacuguaguacacauugaccuuuucuugacuucauaguguguagugaguucuguacaauuuaucacuuaaucacucauuuuuuuuccagugcuguucuaauaaacaagcuauuugaagguggggacaacaauuuugcaucuuuuuauuuuucaccuagugguagguacuagugaauaucuuuuuuuguuuacugcauucuuagaggcacuuuuauuuuuuucuacauauuguuucuguauuugauaacauaaugugguaauuuucucccaaaacaagauauuaaacugauguuacacuuuacagaauaaaggacuuaacagcaauugauacuuuuaaaaauugcauuugugaaacugaaguaaucauuuguugagaguuucaguuuucccaaucccauaucuuucacuauguaccuagauuuaauaauguguguuccaaaugaaagccauuguguccuucaucuaaaaaccacugagcagaugacuaccacaugguucagcaaccuuucgugacugaguauacaacaguaguuaggguuuuauggacugguuaguuauuuuguauuccagccuaguucccaagagauaaacuuggaauuuuaaagaccccuuaacauugaauuggagauggcuuuuuuaaguuugguccuagcagaggguuugagcuauuuuuuuuuaggagacaagacccaaggcuaagauaacuuguuugaguuauggccaaagccugaagguggcaaaggaagccugucggugagggcagauaaggaaggagguagauuuauuugggaaguauggaagaaauaggacuaaaauaggaaaacaacugugagggccugaaguguuucaaauucauacaaguggcuacccuggcuacugauguagagcuuucuuuccuuccuuccuuuuuggguggggggcagggguccaaagaucuugcuuuuaaagacccuuucagcuuuaaaauuguauuuuauauugugcuacuugguuacagcagugguucucaaauuaugacccuauuagcaccaccugggaacuuguuagaaauuuaaauuugggggcucccccaacccagaauugcuauaacagaaacucuugggcuaugguuagcaguguuuguuuuaacgagucuuccgggagauucucauucucuaacugaaaccgaaguuugagaaacuacuggauuagaggagucaucuucuuaaaaacaaaacaagcacuuugggaggccaagacaggcggaucacgaggucaggagaucaagaucauccuggcuaacacggugaaaccccgucucuacuaaaaauacaaaaaauuaaccaggcgugguggcgagcaccuguagucccagcaacucgggaggcugagguaggagaauggcgugaaccugggaggcggagcucgcagugagccgagauccugccacugcacuccaaccugggcaacagagcgagacuccaacucaaaaaaacaaaacaacaacaacaacaacaauuaggccaaagucucauguugcaaaguuauaguaugguagucccccauuaucugcaguuucacuuucugaaguuucaguuacuugcagucaaccacagaccaaaaauauuaaauggaaaauaccagaaaaaaaauuugugaguuuuaaauugcucccuaaucugaguagugugaugaaaucuugugccauccugcuccauccuguccuuuagucacuugauagucaucacaguuagguguaugguagugcuauguucaaguaacccuuauuuuacuauguauuauaauuacuuauuuuacuauuuauucuauuuuguucuuacaauuaaucauuaguuauuguuuaucucuuacuaugccuaauuuauaaauuaagcuuuauuauagguauguacaggaaaaaacauaguauauauaggguucuguaccaucugugguuucaggcauccacuggggguacuggaagauaucccucgagaaugaggggggacuacuuuauuuucaaucauucuuaaguccuccaagguggaauucauaauuccauaauuuuaauguuuuugaauauaauccuacagccucauuuuaaaaguuuaaaguauuguaaguauacacuuuuccucuaaacuaaaaucuuuagugucaguaauuguguauuaaaugaacugaugaaaaaaauuaaacacauaguguuuagucaucauuaucuucuuuuuucuuuagagcacuuagugucuuaaucauaguuuuuuuaaguucccagucugauaauuccaaaaucugucauaucugagucugguucugaugcuugguuugcugcuucaguugaaugaaaaagauggaacauaguuccauaguucauuuacauaguucaauuacauaauuccauaguucaauuccauaguuuaauuacaaaagguguaacauaagcauaaugggaauaucagaaguggaagaaagaaaggaacagaagaaauauuugaaguaauaauaacuugaggauuucccagaauuaaugacaaacaccaaauccaggaagcucagaggacaccaagcaugguaaauaccaaaaaaaaauaugccuaggcauauuuuacucaaccuguagaaaauuagagaaaaucuugaaaagccagagagaaaaaaaccacuguaccuacagaggaauaaagauaagaauuauaucauauuugaacugagaaagcaugcaagcaagaagaaagugcagugaaauaucgguguugaagaaaaagaaaguaaaaccgccaaccuagaauuuuguauccagcaaaauuauucuucaaaagugaaagagaaauaaugacuuucucagagaaacaaaacuuggaauuugucaacugguagaacugccuugcacaaaaugugaagaggucuucagagagaaggaaaaugauaaaggucagcaauucaguucuauauaaaggaagagugagaagaaauaaaugaaaauaaaauaacaccuuuuauuuuucuuauauuuacuugaucuaauagauaacaguucaaaauaauaacacuguauucauugaguacagcucauggauaagcgaaaugaauaacaacagugucauucacugcugggaugaaggaauugagaauacucuaagguacuugcgcuaaucgugaagcaguauaguguuauuugaaaguggacuuggauuagucauaaauguauauugcaaacucuagagcaaccaauaaaaaaaauuuguuaauaaaggaaguguaauugguugcuaagagacuugagaauauggaaucauauaaaaugcucaaauucagaauggaagacaaaagagaaauggaaacaacauggucaaugaauaguaaaaaguuaaagauaugguccauaucaauucaguuauaucaguaaucauuucaaguguggauguuuuaaauaacaccaauuaaaagacugucagaguggauaaaaaaacaagacucaacuauauguugucugcaaguuuauccuuuacaguaaccaauuucauuuuaucauuuaguaaccaauuacuuguaauauauuucaugaauguguuguaacacugaaguugagaaccuuugcaaaauacuauaagccaguggcaaagugcuuaaauuacagaggugaagaggaaauggccauauuuggugccaguguuauguauaaaccacuuaauuuuucuacuuagaauuaauuuuacaaguaauuauugagcacuucuuauguggauucugauuuuuuuaaaacagguugauugagauaauuuacauaccaaagaguuuuuccuguauuaaauagauuugaggaaccuccaaacagaaagcaagcucccuuuuguucuuugaugguuggccacucccacucccauccgaguuuugggugcuaccuuucuuuggggcugcaguuuacuuuugaugcccuuccucaguaaaggguuucagcuauuuauagcuuucauuauauucaugguaauaaggaaaucauuggguacaaacuugaaaaguaguggguaauuuacaucagggucccacuuuuauuaaauagcaggucuuaucacaaugcuuaaguauuuacaauuuucucucuguauuacuuucuuauuccaucuuugcuucuagcccauuuaagccuggguuuucuuucucagcuccuuuuaucacuuuguucuuuuuccuccagcucugccucugaaauuaagugcccagucuuuggcuuccugaaaaugaugaucagaguuuguuacuuaacaguuucccugaacuaauuuccccuaggguguacuguaucuguuugucacucuuuccaaagguauuucuugcuuuuaauccuucuuuacaugacuucccucuggguaacuaguagguauuccuguugaauaccuacauuuguauuuccuuuuacucuuuuaauuaaucaugaauuccccaccuuuccugauagucacuaugauagguagacucuguagguggccccaaaauauuugcauugguguauuauuacaucuccuuuaaagcuuguguuuaauaaauauggauuacauuuuuaucuagucuaaagacacaagauaauagccaauaaauugugaaaggaaguauuuccucaacacuucuguaguacagaguguuuguaguggaaaauucagaaccuccuauuuugucucccugucuuuuguugcuccuugaauuuuucuccauccccuuuuuguuuucuuguuuuuccucucuuguucuuacccuuuucccguccucuuuuuauauuuuuucucugucuuccacuuccucucccaucauaaaagaaaauaguuauucauauaauuuauaaaaguauugugucugcuuuuaacauuuagaaucugagaaguuaacagcuuuuuauuagguuguuucaaaguuuaauuagguugucuaagaaaauaugugauuagccuuugauauaaaaauauuauuacaaaaucauuuaauaauguccuauagggaagaugugagucagcaagcagguuuauagaaggaaacgguuaugcuagauaguuuacuugcuuguagucuccagauauaaagauaccaaauuucaaccuguugcaggcaccuguugaaggcagagaggaauuaagcuagaaagacauuuuggaguuccuaacuucuaaagugagaugugauugggauuccugacuucuaaagugagaugugaaauguugugaauuaccuacauuuucagccuauuuggagagaaguacgauuuaugucuugcuuuaaauaauagaauaaaaucucuauaauuguuuaaaaucaguuuuuaaguaaguuggagugcauauuccagcacuggcagugcaguauaaacaauggagagguagcucagacagggcuuuccauaaugaagacaaugacccaugagggacuguaacugaaacccagcaagagaaauccgguuuuauaagaaauuguuuugggaugucaguuguacaguguuuguuacuuguuuauauagcugagguuacauguguuaaucuuugcuaugacuuaaaagagauaaaugggcucuggaguuauuguggcagauuaaaaaacaaaacaauuauauuuuagaccugcauauuuuggcuguuuuggacuacaguuguucaucccuugaguuccaaauguaaaaauguuacauucaguaauaucuaauugugaaaucuuguuuguuacugcuguucuuguucuuuuuuuauucagaaucuuaaguaguauuuuuguuauaauacuaauacaaaucagugauaaaggaggcaucaacaaaucagcaggaggauuauuuaagaaaugguauuagugcaguugguuagcuguuuaaacaggcagagagagagaauaaauuagccucaaccccuaacaguuaucaacagaauuccagaugaauacauaguuaaaugcaaacaacagugggaugauuuucaaaaaguaggacaaaauagaaaugaacuucugauagaaugaaaaguuuucucuauuaaguagaagacaucucagaacaaacaagugaaaauagaaguuacuacuuauaaugaaaacccccaaaaaaacuuagguguuuuuuucacuuauacugaaucccuauuaaaagacaggacagaggaaaaugggaaaaugugaauggcuauguagucauuaaaauguuuaacgacuucauguaacuacguuaguaaauucuuuuguuaaaauauuagugggguuaaaaaaugccguauaguuaauacaguuuuacacagagaacugcacacacacacacacacacacacacacaaaauccuaaucuuggcaaaagagaguggaagaaaaauacaccaaaaaauguugcuuuuuguuaauguugggagugaugauacaguuuucaaaauauuuauuuucuucuuuuuaauguguuuuuuagccuuucugagaugaacaguuuacauuaaaaauacuuacuuuaaaauugcuugcuuacagaauuaaaauacuucauaauuucuuugcaacuugaguuuucagcuuaucuucucuauccuccuuucucuuacacacgguucccuuaccaggacuggcaccguucauuuuacaaaauuuuacaaaaauuuuaaugugaaugccuucaacuuguuccauuuuacuacauggcccaccacaucuuauuuauauuagguccagcugcaucacacauuuauguuauuugccuaucccugaagguuauccuucaaaaaaaaaaaagacugcuuauuauuuuuaaauuacgccaggauuuuacuguauagcuguaaaaagauucuguuguuuauguauaaugucuugagaaaauguccaccaugcaaugcuaaaugggaaaaaaaacuaguuuuaucuuuugugauuacugggauugguguuugcugaccuccacugauauguggguuuucuucaaauucauauguuaaaugggggaaaaaacaaaacaaaacagucgaaaguauaaaguaaacugagguagcauuuaucauggucuugaaagauguuacaaauauauaaguagaagaaaauauacccgaaguaaacagaugcucuuuguagggcuugguuuuuuaauuucuugaaaaauuguucauuuuuucaguuuucuugaugaguauguauuaaacuuuaaaaguauauaaaaauuaauugauacauuuuaacuuccaggaccagccuuaaugggguaauggguguuaaacuuacccucccuccaugaucaacuguaaaaguggauaaaagacaugaagcaacuggguuuuauuuggcauuagauagccaaccauagggcuaugauccuuaggagaagggaaauccaauagguaagcucacccuggcuauccaaacuguagcugagggaaauaaugcccaaauagagacuagagguuuaguaggauaaaggaaacagugauuggagugcauggcugcugaagcaguuggauuuguaaggcuucugcuggaaggaagagagcugcuuagagaagcuucagaaaccuuuauggggaucauucugaaucuuuaacugaaugccgaacuccacgugugcagggccagucucuucuaagaacaacuguuggggccuguagucaaaaggagguucuggagauuacacagugcugaaagacauaauuucaaacagcuaaauuggagaggucucgcucagcaccuugggcauuaauuaagacuucaggaugucuauagcauaaagacuagggcuacuuuacccauagaguaagaauuauuuuagaucaauucuacaaagcauaaagcuaaccuuuaaaaauacuagguuaaacugccaguaaauaacuucaugcaaaaacaaaacauacuuuaaaagaauuccaaauguuccacaacauaguacccacaaugaccagcuguauaaaaaauuacuaaacaaaugaagaagcagggaacuauagggaaaaaaauagaaauagacccagagaugacagagacauggaauuagcagccaacuauuuuauguugucucugguaaauaggcucaaagauuuaaaggaaaagaugaacaguauccaugcacagauagagaauaucagccaaaguagagcucuaaauaagaaucaaauggaaaaccuagaacaaaaaauguaauaucugaaaugaaaaauucacugaauaugcuaaaugacagauuggaaacuacgaagaaaacuucacugaaguuaacuacagagagaaaaaaggagaggaaaaagaaaugaacaagucucugugacucgugggccaauauauguguaauuggagucccagaagaauagauacuggagcagaaaaauaauuugaagauaugauuauugaaagauuuaugaauuugaagaaaacccacauaucauuggaggucagcaaacaccaaucccaguaaucacaaaagaaaucauaguagcacaacgaguacaauuacuuaaaacuaaaaauaaagagagcaucuuaaagacagcuagaggggcaggaauggggaagauacgugauauacauagggaaacaacagcaacgaagaccaacuucucaucagaaauaauggaggcuagaagacaauggaaccuuuuaagugcugaaagaaaaaguugucaaucuggaaauuuaaaucaaacaaaaauauauuucugaaauguaaacaaaauagacauuuugagaugagcaaaagcuaaaagaauucaucaccaucagacuuucacuguaaauaaugcuaaaauaaguccuucagucucaaggaaacugaugccagucagaaacucagaucaaaugaaggggugaagagaaccagaauugaucucucuguaggagaauauaaaugacuuuuuuaaaguacauauuuucugugaaagacaguuuuuuguuuaaugcaaaaauguuaacaauguuuauaucauguagaaguaaaagaucgugaaacagcacagagaacaguaguaagacagauugaauugcacuguuguaagaugaugaacuuacaauauuaagugaagguagacugugauagauuaaggauauauauuguaaucccuagagcaauugucaaagugguacagguaaaaagccaauagaggugauaaaauggaauacuaaaaaauaucagaugaauaauaaagaagacaggaaaugaggaacaguggaacagaaugaauaaaaaacaagaccauuaacuuaaucauuaauaauuacuuuaaauggguuaaacauuaugguuauaaggcagagauuuucagacuagauaaaagagcaagcuccaacuauauacugucuacaagagauauacuuuaaaguguauauuauauuuaaauauaaagauuuggaauaaauauaaccuaagaauacagcuuacuagggaagugaaagaucuguacaacaagaauuacaaaacacugcugaacgaaaucauaggugacacaaauggaaaaacacauuccaugcucauguauaggaagaauuaauguuuuuuaaaaggccauacugcccaaggcauuuuacagauucagugcuauuuguaucaaacuaccagugacauucuucacagaauuagaaaaaacuuaaaauuuauguggaccuaaaaaagagccugaauggccaaggcaauccuaagcaaaaugaacaaagcgggaggcaucacauuaaccugacuucaaacuauuauguaauacaaggcuacaguaaccaaaacagcaugguacuagcacagaaacaaauagaccaauggaaccagaauagagagucaagacauaaagccauacaccugaaaccaucugaucuuugacaaagucuacaaaaacaagcaaugggaaaaggacucccuauucaauaaauguugcuaggauaacuggcuagccauaugcagagaauugaaacuggacccauuuccuuauaucauauacaaaaaucaacucaagauggaauaaaaacuuccauguaaaaccuaaaacuauaaaaacccuggaagaugaccugggaaauaacauucuggucauaggaaccgggaaaggaaagauuugacagaggccaaaagcaguugcaacaaaaacugacaaaugggacuuaauuaaacuaaagaacuucugcacagcagaagaaacugucaacagaguaaacagacaaacuauagaaugggagaaaauauuugcaaacuaugcaucugacaaaggucuaauauccagagucuguaaggaacuuaaauuaagcagaaaaaaaaaacauuuggcuaggugcgguggcucccgcuguaaucccaacacuuugagaggccgaggcggguggaucaccugacgucaggaguucgagaccagccuggccaacaugaugaaaucccaucucuacuaaaaauacaaaaaauuagcugggcaugguggcaggcaccuguaaucccagcuacuugggaggcugaggcagaagaaucgcuugaacccaggaggcagagguugcagugagccgagaucacgccacugcauuucagccugggcaacaagagcaaaacucugucucaaaaaaauaaauaaaaugaaauaaaauaaaaaccauuaaaaagugggauaugaacagaugcuuguuaaaagaagacauucacauggccaacaagcauaugaaaagaugcugaacaucacuaaucauuagagaaaugcaaaucaaaaccaucuagucagaauggcuguuauuaaaaagucaaaaaaaaagguuaugcuuccuggucagggaacaacagaaagaugcugguaaggcugucaagaaaaggaaaugcuuauauacugcuaguggaaguauaaauuaguucagccacuguggaaagcauuuuggagauuucucaaagaacuguaaacggaacuaccauaugacccagcaaucccauuauuggguauauacccaaagaaauagaaaucauucuacccuaaagacacauguacacacauauuuucacugcagcacuauucacaauaacaaagacauggaaucaaccuaaaugacaauccaugguagacuggaugaagaaaaugugguaaacauacacuauggaauacuacacagccauaauaaagaaugagauuauguccuuugcagcgacguggauguagcuggaagucauuauccuaagcacacuaaugcaggaagagaaaauuaaauacugcauguucucacucauaagugggagcuaaacauugagaacacauggacgcaaagaagagaacaacagacacuagguccuacuugaggguagaggguaaggguuaaaaaagcuaccuaucagguacuaugcuuauugccuagguaacaaaauaaucuguacaccaaaucccugugacauagcaauuuaccuauauaacagaccugcacguguaccccugaaucuaaaauaaaaguuaaaaaaauauuuacaauaaauauaaaaggauggaaaaaacauguacuaagcaaacacuaaccauuagaaagcuggaguggcucuauuaauaccagacaaaauagucuucaggauaaagauuauugccagugauaaaguggauauaucuugaugauaaaaguaccagucaucagaaaaacauaaaauccuaaauauuuauuuauaucuaauauuggagugucaauguauaugaaguaagaacugauuuaacuaaagggagaaguaaaaguuaauuuuguagucuugucaauuaauuaagaaauuauuacacuuuaacuuuuuauaauaaaccccagaagguauuaauguuuguauguuuucacucuuuuucucccagugucauccugcucacuacuuuuuuaucuaauuugauuccuucacucauuuccauuuguuuauucacuguuguaauauacauuuauucucuaauugugcaauucgaucucucuguuaucugauauugguguguagugggaauuguagguuuguaauaagacagacauggauuucaguccugguuucauuucuagauuuguauuuguaccucauuuugcaaguaauguacauaaagcacaauguauuggcacucaauacaugauaccauuauuauuugagagaguuuuuuugcuugguuuggauggaggugauuaucgccuucuuuguugcucgcuacacaugcuguuaaaguuggcuuuccgcuuuuccuaauagaauaacuacugccaugccuccucaccucuagaggccuagaugccauacagcgagcagucccucuguaucuguggggaauugguuccaggacccccauagguaacaaaaccagggauguucaaauuccuuauguaaaaugacauaauauuugcauguaacugcauacauucuucuauauacuuuaaauuguuucuaggcugggugugguggcucacgccuguaaucccagcacuuugggaggcugaggcgggcagaucaccugaggucaggaguucaagaccagucuggccaacgugguguaaccccaucucuacuaaaaauacaaaacauuacuugggcaugguggcgggaggcugaggcaggagaauugcuugaacccgggaggcagagguugcagugagccgagaacgcgccauugcacuccagccugggcaacaagagcaagacuccgucucaaaaaaaaaaaaaaaaaaaaaaaaaaagaaaaucauuucuaaauuacuuguaauaccuaauacaauguaaaugcugugcaaaucguuuuuauacuauauuguuagggaaugaugacccaaaaaaaguuuggguguguucaguacaggcacaaccaucucuuuuuuuucccccugaguguuuucaauuugugguugguugaauccauggaugcagaauuuacagauagagcugacuauauccuuacauaaugcucgcuggguuuucgccagucucccagguggagaacuaauaaaaaucaaagguaaaacacgacagauuggcucgauugagugaaagaauauggauuacugucauuucaugaguuauuuagcauuuaugccugaauauguugcuaccaaauaacagcuaugcauaucauuaaaacuguguacaauuaaagcuauaauuaaauaaauuguacauaucaugcacuucagcuaauguguagucagacuucauaacuaguacucaaguuguauggauacugacucauaaguuaaaacauuuaguggaaaagaugcccauguauuaugaaggauauaaagucuauaaagucuauauaaagucuauaaaguguguguuuuauaauaguacaugcauuccuuuaugacaucaagagaaagcaaucacacaaauucagaguaugugacauucucaagacaacuguccugggcucuucagaaagggaguauuguagaaaaaaaaaaaaaaaaguuguaacagccccuuacaguguaugaaccuagauuugaucugguucuaggggugaaagcucuguuagacauucuugagauaauuagggaaaaugcgaaaguggacugcaugauauauuguggaauuauuguuaauguuuuuagauggcauaaugaaauuguuauuuaggagauuuugcuuauucuuaguagauacauuugucuucuuauucuuaggagaugucagguauuguaauguauacaacuauuaaaauagugcagcaaaaugaauguauuauaguacauaugugucuauauagaaagaaaauaaauuugacaauggucaauauaggugaagcauauaguuuuugguuguacuauucuuucuaauuuuuuuuguuuuaaccauuuuuauguuaauaaauuguuggaaaauaccugcaaauacuuggcaauuaaaaauauaccuccaaagaauauccguagagccacgcaugguggugugugccuguaauucuugcuacucuauaggcugacaggaggaucacuugagccaggaauuugagaccagucugggcaacauagcgagacccuaucuauauuuuuuaaaaaagaaagaagaaaucaugacaaaaauuagaagauguagaaaauuugaugauaaugaaaagauuccacaucagaacuuguaguuguagcuaauugauauuuauaaauuugugauuuaacuggcuuguacuuggggggaaaguugaaaauuaaugaguuaagcuuugaauuuuagauaaaaaaugaacagaacuaaccuaaagaagguaagagguagaaauugauuaaauagaaaauuaaaguaugauagggucaguagcaucuaauuugguuucuuugcaaacuuguauuaaauguuccggggucagaagugacagaucaagaaaaaaguaggugcaaauaauauuagaaauaaaaaugagucauaacuauggaugcagcagaggugaaaauaagaauauuauaagcaacuugaugccaauaaauuuuaaaacuugaauacaauggaugcauucuaagaauacuuuaaauuacuucaguauuagaaaacuuaauugcccuuuaacuauuaaggaaauggaguuaguucuuuaaaaauugcccacaaagaaaauaccaaaucaccauaguuuuguaagugaaaucuacccaagauucuaggaacaaauaauucuaaucuuauacaaacucagaacuuaggaaggaauucucugugguaguuaaaaaauauguuuacaaucucuugauauuuuggagcccuguuccccuugccuugagugugggcuggaccuaaucaugcaauucuaacagaagaaaagcagacaugguggugugggacuucagaacauaguucauaaaaggcacugcagcuccauuuucacucucuugaauuguuuguucuggcagaaggcagccaccacaucaugagguaagaagcccacagagaggcucuugugaugagguauaaggccuccugcagugugagugauccaucuuggaaaugauaaugcagcuccugcugauauccugacugaaaccucgggauagacuguuagacagaacccacccaccucagugacuccuaaguuucugacacagaaacuauuagauaaaaaauguuuguuuaaaccauuaaguuuuugaguaguuuauuauacagcaauaaauagcaaauauacauuccuacucauuuugugaggcugguauaaucuugguauccaaauagaauauaagaaugaccuuuaauuuuacuaucccacucauaaacauaggaacagaaaaucuaaaacaaaaauuagcaaauugaagccacaaguguauaaaaaugguaauaacauccuagccagcuugagucuguuacaggagggcaaagucgguucauuagaaaaucuguucauauaauuuaccacauuaacagaugagggaagucaaguuauuugauuaucuaaauugaugcaggaaaauaaauaacacugaauaucuguuuuaugauaaaacacuuagcaaguuaggaacagaaggggacuucuuuaacuugaugaaugguaucuacagacuacaauagauuuaacagucagcccucuguaucuguggguucaaccaacuggauuugaaaaaagaaauauaaaaugauacaauaauaauacagauuuuaaaaacaugauacagcuauuuacauagcacuuacauuguauugauuacaaggaaucuggagaugauuuaacauacaugaaggugugcauagguuauaugcaaauacugugccauuugauaaaagagauguaagcaucugcagaucaugguauccaugggagucauagaacuaguaccuugauacccaccaagggacaauuguacguauuagugaaaaaguuguaguuaaaacacugucuuuaaaauuagaaacaagaaauguacagauuucuuaguauauucagaaguuaaaaaaaugaguaaaacuuaauaauuagaagcuaacuuaccauacguuagucuacauggaaaacucaaucuacacagaauuacgaagauaauguagcaaaagucauuugcauuucuguauacaauaaaaaucgauaguguaauuaaacauuuucaauaacaaguagguucuuggaaauaaauguagcuauaguuauguaagacuuuauucuagaauuuuuuuuuuuuuuuuuuugagacagagucucgcucuuuugcccaggccggagugcaguggugcgaucucagcucacugcaagcuccuccucccggguucacgccauucucuggccucagccucccaaguagcugggacuacaggcgcccgccaccgcgccuggcuaauuuuucguauuuuuaguagaggcgggguuucaccauguuaaccaggauggucucgaucuccugaccucgugauccgcccaccucggccucccaaagugcugggauuacaggcgugagccaccgcgccugaccuauuauaggagauuuuaaaaccuuauugaaagauuuucaauaauguaggcauaaauaaauggagacauguuccauguucauugaaauaaauaucgcagauuuuuuauuucuuaauauauuuauaaauucaaugaaauuuuaaucaaaauauuuuucaaaaaaccugacagucugauuuuaagcuuuugguggaagaaaaaauggccuagaauagccaaagugcuccuaaagaagaaggacaaaguuaggaacuugccauaccaaaugccaagaguuacuauaauuacaguauuuauggcgguuugguauuugcacaugguuaaauaacuggagaugagggaaaagaauugagccuagaaaaaaacucaugcaugauggauacuugauauaagacagaggugagcuuucagauaauggcagcaaugggcuauauaauggugcuaagaucacgggcuaucaauauagaaaaaaagugaaauggauccaaguuuaccccuugauccacaaucaauuguaggugacaaagauuguaaaagaaaaucuuaaaaaauacuagaauaaaauauauacuuguuuuuacaggacaaaagauaguuuuagaguagggagggauacaaaugcacauaucaggaaggaaaugauuacauauguauguuuaauuuuuucuaauugaacuuuuuauuuugggauaauuguugguucacaucuagucauaagaaauaauauaaagagagaucauguguacccuuuauuacccagucccccaguggugucaucuugcaaaucuguagcgucauacacugucacaaccaaaacauugauacggucaagacaaaacguuuuugucacugcaaauaucccucaugguauccuucuauaucccuacccacuucuuaccuuucacccucaacuauuggcagucacuaaucuguucccccauuucuaaagcuuuugucacuucaagaauguuauguagauaggaucauaagucaucuuuugggaugggcuuuuuucacucagcauaauucacuggguguucauccagauuguucuagcuaucaauaauuuauuccucuuuauuauggaauaguacuucaugauauggauauaucacaguuuaaccauucucccauuguaggauauauggauugauuccaguuuugggcccuuaugaguaaagcugcuguagacauuuauguacagguuuuuaugugaacauaaucugcauuucucugggauaaauggagaaauguacaaauguacuguaccaaggaguacaauugcuuggucauaugguaguugcaaguuuaauuuccuaaaggauagcaaaacuuuuccagaaugucuguaccauguuacauucccacagacaaugucugagugauccaguuuuucaauauccuugccaguauuuggcauugacacucucuaauagcuguucuuauagguauauaguauacagugauaucucauugugguuguauuuguauuucccuaauggcuaaugauguuaaauaucuuuucauguguuguuuaccauuuauacaaacaucuguacuauuuguguauacucuuuggugauauauuuuuucaaguauuuugcauacauucuaauuugauugcuuuuuuugcuguugaguuuugagaguauuuuuaacauacucuauuuuuaacauauuucuuuguuggauauacguaugaaauguuuuuuuacacuaaagcuugucuucuuuaauuaacuuuuuuuaaaaaauaaacuuuauuucuuagagcaguuucagauucacacaaaagaagaaccagaagauacagaauuucccauacauucucugcccucaacaugcauagccuccccauuaucaacauccuacauuagagugguacaguuguuaaaacugguuuaccuucauugacacaguauuacccacaguccauaauuuacauuaagcuucacuccggguguuacacauucuauggguuuggucagauauauaaugacauguauccaccauuaaaguaucauaaagaguaggcuuacuacccuaaaaguccucugugcucugacuauacauucuucccuccccucuaacccuuggcaaccacugaucuuuguacugucucuguaguuuugcuuuuucccugcaugucaauaguuguaaucacacaguauguacccuuuuuauauuugcuucuuucacuuaguguaguauacauuucaguuucuuugaugucuuuucaugucuuguauagcuaauuucuuuuuagcacugaaucauauuccauuaauagauauaccacuguuuauccauucaccuaccgaugacauuuguguugcuuccaaauuuugacuguugcaaauaaaucuacuaaaaacguguaccaguuuucguaugaauguauuuuuuucuccuuugaguaaauuucaugaagugcaauugcugggucauaggguaggaaucuauuuaguuuugugagaaacugccaaaaugucuuccauuuugcauccccaccagcagugaaugcgagcucugguugauccacauccuugucaggauuugguggugucaguauuuuggauuuuggccauuuuaauagguauguuuaguaucucauugguguuuuaguuugcauuuuccugaugacucaugauauggagcaucucuucaugugcuuauuugccaucuguacaucuucggugaaguaucuauucaggucuuugucccauuuuuuaaugggguugauuauaagaaucuuucuguauuuuggguaagucuuuuaucugaugugucuuuuguaaauauuuuuuucuccaucuguagcucaacuuucuuuucucuuggcagugucuucugcaaaacagaaauuuuuaauuguaaugaaguccagcucaucaaugcuuucuuuuauggauagugcauuugguguuauaucuaaaaagucacaaacacaaggucaucuaguuuuucuucuauguuguguucuaggauaaaguuuugcauuuuacauguaggucuguaauccauuugaguuaauuuuugugaugaguguaugaucugucucuaguguuuuuguuuguuuuguuuuugcauauggauauucacuucuagcacuauuuguugaaaagacuguuuuuucuuuguuguauugccuuugcuccugugucaaagaucaguuggcuauauuucugugacucuucugaaaaggacuguagaggauugauauacuuucuuuuuuaaauguuugguagaacuuaccagugaacccauccagacccuuugcuuuugguuuggaaagauuauuaauuauugauucauuuucuuuaacagcuauagcccuuuucacauuuucuauuucuuuucugauuuugcagauugugucacccaggaacuaguucauuuaauguauguuauuacauuuguuggcauagaauuguucauguaauuccuuuauuaucuuuuuaaugccaggggaucuguagugaugucccgucuuugauuuccagcauuaguaaucuguguaucuuuuucuuuuuuaagccuucuuuuccuaguuuccuacgauggaagcuuagguuauugauuuuaggucuucuuuucuaauauauguauucagugcuauaaauuucuuucuaaguacugcuuuuguuguuucucacaaauuuugacauguugcguuuucauuugaauuaaaguauuuuacaauuucucucaaaauuucuucuuugacuuacgcguuauuuagaagugcauuguuuaauuuccacguauuuuggaauuuuucagcaaucuuuguuuaugauuuaauuccucuguggucugaggggagauacucuauaauuucuauuuuuaaaaaaauuuguuaagauguguuuuaaugcccagaauaugaucugucuuggugaauguuccaugugagcuugagaagaaugugcuguuuuuggaugaagugcucuauaaaaguccuuuauaucccauugguggugguguugaguucaacucuguccuuccugauuucauaccaguuggaccuguucauuucagauagagggauauugaacucuucagaacucuucaaguguaauagucuauucuguuucuccuugcaguucucuguuuuugccuuacauacuuugaaguuauauuauuagguucauauacauuuaggauuguuacgucuucuugaagcauucaccuauuuaucacuauguaaugcuccccuugcuuugaagccugccuuaucugaaauuaauauguuaacuccuacuuucuuuugacuaguauuagcaugacauaucuuuuuccauccauauacuuuuaaucuguauguauccuuguauuuaauaaaguuggcuuuuguagacgacauauaauugggucuuauuucuugauccacucugacaguggugucuuucaauuggugcauuuagaccauugacauucaaaguaauuauuuauauaguuggauuaauauuuaucauauuuguuauuuucuauuuaucguccuuguucuuuguuuuuauuuuugucuuccucucuuuuuuguuuugccuuuugugguuuugauugagcauuuuauuugauucuauuuuaucucuuuuauuggcauacuaguuauauuucuuucuuugcguuuuuuaguguuugcccuagaguuuucaguauacauuuacaacuaauccagguccacuuuuaguuaacgucauacugcuucacagguacugugaauacauuauaauaacaaaauaauccuaauuccugccucugguuucuuauauuacuacugucauuaauuuuguuuauauagaagcauaugugucuguauaagagcauacauaauucaguacauuguuccugugauuguuuugaacaaauuaucuguuggaucaauuaaaaauaagaaacauuuaaaacuugauuuuaccugcacuuuuuccuucucugaugcuuuuuccuuauuuacacagauuugcauuuugaccuuuauuauuuuccuucucucuaaagaauuccuuuuacaguucuugcaaggcaagucuacuggcaacaaauucccucgauuuuuguuuuugugagaaaauauuucuucuucacuuuugaaagaacauuuugcagguguuaguauucuagguuggguuuuuuuuuuuucucuugacacucucgaguguuucacuccacucuccuucuugcaugguuuaugagaaucagauauaauucuuaucuuggcuccuguauagguaugguauguuuuuccucuagcuucuuucaagauuuuuucucuaucuuugauuuucuguaguuuugagaauuauaugccuaaguauaguuuuuuuguuuguuuuguuuugcuuuugacauugauguugguugacguucucugagcuuccuagaucugugguuuggugucugacauuaguuuggggaaauucuuuugucauuauuguuucagaaauuucauguauuacucuuuuuccuauccuucuggaauuuccauuacacauauguuacacccuuuguaguuaucccacaguucuuggauacucuguucuggguuuuguuuucuuuuguuuuuucagucuuuuuucuccuugcuuuucaaauuuggugguuucuaccaaguuaaaccucaagcugagauucuaaccucagcuguguccagccuaccauuaaguccaucaaacauuucugguaguguuucuaaucucuugacauuucuuuuuaguucuuauaauuucuauuuauuuauauugcccaucuguucuugcagucuguguacuuuauccauuagaacccuuagcaucuuaaucauaaucauuuuaaauuccuggucugauaauugcaacaucccugccacauuggacuauguuuuugcuguuugcugugcucuugaaacuggauuuugccuuuuacugccuuauaacuuuuucuuaauaaccaggugcgaguuacugaauaaaaggaucugcuguaaauaggccuuuaguaaugugguaguaagguaugugggggagcauucuauaauguuaucuugaggucucagucuuuuggaaagccuguaccucugcccuguaaacuucacaagugcuucucagucucuccagugcccccuuacuuggaacaggauggcuagacuggucuggaguuggguuuugccuuuugcccaggucaguuaugcucugaugaagcuccagcaggauaggcucugguugauuuaauuucuccugaggguagcguuauuaggaacagaaugcuuuggcauauuucacaaugauuccuuuucuccuucccuugucuaaggcaugaaaguuaucuccaauauucagaggagguuuuucuuaaauauucacugggaaaaccuggucaagcucuuggagguaaaaguguggagaugcuugauuacuggauuucccuggaguuuaucucagacuuguucauucugagccucuuguaauucaucaguuauaguuuguuuaccuccuuugguacagauucucaugcagguuuguggcuuguggguuucugcuccagcaagcuacaauucucugcauuuuccuauuggucuuucccauuugggggguuugugauuugaccccugaucuuaccacucugacaaauccuaagaagaguuguugauuuuucaguuuuuuucggcuuuuuaucuuguagggcuuaguguugacuuacagcuucuuacaugcuggaccagaaaccagaaguccuagcucuuuuuaaaaaauuaaucugcuuaacagucuuuuguagagcacaaguccaauuuaucaguuuuucuuucuauggauaauauguuuggugccaagucuaagaacuuugcuuugcccuagaucugaaagaguuuauugcuuuuuuucucaaauguuuuguauuucuauguuuuacauuuaagucugugauccauuuugaguuaauuuuucuguaagguaugaggcuuagcuugauguuaauuuuuuaaaaauuuguuuuaauuauaguaaaaugcaacuaagauaaaauuuaccacuuuagucauuuuuaagagaacaguucaguagcauuaaguacagucacauugauuguagccaucaacacuagccauccacagaacucuuuucaucuugcagaauugaaacucuguacccauuaaacaauacccccccauuuccuccuccuucuagucucugauacccacaguucuacuuucuaucucagaauuucacuacucuagguaccucaugaaagugaaaucuuacaguguuugucuaguuuggggucuuuuuuaauuuuuaauuugacauaguuauuuuaauaguacauguauguauuuauggguaacaugagauauuuugauacaggaaugcaaaguguaauaaucacaucagaguaaaugggguauccaucaucucaugcauuuauccuuuguguuacauacagcccagucauacuuuagugauuuuuaaauguucaguuauuuuuuacuguaaucacccuguugugcuagcaaaugcuaggucuuauucuauuuuuuuuuuguaacuauuaaccauccccacuuccccacaccccacccccaaccccaaccuucaagccucugguagccauccuucuucucucucucucacuuucuccccaugaauucaguuguuuuaauuuuuaccuuccacaaguaagugagaacauguacuguuuuuuuuuucuguacauggcuuauuucacuuaaaauaaugaccucuaguuccaucuauauuacugcaaugacaggauguuguucuuuuuuauggcugaauaauacuccauuguguauauguaccacauuauccauucaucuguugauggacacuuagguugauuccauaucuugaccauuguuaauagugcugcaguaaacaugggagugcagauaucucuuugacauacugauuccuuucuuugggcuauauagcuagcagugggauugcuggauaauauggaaucucuauuuuuaguuuuuugaggagccuccaaacuauucuccaucaugauugugcaccagccacugugucccccuaacaguguaugugguuucucuuuucuccccauccuugccagcauuuguuauuguuuuucugugacuggcuuauuuuacuuagcauaaugucuucaagauucauuuauauuguagcaugcaucacaauguuuuucuuuuuuaugucugaugaauaauauucuauuguauauguguaucauuuuuuuuuguccauuuauccaucaauagacacaugcauugcuuccacuuuuugguuauugugaauagugcugcucucaacauuaguguacaaaggucuguucuagucugugcauuuauucuuuuugauacauacucagaaguggaacugcuggaucauaugguaauuuuaauauuuugaugaaccaccauacuguuuuccauaacagcuacaccauuuuccaucccuaccagcaguacacaaggauuccacuuucuucacaucuuuacuaacacuuguuaauuuucuggguuuuuauauaauuuuuauuuuuaauaguagcuauccuaauggauguggggugguaucucuuuuuuuaaccugugagugucugauugcuuuagcaccauuuguuggaaaagcugucuuuccuccauuuaauaacuuucacuucugucaaaacucacuugagcauauuugagugaguuuauuuccagguucuuagucaugcuucacuaauauauguuucugucccucugcuaauagcaggguagugacuagcuucauaaaaugaauugggaaguuuucucucaucuucuguuuucuguaaaggaauguguagaauugguguuaguucuuaaauguuuaguagaaaucucuagugaaaacaucugggcauuuacauucaauuuuaaaguuuuguuagucaaacuugugucaacauaaugagagugaaaggguaaaaucacucugggaggagaagugagagaagauaguugcaauauaacugaaagaagguuaguauuugagauaaagacauuuuacagauuucuaagagagaaacaaaauuugggcaaaaagcauaaucaggcauuucauggaaaggaaauguguucaaaaaccuagagaaacuuguucagacuuguuaguucucagggaaaggcaaauuaagacagccuuuuccuacccacuggaauuggcaaaacuugaguuuccugcuacuggcaauuacagcuaucugcucugaaaacuaaaguguuacucacaacuucauuuuauguucucucuccuuuggugauguagaaagagcauuuaauucagaccagggauuuggagaaauuagacaauauuuuuuggaguaugugcuuugucuuaaauuuuugaaaugcucuccacaagccauagaaaacucuucuuucuuaggggaaaauacucuucuuuugccuuuauugucuuaauagaugccuuuauaggcauucaggugccuuuugguucuagacaauaugaucguuuuagauguuucuguguauacuacuuauucucauuggucaguuacuucuuuaaacuuugugcuuugagguucacagauuauugagcacgccuaguuugaacuguagcagguuuagaguaaggugcaugacccugacucgcauuugauuucauuaaguuccuuuuuuggucuuaagagcauaagacuaaaauaagauuauuugggguaagauuuuaauuacacucauacuauauuccauugccauuauuacuugaauguagguauggguagauaguauagcuccauagaucauuaccuuuugguuuugaucaaaucaaaaagguguuccugaucauuuaguuauuagacuuuacauuaaaauauuguaaggaucuagacccucaaagcuuuagccuacaauauucucauauugcuuacaaauacucuggcacugauuuucccuggguuuguaggaguagccuuaccugugcuuuuaaaucagcauuccccaacauggucuaauaguuucucaagaugauccaugaaaauaaaguguuuuuuucauuaguuugggaaaugauguaugggauagcucuucaacccacucucaaauagauacaacguauguuagcauauuaagguucgugaucaggccaggcucgguggcuuaugcccauaaucccaacacuuugggaggccaagguggacagaucacuugaggccaggaguucgagaccagccuaggcaacauggugaaaccccaucucuauuaaaaauacaaaauuagccaagcguggugguacgcaccuguaaucccagcuacucggaggcugaggcaggagaaucaccugaacccgggagguagaaguuacaaugagccacgauugggccacugcacuccagccuggggcaacagagugagaguccaucucaaaaaaaaaaaaaaaaaagguuuuguuacagaaaagaggucccaaucagaccccaagagaggguuauuggauuaaaugcaagaaauaauucagggcaggaccauagaguaaagugaaagcaaguuuauuaagaaaguaaaggaaugaaauaauagcuucuguauagacagagacgcccugaggacugcugguugccuauauuugugguuauuucuugaugauaugcuaaauaagggguggauuauucaugcuucccuuuuuagaccauauaggguaacuuccugacauugccguggcauuuguaaacugucauggugugggugggaguguggcagugaggaugaccagaggucacucucguggccauuuugguuuugguggguuuuggccggcuucuuuacugcacacuguuuuaucagcaaggucuuuaugaccuguaucuugugcugaccucccaucucauacugugacuuagaaugccuuaaugucugggaaugcagcccaguagguuucagccucauuuuacccagcuccuauuuaagauggaguugcucugguucacacaucucugagaguuucaugaucagucuuguauuauaaggauaggggaacuuaauccuuaaauuaaaauccaauuuuaaacaauauuaaaauccuggcucauuuuauuuaacccagcaauuccuaaauuuaccugaacauuagccacuuucucuguggguuaccuacagauauuaggaagaagugucuucgcaaaguguacuucuagaauacgggcaauaugucacuaaucuguacuaacuuugcaguuuucuaucuguuccagguugucauaugguuggcuucucacguuuucagauaccuuuuauacuugacaacuuacuccugcccauguucuauuauaaucccuuacugacuguaauacauaaaugccuuaugaucugugccugugauucuugguuuuaagugaagagcaauaagauauuagcuuagucacuuuuuuuugguggggggagggcagauauugagauacugaucacuuugcuguccuaguaaaaucuagaaaggaauuaaucugcauguaucaugauugauggcacucuacccaagagauuggcaguuuuauguacauuuuggauguaagcccugucagaauaacagaugaccucuuuugucucuguaugcucaccucugagacagucauuauacuuucuuuuucuuuuuuagagacaaggucuugcccugucgcccagacuggagugcaguggcacaaugauagcucacugcagccucagacuccuuggcucaagccauccuccugucucagcaucccacauagcuggaucuauaagcacacaucaccacaccuggcucguuuauuuuauuuuauuuuuuuuguagagguagggucucgcuguguugucgaaguugguuucaaacuccuggcuucaagcaauccuccugccuuagccucccaaaguguugggauuacaggugugagcuauagcugcuggcccaaacuuuuaaguauagcucaugagacaugcugugccauagacauacacuguccaguacaguagccacuaguugcauguggcuguugaauacuugaaauguggcuaaaucaaauugagauguguuguaaguauaaaauacacauuggauuucaaagacuuaguaugaaaaagaucuuaaguaccucaauauuuauauucauugcauaucaaaauguuaauauuuugacacacuaaaauauuuuacuaaauguaauaucuguuuuuuacuucuuaauguacuagguaauuuaagauuucuaugguuuguauuauauuucuauuggauagugagacuguaggcacuucucccgcgaagugauagguuucagagacuaagccugauuaucuagguuuuuauaaagcuuucuggucuggggaaaaauuguguuacuuggcaguuuuucuguguggcugugugguuuuuguuuuguuuuguuuuguuuuguuuuuugagacagagucucgcucugucgcccaggcuggagugcagugacgcgaucucagcucacugcaagcucugccucccagguucaugccacucuccugccucagccucccaaguagcugggacuauaggcgcccgccaccgugcccagcuaauuuuuuuguauuuuuaguagagacgggguuucaccguguuagccaggauggucucaaucuccugaccucgugaucugcccaucucggccucccaaagugcugggauuacaggcaugagccaccacgcccggccaguguuuuuuaaacuuuuggccaaaaaacaaaugauuucuuauccauacaucgcuuugaaguagcccaaaaagagacuacuaccagacauuccuacauagaauuaugcuuuaggcacaggaaggaaaaugaaaaaucuagacguaucuaacuauauccuuaauaaauuauuuuaccuauuuccacuaauaacucuucuaucuuuaaaaauauaucaguuuugguaucuuccucucuagagcaucauuugaacauugaggagauuacuucguaauuuuuugaucuccuuagauagccuucuccuuuauagauugaaaugcuuuuaggcuggauuuucuuuccuuugguucuauuacugccuuguggaagagaauuuuaauauuaacuaucaaauugguuuucgaauuguuuugccuuuugugauaagaaaaguucugugauucuuggguuuaaguggaggacuacaggacauugaacuuggcgacuuuauuuuuuggaccagauuugggauacugaacccuuuacugcccuaauaaacucuuaacucuagaaaagaguaauaagucaugucuuacaaguauaccuguaggccauuuuagcuacaguuuuaagaaauguucucauauuaauuuauaugagacacugguauaguccguagucuucccauuaagcaccauuaccuggauaugccaccuuaauggaauucucauuuuaacuucagcucucuaaaccauuuccauuuugguuuucuuuuuuauaaucauuuaagcaccuaauaccaugggcugguuuaaugcuuuucaguuaaaaaaaaaaagacuuguacauacauagcaugucaccuauuaguggcaccuaaaguacauucaaaaaauugaagucacauuuauccucuuguuuuucucaauuuaaagaucugccuuaucucugacacaacuuuuucuuuuuuuuucuuuuugagacggcgaggcuugccaggcuggagugcaguggugcgaccucugcucacugcaaccuccgacucccucauucaagcauuucuccugccucagccucccgaguagcugggauuacaggcaugcaccaccacacccagcuaauuuuuguauuuuuaguagagacaggguuuuaccauguuggcuaggauggucucgaucuccugaccucgugauccgcccaccucggccucccaaagugcugggauuacagcacuuuuacgacuuuuucuuaauguaacauuagauacuaagcugcaugguuuguaacuuccucugaaacuaugcaguaggagaagaagaguuguuuuccccacugugcaauccagugauguuaucuugcccuguguuuuagcuucuuuuuaaauguuuuauauguuauaaaaacuuaaacaauaacaaaaaguuuuaaaagcuuuuuaaauguuugaaaagaaaguaaaggcuuaaaaucucaucucccagagagaacagucauccuuacagaugggucgcugugcauguagcuaucucauguuuucauuucauuauuuuuauggagauuguuuccuguucuguagacuagguaaauuugccuguauuuggaaccugcaccuaccucugaagguucagcacuagagggcacugaccuuuaauucagcuuauuuacugacaauauauaauguuucuaugacagaggaaguuccaaaaugguaagacuggggcacaaaauauucuucuugauuaaaaucccaguguaaaguggaggcauuauuaucagacauaaucauagcauuuuuaacuggauaauggagccaaauaaaaaucagugugugaccuuguacaagucauuuuuuauccuaauuuguaaaugaaaggguuagacuagauuuaguuuuaauguagcauuuauuaagaaccuauuacaugcuuguuauuacaauauggcuuuuuauguaaauguugaaucuuuauuuuaaaaacucgagauguaguaugccucgggaaaaaugauucuucuaagucaagggcauauagcuaguaguugcagaauuggaauucuuccugucaagaccauguuuuugguuccugcuauauuuaccaugguguuucuuacuaaauaaauuuauuugaagaucuucuuaacuuuaaggaguauauuauaugugcaaaugcuuuccuguuauuugacauauuugaauccuguugacucuuugagcuuuuaauauuaauaucaaccugaaaaugcuugcauuaaagaaaacagggaaggcauauagauugaggcuaaagagagcagcacaauuuguucaguacucugccuccccaaaauacauauuuuuacaauccuguuagagcaaauuagcuauuuuuaaauauuacaaugguaaaauucagcauuuggagcaaccagcaaucacguaaggaaagauaccuauacguggaaggacagcaaaaaaggaaaauaacucauuagaaagcaaaaaugagucauuauauccuacacuuucaaauaauauucuuucaguaucacucagugguaacuuaaguaaauacugauuaacagucacucaguagacugguuauagugguugaaucuuugauuuacagccuucucuuguaaauuuuaaguuuuucacaguuuaaaucaacaucagaagguuuuuaggugucagacugcagucucuuagcuguagguccuacaugguuuauuugcuuuuccuuuuaaaaggaucugcuaaguccuuccucucuuuuaacuuuuuuuuuuuucuuugucagagauggggucuugcuauguugaacaggcuggucuugaacuccuggccucaagugauccuuccaucuuggccucccaaagugcuggguuacaggccugagccaccacacccaguccccucuuuuaacuuuucauuguaaaaaauuucgaauguauacaaaaggagagaaaagacaaugaacucucaggucuuuauuauucaacuuuaacaauuaguuucauagcuaaucuuauuuaucuguaagucuucauugguuauuuugaagggaaucccagacaucauaucacauuuacaguuuguuugaaucaguguccuuauggcuacugguggauaucucucaaacuguagaucccuuuaaaaaauuuuuucuugaaguuuuuuauuuguugaagaaauuggauccuuuguccuauggaguuucccacagucuggauuugcugauuuuaucuucauggugcuauguagcauauuccucuuccccuuuauuacuauaaauugguaguuaaauagagauauguuucaauauuucagcaagaauacuuuguaggugguguugcguacuuacauugggaggcugagucccuuuuacucuaauggaacauauuuccuugacuauacugaacuagacauacguugcucuagggagagauguuuuucuuuugagggcgucugaggcaaaagucauucuaggucccauucuuuuuuuucuuuuuuauacugccuccacuacagcauuccaccuuugaacuucagguuagggauuguugggaagaggcuauuacccaccuguuguaugcuccuaaauuauuuaguuaagaauguagaaaccaagugacuauucugaauagcagcaaauacaguauaucuaaaaaaguuuuucccaucucuuuagguuuccugugguacauauagccaccgucccuacgagaaagguucagcuagcauugcuguaucaaguucugaauauaucauugccuuuuuguaccuaggcuuucuugaacauucugcaaagacuuaauaaaugauauuuauaacaucacaauuuucuggauuuugaacuaauucagcacuagcaagaccauauucucauccugggggagagaaagcagagucagugcccagaugcacuuaagugguauauuuaccucuagcauuccagaauccuggaaagcccaucuuccugcaguccaccccuugaaucuguuuuaauacccuuugacuucugugguucaaauauauaguuuguaucaaagaccaugauccaaauacuuuuuuuccacacuccuaucccuacuuugcuucccuuucucucccuucucuuucuuccauccuuccuuuuauuggucacauguuuauaauugccuaacguguaccaggcaaagugcuagacuuaggaagcagguuaacaagacauaggccuugugugcaagggaagggauggcccacugggacauuucauuaucuauaugaaaaaaaaacuaucacaucacacauggaauccagaaaaacucagcccccaaaugugaaaagcaaaaguuuagaagaaaauaaaauaacuuugggagcucacgguaaggaagauuuuuaaaaacaugucaaaagcacuuuucauaaagaaaaauauuugacuauauuaaaauaaaaauuuuccuuggacaaugaacacuguuuaaaaaaagcaacaugccgcugauggcgauguaacucaaguaguugacaaaagauuaguaucuaaaguauaaaaagagcuucuauuaguaaauaaaauaauaaaaaccaccaugcagaaaaagggguaaaggauaugaguaggcaauucacagaagaaaacuuagugaucagcaaauacauuaagguguucaacaucacugauuaaaaaaaaugcauuuuaaaacaaaauauuucauacccauccgauuggcagaagucugucauuaccaauuuuggagaggauagagagaaaucagucuuauacacagcugauggaguauagauuggccaaaauuaccuugaaaggcaauuuggcaauaauuagaaaguugaagaucaacauacuguagugugugugcgaauauuuguguauguguccaagaaaaaguccugcaauaugaauaacaagaucuccauaccaaacauuuguugcaauguuguauguuacaguacagagcuggaaauaccguuaagagcccauuauuaaagaauaaauaaagcaauggaauaccgugcauauuaguuugcuagggcaaccauaacaaaguaccacagacuugauggcuuaauagaaauuuauuuuauuuuauuuuauuuuuaccaguucugguggcuugaggucgaagaucaaggugccagcaggguugauuccuuccgagugcuguauccguuccaucagauacagcacuuggggguuagggcuucaacauacaaauuuggggaggggucuggacacacaauugaauccacacuucuauguaacaguuaaaauggguaaacuagaauguaucaaaauagauaaacuucuaaugccuauuaaguaaauuuuuuuaaaaaaaagagugauacaugccgcagaacuucaugccugugaaguaaacaaaacuauuguauuguuuauggagauagucagcauuuguaguaaauguauauacauucaugggaauaauaacaacuucuggauagcggucaccacugagaaaggaaugguggaaugagauaggaaaagaucccauggggacuuuaucuguaaaguuuucuuccuuaaagaaaaaaggaaaaaguugaaguuuguucaaacuggcuagcagguacauggguguuauauuauucuuuauaacuuuccuauauauuuggaaccugauaauauuuuuuaaaaagcaaagaaaauauaugaaugaaauaauguuauuaauagaaguugaaaauucauuuguguaauaugaucuaguaaucaaauaucaggcacaaguuaccuuaugauaaaguucauucuucuggcugaaauuagauuuuauguuuagaacaacaauaaaaucaauaaaucuuuauagcauccuaugucaaaagcaagauguuuacuuuccauacauaaaaacgugugagcuuuugaaaugacucauuuguagagcauugaguugcguauauuagggaacuucuuauaauguaacacaauacauagcauaugucauuuuguucuagagcaguggcucucaacuagaaacaaguggaaauaauguggggcaauuuuagcugucagaaugucuaggaagcacugcuggcauuuagugaacaccacuguaugauuccaaacaucuuauaaugcauuugauaaacccauaaaguaaagcagggugccauccuaaaugucaguaccugguugagaaacacgggucuuugguuaauuuccuuucaugaaaaguagagucucuaaaauucauaagagcaggcaaguacuaagaacaaugacuauuucaaaggcaacuuggauuacagagagaaacagaauugauaguuugcaaucuguugauuaggcacuaguaguaucuaaaggaaguuuuuucuuaauuuuaugauccuaauuauuuuuuauuaaguaaaauuaauaacauaaaaauuaaccacauaaaguguaugauucaguagcauuuaguaacuuuacaguguuauguagccaucaccucuaucuaguucaagaacauuuuucaucauccaaaaggaauaugcauuaagcagucacucuucauuuccgcaaccccaaccaaccacucaucugcuuucuaucucucuggauauagcuauucuggagauuuuguauacagggagucauacaauaugugaccuuuuaugucugccuucuuucacuuagcauaaaguuuucaagguuuauccauauuguagcauuuguugauacugcauuccuuuuuaugguugaauaauauuucauuuuaauaauauaucacauuuuguuuauccauucauccacuuauggucauuuggguuguuuccuccauuugacucuugugaacagugcugcuaugaacaucagcccauuuguguagagguuuuuguuugcauuccuauuuuuauuucuuuggguggaauuguuaggucaagugguaauucucuguuuuagcuuuuugaagauaugucaaguuuuucaagagcagccauaucaucuuucauucccacaagcaaugugcaaggauuccaauuucuccccauccuuaccaacagaauccauuauuuuuaagaagacaaaguaagugaauuuaaaugucuucauggugugauuccgaauguuuuuuauuuccuuuuuuucuggcuacaccuuuuuagcauuagccacuauuaugacuauuauuauuuuuuuaaauauaaaaaauuuuguuuuauagcauaugagcaaacaaaaguaaaaguaaauaguuuucauuuaauauaagcaaguauaagguaaaaauaaguuuugcuaugauggacugcgagccaagucacaaccuacaaaagggaucugaagucaauguguuuuuaacggaauuaauuauuuuauagggguagaagcuaagaguuugauuuguccugguaaggauagaauguaagagcuucuucucguugaucuauuauaguauaccuccucuauuucagauugucuuuggguuaaaucuaguaucugguauucacagauaccucuguuucuauaacacaagaaauuugaaucaaguauauaggaguugugagucacucugacuucagacuugaggacuccaaauaaauguaaaaauagcauugaacuuuuggauagaggcuaaacuugguguuggaagggacaagugagagucuccuagaauauuuucugcaguaaaaaauaguuuaucaaugauuuguugaaacuggggaaaguuucugaaauguuucuagcaaacaagauaucuaaauguucuuucugugauacuauugcuuacauuguauuauauauuauauauguuuggcccaugacugcuaauuuauuuauuguaucaucuuuaaauuugaauaaagggaaauguuacaugguauuuuugugacauuucuuugugagaaaguaggauuagacuaaguuuuuuuaauuuuuaaacacaugcuuccuaaaauuuauuauuucuuuuguguagccccccuggauaagaaagcuuuaucuagcuucacccuauaguuugauuuagagaaaacacaauaugcuuucucaagccaucucuguugcuuaaauuuuuaucugcuuuauugcugauguuuucccccucuucccuacuacuuuauaucaauaacauucugguaauaugacuugagauguaaaucuugaaagauuuagaagaugaguaguuagcauguuccauaaauguaauaguuaugauaccacagcacaauuaugguacugaaauuuuguuuuuuaaaaucuaauaccaaaauaccagacugauacuauuuaauuaaaauuuuuguaaaaguuaaaaaucagcaaaacaggaaguucaaugccugucauuaucaauuaucaacaaucaucaauuuaaaaaauuagaaaaauauuaauguugagcauacauugucauuugaacaaaacuuauuugcagauaaaauuaguaguaucauuuuauucaaaaauagaaaauggccucagaggcugcccgucugcuggucccaacaccacacgcgccuuuccugccugggucuuguugcagucgccgccgccacugcaccauggcuuucaucaccaggcaguucaugcacucuuugucuuccuuguccacaaccuugggcaagaaaaaucaucaucaagcacaugauggucaucagcaucacacagguugcugcagugaccggccacacaguaguguugcuagaccagacagaggacaucuuggcaaaauauaaagagggaauugagaaaagccuuaggaaagugacaaagaaguuguuuguagaaaacccuaaggcuuuugaugaauuuguggagaaaacccuaagcagcauaucaaccagcacagaugcaauauccguaguccacagcacagaccuagugguagaggccauuguagaaaaucuaaaggugaaaaucaagcucuccaagagguuggacaaguuuguugcugaacauacaaguuugccagcagcacuuccucuuugcaaauuacaagcauagccaaugcuaccaccaaacaagaccgauuugcuggccuccauuuacucaacccagugccccugaugaaauuuguagaggucuuuaaaacaccagugaccacccgaaagacauuugaaucuuugguaaacuugagcaaaacccugggaaagcauccuguuccuugcaaggacacuccuggguuuauugucagcugucucaggauucaacaccucauggaagcagucaggcugcaugaaugaggugauguauccaaggagaacacugacacugcuauguaguuaggagccagguaccccaugggcucacuugagcuucuagauuacguugggcuggauucugugcaguucaucauggauggauggcaugaaauagauacaaagaaccccauauuucagcccagcccauccuugaaaaagcugauggcagagaagaagcuuggcaagaagucuggagaaggauuuuacaaauacaugugaugcucagcuucucuggcacugagaagaaucccugugagcgcuuaccagccagcacccaaagugccugugagaauacucuuuggucagacauucccucacacagcacagucuauuugauaagcauuuugauuguaaucuauccgaaguuauuauuacgcuagauacaguaguaacagauuccaccauuaagaacuaauucccauguuuagucuguuuauuucuguguauuuucuaaaaagcguuauacuguuggugcuuuggaacaaaugcugucauuuuuguaaagaauugccugaauucauucucucauaaggggaagauacuugcucugagagugagagugagaguauauuguguucauuguugcuguguggcagucacaagccauugggacagacagggugugucuguggagugcuucagcaagcagcaccugaaucuugccuuuaugagaacauuuugccccuugcagccuugagccuuacccuaccuucugggcacaacauaagauguuauaucuccauucagcugaucaucaagacacugcugcugcaugggugggcuuuccaugugcuugguuugcaguaagaggucgguuuuccuggucauucaguuccacagaucguaauaauuacuaucugucugguuuuuuuuucccacaagaaaucaguguugcaaaauugccuauaaauggacuaauaaaauacagucuuuuagucugucaaaauuugaauugaaauaaacauguauaaaauaaaaauguuuaagaaaccccaaaauaauaaaugaacauuuaaauuaugaaauauuuaaaagucaaauguuaucugcuuuuauaaagugcaggcucagaugugcauuggugguuuauuauugagugauacguguauuuuugugcauaucuuuccagcugcugaaaaugcuuucuuaacuaguuggaguaaugguaaaaagauagauaauugcaaauauauucuucuaacuccuuugucuauagguaauuccauuucuuuuuugauaacuuugagguuuuguuauuugaaauuuuauuuacuugaauuuucauauauuuaauuuuuuaaucaaagcuuuaggaacuuauaauuuauugacucaaaaagauauuacaaaacaugcuaacaaaaaccacaguuacccaaaccacuaacucauugccugucagagagaaccaggugcuuucucuucuuuuacaucccuaccucuguccagugacaaaaauuggccagagaggaagggagcccuacugauggugaaaaguccagcuuccuggguuaucacagaggguagagagugauuucaaagagcaaacagaaaauagccagccuaaauagauuuaauuucuaagaugucucuuuuuaacuuucugaauauacuuuaaaaauauauguauauaguauccaauuuguguuucuugaaugccgugucuucccuuaaccuuugugaggauuaaaauuuuguuuucuuuuugcacaguguuauuucuuccaaguaaggguuucacccccuuuuuuccugucuuucauauuagagaguuuuuuccaguugucuguccaucugaguauguuuaagaguggggcacaaaaaguugauaggaagcucuucauguguagauggugcuucugcugucugauucaguaggucuguagugggacccauaaauuugcauuuuaacuaguucccaggaauacugauaccguuaguccaggaaucauauuuuuuuaagaacugcuuuauuagggaaugcuuuugugauucauaucuauggaagggaauggaugggaaggaaacagcuugggcagaggugaaguugaacuguaaugcugaagaguucugaagauagaaugaccaaucaaagcugucccagguugggggaaggggcugggccuuaauauccccauguugauuagugucuagauaugggcugucccuggaaauugguaugaccuugagaagugauauuuccuucagccuaagcaaucauacccaaggguacagacacugaaugcugacagacacccauggcuuugugcugcacugcacugcacucccagcaguggacaaaauucuuuccugaaaaggggaaauggagcauugcauuauguugucuguacaugauccuucccagugagcagggaagccucauccugagacagauacuuuuucuaauuuuuccuuuaccauggauuaauuuuaucuacucuagaacuucauauaaguaaaaucauauagaaugaacuuuucuagguguuuuauauggcucaguauaauauuuauuagauucauccauguuccucuguguauguauggguuacuuuuaauugcugaguaguauuccauugugugacuaugccacaaagcguuuauuuauucuuacauugacaucauuuggauugauuccaguuuggaauuauaaagaugcuaugaacauucuuuuucuucaacaucuguuuuguggacaucuaguuugauuccuguuggauaaauacuuaugguagguuuaugucuaaaugcuaaacuaguccaaggugguuuugccuuucacauucccaccauaaauguaugaaagcuaugguugcuucaaagccuugccaauauuuggguuuuuggaauuuuaaauuuaagccuccuacugguguauuguugcgauuuugauuuguauuuccuugguggcuugguuccuugaacaucuuuucauguguuuauuggacauuuguguaccuuuuuugugaaauaucuauuccaguuguuugcucuuuauuaauugaguuaccugucuuuacuauggaguuguaggaguuccuuauguauucugggcauaagucuuuugucagauauguuuuucgaguauuuuauguaguuguuuuuuuuuuacugucuuaauugaugucuuucagugaauagaaguuuauucuuauuucgauggggucugauuuauuuuuauuuuuagaaacagggucuuguucuguuguccugggugaauugcaguaacaugaucagagcucacugaagccuugaacuccugggcucaagcaauucucagccuccaaguagcuaagggcuacaggcaugcaccaccacgccuggcuuuuuaaaaaaaaauuuguagaaauagagucucacuguguugcccaggcuggucucaaacuccuggccucaagcaauuuuuccgccuuggcuucccaaagccuuuuuaaaaauguuuauugcaguggggcgcagugccucacgcuuguaaucccagcauuuugggaggccgagaugggcggaucaccugaggucaggaguucaagaccagcauggccaacaugggaaaaccccaucucuacuaaaaauacaaaaaucagcugggcaugguggcguagcuacuggggaggcugaggcaggagaaucacuugaaccccggagguggagguugcagugagccgagaucgcaccacugcauuccagccugggugacaaagugagacucugucucaaaaagaaaaagaaaaaaaaauguuuauugcuucuguaacccuaagaaaucuuugucagcucucacaucauauucuccuaugguuucuucuagacacuuuaagcuucagcucaaauuuuucuauaguaugagguuuguacauuuguuuacagaugugucuaguuacuccaccaggauuuguaauaaggauuuucuuuugucccucgaauugcuuugguaccucugcugcaaaucaguuuacuauguagaagucagguaucauuagucagguuucauucauacaacuuuuucacugcaugcaauguuacuuuuuucuggcugcuuucacagugugcuuuuuaucuuuguuuuuugauccuuuugacaauguguggguuucuuuauaauuauccugcuuggaauuugcugaacuucugggaucuagaaguuuguguuuuucauaggauuugggaagacuuuggccauuuauuaaacauuauauuuuucugucucauuaucucuccucucccauuguacauaguuagaccacuugauauugcacuuuaaauuucugaagcucuguuuauuauuuuuaaaaaaucuuuucuucacauucaauagaccuauugauuuuccaguuaagugacccuuuuucugccaucugaucucaaauuaaggucauccaaugaauuuuucauuucagacauuauaacuuuuaaguucuagaacuuccauuugguuuuuuucauaacuuccauuuuucagcugagauuuccccaugcgaacauuuauuaugaccauauuuuccuuuaaauacuugaacauguuuauaauacuugcuuugaaguccuugucugcuaauucugacacuuuggaucauucaggauuuagugucugugagcugcuuuuucucuugacucuaggucuuuuuuuccuguuuguucacuauaguguauuuugcuuguguaaugggcauuaucagugauauguuauagacuuuggauucuguucuuuuucucugaugaguguugacuuuuuguuuuaguagacaucuaauguggcuggauucaaaccccaacuuuauuuuuucugugacaggcagcagcagaaaucucaucucaaauccuuccaccuuccagcuguuucuuuuugugaagaaccuuggagucuuccucaaacuagggucauucaaauacugggcguaguucauauagaaauuuuggagcacuuuccuuucugggauuucaccuuucacuuuuaagcugccuuggcaaccccaaacuuuguccuuuuuaagcuagcaagacaacagauuccugcuucagucuaagugaccauugccacaugggcugauaaguacccucaggcaaaagccuuauaaaaauucuacuagugcacuuugggaggccgaggcagguggauugcuugagcucaggaguucuagaccagccugggcaacacagugaaaccccaucucuacuuaaauacaaaaaauuagccagguguggcaacaugcgccuguaaucccagcuacucaggaggccgaggcaggagaaucacuugaacccaggaggcggagguugcagugagcugagaucgugccucugcccuccagccugggugacagagcaagacuccaucuaaaaaaaaaaaaaaaaaauucuaccaguacaguuuucucauuuaaggcuaacuuccuuccaguugcuuccugcuuuugauuacucuuuugauuuaauguuuguuuuuauauuuuguccagaauguauaauuguuauguguagcaaguuuauuuuaauauauguuaacuugucguuaucugaagcagaacacugaagcauuauuuuaauugaaacacucaaaguauauucagguguuaguucaggaaacugaaacauccacuaaauggaauauuacaaaaaauacauuacauuaaaaauuugaagacucuuaguagaacaugauuuugguaaauuuaaauaauacccugcuuugauuauagcuguguuaaaaauuagauauguucaugaauacauacaggagagaauaugggaaagaaggaaagaguuuauugguuguagugguggaauuugggggaaguuuucaaaaauauuccauuaacacugguauaaaacuaugguguguuuauuauacacacauauauguauagauauguguguuuauuauacacacauguauagauauguguguauauuauacauauauacacauacacacauguauacaguucauagguauacauauaguauauguauacacccauauaauaaaagacuccuagacaguauaguugagcucuuguggcaggauuuucaccccacacuccggacauaaacuuuugauaagauauauacagaaagguuauauacguauauaaaagcuucaaaucaagaaagagaaauuaaauucauaggugcuaguaacaaggaaucaggggagcuuacuuaagaaaggucguaagcaggaacuaauuucuaaaugacccauagugguuuucauguccucauacagaccuuaaaugcuggggauugaugucuuaauguucauaggaaugucuaggccacauacucugugcccucacaaaguaguuggaacugaugaacuaaagcauagaaccugaagagagauuuuuaccugugaaauaggacuaaaacagggaacccacagacagacccaggaaguuucagguaagcuugcuguuugcucagggcauguagaaggguaaaauaugagaaccagagccuuaagccuguuuuguagaugaauguggaguuucauuugauauaacaguuuccuucugguacaaggacucuaaaucaauaaauccguauacaaauuggucuggaaccauuaaacccuuagaaauucagcagagacaaaugugaaacugcuucuguaacccacaggauaugagacuccucugaaaaauaaucuuugugaagauaaguucauaauuaaaaaauuucaaaucacgagagaaauuaaugccaauccagguauacaggacuuccauggagaaaauauccucacuuaaaaugaacucaugauuaaauuaaaaagcauaaauuacacaaagaaagggagacugaccacaaacuucucaucaguaguaaaaaccagaaaacaaaaagaaagaugguuuaacaaaauuaauaugcagcagaguagagcuuaagacaaaauggcauuacugaguuuaaaggacacuagaucaugauuaaaggaauauacuaccaagaaaauguaaaaauuauagucuuauuuauauagaauguagucuuagcaguauagucuuagaguuaagaaggcaaaaauugacacuuccaaagagaaauuaauaaauguccaguuguaguuggauauuuaacauaugucagaaacugguagauaaaauggcaaugaauuauuuaaacagcauaauuaauaaacuugauuaaauauagaucuauauggaaaucccucuagcagauaaauagagaauauagguuuauuuaaaggauacauagauucuuaaaaaauaugacugugacuugggucccaaaggaaguuuucaucaugaaaaccauauucccuggcugaagugaaaaaauaauuggugaguaguagauaguuuaaaaauaaaauacauacauauacauggacaucaaauacuaaguuacaaaauauuuaaaaguaaauaacaaaauacuacguagcaaaauuuguagguuccaguuaauggaaauuuuucaggaauagaaagauaaagucuuucuuuugugugcuuauuaaaaacaaagaacuaagaggaaaauguguuuuguauucaacuuuaacagcauaaauacaaauaaugcagaagaaaaacaaaaaauaaaaacugaugagaugucaaaaaagcucgaucaagaaaacucaaagcuaguuuuuuaaaaagauacauagauaaaccucuuugccagguacuguuccuugcguugggaauauaguaguaagcaaaucauaccaacuucugucuuuauaagcuaguggggauguuggacaaacagauaaaugccaguggcaguaauuauaauaaagauaaauaaagcaacgugaaugacaagauagucagggaagguuucuaaggagauaacguuugaaccacugagcacagaaaaguaagggagcaagccaggcagauagcacuuuugaagaguguuccuuggcagagagaacagaagaacaaaagccuuaacuaucauacuaguaggacuaaaagaagagugccuuaaauugauagagaacauuuaccaaaacagauguuaccagaauuauucuugauuacagaaaguuuagaaguaaauucuuuaaugcggaaacaaaacaaggauaucuucuaucacugcuacucuuuauuauauuggagauuuuagccaaaguaauuagauaagaaaaagaagggagaaagagacauaaagauuggaaaggaagaaaaauauuaauuauaaaugaaaugauuaucuacaagagaaucuacauacuauuagaacuguccgggcgcaguggcucacaccuguaaucccagcacuuugggaggccaaggcagguggaucaugugaggcugggaguuugagaccagccugaccaacauggagaaacuccgucucuacuaaaaaaaaaaaaaaaaaaaaaaaaauacaaaauuagccaggugugguggcacaugccucuaaucccagcuacucaggaggcugaggcaggacaauugcuugaaccugggagguggagguugcggugagccgcgauggcauacugcauuccagccugggcaacaaaagcaaaacucugucucaaaaaaaaaaaaaacaacuacaugcuguuagaacuaauaagaguucaugaagguugcuggagauaaggucaacauagaaaaccaauaguuugccugaacaucaacacacagauaaaauucacaauaccaucuguaaguugccuuguacucuuucuaacaaaagauuuauucagaaaggaaaugacauuuuaaggacagauuaaaaaaaugcaaauuaucagucaucuucucccauucaaccuauaacauuaauacaguccaaaaauaaaguccuacauaaaguuuaggaggacuguugugaaauuagaaaacccgauugaaaaauucaccuggaaaaacaaagguccaagaauugucaagacuguuuuggaaaugaacaaggggggucaugcaaucaaauaaauagaccuaaauuuuauaacaguaauaaauuugaagugugguguuaacuuagggauaggugaguagauuaauaauaaaacagaaaaggcccagaaaaagauucaagcguguacagaaauuuaguauaauaaaauagugaaugggcucccagauggaaguaguauauacuguauauuacacuauaccauauacaagaauaaauuccgauuaaagaucaaaaugagaaaagcuaacuucaaaacuuuuagaauaaaauauagacugcuuuuaaccuuagcuagauaggauuucuuaaauaagacauaaaaauaacucauaaaggaaaaaaauugacuagaucaaaaauguuaacuuuaauaaaaguuauuaacaaaguuaaauauguauaauagaauuaguauccagaauauauaaagcuucuauaauguaauaagaaauagcuccgcuuaaaaauaugcaaaggauaggaacaaacaauucauaggggagaaaaucccuaugucuaacaggcagguaaaaaggcacacaacauugcuaguaauugaggaaaagacaauuuuuuaaaaaaauacaauuucaugcccauuggaauaguaacuuuuuaguauauauguauuaccuauaucauguauaaauggcauauauaugcaagguaauaagaaaauaggaacuaucauauacugcuaauggaaguauaaauggauacaaguguuugagagaaauuuguuaauauaaaauaaaauagaaaaaaaucauuuauaagcccuagaaaauugacuucuagauuuaaagcugagaaauucuuacagguauaugccaagagacauauacaaagacacuuauggcaguaucguuuguagaaaaacuggaagcuacauaauuaccuuucaguagaggaauagaugaauaaauuuuauuauucauucaaugggauaauuuuuaguaguuaaaaugaaugaauuucauuuaaguguaucaacauggauggaucucaaaaacaauguugaauuaaaaaauuguagaaaaguacagugugauggaauuuacauaaacauuuaaaagcuucacagaacaguguauguugcuuauagauuuuuguuuaauacaaguaacaacuugaaguaacaacuggaaaguuuacauauuggauuaaugauaguugccuuugagaagguagggagggguauaaggcuaggcagaagaaaaggggaacuuaaaauucaucuauauuuuucuauuauguuuaaguauaaaguaaaaauaaucaaggggcuaaguuaagugauuccagggcccucaucuaccagaagggcuuucaauuuucuuuauaacucuguccuuuaaaacagcaguccccaaccauuuuggcaccagggaccaaauucauggaagauaaaaaauuuucccacagauggaggggugggggagaugguuuggggaugauucaagcucauuacauuuauaguacaguuuauuuauguuauuauuacauuguaauauauaaugaaauaauuauauaacucaccauaauguagaaucagugggagccugcuuguuuuucugcaacuagauaguggucucuucugggagcaaugggagacagugacagaucaucaggcauuagauucucauaaggaccaugcaaccuugaucccucacaugcacaguucacaauaggguucacaggcuccuaugagaaucuaauguugccacugaugugacaggaggcagagcucaggcaguaaugcgcuugguugcucaccuccugcuguguggccccguuccuaacagggaugagaguuggggacccugcuuuaaaaggcuaucauuuacauauauuuuuuagagguuuaccaaguuguuugugauagguggauagaaccauccuccuuagauaaucccauagaguagucaguuacugguagaaugaaaauauauugagaucuauauguuauaaaauaaacauuucauuuucauacuaauuuauauaaaaacucauucuuaaguggucccagucuuuccaaggacuuuuucuucaucugggggacugaaauuuuuuuuuucauuuauucauucaacagauuuuauugaacuccuuacauauaccagaugauacagcaaugagcaaaacagacaaagccugcuaucaugaagcuuaaauucuagucaaggaagauagcugguaaacaaauuaauaaaauuauaacaucacuggugauaagugcaaugaugaaaaauaaagcaggaugagagcuauagcgagugacugggaguauuuuauauggggaagucagggaagaacugucuguugaagauaacauggagcaaguaacaaagaaaguaaagggauaaguuauaugggagaaaaguccuagaagcugacagagcaagccagugcagggcccacuccugccgcggagcuaucacggaggcugccuggcuagagcugaaugaaugaagaauagacuaguaugagauuagaucagaaagauggcagaggauugggucauacuggguuuuuauggccaugguaaagacuuuggagcaaaggacuaaugucaucuucaaaaagaaucacucuggccacuuuguugggaguagcccacaggguguggugguuggugauagggcaaagauagaaacagagaaaccaguuaaaagguuauuguaacaccuuagacaagaaauaauuacucuuuauuuuguuuuauuuuuuuuggagacggagucuugcucuguugcccaggcuggaguacaguggcacaaucucaccucacugcaaccucugccucccggguucaagcaauucuccugccucagccucccaaguagcugggacuacaggugcaagccaccaugcucggcuuuuuuuuuuuuuuuuuuuuguauuuuaguagauaugggguuuuaccguguugcccaagcuggucucgaacuccugagccaaggcaauccaccugccucugccucccaaagugcugggauuacaggcaugagccaccacgccuggccaguaaugacuguuuagaccaaggugaugagagaugguuggauccuggauauauuaccuuuuuagcagcaauucuuaauauguagauuacucucacaucucagaggaaacugggaguuauugagaagagagaaaaaauaguacaaguuaggugccaaugaauuauaagcuauacaaagagauuuuaaaaccuaaaaaucuuuuguaggacugugggaaggggauuucaguaccucuuaaccuauccuuuauccuuuacuuuuuuuugcucuuuuuagucguucugaacuuugcaguuaaacugaauccagucauauuuuauuguuuagaaaaugaaauuugaaaucuggguacaggcauaaaauuuuguuauuaaugauuguguuaaaugagauuuaaauacuaauuuuuuuuauauuauagcuuagcuguauggcuacauacaaaggcaaauaaccaauuuugguuuacauauauuuggcuuuauaacuuuuuacagaagacaauuugguuuuaacaucuuuuaaagauuguguguaaacuguuccugaacauuuugcacgauuucuuugcauuuucacuuuccuauguguuacaacaaaauccaaaggauaguuguuuaaauuauuuuauacuggcuucauuuguguuauauauuaacaguucacuuauauucaguaguucaguuaaauugauguauaguggcuuuauuguauuauuuauuucuaaguguauuuuucugcccucccaauuuauuacuauauuaguuaaucuuuuauuauugcuuuuaugucuagggauuccuguuacugguguguguguguguguguguguguguguguguguguguguguguguguguguugagacagagagaggagggaacagaaucuuuuauguaucaaaucuuacaagcuacagauuguaguacaucguuaugacuuuuaagugcuaagcaaauuauuguccagaguggcaggcagacaguaaaaaucauaauuauuguaagcucugggccauacuuguaaguauaguaauaaaucugcacuuauacacuguuaaaaauuuaauuguuuauucaaaauaaacuuaggaaauguuuuaaccaugcuuuaagauuaaauuuaguacaguaaaugggaaauagauuuuuguuuugcuuugugaaaaacacagauuuaggcuacaaucccuaaucuuaauaggaagcuguauuuauuuuuuucuuaguaaggaagacuaaauuaccacaucuuuuugagaauauugcagauaguuaauaaacuuuucauuuuacuaaccuaacuuucucuuucuuuuagcaaaacuguacaaucuaaaguggacugcauuuugguaagugaaauaacuaauauuaaaauccuuuugcaauaagguuuuuaugacgauauaaaauauacaguuuucaaguaaauauugauuuuaaauauaaucuaacuccagugaauaaaauuugauauuuuaauuacagcccccucgggugaauuguuuauaagcuaccuagauacuuaccuguaucucaucaauaauaaaaucacaaucugagguaauuacauguuuuugaaucuuaacuggcucuuacugaaagacugcuuaaacgaacaauuaaauuggauauuuauuuuucuauucuaauaacucugagaauuuguuuagagaaaaguuuuugaagauguuuaauggguuaguuuuguugagauaguguguuuuucauguuuugguuggcagccuguaggaauuaagccauaauaauaguuuaaguuuagauucuacuuaauagaauuguaaaaauuuguuuucaaaaacagcuuuuaagaugcuuaguggauuaguuuuugugggguugccagcuuucaagauuuaaagccacaauaauaguuuaaauuuagauuguguuaguauaguaguaguuucauaggucuucuuuuaaacgugugagggaaggagcauugcagcuacugggacaucuggaauacugcugauuucuuucauaaaaucucuaccaaaaggauagccucuaggcuuuagaacacacgaaggcucuauacuguuagauuccccaaauugucaguauaguuaguucucuuuccccacuugugacuugggaaguucucuuauccaaguuugggucuugcuuauaagcuaaccugacuauguuguuguuggugguggugguggucuguuacagugucuggugcugaaauaguaugaugucuuauuagcuuauauuauuauuagcuuauuauucuauagguagcugaauacauaggaauaguuuauaggagaagaggaaauuuaaucaguucucuuacacuuuucuaaccuaauagcuagcuaaaagaggacuuuguggagguguuuuucuuuuuccuuucauuuacucuucuuuuuguuguguguguguguguguguguguguguguguguguguguguguguaguuuuuugguuuucgaguuuuuuuuuuugucuuauaauaauccucugaaguagguaaucuuguuaccucccuuuuacaaaugaagacaccaaugcucuugcauuucauucaaaaaauuauuaaaauuauuggacaucuucugucugccaguuuuacucauaaggaauacaaaacagaaaagacauauuccaugcccuuaagaaauuuagucuguuauagagagauauauucaagacuacucuuaagaccuagaaaaguggugacugggaguggagggaguaauacauugccaccaacccccagagcauuuccucugucuuccaacucuuaagagucucauuguuaaugugucauucuguaauuauuucauguuuaucauauacuagacccuguucuugguacgagaguacagugguaagcaagacagacacaguucuugucuauauauggccacccacucucuuugcaauacuugagauaacuuuggaggaucacucacuuuuuucucuucauuaagaagagguagaagacugguauaaauuauaaaauaugacacuuauaaaauacuaaauaagaacaaaguucuuuuuaaagucuuuuaagaguucagaaauguuuacauuuuagucuaaguuuuagaauauauguaaauuuuuacucaguaauuaaaaaauauuguguuagguccuggacauacagugaugaacaagauacuaagaucucuccucucaugauccuuuuauuuuauugggugagguagacauuaaacaagugacuaaauaauuaagcauuacaauucagauaacgauaaaugauacuccacaauuuuuaaaagggaaagggaggcaagugaugguggguaggguaaccuuagauaggguggccaggaaaagcuucucugagaaucuucucugaggagaugacauuugagugccgaccugaguaauaagaagccagcuugagucaugaucuccuggugacacacaugagguagaaggaacaguagguacaaaaaaucugaagcugggaaugaguuugcgguauuugaagaauacaggaucccaguaugcuggaacuuacggaaggaaguagagaaugauagaaaaguucaagcaggaaguaguucauguauuacauauuuagucauggcaaguaguauccuaagugcaugaaagcugaugagaggauuuuaugcagagaauagugcaaucuguuuuuuuuuuuuuaauacccuggcuguuguuggaacaguggauuguagggggauaugaguaaaagcaggaaaauuaguuaggcuauugcagaaguucaguagauaauucaaggcucuugcucagaugauggcaauggaagauuuuuuuuuguaaguagauggauuuaaggcauuuuuggauauaaaacuaguaggccuugcuugcugauagauucaauguggaggggaaacagaggaaucaaggaugauuccuuucagucuaaagcaguucuucuaguauuuauuauaccacagguuuguguguaaugaauuuucucagucuguguuuaucuaugaaugucuuuauuuugccuucugcuuuaaaagaugguuuugcuggaaauagaaugucugguuuacaguuuuguuugcuuguuuuuucuuucauuguuuugaauauguuaauccauuacauuuuggacaucagccauuaauuauauuaaugucugccuguacguaaguuuucuuuuguugguauuaagauuuauccuagauugauucugucacucauucacuucuccugucucucugacuuuuaacaguuugacuacguauauaguggaucacuucauguuuguccuacuugggcuuuguugagcucacauagauuaguuagguuugggauguuuucagccauuaucuuuccaaauacuuuuucagucccuugauucucuccuccccuucuaaaaugcccauuucacguauguugaaaugauugauguuauuauucucuucucucugaagcucuauuuacuuuuuucucugauuaucuuuauuugugcucuaguuucucuauuaagauuuccuguugucugauucuuugucauuguguuuuucuuugcguguuuaaacacaggcugccucauccuagcaacacuacuauuuuaaccaugugggauaggucauggcagcagccauaagcaagaauaauagacucucauaguuacuacuaccuaaaguucaguagucacuaaugacuaaacacuucccaauauguuguuugccuguaguuaguuuccagagccuaguuucugaccauuuugugucauuuuauacuuguuuguagggaggauuggccagccucuuuacuuccuuuuccagauaucucaaucuucucauaaagauuuuauuagguuuucuucuagaaguuuuauaguuguaguguuuuucuuuuagauguuugaaccauuuuguguuaaauuuguguuugcuuuaaguugaacuucaagguuuauuuuuuacaauauggauggauauccaguuguccaguaccauuuauugaaaagucugccucuccccagucacuuccuauaucaaaaaucauuauauguggguguuuuucuaggcucuuauuuuccauugauugcugugucugccuuuaugacaucacuacacugucuuguuuacugugcuuuauagaaagucuugauaucagauauauaaaugguucauauauuuuuuggcauuuccauacaaauuucagaguuacuuugucaauuuuuauuuuuaaaaaaaguucuacuuggauuuuuauugggauuacaucaaauuuauagaucaauuuggacacaauugaugucuuauuaacaaauuuuaauucaugagcuugguguaucuccauuucaguugguucuucuauaauaucuuucagcguguuuuguuauuuucuguguauagguuuuguacacauuuuauuaaaacuaaaaguuuuuagaugcuacugaguauggcauuuaaaaauuuuuguuauccauuguuuuauugcuaauaguuauagugaucuuguaaccugcaaacuugcuacauucaccuauuaaaucuaguagcuuuuauguagucuuuaggauuuucuacccacucaaucauauuaucuacgaauaaaaagaguuuuaauuucuuguuaauuuauaugccaauuucuuuuucucaccuuauuguacugcuaggaccucugggagauaggcuaauagaaaugugagagugaauuuccuugccuuguuccggaucuuaaggaaaaaacagugauucauucaccauacaauaugaaguuaacauuagcuuguucauggacgcucuucaucagguuaaacauguuacuuucuguuucuauuuugcuaagaguuuuuuuuuuaaaaucauaguuacuugcugauuuuuuuauuuuucuuagacggagucuggcucuaucaaccaggcuuuagugcaguggugcaaucucggcucacugcaacuucugucucccagguucaagcgauucuccuuccucagccucccgaguagcugggacuacaggcaugcaccgccguguccaacuaauuuuuguauuuuuaguagagacaggguuucaccauguuguccaggauggucucgaucucuugaccucauggucugccuaccuucgccucccaaagugcuuugagaugggauuacagguaugagcaaccgugcccagccacaugcugauuuuuauccaacaauuuuucuauacuuacuaauaguuuguuucucuauuaucacuuuucuuauucuuuuccccugaacuaucuaaucugcuauaaaucccaucuaauaaauuuucucuucuagaucuuauauuuuuuucaguucuagaaauucaacuuuuuggguuuuuuuugagacagaguuucacuuuuguugcccaggcuggagugcaguggcacaaucucagcucacugcaaccuccgccucuugaauucaagugauucuccugccucagccucccaaguagcugggauuauaggcgcucaccaccauacccggcuuauuuuuguauuuuuaguagagacgggguuucaccauguuggccagacuggucucggacucgugaccucaggugaugcacccaccucagccucccaaagugcugggauuacaggugugagcgaaauuccacuuuuuuauagaaguuuuuauauccuccauuuuguuucugucuuaaauaccuguccuaaauuccuugacugcuaauuguaguaucucuaucauuuguuuaucauuuucucuaucaucuuaucauuuuguuucugucuuaaauaccugucuuaaauuccuugauugcuaauuguauuaucucuaucauuuuuguggucccuuuuuuuugagauggaguuucacucuuguuguccgggcugcaaugcauuucagaaccacagcucacugcaaccucugcugccuggguucaagcgauucuccugccucaaccuccggaguagccuccagaguagcugggauuacagguauccgccacuacacccagcuaauuuuuuguaguuuuaguagagacaggguuucaccauguuggccaggcuggucucgaacuccugaccucaucugauccacuugccguggcuucccaaacuguugggauuacaggcguaagccacuguguccggccugugguccauuuuauuuacugauuuucguugcaauuacaggucauaauuuucugcuucuuugcauauguaauacuuuuuaauuuagugcugaacacugauuuuuaugguuuuugagcauuugaguuuucuucucuuccuuugaaguguauugaaguuuguucuucucuuccuuuaaaguguauugaaguuuguuucagcagaacuggaacaugugucagccacuuguagaucccugguagcucuuugcccagccuuuuggaguuuuuaucuacauauauacaguuuaguuuucagcuauagauuccaaauuccaaaucuacauagggauuuguguaaauuuugaagcuguuuauuuuucuuccauaugauucuuugccaccucgaacacuaaccuccuucucuuuagcucugcaguacugccuugcuuugcuuaaguugcuucuuucugcacgacagucaaguugucuucagauagaaucgucucauuuguuuuuuucuuuuucaggucuaacagucuaugcuuuuuguuguccaauuucugaaaacacuuguuucugauauuuuguucauguuuugagaugguggugcugggagaguugcugcaguaucagguacuccacugcggccacaugcagaagucuauuaacagcuauuuuaaggauucaauaaaauauauaggccccuucacacccucuuuuucuuuagugauuuauuuuccacuauucuccacuaaaccuguuucagacuucuuuagcucaagcuacuaaacucgccucuucuuuucuugcugccgguaaaugaucuugccuucuacuucucugagaaaauaggaaguugccuugugguacuccaccaaauuaauacauuucuugucccuaacuuaauacuugcucaauucuauaccuguucuugucuucuuucccuuaucucucaacagaagaguuguccuucugccugucugaaugcugaucucucucugccuacccucuaggucucauccauuccuaucucagaauucauguuaugauucauucucuuucuccuacuucuuuauuuucuuauuuuuuacuagccuauucucaugaauaguuaaaugcuuaauuuuacccccauauuuaaaaaagaaauccuuccugaaacccacaaccuuuccucuagcuaccacuguaucuucuucccuuugaaagaagaaagucaaaguuuagucaaaguguugauugaauuagucucaugccucaccuuccauucaguuuugaaccccaguaacaaaaaucuuuaauaccacuccucugaaacuuuuauaaaggauaccaugaccccucacugcugaauauaauagguaauaucacuuccaaaugacagccuuuuuucaguucacucuguugaccauuuccauacacacacuacccccucauccccccaguuugguacauucucauuuuuaaaauuccuuaagaugucacacuauccugguuuuccuguuacauuuuaggccguuccuucucacacccuucaagggugucuguugcuuugcauuuugucuauauuuguccaaaauaaucucaucuacuuugaugguuucaauuagucucauuauaccaaugacuccuaauuauauguccccauccuaagcucuaggcccauauaauccaacucuuuaucagcugaucaguuuuaccuggaugucacauaaguacuucaaacucaacuuuuccagagccaaacuuguaucauacccccacuucuauaacuaucuguauuagucuccuauugcugcuauaacaaauuaacauacauuuagaggcugcauaaaauaacacaaauugauuauuuuagacuucugugugccagcagucugacauggguuucacggggauaaaacuaaguuguuagcagugccauggguuuuuuguuuuguuuuguuuuguuuuuuuucuggagacccuagggaagaauauguuuccuugccuuuuuuagcuuccaguagcugcaucuucaaagccauuaauggcugcuugagccuuuuuacauugcaucauucugacagggcucuuuuuuguagucaaaucucuuucagccucgcuuuuaucaggauaccugaguauacauugauccuacucagggaagccaagauaaucuccccaucuuaagguccuugauuuggucccaugccaugcaaauuuccagggguucaaagauuaagacaugaacauuucuggggucauuauccuaucauacuaucuuagugaaugguacucacucauguaaccuaaaaaccuagaggucagucuugacucuuccucagccugcuuuacaacuagucagucaccagauccuaucaguucugacuccuugguugcucuauuuuuguguauuccuacugcuacugcauuaauccagaucauaauuauuugagauacugcaacucuuuuucugcuucuagucuuuccacauucguucuccacacuaucaucauagucgucuuuauaaaguucuguuuauuucacaccuuugcuuaaaaccuuucauuggcuccccauuguucugccuuaugguguggaagauucuucauacucagaccuuaccuuuuuuguccaaccucaucuuucuccacucuccccacagccuaucagcaaacuguggaauagaagacaauauuuacucccucaaucuguaagagcauuauccauggaacuuucuguggugguagaaauguuuuauaucauauaugcacuauucaauaugguaaucaguagccauguguggcuaccgaauacuugaaaugugguuagugugacugaggaauugaacuuuuaauuuuguuuaauuuuaaugaauuugaaguuaaauagccacauguggcuagugguaaugauuuagacaacagagaucucgaacagugcuucucaaccagaggcaauauuugcccuccacgccccuaggggacauuugacaauauauggagacauuuuggguuuucacacuuggugaguucuacugguaucagaugggaagaggccaaggaugcuguuucagcauccuccaaaacaggaugucccccgcccccauaacagacuuagcccaaaaggucagagugcugagguuaagaaacucuauucuagacuguuccuucuuuguucguaacacguacuuauaguuuaggauucgucuuagauaucaaccccucuggaaagccuucuaugauuucucaggucugaauuuuauauuuucuguuccauuauauccuuaccuuauuugugugauacaauaaccuuuaugguaguuauaauuggcauuuuuauuuggucuuggcuucuugaguauaggaacauaugcauuggaauauacccagaggcacaugaacgugaucaauauuuguugaauguaugaacgaauauaaacuaaugaaucaaucauuaaacauacugcgguuuaaaauagaaguguugccaccuuaaauuuauaccuuuuagagaucauacacuuauaaaauauuuggaaauauuuuugggaguuacuccugguuugccaauaaguaaagauaacucauuccuuuagaagggaagaacuuuuuuuuuuuucuguuucugccauucuucccuuugcuccugcucuacuuaguuuaguaugccccuuccuuccauacucaccuguuaaaagauaaccaauccaccccacucucauccccagagugcucguggggaacuaaaacuuuauugcauaaaugcaggaaggauuugagcaggugaagugggacaaagagacuagaaacuaaaaaaaaaaaaaaaaaaaaaaaagaacugacuagcauuauagcagaguggcucagagcagaggcuauagaaugaaacagaacugaguuugaauucuuguccugccauucuuuucugaauucccauaauucuaaccuaacuuagguggguauaaagaaggauaauaguaccuauuccacugaguugucauauauauuaaaugagauaauuaguguaaauaaagugcauagcacauaagcacacauggcagcuuuaguugaagguguuauauguguaaauucauaauguggaucaaagugacuuaauuuccauaaauauauguuucuaagucuaaacauuagucaaggauugcauuuuauguucaucaucacagaacuuacuguuuaaaaauaaaugcucaccauauggaauuacugagggcagaguauugaaguucuuaaacauaagcagguggaagauggagaaaguuuggaaucaccuggcuaaagccauccaagaaacuggaaggugcuuacuguagaacacuucaugcucccucccucuccaggccuuuguaggugcuauucacuuuaccagcagugcucuucuugaguuucuucacuugccuaaguucuacuccuuuuguugcacuagcucagaaguuaccauuuucggaaaucuuuaucuacuaggacuaugcauuuaucugcagauaauagaaaauccuaacuauagaaugaaacaacugguggcuuaaaguaguaagaauuugugucaccaaauaaagaguccaaaguuaggcauucaagaguauugcaauaacugcaaugccaccagaguccuagucucuuuuuuauuugcuauguuaucuuuuguugugucacaucacugaugggcugcuguaccacuaugccuuuaguccaaagacuaaggcaggaaaaagggaagaagggcaaacgggcuuucuucuagggaagccaucuuuuuauucaggacaccuccuuauauucaggaaaaccacuuuaggaacuucaaccuccagaguaaugucaacauggcuaccccuaccugcaaguggaacuaggacaucuuuuguuuucuagucuaaaccagaggaagaaaaagaauguggugguuagcaacauaugugucaugagacaacauauuagucaugcuguccaguguuaagggccccaacuuucuuguacucuguguauaucccuaucaaagcuauuaccauguacuaugcuaucgccagcuuaauuuguuuucuucuccagaaauaaguuuuggaaguaagggcugggacuuaugucucuauaucccuaguacuuuaacacugucuuuucauggaagacacucaguaaauauuuacuggaucguuauuuacaaacagugauuaucaaaaaguaaguaaauaugcacauaauauccccuaaacaaaguuucuuuguuuuuuauuguuauuguuaguauuuauuaauuacuaugaggcagacaaaggcuucacauguuuuaucauucaguccucauaauuugccugugagguuaaugugucaucauugucauuuugcagaugaagaaacagacucagacaaguuuaaguaauuuaccuaagguuuuaaaacuuacuuauugguagaguuagacauuuaauucagauaaucugacuucagaucccagacuuuuaaaaaacuaugcuauaucaugcuuuacagauuuucugaaguaugagcuuauaaucaagaaaauguuccuuauuuuuccaaauagaaaguaaucugaaaugaaaaauuaaaaacuggacucaucuuacugaauuuugguaaccaauaauuguaaacacagucuguuuuuauaagcagguugucugaaugccauuuuaaaaacuuacagugugcucacuaaagugaaauagcuacaauaauguuagauauuuaaguugauuccaauuaugaagacaauaugaaaucuacuagaaguaaaaaauauaaaguacuuuucuaguuuuaaagcuaugaaaaaauuuaucuguuuauugguaaagacaaaugaaaauauuuguaguagcauaaauaugaauagauuuuuuuguuaauguuuuagugcuuuugcagugaaaauguaauuuuuaacaauaagcagcauaucuuaaacuaaauuucuuauuugaguuguaacauuuuuagauguauaaugucauaauacacuuguaaagcugauccaguuacauuuuucauaauuaguuuacuagugaggguaauauuuuacccuugauauauccaacaccagagcauuauuagcuaaacccagcugaguguaaguuucucagucuauauuaccgaguccccuuauuuuacuucaguuacguuggucuaucggagagguauaguuagggacuaaaauguaagagaaauaacuuuuuuuuuccuugagacaucgucucacucugucacccaguuuggagugcagugccaugaucauagcucacugcagccucaaauuccugagcucaacucaagugauccuucugccucagccuccugagaagcugggacuauaggugcacaccaccaaacccggcaaaaaaaauuuuguuuuuuuguauggaugagguuucauuauguugccaaggcuggucuugaaucaacuccuggccucaagugauccuccugccucagccucccaugagaaagaauucuuaacaugugguguacaaaaggccuagucugcugagagucaaccaaaggaggaugggaaauaguaauccaguguuucccaaaauaugcuccuuggaauaguaauuccauaaaauaggaauauguuaugcaaaagguuccguaaccaggcaugguagcugucgccccagcuacucaggcuggguggauuacuugagcucaggaguuccagacugcaggagcuacaauugugccgccacaguacagucugggugacagagcaagaccccaucucuuuaaaccaaaaaaaaaaguuccauagucaaguauguuuaugaaaucaauuaaaagaugucuuaaaugcuuuaucagcugcuacaugucaucaaccuuauuugugcaguauguuccaaaauuuuuuugcucugaauuccucuucacccuuuuccucauacaacuucucaugaaacugguguuaugaaacacaauauuuaugaaauaguaaggucuauagggcaaguuucuagcauagaaagagaaauuacuuuuuacauauuauucauaaguaacaggauguugagaacuuccuguuuauauuacugccuucagguguguauaccaacaggaagcagucucccaacuaauucuaauguuuggguccccuaaauugacuaguuuugcuuuggaguuauuagaaaaaauaaagguuaagagggcuauauauuuugguucccuuuagcaaggcuaauguaaaauuaaauaacauuuagcuugccaggaauucagcugaaaacaagagagaaguauuucuaucucauggauucaguaauucaacgcaauccuaguaagauuuuagaagaguagacaaccuaggcugguugccguggcucaugccuguaaucccaacacuuuccgaggcaggagaaucccuugagcccaggaauuugagacuagccugagcaauauagggagaucccaucucuacaaaaaauaaaaaaucagcugggcaugauggcaugaacauguauucucagcugcuugggaggcugaggugggaauaucucuugagcccaggaggucaaaggcugcagugagccaugaacgugccacugcacuccagccugggugacagaaugagacccuguccuaucaccuggcugcagagaucaaaggcuuaaaaccagggauaaaagaggcugaguauuuuaaguucauuuaagucuguauuacauaccuuccaggaagaguguaccaucuuauuuucuaggcuuucuaaccagccaguguucuaagaaagcauuuuuauguuuugccagcuauuucuagguuuaaaaaaugcagguagccuauauuuuugguaacuuagcauacccuaguaaagcaucugcuuuacaggccaugcuaugcucagcaccuggaaggccaaguaaacucaccuggucaaaaauggaacgugucuaaugaguuccuucucauugguacguauauggcuuucugaauuaagucagcucuacuaggguaggguuuauucaugagaacugaccaaaggaggauuuucuaggacugucauuaggagagaaaauuugaaaaaugaugugggguuaccagaauaccuguugcuucuggaggauuaaggguauugucacuuccugaaacuagguaacagaugccaucauuuagauaauuguguagugagucagguuccuuccaggggagaagucuuagugauguccucuugcaggggaauauaguaaaaaacuuguaguugguauauuuuaaguuuuaaacacugauuauguaauccuuuaaaacagggguuccccagguaugguucauggccugucaggaaccgggccacacagcaguaagugagcagcaggcgagcaagcauuacugccugagcuccgccuccugucagaucagcagcggcauuagauucuuauaggagcacaaacccuauugugaccugagcaugugagggaucuagguuauacgugccuuaugaaaaucuaacuaaugccuaauggucuaaguggaacaguuacgucccaaaaccauccccauaauccccaccccauccauggaaaaauugucuucugugaaacuggucccugguacugaaaagcuuggggaccauugcuuuaaaagacuuuuucuuucuaccuuccaacucuacuggcacaguguuuguacuccugaggcaaaugaucaaaauuaacagccuaagcuguguucucuaaaaacuguccuacuuuagugaacagcaaagccuauuaugagauaaaccuuaagaaccaacuuucugggcacacaugaguuguccauuacaaaaaucuaaaaccuaaaaaagaaaaaaaaucgcggcagagguacuaacuaccccaugugaaaaauccaauuuuagcauaguuaaaaucaggcaaaggaaggcagugcaagcagucuguugguaggaagucuguucauguaucaugguuaucuguguggaauuucaguaguaccugaguucucaccaggauccuaucugggacacugcaauagauauuauuucccuggguauaaccuuccuagucucaucuccaucuuggcuuaauggaaucuuauugguauggcuugcuccauaucuaagugcuguauguuucacagaucuuggauauuaaaacauaugauugcucagauauagucuggaugguaauaacaaacaggugugguccagcaaaucaagcaucuggugcuuauggcccuggaaggaaucagcuacugacccuguagauggaccagaagggcuaaacuugagacccacagcuagaucucuuccacaaaauuguuuuguuuggcccacacugauguucuaaaauuuuuggauugguugccauauuuuagaaagaggaaaguucacagaaaaacuuagguauuuguuuucucuuuucucuugaaaacaggacacugaacccuuguuugcgcaugacagcaguugaaccuaaguagugguuauuccuuuuaaacaugacaugcacucuuuaauccucuuaguccccaccaugcuuuuaccucaucagauuuuucuuaccuauguucuacuguacucaugugcauuacgugccuggcguuugaguuuguggcuuuuguguuagauuauuugggggcaagguuauuauaagagcuauucuuuacaggguuggggacccauaaugguacauaugaggauagauaaugggaagaaagccucuguuuuuauuucuuaguaauauggagucuuuacugucaguuccugcuuuagcugccauuacaacggccagccaauagaaagcaaaaauaguauauaacaaagaauaaugauaacuguuuugagucucugcuauagaucagccacuguguaaaacauguugccuucucacuuuccugugagaccauccuugauuacucuauuuuaaauugugguuuaacauacccucccaacacuuuuucuucauagcguuuaucaucaucauguaacauauguuuuacuuuuaaauuuuauuguaugucuuccuguuacuaaaauauaagauagugccuagagcauaguaggcacuugaugcuagaugaauauauaaaugaauaauguuguuuaauuuuuaaacuuuccaagucugucccaugguuuaguguuuuaaaucagaagccagucuucuucauuuacuuacugcuaaaguguuccugagaaacagaccuacuauuagaauggggccuucuaagaggugacacacucccagcaauaaauuugaguaguucacuccaguaguaauucuuaacaauuacuuuccugcccuccagagauauaugcugcaucugugagggguuauggauguguggaguaugcaauuccaaaaaauuaucuucuucccuuuacaagagaaagcaugcuuucucaccucaaauccuugcuuuaaugaauacuaaauggugaccaaggucaacucaccgacacagacuugauugaaacuaaaauuuuguuugcauuaucuaauuaaaauauaucaaauaaauaaauaacaaaaauucaccuguuacugcucgaaaaaggcucauggguagaagaucacauuuauuuugugauacggcacuggaguuacuguuaguaagauuuaucucagaaucuuauuuuuucuuucuauucacuuaguggagaagaaauaggcacuuuucaaaaugaagagcaugucugugcagaauuuacuugaaugagaaaacuuggcaguggggccagauuuaaauagcuuguuugguuuuguuuaguaucacaaaaagaaauaauuuauauaaggccaugccauuuaaaggauugugaaccuuuuacucuuuccuuuuuuuacauuaaacacuugaguuauuguauccuccuuuaguaugugagaaaaacaugguuauuaauguuuuuuuuuucucuccuguuagggacucgaguggacuaaauugccacugagccccaaaaaaauaaguucugguaacuuuuguguuucaugauuauaaacaaugcucuaaccauugucagcuagcuuucaaauuuauuacauugucucaaaaauaugaugggaauuucucaucauuaccagaaagaaaugcaauuuucauuaauauguuuauauucaaagaaugacauaauacacaaaagugugcucugauggaaacaaaugaauucuuacaguauucuaauuuuucuaucuuugcacuuuaagucauuucaaacuugcagaaaaguaaacucuaggggagaaaagaaggaaagguuacuaggaacagagaaaacagagacuaaagaauugacuuuuccucucaauggccuaccuguuuguuaaggcuguaacuuuguaaucuugaagaauccaguagaaauccaguuuuuugaaagcauuguggcagcuggacugucaaguaccaucauuuuuuuacaugcugaaaaaaguuaaaaacacagugacuagaaagaucuaaaccuuauccuucuugcugauaccaccacccauccccaccugcuaguagaacugugugaucuuuucaaauagcacacagaaacauugauaauaaccuuggcuucuccugagugauucagagugaauuuaggggaauguuacaugaugauccuaugauggucaguuuuuguagaauuuaacaaugggaagauguguucuuaagauggcucucauuugaauucuauuucaaggggacugaaauauuuuggcuuugguacccuuuggcuauuugaaccauaguuccuacuauaugaguguuuuagcaguaugcccuugucuaagcauuucauuugguucuuacuuuggcacuuaugaagccaaagauacuaugauacuacgguacuuucuaccguguuauucauuaucucaguuucagagauucagcuuccuuuuuuacuauuaaguucuaaaaaauucauuguaguuguguuucuuuccggauuuaucuuuugauuuaucaucaauuuaugaacucaguuucuuuaaaguauuaaacaggcaaauauaaauagcuaagaaaaccgaaauauauuuuagagcacauucauaaaaauuaccaaugaaugucccuacuuuuuucuuuuauaauguaauauaaucauuucuuaguuuuaugugcagaaacuucucaauauuaagcacagaaucuacuuaguaauaucuuacaugucuaucuuggaguaagaauuugucagugcuaauguugcagccccuuggggcuucuuaauauuggaauuucuccaggcuugauuauaguugagggaaguucaaagggaauuuuuuuauuguuuagcuuguuuuuagguugcaguaaauucucuaggucauccagcaggauuaggaagagaagcauugugagaaacagguuuuggguuuugcugaaauuugcuugucagcauugcaucacuuuuccuuaacuguucucuaaguacugaugucuuucaaauugacucagaucauacuccuuaucuuugagcagaauauuuugaacagaaaauuaagccauuuucauuuauauaccuaauucaauagguuuauaaauaaaagggcaaauccucacgauaauacaguacaguaaaaauugcucucccccuagaacugagaauagaaaaacaauuuccucuuacauuguuuauaguagguagcccuuaaaagaaaaucacuuaucccugccacccccagugguccucauaacaaguuaggaaacugaaaauugcugaaaauuaagaauucuaagcaacaagcauggaaaauagaguccucauaccugaccuuuuucucuaucuuccuuacucaauccuguggaagaacugcuggggccugagagaauauaauaucagguauguugauuguuuccauaaauuuaaagaggcaacagaauaagcuuuauauuuucucccuuuugauccuuauacuuucuccuuuuugauccuucuguuagugaucuggugaagaagaguccuuuuagaaacugcuccugaaucagugucgcuugaggggggaaaaauuaguauuucuuuuuggaguuuuguuuuugaagcuuaaaucaagggcagacaaauucaagcauaauuauuaguguauuuauguucccuccauauaugguaacucaacugaagaaacaguuaaacuugauuauuuagguuucuggaauuuaagcugacuauuccaaacacaaaguuaaaacuuaaaaaaaaaaaaaaacuuuuuacugauaccaaucugaaaagaaaaguuucauggacuaauuauggacaugauacccugauugaucaucuuccaccagaacucauuuauugucaaccuggccaguacuuuggaagguguuuauaagucucaaacaagcauuucugcuaauucuggaaauaaugauccucagauauaauuucaccaucaaggauuugcaagaaagcuccucagugaaguacuaauuguuaugcucuuuauaagcaucagcccuuccccacuuuuuuaaccuugcuuaaaaaaacaaaaccaaacagaauaacaugagagggaagauugucguuacaggaaacaaaucacuacagauuucaaacaagggaaaucacuuuucauuaacauuugugaaguuguggcuuaaaccugaugcuucacuuuuucacaguggucccuaaaaacaggagcagaucucuccauuuaggcuacuuuuaaauugaauauuaugccaauaaauaaugaaaacauaguuccuuaccaucugcuuaaaggucuuuaaguucugguaauaagacauuuaaaacucucucugguucucuguaguccaucugguauguauugacaguucagaaacagauguccggagcaaacaggaacaccgaaaaauuaguauuugcaauauagaauauuguuucagguauuucuuuaugacagaagagaaaugaaaaguuacccauuuuguucccagacgaaccuggagaaaguuauuucugaacuauucugcuuagauugauuauuucuuucucucuaguagcacagcuguugucagaaauauuuacuaacuucaauuauaugucgauagcuuaggaaaaaauaguaucugcccuuuucugcacucacccuaagggaagccaguacuuguguaacauaaucuucaaugaugagugaccaagucugauggucaccuauaaaaucuggaggacucuugcucuugugguauuccaaccaaguuaguggagauuaccaggcgaaauacguccugaauuucuuaaagaugccuuaccuacuccuaaguucguugaagccuuauucacaguaccuaagauacagaagcgaccuacguguccaucaucagaugaaugaauaaagaaaauguaauuauacauacacaaugaaguaguauucagccuuaaaaggggggaacuucuguuauuuacaacaacauggacuaaccuagaaggcauuauacuaagugaaauaagccaggcacagaaagacaaauaaugcaugaucucacuuauauauggaaucgagaaagguugaacucacauacauagagaguaaaaugaugcuuaccagagacugggagguggcagggagggauaugggaaggggagauguugaucaaaggguacacaguuuucguuagauaggaagaauaagcuguagugcccuauugcacagaauggugucuauuauaacaauaauguguuguauauuucagaauugugaaaagaguuguuuuuuggguuuuggggguggguuguuuuguuuuguugagacagggucuugcucuguuacccaggcuguaguggcacaauccuggcucacugcagcuuugaccucugugggcucaagcaauuguaccacuuuagccucccaaguagcugagacuacagguaugcaccaccacaccagcuaauuuuuguauuuuuuguaaagaagggauuuugccauauugcccaggguaugagaguagauuuuaaauguuucagcuacauaaaaaaauaugugaggcugcagugauuugugauuguaccacugcccuccagccugggugacagagugagacccuaucucuguaaaaaaaaauuuuuuucuacuuuaauguuuuaaaugccuuacuuugccacaucaaauuuucuauacuuguugauagaauuugaauuauaaacucuucugccaaagaucugauuuuaagcaauaacauauuuuuaaaauaauaacauuuacauaacacuaccuaucauaaguuuuauaucacaaaaauuaugagcauuuugucgcuguguuuuauauuuugaaauugauacucagcuuaaaaagcuugccuaauauuacaaagcuaaugaguggcaaaucuggaacucagaucugggucuucuaauucuauauccuauaccuuacccacuauagcuuacugcuugauauagacaucaauuucaaguaacagcugcuucauucaucuauuuuauauauaugucauauccuuauuauaggucuuauguaauauggguuauucuuuauuauuaauuugucaguaggagacuugcuuauuaaccucagauuuauaaaagcuucaucaaagcuacuuuuauuacucugcuaaucaguuacugggugauauucuuauaugagaagucucuaugacauaaguucuagaagagucagugaaucauacauuuugcuguaugaccaucuuaaggauaaauuguuaggccgggcgcaguggcucacgccuguaaucccagaaauuugggaggccgaggcgggcagaucauugaggucaggaguucaagaccagcccgaccaacauggugaaaccccaucucuacuaaaaauacaaaaauuaacugggcgugguggcacacgccuauaaucccagcuacucaggaggcugaggcaggagaaugcuugaaccugggagguggagguugcagugagccaagauugugccacugcacuccagccugggcaagagagcaagacuccgucucaaaaauaaaaauuguuagguuuuuuuccuaaauugaauaccaacucagagaaagacguuuucauaugcugaacauaaaaguggcauucuuuuucaucuguaauaaagaaucccaugauauagauguagcacaaaaaaucaguagagaaagugugaaauacucaguaagugauacugggacaauuuuuaguuaggucccuacuuuauaucuuacagaaaaauaaauuccagaggaauuaaaggcccacacaugaaaaacaaaauuuuuaaacuuuaaaaagaaaauauaggauacuaucuuuaugacacugaaauaggggaaaauuucaaaaacaaaagaccaaaagcucagauuaugaaugaaaagauugauagauuugacugccuggaaaugacaaacuucgauaucacaagacuucaaaaacaaagugaauagacaggcuacaacuaggagaagauauuagcagcacuuucaaccacuagaggauuaguauccagacugccugauaaauauccgcauauuuagaugaguaaaagaaaugaacgggcaguuccuugaacauugugguucuccaaguguaauccucugaccagcauuagcagcaucuccuaggugcuuguuagaaguccagauuuucagguccccacuugagaccuacugaaucagaaacucuggaaguggggucaugcacucuuuguuuuaacaagcucacuaagugaaucuggugcauauuaaaauuuuagagcuacucuguuaaacucaaaugauaaauaauaugaaaagauucagucucaucaucaaucagagaaguauaaaacaauuagauacuuuuucauacccauaagauuagcuaaacuuuaaaacuuaaguuuuaacaagaaucuggagaaauaaacuguaguauugcuauuaggaacauaaauugguauaaguuuuagagagcaauuugaaaauauccaauaagguugacuauauacauucuuuguuaccagacacuuguacuuuuaaguuacauaccuuaggaaaaaacucucacacaaggccacaagagucacaaauaaaggauuuccauuacagcaccaucugaaauagugaaacuuuguuauaacauauugucuaucaguagagacaugaacaaacugugguuuuguuucauagaauacuauuucuauaugcuguuaaauagauuaaguccaagaucagaagcaaacaugccaaaagguuagcaucuuguaaauguggacauugaugcaugcaugugcacauucucuacuguguuugaaauacuuuguaguuuuaauuuuuaaaaauuaaaugagauauuaaaauauugaaagaguuuccauuuggcugugucuuaucuuucaggauucugccucaaagguggauuuaguuuggacaaaccaggaucauuauaguugagggucguaaccagacacuggaaaacauuuuuuaaaacaaucaguaaaugcagauuaauugaagauaagcugcauacuuuccugaguaaaugcuacguacggcccaaaguagaggaacagauuggcauauugcagguucauguguaguaaacuuauuagagcugacuuuuuaaccaguuuuuggauuuuuuuaaaaguaaaaguuaacuggaagagagcaugaaggcuguauauucuaaacuggugcuuauaaaccauuuuuugcccauaccccauucugauaaauguaauuauauucuugguuaauaucauuugaaauucaaaauaaguuaaauacuaaucuaaaaaaugaaugaaugaaagccuuuuuuauuauggggaggagacuuuuucuuguuuccacauuuuuuuaaauauacuuuuuaaguucuggguuacaugugcagaacgugcaguuuuguuacauagguauucaugugcccuagugcuuugcuguaccuaucaacccgucaccuacauuagguguuucuccuaauguuaucccuccccuagccccacacccgccgacgggccccagugugugauguuccccucccuguguccauguguucucauuguucaacucccacuuaugagcgagaacacgcaguauuugguuuucugaucuugugauaguuugcugagaaugacgguuuccagcuucauccaugucccugcaaaggacaugaacucauccuuuuuuauggcuguauaguauuccgugguguauaugugccacauuuucuuaauccagucuaucauugauagacauuuggguugguuccaagucuuugcuauugugaauagugccgcaauaaacauacgugugcaugugccuuuauuguagaaugauuuauggguauaugcccaguaauauugugggucaaaugguauuuccaguacuagauucuugaggaauugccauacugucuuccgcaaugguugaacuaauuuacacucccaccaacacuguaaaagcguucuuauuuuuccacaaccucuccagaaucuguuguuuccugacuuuuuaaugaucgccauucuaacugccgugagaugguaucuuauugugguucccauuuucauuucucuagugaccagugaugaugagcauuuuuccuaugucuguuggcugcauaaaugucuucuuucgagaagugucuguucauacccuuugcccauuuuuugaugggguuguuuuuuuucuuguaaguuuguuuaaguucuuuguuucuggauauuaguccuuugucagguggauagauugcaaaaauuuucucccauucuguagguugccuguucacucugaugauaguuucuuuugcugugcagaagcucuuuaguuuuaauuauaucucacuugucaauucuggcuuuuguugccauugcuuuugguguuuuagacaugaagucuuugcccaugccuauguccugaauacuauugcccagguuuucuucuaggauuuuuaugguccuaggucuuacguuuaagucuuugauccaucuugaguugauuuuuguaaaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggaguuauuucugagggcucuguucuguuccauuggucuguauauuuguuuuggcaccaguaccaugcuguuugguuacuguagccuuguaguauaguuugaagucagguaacaugaugccuccagcuuuguuuuuccugccccggauugucuuggcuaugcgggcucuuuuuugguuccauauguaguuuaaaguaguuuuuuccaauucugugaagaaagucagugguagcuugauggggauagcacugaaucuauaaauuacuuugggcaguaugaccauuuucaugauauugauucuuccuauccaugagcauggaauauuuuuccuuuuguuugugucuucucuuauuuccuugagcaguaguuuguaguucuccuugaaauccuucacgucccuuguaaguuguauuccuagguauuuuauucucuuaguagugauuaugaaugggaguucacucaugauuugggucucuauuauugguguauacaaaugcuugugauuuuugcacacugauuuuguaucuugagacuuugcugaaguugcuuaucagauuaaggagauuuugggcugagaugaugggguuuucuaaauauacaaucaugucaucugcaaacagagacaauuugacuuccucucuuccuauuugaauacccuuuaugcuuugucuuuccugauugcccuggccagaacuuccaauauuauguugaauaggaguggugagagagggcauccuugucuugugccaguuuucaaagggaaugcuuccaguuuuugcccauucaguaugauacuggcuguggguuugucauaaauagcucuuauuauuuugagauaaguuccaucaauaccuaguuuauugagagguuuuagcaugaaggggugaauuuuaucaaaggccuuuucugcaucuauugagauaaucauaugguuguugucauugguucuuuuuauguggauuggguuuauguggaugggauuauguuuauugauuuauguggauggauuacguuuguuguuuauguggauuggauuuaugugaauggauuauguauauugauuuguguauggugaacaagccuugcaucccagggaugaagcaaacuugaucaugguggauaagcuuuuugaugugcugcuggauucgguuugccuguauuuuauugaggguuuucacaucgauguucaucagggauauuggccugaaauuuucuuuuuucguugugucucugccagguuuugguaucaggaugaugcuggccucauaaaaugaguuagggaggagucccucuuuuucuguuguuuagaauaguuucagauggaaugguaccagcuccucuuuguaccucugguagaauucggcugugaauccgucuggucauggacuuuuuuugguugguaggcuauuaauuacugccucaauuucagagcuuguuauuggucuauucagggauucgacuucuuuguggcuuagacuugggaggcuguauauguccaggaguuuauccauuucuucuagauuuuccaguuuauuugcauagagguuuuuauaguauucucugaugguaguuucuauuucuguggggucaguggugauauccccuauaucauuuuuuuauugugucuauuugacucuucucucauuucuucuuuauuagucuggcuaguggucuauuuuguugauuuuuuuuuuucaaaaaaccagcuccuggauucauugauuuuuuuuuuugaaggguuuuuugugucuccaucuccuucaguucugcucugaucuuaguuauuucaugucuucugcuaguuuuugaauuuguuuucccuugcuucucuaguucuuuuaauuuugauguuagggugucaauuuuaggucuuuccugcuuucucuugugggcauuuagugcuauaaauuucccucuaaacacugcuuuaaaugugucccagagauucugguauguugugucucauucucauugguuucaaagaacaucuuuauuucugccuucauuucguuauuuacccaguagucauucaggagcagguuguucaguuuccauguauuuguacggauugggguaaguuucuuaacccugaguucuacuuugauugcacuguggucugggagacuauauguuaugauuucccuucuuuugcauuugcugaggaguguuuuacuuccaauuauguggucaguuuuagcauaagugugaugaagugcugagaagaauguauacucuguugauuugggguggagaguucuguagaugucuauuagguccacuugguccagagccgaguucaaguccugaauauccuuguuaauuuucuaucucauuuaucuaauauugacagugggguguuaaagucuccuacuauuauugugugggagucuaagucucuuuauaggucucuaagaacuugcuuuaugaaucugggugcuccuguauuggcugcguauauauuuaggauaguuagcucuucuugcuacauuguucccuuuaccauuauguaaugcccuucuuugucucuugaucuuuguugguuuaaagucuguuuuaucagagaccaggauugcaaccccuacuuuuuuuugcuuuccauuugcuugguggaucuuccuccaucccuuuauuugagccuaugugugucuuugcacaugagauaggucuccugaauacagcacacugaugggucuugacucuuuaucuaauuugccagucugugucuuuuaauuggggcauuuagcuuauuuacauuuaagguuaauauuguuaugugugaauuugauccugucguuaugaugcuaucugguuguuuugcccauuaguuaaugcaguuucuuaauagugucgauguucuuuacaauuugguauguuuuugcaguggcugguaccaguuauuccuuuccauguuuagugcuucuuucaggaccucuuguaaggcaggucuggcagugacagaaucccucagcauuugcuugucuguaaaggauuuuauuucuccuucacuuaugaagcuuaguuuggcugaauaugaaauucuggguugaaaauucuuuucuuuaagaauguugaauauuggcucccacucucuucuggcuuguaggguuucugccgagagagcugcuguuagucugaugggcuucccuuuguggguaaccugaccuuucugucuggcugcccuuaccauuuuuuauuucauuucaaccuuggugaaucugacgauuaugugucuugggguugcucuucucgaggaguaucuuugugguggucucuguauuuccuaaauuugaauguuggccugucuugcucgguuggagaaguucuggauaauauccugaagaguguuuuccaacuuaguuccauucucccugucacuuucagguauaccaaucaaauguagauuuggucuuuucacguagucccauauuucuuggaggcuugacucguaccuuuuuuuuuucccucuaaucuugucuucucgcuuuauuucauuaaguugaucuucagcugauauccuuucuucugguugaucgauuuggcuauuaauacuuguguaugcuacacgaaguucucgugcuguguuuuucagcuccaucaggucauuuauguucuucucuaccuugguuauucuaguuagcaauucaacuaaccuuuuuucaagguuauuagcuuccuugcauuggguuagaaccuggugcuuuagcucaaaguuguucguuauuacccaccuucugaagccuacuuuugucaguucuucaaacucauucugcauccaauuuuguucccuugcuggcgagggguugugauccuuuggaggaggaaaggcguucugguuuuuggaauuguuagccguuuugcguugguuuucccucaucuuuguggauuuaucuaccuuuugucuuugauguuggugaccuuccaguggggucuuugaguggauguguuaacucccgacccuguuugucuggguaucaccagcggaggcugcagagcagcaaugauugcugccuguuguuuccucuggaagcugcgacccagcggagcaccugccagaugccagccagagcucuccuguaugaggugucugucggccccaucugggaggugucuccuagucaguauacacaggggucagggacccacuugaggagacagacugagccuuagcagagcuggaacgcugcacugggaguucugcugcucucuucagagccaucaggcagggauguuuaagucugcuauaagccacugacuggggcugcugccuguuuuacagagaugcccuguccagagaggggcaaucaggcagucuggccaccgcagccuugcugagcugcagugggcuccacccaguuugaacuucccagcagcuuuguuuauccuguggcugugaaacugccuacucaagcuucagcaauggccgacccccccgccccaccccgcaaccccccgaccaaggucgacugucucaggugcaucucagauugcugcugugcuggcagcgagaauuucaagccagcggaucuuaguuuccugggcuccgugggagugggacccgcugagccagaccacuugacucccuggcuucagcgccccuuuccaggggaguaaaugguucugucuuaguggcauuccacaugccacugggguauggcaaagaagaaaaaaaaaaaagcuccugcaucuaguucggugucugcccaauuggccagccaguucugugcuugaaacccagggcccugguaggguagucaccagagggaaucuccugguuuguggguuacgaagaccaugggacaagcgcagugucugugcuggaguucuucaggcucagucccucacagcuucccuuggguaggggggaaaauuccccgacaccuugugcuucccaggugaagugacgccccacccugcuucgccucgcccuccgugggcugcacacacauuccaaccagucccagugagaugaaccagguaccucaguuggaagugcagaaaucacccgccuucugcaucaaucucgcugggaauugcagaccggugcuguuccugucuguuuccacauuuuuaucugcauauguaaaaaggauccuucaguuuccucaaaggugcuagaggaaagagucuaauuuuuauauuaaucaggaugggcuaaucuaugauguuguaacuaagccugaaauaccaguggccuaaccacaaaaauguauuuucauucacaucauaugcagcagaaaucacugaagaccacuguuccaaauaaucccucagaaccaacauugacaggaaggcugacauguuauagcuucaccagugcaacacauggcuuccaaggugccacagagggggaaaugggauggggugacacauugauuuuuuuuuuuuuuuuuuuugagacggagucucgcucugucgcugaggcuggagugcaguggcgcaaucucagcucacugcaagcuccgccuuccggguucacaccauucuccugccucagccucccgaguagcugggacuacaggcucccaccaccacgccuggcuaauuuucuuuguauuuuuaguagagaugggguuucaccguguuagccaggauggucucaaucuccugacuucaugauccgcccaccucagccucccaaaguucugggauuacaggcuugagccacugcccccggccgacacauugauucuuaacugucagcugaguagugaauuacaucacugugaucagauucauaauaaucacaugacuacaagcuaacugcaaaguggacugagaaauguaggugagcagauggaauacugucucugucccauguuuucuucaccucuacacuugcaccucauagaaagaauuagcuucauguuacuaguucuuaugucaguauuuuuugucaaccaaaguuuuagaagggaaggggguugcguggcaggauucaaacaccaaaguccaccuucaaccuccaaaagcaacuugaucuuacacuaugccuucauuuuccccuugaucacauaauauaaaaaugaauguugaaucugauuguuugcuacaggcuuuucuguccagaaugugaaaggucaaaguaccaucucaaucgucauuaaguuuguagcauuguugugcuuucauagcuaaaaguucagaaaaaccgucuucauaaaucuuugcuuaugaaaaugggaugaugacaugcaaggucggcucacuugcuggaaauaaccaaggauauuuuuugaaaauucuccaaaauuguuuccuggaauguguuugacauauaaaucaaacuugaguucaaagauuccuuuuuaauaucuuuuugcaaagauugaagugcaugagaaagaggucuuuuaaguuuucaggcaagaucuucaacugcaauaguaugaaauuaucagcuaccucauucaaaagacuugaauaauauuugagguucugccuaaauuugaaaccguuuucacuagcuuuucuuugagaacuucuucaacucaaguaagugaagacuuuuaagucuacaaauguuguuugucauuuaaguuucacuucgaaucaucagauauguuuuccaaaugugcaaaucucuguuaaaaauuagaguuuuuaggcugggcaugguggcucacgccuguaaucccagcacuuugggaggccaaggcaggcggaucaugaggucaggagaucgagaccauccucgcuaacacggugaaacccugugucuacuaaaaaugcaaaaaauuggcugggccugguggcgggugccaguagucccagcugcucggaaggcugagucaggagaauggugugaacccggggggcggagcuugcagugagcugagauugcaccacugcacuccagccugggcgacacagcaagacuccaccucaaaaaaaaaaaaauuagauuuuuuauuguaguaaaauauacauagcauaaaauuuaccauuagugauauuuaguacauuaacuguguuguacaaguaccaucugaaucuaguuucaaaaccuuuuccucaccccaaaaggaaacucaguacccuuuaagcagucaucugccucugggaaacacuaagcugcuuucugucccuagggauuugccuauuuuggauauuuaauauaaacagaaucacaugauaugugucuggcuucuuucacuuagcacgauguuuucaagguucauccauguuguagcauguaucaguacuccauuccuuuuauggcuaaauaaaaaauuauaauuuuuaaaguuuaugaaguuggucuuuucucuggugcuccaaaaauagaauaccauuaugauuuauuuuauaaauccagccaaaggaauuuuuuuugaccaccaacgaauuucaacauagaacagaaaacuuuuaauucuuaucauuuaaauugucauaaagcauaucaaauaaucagauguuuaacauacuugccacaugauacucuugccuugacaaucaagcaagguuagggucuucuccuaaaccagugagcauuguuucagaagccacuaauuagcaguggaugacacaguauauccaaaaccagaaaucuugaugaugagcccagccuugcuggacugaaaugccaucacuauacacuugagucauuuuuuuuguuugcuuuauagaauuuuguuauuaucaguuuucaugcugcucuccaaauuuuuucuucuauguguuguaccccauauggcaaugaaaacaguaauugaacaguuacaaguuuucauuguuuuaaaaaaaauuaggacacugacuuuaaucuuuuucaaaacuuuuuuuugccaucuucuaaaucaucucuuuggugcuuaauacuaauuuagaacaucuucugaaauuucuucuauguucuggaauuucuuuucuauucuuuuuuccaguauauuuaaaauuugaaagcuauauagaauccaagguuucuccaacaguagauuuuuuucuuuaugaucaaaaaugauauuuuuauuacacuuucucagacauggcucauaauauuagguauuuuauuauuauaaccuucucuuaauuuaauaugauuggcauuggugugauuaagugggugauguuaauaauauuugacaguaguucauaccuagcaucccagcacuuugggaggcaggaggaucacuugaggccaggcaggaauuccagaccagccuaggcaacaauuuuguagcaacaagcuacaaaaaauaaauuaaaaaauuauguggcugugguggcacgcaccucuggccccaacuacuugggaggcugaggugggaugaucaguugagcccaggaguuugaggcugcagugagcuaugauuaagccacugcaauucaaucugggcaacagagugagacucucuuaaaaaaaacaauuugacaaaaaaaaauuucaggaaccauauuuaagacauuaaaguggggugacaucggagguaggaaaaccagcugguuagacauuuuagaaauuuaagugucauuaaaaguucauuaagggcaagaacugugguggugguguguuguucaucuuuguuguauuguucacucuuuguaugauuugugauacauaguauagguucauaguuauuuuaugccacuuguggaacauagcagaaaacaaaaguaaugcauaagcaaacgaauuauccuuauucuugaaagaaagacagcugaagaccuagacuacugugguggcagugaaaaaucgagacuggaagaagauggggcagaguguuagagggcuaaauaaaggauuaauguggaaugcaccaagagaaaaagaguuaaacacacucccaaacugaacacuguggaaacuagagaaaagaaggugaugauaaguagcaauuaagaagagaauguguguuuguuuucuuugaggggagagcuacacaaggguauagcugauaacauuagguauuggagcaagagccaauuggaaaauaccuguaggccaugggauuuuaaaaauguaaauuugggagcuauuugcaugugauugauuaaaucauuauguggauggauucuaagauuaaacuuuuguggauaucuucugauaagacuaagaauaggcuugguuauaucauguuaaguauuuucaaaaacugaaucucuguuuaaacugugcuuuauuaaguaagaauaaauucuaccaggaaugccaguaaucuguccacauuuuucauugcaauggaauuuugcuuagauuaggcuaccagaauuuuacuaugaauauuuuuauuauaauaggauuuguggcacauuuggagccauuauggcaaacugaguuuagaagaaagguaggaaggcaaaaauuauuuuaaagguuacauuuagagacaaaaugacauaguugcagaacaguagcaacagaaaaucuuacaaguagauucucuaaauagcuacuguuggcaagccaacaaauaauuacaucuguaaggucuggaaagaguuacugguuuuauuucaguguuuuuaaccucaguuccauccacagguaacaguagcaccaucagucacauguuguaaauauuugaaaauuagaaacggauucuagaaauuaugucauucauuuuauaguucuacagaaaauuugcuguaaaagugcugaaaaccucauagccaguuaacgguuaguuaacuaauaacuguuucucuugauuccugguccaguacuuguccuauaggacaaguaaaacccuccuucuuuaaaugugauuaaaaaugagaagcuuuuuuugagccuuggucaauaauucuauuuaugcccaugauguaagaacuaauagggaagugccauuuucuuuuauuaaauuuuuguaugcaauaaauuuaucaaauaaccucauuguauuauuuuagugaugagaaaagacagaugauucaucuguuuuaaauuuaaauagucauuaucguuuagggagauguuaguaaauuuuguuuggggaaaaaugaguguuuuuuaaaaaugaucuuucuuuuuaauccuuuguaaauagcaagaaguugagaaguuuacagaccuagagaaacucuaccucuaccuucagcugccuucuggucucagcaauggagagaaaagguauaucuauucuugucuuugcuauaauuaugcuguuuauaggaugucccuaggauauaugugaggucuguauguuuugguuguuagaguuuuugcaauauuccugaaaugauuagaaaacauacuggcaaaacaauacaucauuuuagucuuuggugauauuugguuaaguauuuacuugcaguuuuuguuaauuuauuugugcaauuggguaaaugcuaugacaugcaauuuggguuuuguuucauagacagaugacuauguuuaugcagugugagggauugugaaaauugaacagaaaaccaaagaauaaacagauaaguaucauaaggaauaagguauaagaguuuuuuuagguacuaucagauaaacacaucauagaauauaaaacagaaaauaaagugaaauugccuguaugaaacaugaauucauaaauguaagguguguuaagugcuugggguauuacuauaguuucaucauuaaaaauuauagaaacuguggagagaagcuguucauucagucauucuaauuuuuaaaagaguuuccuuaaccuuuuaaguauuucucagaauucaucucauucauauaaauuaugcuuaucauucuauuuuuuaaaacuguauauagaaauaaaugaaaugcaaauuauuugaguuuuaucuuuuuuucccucagaccaacuuuuaucacuguuuuaaucauguuauguccuagacacuugcucaguguuuucuuugaaauuaaauaaauuauucuuacagauagcugagauggaugucacaaucaguagaguagcuucccuuguccuaucuuugguguccauuucgguauuuauuuauaaguaauacuuccauauaguaaaaguuuacaguguuuaauggauaugucaggcugaggcagggggccuggcuuuaggaaggauuguagggggagauuugucuguucaggaucucucuggugcaaauuccauucuggagcacagaaugcuuuaguaagauuuccaaguaguuauauauacauauauauguguguguguguguguguguauguauauauguauauguauguguauacauguguauauauauauguguguauauauauauauuauaugagaaugcugagcaaauagaaauaagcaauuuuuauauaauuuuguuuuaaaguuugaugauuuauuugguaaguguaggcaaaugaacagguaaguacaugagcagauacccacuuaaaggugauuuuugaccaaaacaaauacuuugucagugcucuaucaccugcauggggagggauggagcagggcaguaacuucagucuuacacuagcuauagcaaacagcucacaaccauagguggacaauuaucuacuagauguccuaaguuugguuuggucguugauaguguauuuguauacaguucuuuaguggaacauuuaggccuagcucaaaaaucguuaaugaauugcugucuggucagcuaaaacauguuuucauucuauuagugaucagaaugccaugucaucuagucgggcacaacaaaugcaugccuuuuccuggauucggaauacccuagaggaacauccggagacuucacugcccaaacaggaagucuaugaugaguacaaguaaguaguauguguaauauggcaugcugauauauuaaagagguaaaauacuauacuuggccauagugauuuguuuuauuauuggugaauaucaagcugguauaugggaauuacacuuagaaaucucuuaagauucauuccagcucuaagcuucuguaguagcauuuauaauaaaggggggcaggauuaaugaauaaaaggauuucuguagaguucuucaggaugacaggagggaggucagagagugcaaggacagugguguaggauuggugaauaaaaggauuccuauagaauucuuagguaugauaggaguguguaucugggguuagagaguggaaggcaauaaauaaaucaauacauaaggcgaaacuaaaacaugauuuuuuacuuggacuuuuuaaaggcccuuuucaugaaucuaaaagucuucuaauucuucuccauaccaaagaauauuguauauuauuuaucaaggacaagagaguuguccuugcacauguuagacacucaaauuugguuguauuuacaauuuauuuaaauccaggauacaaaaauacagaggcugaugagcccuucugguuagaaaaagguuaauaggugcuaaauauagucucguuuaacauuuuuauaauugauuuggaaggaggaauuuauuccagcagaguaaauaaaagcaaauuugagggcauauugaaaggucagaccaacaagaauuaauguguuguacuuacaaauuuggggcaaaaagugucaaauaagugcuauugcuaaccaguguaagguaaugcgaaggaaauuguacuuauugagauuauugguaucuauucacaguucuuacuaccucaccaaaagaaacauaauggagcuagaagaaagucuagauaaaaauaucugaaaugaucaagagaacaaaguuaaacugaaggacucuagauuuauuuucucuuuacaaagguuaaaacugagagugcaugugauccaacuuguucauucauucagucuacaacaauccauugaauaccuauaugccagacccugugauaaguucucaggauacaauuguaaacagucacagcccuugcccuuauucagcauauaugcauauauauauauauauauauuuagaguaagcauagauucuucauuaaauucaaguuaguuaaaauagaccccuccgaaacuucaaagaagcaaauuugaauucaguaaaagguuauagaaaucagguaaacuuguaugauauguugaaacucuggauugaagaucaagagaauagauucugccauuaaacuugugugacauaggcaagcauuuuaaccagucuuugucaguugguucaucuauaaaaugaggcaguugaagauguaugagguuucuuugguuuuuuuguuuguuuguuuguuuguuuuuugagacaggguuuaacucuugucaccuaggcuggagugcaauggcacgaucacagcucacugcagcuuuaacucccacucccacccccacccccagggcucaagcgauccuccugccucagcccucugaguagcuaacacuaugggcaugcaucaccaugccuggcuaacuuuuguuuuuguuuuuuguagagaaagaguuuuaccauugcccaaacugagguuucuuuuagcucuaaaauucuaaaaguugucucaaguagggaauguuaaaggacuaauuauccaaagaugucuugcugguuuuccaaaaggcacauugggcaaauaaaugugugacaauuccauaacagacuaaugagggaauacagaguauucauauaauuuuugaagugaugacuuuaaucugcaccacccuucaugauaccuuagagagagcaugcugcauuugcggaagagugauccuggcccaugaaagcaguccuuauauuccuaaaaguuuucugccuuuggcaagacaugguuauguuuuccuauaauauuugaauuuuuccuugaaaucuuuuucaaagauucccauaaauucuuaugauuuuuuuucuaaaaaaaguuaaaggauuuuuuaaacaaaagagacccaaaacaucacauuguuugggaggaguagugagaacuccaauuuugagcaauuaauuuacaguucaguagagagcaacagagauaaaagaaagugauuuagcggggaaggagccaagauggccgaauaggaacagcuccggccugagugacgcagaagacggugauuucugcauuuccaucugagguacuggguucaucucacuagggagugccagacagugggcgcaggucagugggugcgugcaccgugcgccagccgaagcagggcgaggcauugccucacuugggaagcgcaaggggucagggaguucccuuuccgagucaaagaaaggggugacggacggcaccuggaaaaucgggucacucccacccgaauacugcgcuuuuccgacgggcuuaaaaagcggcgcaccacgagauuauaucccgcaccuggcucagaggguccuacgcccauggagucucacugauugcuagcacagcagucugagaucaaacugcaaggcgacagcgaggcugggggaggggcgcccgccauagcccaggcuugauuagguaaacaaagcagccaggaagcuccaacugggcggagcccaccacagcucaaggaggccugccugccucuguaggcuccaccucugggggcagggcacagacaaacaaaaagacagcaguaaccucugcagacuuaaaugucccugucugacagcuuugaagagagcagugguucucccagcacgcagcuggagaucugagaacgggcagacugccuccucaagugggucccuggccccugaccccugagcagccuaacugggaggcaccccccagcaggggcacacugacaccucacacugcagcguauuccaacagaccuacagcugaggguccugucuguuagaaggaaaacuaacaaacagaaaggacauccacaccaaaaacccaucuguacaucaccaucaucaaagaccaaaaguagauaaaaccacaaagauggggaaaaaacagaacagaaaaacuggaaacucuaaaaaccagagcgccucuccuccuccaaaggaacgcaguuccucaccagcaacggaacaaagcuggauggagaaugucuuugaggagcagagagaagaaggcuucagacgaucaaauuacucugagcuacgggaggacauucaaaccaaaggcaaagaaguugaaaacuuugaaaaacauuuagaagaauguauaacuagaauaaccaauacagagaagugcuuaaaggagcugauggagcugaaaaccaagguucgagagcuacgugaagaaugcagaagccucaggagccgaugcgaucaacuggaagaaagaguaucagcgauggaugaugaaaugaaugaaaugaagcgagaagggaauuuuagagaaaaaagaauaaaaagaaaugagcaaagccuccaagaaauaugggacuaugugaaaagaccaaaucuacgucugauugguguaccugaaagugauggggagaauggaaccaaguuggaaaacacucugcaggauauuauccaggagaacuuccccaaucuagcaaggcaggccaacauucagauucaggaaauacagagaacgccauaaagauacuccucgagaagagcaacuccaagacacauaauugucagauucaccaaaguugaaaugaaggaaaaaauguuaagggcagccagagagaaaggucggguuacccucaaugggaagcccaucagacuaacagcggaucucucggcagaaacccuacaagccagaagagagugggggccaauauucaacauucuuaaagacaagaauuuucaacccagaauuucauauccagccaaaccaagcuucauaagcgaaggagaaauaaaauacuuuacagacaagcaaaugcugagagauuuugucaccaccaggccugcccuaaaagagcuccugaaggaagggcuaaacauggaaaggaaaaaccaguaccagcugcugcaaaaucaugccaaaauguaaagaccaucaagacuaggaagaaacugcaucaacuaacgggcaaaacaaccagcuaacaucauaaugacaggaucaaauucacacauaacaauauuaacuuuaaauguaaaugggcuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauacuauucucugauaaaacagacuuuaaaccaacaaagaucaaaagagacaaagaaggccauuucauaaugguaaagggaucaauucaacaagaagagcuaacuauccuaaauauauaugcacccaauacaagagcacccagauucauaaagcaaguccugagugaccuacaaagagacuuagacucccacacauuaauaaugggagacuuuaacaccccacugucaacauuagacagaucaaugagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauacuuggaaguaaagcucuccucagcaaauguaaaagaacagaaauuauaacaaacugucucucagaccacagugcaaucaaacuagaacucaggguuaagaaucucacucaaaaccacucaacuacauggaaacugaacaaccugcuccugaaugacuacuggguacauaaugaaaugaaggcagaaauaaagauguucuuugaaaccaaggagaacaaagacacaacauaccagaaucucugggacgcauucaaagcaguguguagagggaaauuuauagcacuaaaugcccacaagagaaugcaggaaagaucuaaaauugacacccuaacaucacaauuaaaagaacuagaaaugcaagagcaaacacauucaaaagcuagcagaaggcaagaaauaacuaaaaucagagcagaacugaaggaaauagagacacaaaaaacccuucaaaaaauuaaucaauccaggagcugguuuuuugaaaggaucaacaggauugauagaccgcuagcaagacuaauaagaaaaaaagagagaagaaucgaauagaugcaauaaaaaaugauaaaggggauaucaccaccaaucccacagaaaugcaaacuaacaucagagaauacuacaaacaccucuacgcaaauaaacuagaaaaucuagaagaaauggauaaauuccuugacacauacacucucccaagacuaaaccaggaagaaguugaauaucugaauagaccaauaacaggaucugaaauuguggcaauaaucaauagcuuaccaaccaaaaagaguccaggaccagauggaugcacagccgaauucuaccagagguacaaggaggaacugguaccauuccuucugaaacuauuccaaucaauagaaaaagagggaauccucccuaacucauuuuaugaggccagcaucauucugauaccaaagccugacagagacauaacaaaaaaagaauuuuagaccaauauccuugaugaacauugaugcaaaaauucucaauaaaauacuggcaaaacgaauccagcagcacaucaaaaagcuuauccaccaugaucaagugggcuucaucccugggaugcaaggcugguucaauauacacaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguaucucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaagugcuggccagggcagucaggcaggagaaggaaauaaaggguauucaauuaggaaaagaggaagucaaauugucccuguuugcagacgacaugauuguauaucuagaaaaccccauugucucagcccaaaaucuccuuaagcugauaagcaacuucagcaaagucucaggauacaaaaucaauguacaaaaaucacaagcauucuuauacaccagcaacagacaaacagagagccaaauccugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugccuuucuucacagaauuguaaaaaacuacuuuaaaguucauacggaaccaaaaaagagcccgcaucgccaagucaauccuaauccaaaagaacaaagcuggaggcaucacacuaccugacuucaaacuauacuacaaggcuacaguaaccaaaacagcaugguacugguaccaaaacagagauauagaucaauggaacacaacagagcccucaaaaauaaugccgcauaucuacaacuaucugaucuuugacgaaccugagaaaaacaagcaauggggaaaggauucccuauuuaauaaaugguacugggaaaacuggcuagccauauguagaaagcugaaacuggaucccuuccuuacaccuuuuacaaaaaucaauucaagauggauuaaagacuuaaauguuagaccuaaaaccauaaaaacccuagaagaaaaccuaggcauuaccauucaggacauaggcaugggcaaggacuucaugucuaaaacagcaaaagcaauggcaacaaaagccaaaauugacaaaugggaucuaauuaaacuaaagagcuucugcacagcaaaagaaacuaccaucagagugaacaggcaaccuacagaaugggagaaaauuuucacaaccuacucaucugacaaagggcuaauauccagaaucuacaaugaacucaaacaaauuuacaagaaaaaaacaaacagccccaucaaaaagugggugaaggacaugaacagacacuucucaaaagaagacauuuaugcagccaaaaaacacaugaagaaaugcucaucaucacuggccaucagagaaaugcaaaucaaaacuacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguauggcgauuccucagggaucuagaacuagaaauaccauuugacccagccaucccauuacuggguauauacccaaaggacuauaaaucuugcugcuauaaagacacaugcacacguauguuuauugcagcauuauucacaauagcaaagacuuggaaccaacccaaauguccaacaaugauagaccggauuaagaaaauguggcacauauacaccauggaauacuaugcagccauaaaaaaugaugaguucauguccuuuguagggacauggaugaaauuggaaaacaucauucucaguaaacuaucgcaagaacaaaaaaccaaacacugcauauucucacucauagguggggauugaacaaugagaucacauggacacaggaaggggaauauaacgcucuggggacuguuguuggggagggcgguagggauagcauugggagauauaccuaaugcuagaugacgaguuagugggugcagugcaccagcauggcacauguauacauauguaaguaaccugcacaaugugcacauguacccuaaaacuuaaaguauaauaaaaaaaaaaaaagaaaguaaaaaaaaaaaaaaaagaaagugauuuagauaggcuacaauuuaaaaaggcaguaguagguaagggagaguuuuuauaauagcaugauuaggaaagaaaugccaguucuguucauggaauuggagagaauuauucuaaugauaauuaauagaguacuauacacaaaauaucugagucuggguauuuuaguucaaaaaauuucacuaagaauauuucacuuauuuacuguaguguucccccauagcauuuccacauaguaggcacuaauuuuauaguaagagugauuagagcggaaccugaucucugacaaugauaauaaaauuuguguuguaacagaccuuguaggucuuccacuauguuccuauccucuuuuuauagaugaaaacauuugaaaccuagagaaguuaagugacucuaccagugugacaaaacuagugaggggcagaucuaagacuagaacucagauuucaugagugaguucauaauagguuaagaagguaagcguguuaaaguugaguaauaucaaacugaguggguagaaaacauuggacaaguaguuagaaauacugcuaauauuauuuggccaggacuuccacuugguguagauaaauaagcagcucagaguaugaauuaguuuacauaugguuaguauacgugcauacaaauaauaugguuauuguaagagacacagcauaacaacaugacaugugcuaggaagaaagaauguugguguuuccauagaauuacagcauguagaagcuucaaguuguucuguuauuugauuguacauugccuaaaaccauaauuugccauuuggguuuaaauaauuugaaagagauaaaaaagguagaaacacuacagaaaggcaaaauguagaucaaaguauuagaaaacaguuaaaaguuuuacaauuauguugucuaaagaaaacuaaauagaauauagcuauauauuuuaagaacaagaguuuuaaaucacaggagagauuucaguuagacacacaaucauuaggcacucauuauccuguuuagagugccuaaaugaaauuucccgaacaaaaacuuaacaggaucaguuuaagacugaucauucuguguucucaauacucaaugaaagaaaugguguuauuaauaugaaguauccuuuuaaguuauuccuguuguguauggacccuuuuauaauucauuucaguguauuuagauguauuugugucaaaaucccuuuaauagucauuaaaagcaaaaucccuuugaggaaaaaaaugaaguuguaaucucagacaguaaagacuggcuucuuuuaacuguguuuucaugcuaaauuaagauauuaauagaaauaaaaagcuuuaaggagcuuucaguaugcaaaaacaguuuaguuuacaaaugauuuugagcuuuuuuauuuguugaaauuuuugaauucuaauauucaugucuucaggaaaauuauuagugcauugauuuuuauacuguuuuucuaauuauaaaauguauauucaucaugaaaguuugggcaaauaguuauaaauguauaaagaagaaauuuagcaccuguaaucucacuaucugaaaauaaccaucugguuuuauuuccuuauaguuuuucuaaugccuucuuuaauguauacauuuuuguuguuguuuaaccaaauuuggccccacuguuuaugcaguucuugggugagaggguaguugcaaauagcacugcagugaacauccuuggcuguauaauuuaauguaaauuaucaaaauugggauugcuggcuaaauacuguuauuuauuauucacuaaaugcauuucuuucugauauguuuguucuagccuuuuacauguccauuuauuaaagacauaaauauuaaaacauaaauguuuuucaagauugcuguuuguuaauuuuaguuaauuuuuaaauaaguagucugaucuguacacuuuugucacagcuuguaacauuacuauuaugcuuagaaaaaacuccaugccaccagcugcugaauacucacauauauuuuuccuagguauuuuuuauuuuauuuuuuauauauaagccuugagucuaucugugauuuauuuuaguaaaugcuauuagauaagguacuuauuuuaauuuuuucuaaaugguuaauuaucccagcuuuuuuauugaauaauuuuucugucuuaacacuaaucuauaauguacuguuaccuuacuaaaggcuucuggacucaauuuucuuucuuuauguucucuguucuucugguaauacuauacuacuuagauauuuuagcuauuaaauguuuaaauagcugacaggacccaucuuuccuccuuauaccucuuuuucacaaguuuccuugguuuuauuuucugaccaguuaauuuuuuuuauaggaaguugcgaaucaguuuucugauuuuaaaaaaggaaacucuaaggggauuuugauucaaacacauuaacugaaaauuuuagaaaaauuaacuacagacuagaaauauguuucuuaauuuacauguuucuuucaugcccuucauuaauguuuucccuuuuuucccucaauuaaguucacuuauuuucuccuuuaacauaauccucgguaauuucuauucauauugugaaaaauaugaauaauaugaaaaaaugaauaaauaugaaaaagacuauuuguuuugguuuauaggaacuuccuagauuucuguuauuuuuauguuguacauuuuauauuuacuggauuuuguuuaguccuuauuuuuaguuguuacuuuugacuuuucuagauaguuuauccugugaaucuucuucauugucuuuacuuuguuauuacauuuaauagacuuuccuuccaauuuuacauauagcagugauagacaucauuuccucuuacaguaaguucacugauguuaaguauguaucacuuauaguugaacaagacuuuauuuucuuuuuaaugagaagugaauauuggaauucauuaaauauuuuggcauccaaaugagauuauuuugcagugcuucuuauuugaccugucaaugugauguauuuuauaaagauauuacuuaauauaggccgggcacagugucucaugccuguaaucccaacacuuugggaggccaagucuagaggaucacuugaggccagaaguuuaagaccagacugggcaacaaaacaagacccugucucuacaaaaaauuagcugggcaugguggcaugcaccgguagugcuagcuauacgagagucugaguuggaggauugcuugagcucaggagguggaggcggcaguaagccaaugcacuccaaccugggugacagagugagauccugucucaaaaaaaaaaaaaaaaaaaaaaaaagauaccuaauauaaucucuuauuucuagaaugaauguccuccuuaugucaagacguguuaucuuguaguguaccauugaguucuguuuucaaguguauuauuuaggaacuuugcaucuacauucauaaaugaauuuggucuguaauuuucuuuuuuuuuuuaugcuaucuuugucagguuuugauaucaggguuaggccagcuuugcaaaaugaauuggaacucuuucccuaauuuucugugcucuggaacaguuuauauagcaugggacuuauuuauucuugaaaguuuuaaagaacucaacuacaaaaccaucuaggccuggagccuuuguuggagguaauucuuugacaauuuuuguguuuuacacugguuagguuuuuacuuuauucaucaauuuuggucauuuguuucucucauaaauuuaauaucuuuuguaucuucuuauaugcuuuuugauauuucuaguuuuguacauugaauuuuccucuuuuuucauauuucacuuagccuaauuuauuuuuuagauuuuucuuuuuuagacaaguaaaaucugauauguuuuauuuucuugucuuuuuuucauuuauuaggugcuuuuauuuuugguccuucugguuuucuuggguuuuuuucuuacucuuuaaauggaaugcuuaacuuuguuuucauucuuucacauuuaggauaggaacauuuauaucuaugaauuugccucucauuauaguuuuggcuguauuccauuugauaugcauaugaguuguuauaauugccauuauuuuccaauaguguggaauuaucguuuugcuuuuuucugugaccuaaauuagaaguuuguuuucuuuuuaaauuuuucagguguuugaggguuuauuucauuuuauuuugcuuuacacuuucauauuuuuaguuuuauuaaauuguggucagagaauggggcuuaguuucugauauuuuuauugagauuuacuuucagucuaacaaauuaucaauuuuuaaaauauuuugacauucucuuucuguagcucuguauauuacauugauugcacuaauucaacuuuuuaauauuuuucaaauucuguaaaaaauucuuuuugucuguuaacacacugcucaucuucaacugaguaaauuucucacaaaaaugaugugagauucuuuaucacaguuccuuacuguauuuuuuaugaguuuugcuuuacaaauguuaggauuaacacaaaaguuucaugauuuuguauccuuaguagaguuucaauaaaauuaauuuuaggcaaaugcaaguacauauaagaaaauuaacuguauuacaggauagggaguuuucagcuaccauuuacaaauggcuuaggaaaaucuuuacaaauuguacccugggagaagcagccacauguaccauggccaaaaagaucaaccauaggaaacaucaucagaaaaauaccaaaaccagaaacguuucacccuucuacaaaaccaugauaaugccagauaccucagccugaacuaugccaaguagacauugcaagaccuuuaugaauuccuaguuuuagaaauaccauuacuuuuuuagaucucuucacuuuguauucauugccaucaucaccuacccugggcgacugcuuuguuuucagggcagugugcucuccaacuuccuguuacaaaaauuuucagagauaauagaaauguugaaaguauacuguaagaauauccauauuccuaugugcuucacauagguucaacaguuuuuuuccuauaccauuuguaaguuguggauaugauacuucuccuaagaauaaagacaaucacuuuuauaauacuuugauuacaucuaagaaacuuaacaugaguucuauaaaauucaucuauuaccugauuuggaacuuuuuuuuuuuuuuuugagggggagucucacucuugucaccuaggcuggagugcuguguugcaaucucggcucacuacaaccucugccuuccggguucaagugauauuucugccucagccuccccaguugcugggacuacaggcaugcaccaccacgccuggcuaauuuuuauauuuauuauagggauggguuucaccauguuggcaaggcuggucucaaacuccugaccucaagugauacacccacuucggccucccaaaguguugggauuacaggcgugagccauugugccugguccuguuuuuaaccuaggaaaaaauaaguuauucuucugauccaugaacaugggguauauuuuuguuuacuuagaucuuuaauuucuuucaaggauguauacaucuuaaucuucuuuugcuaaauuuauugcucaauauuuuugauugaaguggaauuauuuuuaauaacacuuuuggauuaguuguugccaauauauagaaauaagagugauuuuguauauugaucucguauccugcaauuuugcucaccuuuauuagcucuaauuauaggguuuaguguauuucuuaggauuuuuuuaucuauuucaucugaaaauagagauaauuuuaccucuuccuuucuaaucuggaugucuucucauuuauuuucuugccugauugccauggcuagaacuuucaguacaguguugaauagaaaugguaagaguggacacccccuuccuugucuguugccugauacaaagaggaaagcuuucagucuuuugccauuaaguaugauauuaucuguggguuuuuaucgauggccuuuguuaggucaaggaauuuccauuuuguuacuaguuuguuggauaucugucaaacguuuuuucugcaucuauugagaugauuauaucaaagguuuuuuuagaugaacugaauauaguguauuacauuauuauuuuuauauguuguaccuaucaugcauuucugggauaaaucacacuuaaucaugauaucuaauccauuauguaugcagcuaguuucaguuugucagucuuuuguuaaggauuuuugcaucugagggauauuggucugugguuuucauucucagaaugcuuuugucugauuuuggugucaggauaguguuggccuuaauauaaugaguuuagaaguauucccuucuaaacuaucaaagaguuuaugaaagacugauuagaauucaccagcuaaaccaucuuggucugggcuuuucuuuguagguacuuuuuaaguuacuaauucaaucucuguuacuggucagguuaucuauuuccuuuugagucuauuuugauaguuuguguucuucuagaauuuuguuucuuucauguauauuauccaauuuguugucauacaguuuuucauaguauucccuuguaguacauuuuauucaaagucaguaguuaauaccuccguuuucauucaugauuuuaguuauuugagucaucucucuuuuuuuuuuuuuaaacuuggacagcuuagcugaacauuuguuaguuuuguuaaucuuuucggccgggcgcaguggcucacgccuguaaucccagcacuuugggaggccaagacgggcagaucacgaggucaggagaucgagaccauccuggcuaacacggugaaaccccgucucuacugaaaauacaaaaauuagccgggcaugguggcgcgcgccuguagucccagcuacaugggaggcugaggcaggagaauggcaugaaccugggagguggagcuugcagugagucgagaucgcgccacugcacuccagccugggcgacagagcgaaacuccgucucaaaaaaaaaaaaaaaucuuuucaaaaaaacaauuuugggguuuacuuuuuuuucuaauguuuuuauauucccuauuauauuucuuuccacuagaaucuuuauuauagccuucuucugcuuguuuaggagugaguuuucucuuuuguuucuaguuucuuaaccuggaagauuagguuauugauuugacaccuuucuucuuuuuuaauguaggcauaugucccuauaaauuuccugcuaagcacuucuuugacuacaucccauauauuuugauauguuaugcuuucauuuuuaucucaaguauucucuaauuucucuuguguuuuuucgauccauugauuauguaggaauuuaauuuucacauacuugugaauuuccuuuuccuucaguuauugacuucuagcuucuuuccauuaugaccagggaaaauacauugugugauuucaguuuuuuuuaaaauguauuaaguaugauguauccuggagaauauuccauaugcacuugagaagaaugcuuuuugugcuauuguuggcuggaggaguguucuguagaugucuuuuaggucuaguugguuuauaguguugaucaagucaucuguguccuuauugaucaucugcuuauuucuauucauuauugaauuggagcauugaagucucugacuguuauugcugaauugucuuuuuuguguguuuuacuuauuuuggagcucuguuguuugcugcauaaaaaguuacgauuguuacagcuucuugguggauugaccauuucaucuuaauaucuuugguaacaguucucuucucugauauuaguacagcccuccaguucuuuuucaguuacuguagccaugcuuuaucuuuucugguucuuuuauuuacagccuauuugugucuuugaauauaaguauguauguaguauauagacaacauauacuuugaugauguuuuauuuuaaauucacccugccuuuuaacuggagaauuuaauccauuuacauuuaauguaauuacugauaaaguaagguuuacauuugccauuuugcuauuuguuuucuauaugucuuaugccugccuuuguuccucuguaucaggugggguccuucagggaauccaccacacaagugaaauaaugacaauuguuugugaugaggauuugcaaaacacuccaacuacuuuauuucagugaacacaagacugcacugggaauaugggguauuaguuuucaaggcuccuaauggggaaugagagaucagacuagggcaaguuaaaauggcacaaagcuauucuuaaauaaaugcuacccaguuugcugcaggucuuugguuaauuuccagggauuuuccauuguuuuauggaggagucaguuuaggaauuuuacuaugcaguucacugauacuaggaaacuaaauaauuuaaaucccuaaauguugauggaucagauaauggucaguucuaguugccaugcuuuauucaaaaauuaacugaaaugauccagcaaauugaaauagccauuuuaaccauaagaaauaaaaacuaugaaaacacagaagaucaaagccuuuauaaagacuuuguuauggucuguaaaaagcauaaacuaugaaacagacuccuuccaaauuauauuuaaugcuucccucugcuacagaauaaagccccaaaccauuuauuuuucaggggaaggaggacuuauacaggggagaaagauuggacuuggaaaguagcuauauguauauaaauuugaguccuaauuuauuuagacauauacugggauuuguauccaugaggaaguccuuaacguuuaauguuugccuacuauccuuuuguaaaauggaaaaauaucaugcuuuuuuaagauuaaaaacuguauauaugaacuagcugaaaaaagcaaucaagaaaguaaucccauuuauguuagccacauacacacacacacacacacacacacacacacacacacucacacacacagaagaaacccucagaauacgcuuaaccaaggaugcgaaagacuucuacaaggaaaacuaaaaaacagugauaaaagaaauuaaagaagauacaaauaaaugaaaagacaucccaugcucauagaucagaagaauuaauauuauuaaaauuaccauacuacccagagcagucuacagauugaaugcaauuccuaucaaaauacugauuguauucuucacagaaauagaaaaaaagaccuuaaaauuuauauggaagcacagaagacccagaauugccaaaaaaugcuaaccacaaagaacaaaacuggaaggcucacaugaccagacuucaaaauauacugcaaagcuguaguaaccaaaacagcaugguucuggcauaaaagcacacauauagaccauggaacaggguagagaauccaaaaguuaauccacaaucuacagccaacugauuuuugacaaagacgcuaagaacacucaguggggaaaggacagucucuucaauaaauggugcugaggaaacuggguauacauaugcagaagaauaaaacuaaacucccaucucucacccuauacaaaaauuaacucaaaauggaucaaagacauaaauguaagaccaaaacuacaaaauuagcagaagaaaacauagggacuucaggacauuggccugcaaaaagauuuuaugaauaagagcucaaaagcacaggcaacaaaagcaaaaguaaaccaauggcauuauaucagaucaaaaagcuucuucacagcaaagauaacaaucaauacaaugaaaagaaaacuuacagaaugggagaaaauauuugcaaacuauucaucuaaacaggagauuaauauccagaucauuauguacaaggaacucagacauuuaagccgcaaagaaaaaucugauuguuaaaugggcaaaggacaugaguagacauuucucaaaagaugguguacaaauggccauagguacguggaaaaaugcucaacaucacuaaucaucagggaaacgcagauaaaaaccacagugagguaucauguuacccuguuaggauagcuacuuucagaaagacaaauaaaugcuggagaggaugcaaagaaaagggaacacuuacacacuguuggugggaauguaaaguacagcugcuauggagaacaguauggauuuuuuuuuuuuuuucggagacugagucuugcucugucacccaggcuggaguggaguggcacgaucucggcucacugcaagcuccgccuccuggguucacaccauucuccugccucagccucccuaguagcugggacuacaggugcccgucaccaugccuggcuaauuuuuuguauuuuuaguagaggcaggguuucaccguguuagccaggauggucucaaucuccugaccuugugauccgccugccucggccucccaaaguguugggcuuacaggcgugagccacugcacccggcagauguuucuuaaaaauacagagagguguaccaagauggccaaauagaagccuccacugaucauccucccugcaggaacaccaaauuuaacaauuaucuacacacacacaaaaauguaagaaccagaaaucaggugaauggucauaguaccugguuuuaaguugaaagagacacugaagaagguacaaaaaaagucuugaauugcugacaccaccucucccccaucucccagcaccugccacggagaaugaguccacuugcaggagagagagugcagcagcuguggaacuuugcauuggaacucagugccgccaacagugggcagaacucagccagcuccuguggaaagagcauucagaccagcccuagccagaaaggaaaucucucaucccagugguuggaaacugaguucccacaagccucaccacugcaggcuaaagugcucuggaguccuaaauaaacuugaaaggcagucuagaccacaaggacugcaauguauaggcaacuccuagugcuuugcugggcucggaaccaguggacuugggcggcauaccaccuauugagacaccagccaggguggccaagggagugccugcaucagccuucccucaaccugaggcagcaaagcuugcaacucugaaagaaccccuuccuuccacuugaggagaggagaaggaaacgugaagaggacuuuaucuuaaugcuuaaauaccaguucagccacaguaguauaggguaccgggcagagucuugagaccuccauuucaggcucuagcucccaaaugacauuucuagacacacccugggccagaagggaacccacuacguugaugggaaggacccaguccuggcaggauucaucacuugcugacuaaagagccuuugggcccugaauaauaccauuagcagugguaaccagguaguacaugccagaggucuuaggugagauucugagacauucuggcuucagguaugacccaguguauuuacagcugugguggcuacaaggcaagacuucugguuggaaaaagcagagggaagaauaaaggggauuuuguuuugcugcuuaggugccagcccagccacaguggggaagaccaccaagagggcuuuugggguccccgauuccaggccuuggcucuuagaugguuuuugucgaccuaugguauuuggcccuuagaugguauuucucgaauaccaucuaagggugagaaauaccaucugaagggugagucccagauuugagggcauucaccacaggcugacuggagagcccuugggccuuaagugaacauuggcaguacccuggcaauacucccugugggccuguggugguggacacggggagacuccucugacuagggaaaggggaaggaagagugggaaggacugucuugugguuugggugccagcuuaaccgcaguaggauaaagcaccagguagauuucuaagguuucuggauccaaauccugcuccuggauagcaucucuggacccaucuggggucuggggcaacucacaacccugaaggcaagaacaaaagacuggcuggcuucacaaacugcugauuguagagcccuagggcuugagugagaacauaaaugguagcccugucgugguaacagugagccuugggcaauacccagugcuaugcuuguuucaggucuaacccagcacagacccaguagugauggucacagggcugcuugugucaccacucccccagcuccaggcauuucagccuagagagagggagagacuccauuuguuugggagaaaauaagggaagagaacaagaaucucugcaugguaaugcacagaauucuuccagaccuuauccaacaccaucaaggugguaccucugugaaucugcaagaaccacauuacuggacuuguaaugcccccaaaugcaguuaucucugugguggccaaaaacagaucacggcacaaaagucccuucgaauaccugcaaagucuuucccaguaggauggguacaaacaggcccacacugugaacacuacgauaaauaucuaacucuucaauguccagacacugaugagcauucacaagcaucaagaccauucagaaaaacaugaccucaccaaacgaacuaaauaaggcaccagggaccaauccuggagagacagagauaugugaccuuucaaaaagagaguucagaauugcucuuuugagggagcucaaauaaauucaagaaaacacagagaaggaauucagaauccuauccaacaaauuuaacagagauugaauaauuuuuaaaaagcaaauucuggaguugaaagaugcaauuaauacacugaagaaugcaucagagucucuuacuugcagaauugaucaaaaagaacuagugacccugaaacagguuauuugaacauacacagucagagggagacaaaaaaacaauaaaaaaaagaaugaagcacaccuacaagaucuagaaaauagccuccaaaagccaaaucuaagagcuauuggccuuaaagaggagguagacagagagauaggaauagaaaguuuauucaaagagagaauaacagagaacuuccaaaaccuagagagagauaucaauauccaaguacaagaaaguuacagaaaagcaagcagauucaacccaaagaagacuaccucaaggcauuuauaaucaaauuccuaucugaggaccuugauagaccccuaucucuugcccuauacaaaaagguaaaggauaaagaaagauccuaaaagcagcaagauaaaacaaacaaauaacauacaauggaccucuaguacaucuggcagcagacuuuucagugggaaccuugcaagccaggagagagugacaugacauaucugaagugcugaagggaaaaauauuuuacccuagaauaguauacccagugaaaauaucuuucaaacaggaaggaaauaaaaagauuuucacagacaaaagcuuagggauuucauuaacaucagacuuggcauacaagaaauacuaaacagaguucuucagucugaaagaaaaggcuguugagcaguaagacaucaucugaagguacaaaacucagugguaauaguguauacacagaaaaaaacacagacuauuauaacacuguaauugugguguguaaacuacucauaguaggaagacuaauagaugaacuaaucaaaaacaauaacuacacaacuuuucaagucauaguacaauaaaauauaaauagaaacaacaacaaguuuuuaaauggggagacaauauuugaguauaaagguuuuauuaguucucuuuuggcuuguuuguuuaugcaauccaauaauuuguuaucaguuuaauacauuguaagauauuaucugcaagccucaugguaaccucaaaucuaaaaacauacaacagauacacagaaaaauaaaaagcaagaaaugaaaaagcacuucauaaaauucaacaucucuucaugauaaaaacccucaaaaaacugggcauagaaugaacauaccuuaacauaauaaaagacauauaugacagacccacagcuaguaucauacugaaagaggaaaaacugaaagccuuuccucuaagaucuggaacaugacauggaugcccacuuuugccacuuuuauucaaauaguacuagaagugcuagcuagagcaaucagacaagaaaaagaaacagggcauccagacugggaaugaagggucaaauuaucugucuuuauagaugauaugauuuuauauuggaaaaaucuaaagacuccaccaaaaaacuauuagaauggauaaauucaguaaaguugcaggauacaauaucaacauacaaaaaucaguagcauuccuauuugccaacugugaacaaucugaaaaagaaaucaagaaaguaauccuauuuacaauagcuacaaauaaaauuaaauaccuaagaauguacuuaaagaagugaaagaugucuacagugaaaacuauaaaacaaugaugaaagaaauugaaggggacacagaauguaaaggcguuccauguucauggauucaaagaaucauuauuaaaauaauuauacuacccaaagcaaucuacagauugaaugaagugucuaucaaaauaccaaugacauucugcacagaaauauuauagaaaaaacuaucccaaauuuauauuaaaagagauagccagaguagccagagauauccuaagcaaaaagaacaaaacuggacuaaucacauuaccuucaaauuauacuauagagcuguaguaaccaaaacagcaugguacuggcauaaaaacagacacauagaccaaaagaacagaauagagaacccagaaacaaauucauacaucuacagugaacucguuuucuuucuuucuuuuuuuuuuuuuuuuuugagacacagugucacucugucacccaggcuggaguccaauggcgcgaucucagcucauugcagccuccgccucccagguucacgcgauucuccugccucagccccccaaguagcuggaacuauaggcacgcaccaccaugccuaauuuuuuuuuguauuuuuaguagagacaggguuucaccauguuggccaggcuggucuugaacuccugaccccauuugacccacccaccucggccucccaaagugcugggauuacaggcgugagccaccgcacccagccagugaacucauuuucaacaaagaugccauaagcauacacuggggaaauacaugguuucuucaauaaaugaugcugggaaaacuggauauccuuauguagaagaaugaaucuagaccccuaucucuugcccuauacuaaaaugauaucaaaguggauugaagacuuaaaucuaagaccucaaacuaugaaacuacuauaagagaacacuagggaaacuccaggacauugcacugugcaaaaauuucuugagcaauacccuacaagcacaggcaaccaaagcagaaguggacagaugggaucacaugcaguuaaaaagcugcacagcaaagaaagcaguuaacaaagugaagagauaacccacagaaugggagaaauuauuugcaaacucuccaucugacaagggauuaauaaccagaauauagaaggagcucaaacaacucuauagaaaaaaaaucuaauaauuugauuuaaaaugggcaaaagaccuauauagacauuucucagaagacauacagauggcaaaaaggcaugugaaaagguacucaacaucauuguucauuagagaaauacaaaucaaaacaacaauauauagucucaccccaguucaaaugacuuuuaucaaaaagacagacaauaacaaaugaugacaaggauguggaggaaaggaaaccuucauacacuguuggugggaauauaaguuaguaaagcuacuguagagaauaguuaggaaguucuucaauaaacuaaaaauagagcuaccauaugaucuagcaauaccacugcuagguauauauccaaaagaaaggaaaucuggauaucaaagagauaucugcacucccauguuuaucccagcacuauucccaauaaccaagauuuggaagcaaccuaagugucuaucagcagaugaauggauaaagagaauguagcacauaggcaagauggaguacuauucagccauaaaaauagaaugagaucguaucauuugcaaucacauggauggaacuggaggucacuauguugagugaaauaaaccauuuacaggaacacaaacaucauauguucucacuuauuugugggagcuaaaaauuaaaauaauugaacucauggagauacaguaggaugaugguuaccagaggcuuggaaggguagugggggcacaguagugaagugggguugguugauggauacaaaaacauaguuagaaggaaugaauaagaucuaguauuugacagcacaacagggugaugauagucaagaauaauuaaauuguacauuuuaaaauaaccaaaagaguauaaauggauuguugguaacacaaagaauaaaugcucgaggugauggauaccccauuuacccugauaugauuauuacacauuguaugccuauaucagaguaucccauauaccccauauauauauauaccuaauauauacucacaagaauuuuuaaaauauguguagauagauagauagauagauaggacuaucauaugauccagcaguccuacugcugagcauuuagccaaaggaaagaaaucuguauaucaaagagacaccuaacgcccccaugguuuauugcaacacuauucauuauacccaagauaaagaaucaaccuagguguccaacagaugagugaauaaagaaaauguauauauacacaauggaauacuguuuagccauuaaaaauaagauccugucacuugcagcaacaugaauggaucuggaggucauuauguuaaguaaaauaaacugggaauagaaaguuaaaugcugcaugcucucacucauauguggaaguugauaaaaguucguuucacagaaguaaaagguagaacagaagauacuaggugcugggaaaggggauggggauaggaagagagugguuaaaggauacaaaauuagaacuagauaggaggaauaaauuguauaguacugaaaaaugacuaugcuuaacaguaguguauacuuucaaguagugcggaggauauugaauguucccaacacaaauaaaugacagauguuuaagaugauagauaugcuaauuacccugaucuguucacuguacauaagucuacauguuagcuuuuuugaaauucuuaguuucaaaaccauaugcugcucuucucaguuuuuguucauauucuuuccucuacaugaaauagaccugccucacccuccacccacccuaacacccauaugaguaaaucuacuuguucucuaaggcccaguuuaaaucuccuuucuccguauaauauuagacccuuaguucuagcucaggcauggcauuuuauuuacagcacucuauguaacuuuuauuggaaaguaacauacacacagaaaauauauacagauuauaaguuuacagcuugacaaaucuuuacaaaaggaauacccucguauuaccagcauccagauucagaaacuaaacauuaccauaauccugccucauaaccucuuacacucacucucuuuaccagcaccucucucaucaaggguaaccucuguccuggcuucuaaugccacaggcuagcuuugcuuguuuuugaacauuacaugaaugauguuauacaauauacuauauuuuuuaucuggcuuuuuuacucaauauuuguacaguuuguacaacuguacaauguuuguacaauuuguacaacuguacaauguuuguacaauuuaugcauuuuaguuuauucauucacacugcuauguaguaucccacuugugaauauauaccauaauuucuuagcucauucuucugcauacggacauuauccuuuuuuccauuguaguuuuaacuugcauuucccugaugacuaaugaaguugagugccuuucuuauauguucuugggccaacuggguaucgucuucugcggagaaccuauuuaagucucuguccuuuuuucucaccucuucuauacauucaugaaugguagguaacuacaucucacucauuuucuacugacacagauucuauaagaaugucauacuguuuacauuacagcuguauguauuuauuaagauuuuaugcagaaaaguaaaauugagggcugaucacuguucuucagagggaaccuuuuaaaaauguuguagugcaaccagucaacaaauauguauugaguacugacugcaugaaauucuacuugagucaucaguaaagaaccacuuauuuaacuacaaaccaucuuacaaaccauuuuacaaaccaucuuuaccucucucuuccuuaguuuucucaucuacgaaaugguaugauuacaucagaugacacuagggucucuuggcuuuuuuuguuuucauguauacaaccuugugaaaauuugaauuuauccuuuuacuaacaugaguucagaaauguucccaacuauugaauaacuaaguguaguauaauuggaucuggauggaaauucaaagaugagagaugguuacucaggaauuuacugggucaaggccccuucuuucaauguuuguuaauucuuaaucuauagguaguuacugucgauaaucauaaaucuggacauuuuauaugcaguuaaauuuuuuuuuuuuuuuuugagacggagucucgcucuguuggcccaggcuggagugcaguggcacgaucucggcucacugcaagcucugccucccagguucacaccauucuccugccacagccucccacguagcugagacuacaggcacccaccaccacgcccggcuaauuguuuuuuuauauuuuuaguagagacaggauuucaccgucuuagccaggauggucucaaucuccugaucucaugaucugcccaccucagccucccaaagugcugggauuacaggccugagccaccgugccgggccuauaugcaguuaauuuaaaacaacggagaccucaggcaauccaaaaaugaaaguauguauacaaagagagcucauacuauauguagaguaugaucaauauauuuaucacauaugugugugugugucuuugcuuuaaaaauaacaauccaaauucaccaaaagaauagucauuuuuuaaaagccugaauacacuaagcagacagccccaguuuccccuuccaccacacacgugucaacuauaaaucuuucugucuguauggauuucuguacuguggauauuucauauaaauggaaucauacaauaaaaaaagaauaguuauuuuagcugggcacagaggcucaccccuguaaucccagcggcucaccccuguaaugccagcacuuugggaggccgaggcaggcagaucaccugaggucaggaguucgagaccagccuggccaacauggcaaaucccugucucuaguaaaaauacaaaaaauuaagcugggcaugguggugggcgcuuauaaucccagcuacucgggaggcugaggcaggagaauugcuugaacccagagguggagguugcagugagcagaaaucacgccauugcacucaaggcugggcaacagagcgagacucugucucaaaaauaaaauaaaaauaaaaaaagaauagucauuuuaaauggcuucuucauaggccaugagaacucaagccuuuaagauuuacuuuuuacugugauuaaguaaagacacaaauuucuuuuuaaaaucuugaggauuuaucagaugacuucauaaacuaugggauuuuuuuuauuagcaauuuauaaacuucagguuaagguucuuaaccugugaaucaugauucaccaugacugaaucuuuuuuguaggauuauuagccaaaaugauggaaaggaaaggcaaguccugguuaaggagggucauauaugauaguuuuuuuauauauaaauaauuuaacucuucuuuaguuuugacuucaagcaaaguaaucuuucagauauauuguucauuguguaguuaccacaaaaaaaagcauuaucaaugaguuucaaaggugauauauuaguaugauccuagucuaagaucagcuuacuaguacuacuaucauuguucaacauacuauaucauuguucugcccaaaacacagaacaauacgaaaacgauaaauuucuuuuuucuuuuucuuuuccuuuucuguuguuuuuuuguuguuguuguuuguuuuuuuuuuuuuuuuggagacagaaucucacucuguugccuaggcuggagugcaguggcgugaucucugaucacugcaaccuccaccucccggguuaaagcauuucuccugccucagccucccaaguaacugggauuacaggcgcccaccaccaugcccaguuaauuuuuuuuuucuguauuuuuaauagagacaggguuucaccagguugcccaggcugguccugaacuccugagcucaggcagucgcccaccucggccucccagagcgcuaggaauacaggcaugagccaccacacucaacuggaaaagaccaauuucuuuaugguuagggucaggcacuuuugaagaguuuucucuccagagucuuaagaucuauuuacuccuuaaaaauaagggaggauuacaacaacuuuuccacuuucuaaggcucaagcuaauuagauauuugaccauauuacuuguacuucauuugucuuucagauugucuagcaaauguuuuguuugauuaauacuuuuaaggcaauguaauucuaccaugucuuugggaccucccaaaauucccauauccuuuauugucauuuauaauauuugaauacuaagacucacuaaaauaacauuaugggucuagguaagucuuaagaguccuuuuaauggaaaauugauaauucuuaauuauuuuuauaaauauuaggaaaaaauuuaaugauguaauuuugguuacaauacaagcauucaguuuacuuuuuuuuuuuuuaauuuuauuuuacucuacauuccgggauacaugugcagaaugugcagguuuguuacauagguaaacaugugccauggugguuugcugcaccuaccaaccugucaccuagguauuaagccccucaugcauuagcuauuuguccuaaugcucuuuccuccccucaccgcccccgcaacaggccaugauguguguugguccccucccuguguccauguguucucauuguucagcucccacuuacgaguaagaacaugcaguguuugguuuucuguuccugcauuaguuugcugaggaugauggcuuccagcuugauccaugucccugcaaaggacaugaucucauuccuuuuaauggcugcauaguauuccaugguguauauguacauuuucuuuauccagucuaucauugaugggcauuuugguugguucuauguuuuugcuauugugaauagugcugcaguaaacauacauuugcaugugucuuuauaauagaaugauuuauauuccuuuggguauauacccaguaauggaauugcugagucaaaugguauuucuaguucuagauccuugaggaagcuccacacugucuuccacaaugguugaacuaauuuacauucccaccaacaguguaaaaguguuccuauuucuccacauccuugccaacauguguuguuucuugacuuuuuaauaaucgccauucugaccggcaugagaugguaucucuuugugguuuugauuugcauuucucuaaugaucagugaaguugagauuuuuuucauauuuuuguugguugcauaaauaccuucuuuugagaagugucuguuuauguccuuugcccacuuuuugaugggguuguuuguuuuuaucugguaaauuuaagucccauguaaauucuggaucuuagaccuuuguccauagguaaauugcaaaaauuuucucucauucuauagguugguugucuguucgcucugaugauaguuucuuuugcugugcagcucuuuaguuuaacuagaucccaguugucaguuuuagcuuuuguuggaauugcuuguggcgauuucuucauaaaaucuucucccaugccuauguccugaaugguauugccuagauuuucuucuaggauuuuuaugguuuuggguuuuacauuuaagucuuuaauccaucuugaguaaauuuguguauaagguguaagaaagggguccaguuucaguuuucugcauauggcuagcgaguuuucccaguacgauuucuuaaauagguuuguaguucuuuuuuuuuuuuuuuuuuuuuuugauuuguacucugauauuuuuuauucuguuccaaauaaauucuggucaggaugcacuaaauuuauuuuuacaauuuacuaaugaagcauuacuuuaauuuugaaaaauaccguacuagugcauagccagucuauguuacaguuaccuguuugaagagagcucuaccaucuuaggcaaguuauuuaauuucugaguccucaguuuucucaucugccaaaugaaaaggcugaaccagguuagugauucuuuuuuuuuuuuuuuuucuggggcaaagugucccucuauugcccagccuggagugcaguggcgaaaucucagcucacugcaaccuccgccuccuggguucaagugauucuccugccucagccucccgaguagcugggacuauaggcacacaccaccacgcccggcuaguuuuuguauuuuuaguagagacaggguuucacaauauuggccaggcuggucucgaccuccugaccucgugauccacccgccucggccucccaaagugcugggacuacagggaugagccacugcaccuggcauuagugauucuuaauccugguugcacaugagaaauaccuggagaacuuuuagauacacuugucuggauccagguuuuugcccucagaauuucugauucugauucugauuuaaugguuuuaggguggggccuaugcccugguauuguuuuuuugguuuuuuuuuuuuuuuuuuugguuuauuuauuuuuuuauugaucauucuuggguguuucucgcagagggggauuuggcagggucacaggacaauaguggagggaaggucagcagauaaacaagugaacaaaggucucugguuuuccuaggcagaggacccugcggccuuccucaguguuugugucccuggguacuugagauuagggaguggugaugacucuuaacgagcaugcugccuucaagcgucuguuuaacaaagcacaucuugcaccgcccuuaauccauuuaacccugaguggacacagcacauguuucagagagcaccggguuggggguaaggucacagaucaacaggaucccaaggaagaagaauuuuucuuaguacagaacaaaaugaaaagucucccaugucuaccucuuucuacacagacacggcaaccauccgauuucucaaucuuuuccccaccuuuccccccuuucuauuccacaaaaccgccauugucauccuggcccguucucaaugagcuguuggguaaaccucccagacggggugguggccgggcagaggggcuccucacuucccaguaggggcggccgggcagaggcgccccucaccucccggacaggguggcuggccggguggggggcugacccccccaccucccucccagacgggguggcuggccgggcggggggcugaccccccccaccucccucccggacggggcagcuggccgggcagaggggcuccucacuucccaguaggggcggcagggcagaggcuccccucaccucccggacggggcagcuggccgggcagaggggcuccucacuucccaguaggggcggcagggcagaggcgccccucaccucccggacaggguggcuggccggguggggggcugacccccccaccucccucccagacgggguggcuggccgggcggggggcugaccccccccaccucccucccggacggggcggcuggccgggcagaggggcuccucacuucccaguaggggcggccgggcagaggcgccccucaccucccggacaggguggcuggccggguggggggcugacccccccaccucccucccagacgggguggcuggccgggcggggggcugaccccccccaccucccucccggacggggcagcuggccgggcagaggggcuccucacuucccaguaggggcggcagggcagaggcuccccucgccucccggauggggcggcuggccgggcggggggcugacccccccucccccggacggggcggcuggccgggcggggggcugaccccccccaccucccucccggacgaggcggcuggccaggcggggggcugaccccccccccaccucccucccggacggggcggcuggccaggcggggggcugacccccccccaccucccucccggacggggcggcuggccgggcagaggggcuccucacuucccaguaggggcggccaggcagaggcuccccucaccuccuggacggggcggcuggccaggcggggggcugacccccccaccucccucccggacugggcggcuggccgggcggggggcugacccccccaccucccucccagacggggcggcuggcugggcagaggggcuccucauuuuccaguaggggcggccgggcagaggcgccccucgccucccggacggggcggcuggccgggcagggggcugauccccccaccucccucccggauggggcggcuggccaggcgagggucugacccccccaucucccucccggacgggguggcugccgggcggagacacuccucacuucccagacgggguggcugccgggcggaggggcuccucacuucucagacagggcggcugcugggcggaggggcuccucacuucucagacagggcgguugccaggcagagggucuccucacuucucagacggggcggccgggcagagacgcuccucacaucccggacggggcgacagggcagaggcgcuccccgcaucucagacgaugggcggccggacagagacgcuccucacuuccuagaugggauggcggcagggaagaggcgcuccucacuuccuagaugggauggcggcugggcagagacgcuccucacuuuccagacugggcagccaggcagaggggcuccucacaucccagacgaugggcggccaggcagagacgcuccucaccucccagaccggguggcggccaggcagaggcugcaaucucggcacuuugggaggccaaggcaggcugcugggagguggauguuguagcgagccgagaucacgccacugcacuccagccugggcaccaaugagcacugagugaaggagacuccgucugcaaucccggcaccucgggaggccgaggcuggcggaucacucgcgguuaggagcuggagaccagccuggccaacacagcgaaaccccgucuccacccaaaaaauacgaaaaccagucaggcguggcggcgcgcgccugcaaucgcaggcacucggcaggcugaggcaggagaaucaggcagggagguugcagugagccgagauggcagcaguacaguccagcuucggcucggcaucagagggagaccguggaaagagggagagggagaggcagagggagugggagagggagagggagagggagaagguuuguaguucuugaagagguccuucacuucccuuguuagcuguauugcuagguauuuuauucucuguagcaguugugauugggaguucauucaugauuuggcucucugcuugucuauugauguauaggaaugcuugugauuuuugcauauagauuuuguauucugagacuuugcugaaguugcuuaucaguuuaaagaguuuuugggcugagacaauaggguuuucuaaauauaggaucauguugucuacagacagagacaguuugacuuugucucuuccuauuuaaauauccuuucuuucuuucucuugccugauugcccuggccagaacuuccaguacuauguugaauaggagugguaagaguacauucuugucuugugccgguuuucaaaaggaaugcuuccagcuuuugcccauucaguaugauauuggcuguguuugucauaaauaacucuuauuauuuugagauauguuccaucaauaccuaguuuauugagaguuucuaacauaaagggauauugcauuuuuucgaaggccuuuucugcauuuauugagagaaucaugugguuuuugucauugguucuguuuaugugauggaugacauuuauugauuuacauauguugaaccaaccuugcuucccagggaugaagcugacuugauggugguggauaagcuuuuugauaugcugcuggauucaguuugccaguauuuuauugaggauuuuugcauugauguucgucagggauacuggccugaaguuuuuuguugugucucugccaggauuugguaucaggaugaugcuggccucauaaaaugaguuagggaggaguccuuccuuuucaauuauuugggauaguuucagaaggaaugguaccagcuccucuuuguaccucugguagaauuuggcuuugaguccaucugguccugggcuuuuuuugguugguaggcuauuuauuacugccucaauuucagaacguguuauuggucuauucaaaaauucaacuucuuccugguuuagucuugggaggguguauguguccaggaauuuuuccauuucuucuagauuuucuaguuuauuugcguagagguguuuauaguauucucugaugguaguuguauuucugugggaucaguggcgauauccccuguaucauuuuuuauugguuuauuaucauuuuuuauuguuuuaucugugggaucaguggcgauaucgccugcaucauuuuuuauugcuauuugauucuucuuuauucauucaguaugcuuauaguuaucaauuagcaauaaaaauaccucaucuguuaaauaaagggauuagugcaccucucugugcaaguuccucaucuauaaaauauguuuaauaaaacuaccugucuuaagguuguugagaggauuaaaugauuuaacacaaagaaagcacucaaaaaaugucagguaugguuagguaucccaugacuauauuuuaccacaagucuuuugugauucauuguuuauauuuuuguaccauuaaacaauguuuaccuuuaacuuguacaauuaaauuugugacaugaaugaauauuaaagacugaauuguuaccauggauuuugagugauguguucauagucauauugaauauuaggcuuaauuucaggcuuaaaaauguacuuuuaaacaaggagcaagagaaaaaaaaaaacaauucuuucuucuuuuuuuuuuuuuuuuuuuuuuuuuugagacggagucuugcucuacugcccaggcuggagugcaguggcgcgaucucggcccacugcaagcuccgccuccuggguucacgccauucuccugccucagccucccgaguaacugggacuacaggcgccugccaccacgcccagcuaauuuuuuguauuuuuaguagaggcaggguuucaccguguuagccaggauggucucgaucuccugaccuugugaucugccugccucggccucccaaagugaugggauuacgggugugaaauuauuucauuuuuaaaaugacauuagaguguuagugaucgcguaaacagaacauucuccguuccucacccuuuuuugagucuugcaaaguauaaucugacacugaguuaagagucaauugacacuguaucuugcuuggucaaccugcaguuaacguugugaagcaggaaaaugagauguaaacuaaccaagaucuccacauggccuggaaugaccaaugguuuguuauauaggacaaaauugaauaaauauuauguaaguacuuacuaaauuagauuuuuaaaagaaucauugaauaucuagauuuuucuuaauggggaaagguguccuauugaaauucuuuuucuuuaaaaauuacaaccacuagaaauuggauaaggccaccucacaauaaagaguccuccccaucaaagaaggguucguguugagguaacccaucauuuaagaguaugaccauuucuacaucuggcaggaaguugaacuauacaacuucugauuuauuuuuucaauucuaacauuucacaaaauuaaagaaauugagaaccuauucuagguauuguucuuguuguuuuuacauugaugcccucuuuauuuucuguuugaaaugaguuaucaaagcauaaaguuuugaaucauaggcaguuuucuucugacaugauucaggaggaauaauuugagcuauuuaugucuacaaaguacuuuuaauauuuauccaccagaguauucgacaaugagguuguuauauccuuccaagagguagaauaaguaucaaaaaccagauggaauuggaugauuuugugaaauaaccacacaauauaaauuguauugaaaaacaaauuuggcauuggucaucuguauaccaagaaagacaagaaacuuuuuaucugaggaacgugagcucuuuuaaauuacugggcccagugaggcauuaaaaugugaaaguagucaucucucacuccccucuuugagcuaaguaaucugccugcuguauggacuuuagacugucaccaccaaguaaccauaaacuaaccuaacaaugccauaugcuagacaccauaauucauacccuauaguucaacaauguauagcaauuacuaaucaguuauuucucuacaccaaugagaauucuuaacaaacaauuuuuguaauugcccccucuccuaauuuguccuuuuuucuuuaaaaacaugagccuuuccuucauucucuggagcacuucucagcauuucccagucugcaguccucaaccuugacccaaauaaacuaaacuacuauauuaauuuugcucacuuuaugucuuuaggucgaugauacuuaacauuacuucuuuugccaaccuuucuccuaccccuucugccaaaguaaaaaauuuugguuuacuaaugaaaaaaaaaaucaaaaucugaaacacagauggagaauagaauggauauauuaucucucaaaugucucauuacacugccucuguuuauuugauuucaguuuuuuagacccauuucugccagugcuguccuaggauccggaggggggcaauguuucuucuuugcuuuuuuaagucuuuuaauguguuucuuuaauguuuauuauaguuuuaaauacagauggucuuacuaugacccuuaaaucuuguuccuagugcugagaauacacuggcgaauccaauagguauggucacugcccugcuugaacuuagugugaugaagaagacaaauaaauuaacuauuguguaauuguaacucaugcaaagaaaagaaacagauuacacugauagggaacaugaugagggugugacaugaggacguugcuuuagucggaagagauccuuucaaaaaucauaaaauuuaagcagagacuugaaagauaagaaaaguaauguuccagguagaggaaucaacaugggucaagucccuggggugcaaaagagccucauucucauuuucuuuuugugccgguuugaaccauaaagaacucauuuaacuugcuucugaaauuguuaugauuugaugcagcucauuuccauugucagcacccaaaauaguuaccucuucacuuugcuccuucaaccuugcaagacccccugagcccucaaaguaucaaauuuagucucaauuuaaauaugaagcugcuaauacuaccuauaugggaaacuuucaguacgcauuaguucccuuucugcucguagcauuguuggugauguguuugcugggcuacuccuucccaucuuuuaaccccagggguaugcaggauuugcugugggaauagggaagccacaaacaagagaaauagcauugucuccagagcuacccuuauucuuucuguauuaaggcucccaggggucucugccuccucuugagucucucccaacuuaacuucuugagcuaaggucacuuuagggauguuaucaggacauucagcaaucuacaaaaagacccaaguccugguuuccauuacacccugcccaccauguguuccaguuguuuucauuucuuuucugcaugacuucaucaagaagcuguccugguugaugcuaaaugagaggugaggcggagacaagggaauuccucuggcuuccucuucauucauauuucccagguagugguucucccaaaggccuugguggccagaauaagguguggccuuggucugcugcugaacugguagaggauugacauuuuaccuaugacuggcagcucuagagaaaaacagaacaccugauuccaguaguaguuaagacuuggugugucuccagaucccacuugaaguuacugucuuacaaaguaacuuuuuuccuagcaauacuagggaugguggggguagaaggaggauaacacuaggaccuuuggaaccucuccccuugccuguuuuuucucuuaucaguaaaaugagaguguugguguauucguagggucccuuuuaguucaaacauaucauguuucuaaauuuuaaaccaccuaguaguauuaucucugucugaugugcaugauauguauauuggaaauuaucccaguaugugagccugauacauauguggaaacuuacagcccuacuggcugagcuggauauauucauuuaugagcacugguugggauuguaauucgaaaacuuuguaccaacauuguaucuuacugcaagauuuaugaauguuauugaaagcaggacuauauacccugagguugaagccagcuaacuaaaccugaguuaacaugcaucaccaaagagugaugaucauagacauuguggcaaaugacuugaaagauccuuugcuucacuuugucagaaggaucaaauuguauugaaauagcacccugcgauauaauucugaauucugucacucuaaauugguccuuccuucuuuugcaggagcuauugugacaaucuugguuaccauccauuaagugcugcugauuuuggaaagaucaugaaaaacgucuuuccaaacaugaaggcacgucguuugggcacaagaggcaaaucuaaauauccuuuaccagaaugguguuaguaauaucucuguguucucacuuguuauagaacaucuauuguuguaguucaacuggcaacuuuauuuagaaauaaacuucaaauuaaagcaacucaaaagcuuaaguagaauaauugcaaauguaacuuucacagguauuuaucacacuaugaaagaaauagcaaauaaugguuuauucauagauuagaauugugauagauuuuaccuuagucuaucaauguaaaguguuauuaauggucugaucuccuuuguuuuaacaguaagaaguuuugaggccugccauauguuuaacaauuauaagaauaaaaguggagaaagaugcuagcuuaucuucguuucuuccuuuaauuuagaaacauaggggaucuccuuggcaaaaaaaaaaaaaaaaaaaaaaaaucuuauggaacuuuaacagaaacacuaaucuuucaguacaaguauuuuucagccauccauuuaaagcccauauuaaaauuaaagccagaguacagaaaagguccuucuugugauggagaaauacuuaggagcaaacagaaauaaggaaauuaaaauuaagaauucauuauaguucuuucuccucuuagaagaagauuguaaaauagagggucucuguaucauauuagaauuacauccauuuucucccccuuagcucuugucuuuuuuucagagcauaaaauggaggagaugagaggaaggggaagggaagaaacuugcuuuucuaaaaugguuccagguguucucuaaccacuaguuggcacgaccuauucuugcuucccaaaugcaaacaaaaauguuuugaugugucuuuggcauguuacaggcgauaauccuguauguuucaguggaaaaagagaaacgaaaagguuaaagcccuugugacacucuuaagaguuguuuuugucccagagcccugggcugaaguuucccuucccugugccagguuuccaucuggcuauuccuuuccuucugaccuguuuguuacugguggcuggcacagcauauuaggaacauuuauucauaaaauuuauaacagaugagaaucuuuucauuuaagacaguaguauuuaacauucuaaagggguauuucaguuucaaaagaguaaaagugucccaaguuuuuaauauuaagguuuuucuuacugaagaauucagaaaguagauguuaugucauguugauuuuuuuuucucauuucauauaugguuacuuuuaaagugcugucuguauaagcaauucauuuaauuuugaauauuuagaccuuaacuguuuauuacauauugcuacaguggacuaagaaaaaaagcuuuuguucauaugccaacacugcccaaccuugacuuucacaaaacuggagaugggguaagaauucagccuuuucuuuuuaauaaguaaaauuguaccuuuauauuaacauugaaaugcauccugcaaagucucauuugguuaagccuagcgacugugccuuuuacaaauaagaaaaaaaaaaucacacaguggcugaaaaauguuaguguauaugaccuacgucaacaugaaauuugggggaacaaaaguuuagaaguuacugauuucucgauauuuccaaaauacauauugacuauauguguguauagucaagaggaaaaagucagucaucauguaauauguuuuauaggaauuuuagaaaaaauguguggcuauuggcauaguuuugacauuagaaagauucaaaacaucagucuucuuguauguuuaaaaaccauuuaaaauguuauauucgcaaggcugcugacugcugugcacuaguggguaugagucccuuauuugcaaagcucuuauaugucugccagugggucaauucauacuacuuuaacccacagauuuauauuguaucuucuaauuaagaauacauaucuuuaacaugcuucaauuuaauuucucuggucuuuuacaaguuaacauuuccuuuuuucuuugccuaguuggaaggagcugaaccuucugggcagcuucaaaauauugaugaagaaguuaucucuucugcuugccgucuugugugugagugggcccagaaaguguuaagccaaccauuugacaccgucuuggaauuagcccgcuuccuuguaaaaagucacuauauaggcaccaagucaauggcagcucuaacuguaauggcagcagcaccagcagguacaacauuacugugaacaagcuaaaaacugacagagguauuauuguauuuagaauugguagcaaaagaagaguuagaucaaagaacuucauccuuuuaguacuugcauguguucacucuuacuccgcuuaacacuaaauucagaugggucuguugagccaagaaaauaauaauccuuucauuauaaagcuuaaugcuauguuucuauauauugcuuugcuggcauaugaaacuguagauuccccagcugauauguuauuaauuuuuccauugcuacuuuuacauuuauagaauguguuuauauguacuuuuauauguacauauauguauauguguaucuaaauuaauaagagaaguaaaauaauaagauuaaauuuuaaaauuacuuguuagauucccauuccagaaacuaaugcuuauaaauaaaauuaucuuugcacacugugacagguaacuuagccucaaaaaaacaaaaccguacaaagccuuacuaaaaaauaacaagagugauauuuuuuacuguguauucaugacuauuuuuauucaaagaugaguuuuuggaaucgacaauuuugggaauugacagucuuguuagaaugacucccuccuaaauuaauaguuguguaaaauaacaguucugaugaauuuuuaaaaauaucuuauuucaguuauaccuuauaaaccuagaguggauaaauuauucuagaaaaucaggaugucuguuaaaaauguagugauauagugaucagagacuuauuuuuccaaggacuguccuucuaaguguuaauucugaauauuuaaaaaucuacaauagauuuaucuuggccagaauuauagucucuuaauuaacuucacuucuuuuuuuaguaucuuuuacacauuaauaaugaguccguuuucuucuaauuuuacauuuaguaugugggauguauguguguguaaccucuccuuuuguggucaauugaagacccauuucagaaaaagagugucacagaguuuuuccugucugcauguaaacuguaugaccuaagucuguuuauucauuguacugaccagcaggagaaugcuugaccagccuuaucgagcuaaauagcucacuuauguuaccucauuuaauucccccagcaguccugugagauaggugauauuuauucccaauuuauagacuuggggaggucaauuaacuuguccaugggcacauaaguaauggagccaggauuugaauucugauuugucugucuccaaagcccagcuucacucaauuauaucauaaugucauauaguaaaauaagcuuuaaaaggaaugaacccuucaguuugcucugcugucuuucuccugccccugccaacaccuaaaagaguacaucaacagaugaaggauuuaggagguaucauggggaaaagaaacaucucuuuccuauuucugucauucacaaagucuaacugugggaaauguugaaugaauugaaugaaugaauuuuuaaggucuaagugcaaauaaaggugugaguuuaacaaaaguauuaaaaauuacauauauuaaaaagacacuccauuuuugaaagcaaucagccugagaggguaaauacuuuaccaauuguaucauuacucaaaacauuuuuagaaugucucucaaaauuuugaucucagcccuuacuauauuuuucaaaaaagaccuucgauaguagacuaauuuuuauccuuugaaggugaauuuuuuuuuuuauaaauauagucuccauauuaagaacagguuguguuacaaauguccuuuuguaagucagcugcuuggaacucauuccugucucaaaacccuggcaggaaggauaagacagccaagcuaugagccauuggcagaggcucuccagagugcaggugcugagaagccagagcugaggcuuggggucggaaaggggcaaaacaacuggagcuggauuugagaugaaaaauugugauuuuuaaaaggggcuggggguucaacagauccucaucauuauugaguauggggagagaguuauagcuuccucauugucuauuuccugcuccccacaccaaguuguuguuguuaacuagaaugaugaaaagcagaaauugggauggggaaaagaaaagaaagggcaagguguaccagcaggauaguuguuccucuccuuucuucucuucauuguuuuuacugcccacaacuuacuuucuaaugaucucaaugccacgcccuaaaucugaaaugagcuuuuaaaaaauuuuuauuuuauaauccauuuuuccuaaaauuuauauuuugcuuauuuugucaauuuuuuucaguguuuaucuuacuguuuuaaagguuuucucagugacacuuuuuuggaauaucuuaacuuuagucuuguuaagaaauucugcuucugaauuucuucuaggucauacuggaaucauuguauaguagcaauaaaauaauagugccuauuuccaugaauugcugguaggauuaaaaacuguuuucuccauacaaauuuauuccauuaugaggaguggcuucagcaaauauuuauugaauuauugaaugccccucaugggcuaaauauuaaaaucaugaaaauacauguauuuauuucugauuagaaauggggggagggaaauuuacugaccuuugagaaaauguaaaaaugcuguguuggcauuuaucucagcuucugcacauuuacgauauagcuacgguuuuuaaaauccuguuguuaacugaaacugucaccugauuuuaaaauccuguuguuaacugaaacugucgccugaguugaaccauauuguaagaugacaaaacuauauugacaauuguuuauaaauucgaagucuaaugcuucauaaagaaauugugaguuaaaauuugccauuuugguugcuuuguccaguagauggcuacauucucaaagaaauucaaaggaaccucccuucuauaaaggagaguauuuauugcagcuuuccuuucuguuuauuuucaggaaugaaaggaauuacccagccuucugcuuuuauaccuacagcugaaaguaauuccuuucagccucaggugaagacuuugccaucuccaauugaugcuaaacagcaguugcaacggaaaauccagaagaagcagcaagaacagaaacuacaauccccuuugccaggagaaucugcagcaaaaaagucagaaagugcuacaagcaauggagugacuaaucuuccuaauggaaauccuucaauccuuucuccucaaccuauugguaucguuguggcagcugucccuagucccauuccgguaauauaauuaaauaguauuuggccuuauugggauggugggaaaucaacuguuuacuuaaaaguggcagaugaaaagaaggcagguauaagaguagccacaaacugauuuugugaccacaggaagauucauuccccuucagucuuuuauucaggauguauguuguugauuacaaaguaagcuaugaaacauuauugaaaauauaaagauccaagacauacaaaguaugcacauaaccacucagagcuuuauguaagagugaguaauuuucucauuuuuagaguuguuucaucccuggcugagccaagauuuuuuuuuuuuuuuuuuuuuuuuugagacagagucuugcucugucucccaggcuggagugcagugcugugaucucggcucacugcaaccuccaccuccugaguucaagcaauuauucugccucagccucccgaguaacugggauuacagguacucaccaccacacccagcuaauuuuuguauuuuuguguuuuguauuuuuaguuggccaggcuggucuugaacuugugacgucaagugauccacccgccuuggccucccaaaguacugggauuauaagcgugagccaccccacccagccaagauaauuuaauugcagucuuuuuuuaaaauuuaaacgcuuuucuuuuuuacauucagauggaguaaaauucuaauguguaaugauuacuuaaauguaggccuauccguggcuuaucagauacaggacuagaaccuuggccaaguucuuuagcuaguuuauuaaccucuauuuguagauaaggaaacagucuccuccuuuccuaucucacacaacugagguuaugaugaagggacuuuuaaaaugagaguaaguuggugcuuuauguuauuauugauaauaauauuuaggaaguauuuugucguuuuucuuguuccuauuaucaucaucguguuauuaaaauaugaaauacaugguaaccgcacuauucauuauagggcaaacuggaguagacaguaguuguaucuuauuugcagugguuuaguuacagacauuuaagguagacacauuuauaagacaguuuccccuaugagugagccaucuuagcauagauucugguagguaaccuuuacaguuguauguuucuucaagauuuuaugucuucuuccuguaacccccuuaaaucauuguuucagcaaauauucaucacaggugugaagcuuuuagucuuaauugaaaaguaacuuaauguucuuacauauuuuuuaauuauaaugcauuaugguugcauuuguuacauuuaugugucugauuguguagaaccuggucuagaagaacucucuucuaacauaggaacuuuuuucuuuuuaacauuaacauuuaauaaaugacuuaaaaguauauacagauacaugaauuacuauuuacaggcuagaccuguuaaaucugauuuuuugcuaucuuuuaacagguccagcggacuaggcaauugguaacuucaccgaguccaaugaguucuucugacggcaaaguucuuccccucaauguacagguggucacucagcacaugcagucugugaaacaggcaccaaagacuccccagaacguuccagccaguccugguggggaucguucugcccggcaccguuacccucagaucuuacccaaaccagcgaacaccagugcacucaccauucgcucuccaacuacuguccucuuuacuaguagucccaucaaaacugcuguuguacccgcuucacacaugaguucucuaaauguggugaaaaugacaacaauaucccucacacccagcaacaguaacaccccucuuaaacauucugccucagucagcagugcuacaggaacaacagaagaaucaaggaguguuccacagaucaagaaugguucugucgugucgcuucagucuccuggguccaggagcagcagugcggggggaacaucugcuguggaagucaaaguggaacccgaaacaucaucagaugagcauccuguacagugccaagagaacucugaugaggcuaaagcuccccagacaccuagugcccuuuuggggcagaaaaguaauacagacggagcacugcagaaaccuucaaaugaaggugucauugaaauaaaagcaacuaaggucugugaccagaggaccaaauguaaaagucgcuguaaugaaaugcugccaggcacgucaacaggcaauaaucaaagcacuaucacucuaucaguugcuucucagaacuuaacuuucaccagcagcagcucaccaccuaauggugacucaaucaauaaagacccuaaauuaugcacuaaaagcccaagaaaacgacugucuucuacauugcaggagacccaggugccuccuguaaagaaaccaauuguggaacagcuuucagcagcuaccauagaagggcagaaacaaggcaguguuaagaaggaccaaaagguuccacauucagggaaaacagaagguucaacagcaggugcucagauuccuagcaagguaucaguaaaugucaguucacacauaggagcaaaucaacccuugaauuccucugcccuuguuaucagugauucagcuuuggaacagcaaacaaccccaucaucaucuccagauauaaaaguaaaacuugaaggaagugucuuucucuuggacagugauucaaagucaguuggcagcuuuaauccaaauggauggcaacaaaucacuaaagauucugaguuuauaucugccaguugugaacaacagcaagauaucaguguuaugacaauuccugagcacucugauaucaaugacuuagagaaaucuguuugggaauuagaaggaaugccacaggacacauauagccagcagcuacauagccagauacaggaaucuucuuuaaaucaaauacaagcacauucuucagaucaguuaccucugcaaucugaacugaaggaguuugagccuucuguuucccagacaaaugaaagcuacuuuccuuuugaugaugaacuuacacaagauaguauuguggaagagcuggugcuuauggagcagcaaaugucaaugaacaauucucauucuuacggcaacuguuugggaaugacccuucagagucagucaguaacuccaggagcuccaaugucaucucacacuuccagcacccacuucuaucauccaauccacagcaauggcacuccaauccacacacccacacccacacccacacccacuccuacuccaaccccaaccccaaccccgacaucugaaaugauugcuggaucucagagucugucacgggagagcccuugcuccaggcuagcccagacuacaccuguggauagugcuuuaggaaguagccgacauacacccauugguacuccacauucuaacugcagcaguagugucccccccagcccuguugaaugcaggaauccguuugcauucacuccaauaagcuccaguauggcauaucaugacgccagcauugucucaaguaguccugugaaaccgaugcaaagacccauggccacacacccugacaaaaccaagcuugaauggaugaauaauggguauagugggguugguaauucaucaguuucuggccaugguauucucccaagcuaucaggaacuaguggaagaccguuucaggaaaccucaugcuuuugcugugccuggacagucuuaucagucucaauccagacaucaugacacuaauuuuggucguuugacuccugucucuccugugcagcaucaaggugccacuguaaauaacaccaacaaacaggaggguuuugcagucccugccccucuugauaauaaaggaacuaauucaucugccagcagcaacuucagaugccggagugugagcccugcuguucaucgccaacguaaucuuaguggaagcacccucuauccaguaucuaauaucccacgaucuaaugugacccccuuuggaaguccaguuaccccagaaguucauguuuucacaaauguucacacagacgcaugugccaacaacauagcucaaagaagccaaucaguuccauugacagucaugaugcagacagccuucccaaacgcucuucagaagcaagcaaacaguaaaaaaauaaccaauguuuuguugaguaaacuugauuccgacaaugaugaugcagugagagguuugggaaugaacaaccugcccucuaauuauacagcccggaugaaucucacucagauuuuggaaccuuccacuguuuuuccuagugccaacccacaaaauaugaucgauuccagcacuucuguuuaugaguuccaaacaccaucuuaccucaccaaaaguaauagcaccggucagaucaauuuuucuccuggagauaaucaagcacaaucagaaauuggagagcaacaauuagauuucaauagcacuguuaaagaccuguugaguggagacagcuugcaaaccaaccagcagcugguaggucagggagcaucugaucucacuaauacugcaucugauuucucuagcgauaucagguugucuucugagcucucaggcagcaucaaugauuugaacacuuuagacccaaaucuacuguuugauccaggucgucagcagggacaagaugaugaagcuacacuggaagaauuaaagaaugacccauuauuucaacaaauuugcagugaauccaugaauucuaugacuucaucagguuuugaauggauagaaagcaaggaccauccuacuguugaaauguuggguuaaauuguguuuuauaacauguagcacacuguaucuaaagacauauguauuguauuugucuuaauggaagugccucccgcagcagaaauacuauuaauugugacauuuuaaaagcguuugcugcagaagugguuucuucaguaggaaaugguuagacuugccucaguucuuaacaagugucuaaagacaguaggcuguagaagaacaaguauuagguuuuaaauuuuauaaugugccccauuuauucacauugauugacuauccagcuguuacaagagcagucgaucuuuauuuuguguaaguuaguuucauuucaucagaugaucugcacagaacucagaauaaaccaucaauuuuagguauaggcuguuuuguuguuggcauuaucuuuuagauauaaaaucauagcuagggugaacuguagacaagaaagucuuccuugaaacagggauaauauucagguuauuauaaauauuuaggcuugaagcauagagcuacuguagggugaaaaaucucuguaggacuuucuggggcuucaguaccauuuacacccacgaugaagggcuuaaauagaaaauaauggaaaauuaaauauuacuuuaaggaaagcaaagcugcacuaaaauuuuuaagggaaaaaaaacaaguagccauuuauauuugugaccuugcauuaauauuuaaauguugauuuuaauauggagcuagcacacauagaugcgcaggcacgcacacacaaaacaagcaaauguaacuccaggcauuuguaauuuaauauaauaaauacaagcauguuagaaaaaugcuuuaugucuuauuauuuguuaaguuaggggaaugagaaggaaaacaaaagcauucucuuaguuucaucacaauggcugcauguacauauugagauucuaacugagauuuacuuugaaauuuuucauuaaaauauuccacaauaaucaguuuuuuuccucuucaauugagugacugacucccucacuccuccugaauauaguaauguaguuugaucauaggaucccuuugaaaaacaggaaggaggauaacauaaaaaacaacaaaaaacauuucaccaccuaaggucugaagccacaaaucuuuauaucucugaugaaacaaaggggauaucaauaguacuugaagaagaagagcauuuuauuacuugcuuaauuuauuuauugugauaaccacaauugcaaaagaagaacucaggauuuguuuuaaaauguuucucucuauggcucccauuuuguuuugugaauaauuauuuaugaguugcauguugacacaaaccuacucacugguugaaagcuccauuuaagugaguuucaagaucacuuucaaagagauuuuuaaauugccauuguuuuuaaagcuaacauaaaaccauuugcuaugcuaccuugaaccuagcuaagcuuuccuuuaccuuaguaagccaaucagaagacuacaaucaaugaauauuuagcaaaugugcugaaggguuuaauaagguuuuguuguucaauaaauuugcaagguaggguauuaacauauuuugauaaauaaauggugcuagaguuggcgcagagguuuauauauugauaugucuuaguuauuggcauuuguguguguuugcuguuaucuugauuucaugauuuguuagguauuuuuuucuugaugcuaguuauuucuucacuguacauugagacacagcacuacugcacaccaaaguaugcaauacccaaaggaaacugugugauuucuccugacaaaugaugggagccuuucuuuaugagauacucugaaaaggagauuuugaggccauucuaaucccuuguuuacauuauuagcuuccuacuaauauaaaaauaauggaaaucuuuuuugauaaaaauauuaagacuggaggauuuuuaaccccuuguacaguauugcagcaaacucuuuaaauuugguugaauucguccagcaaacuuucugggguucauauauugcacuaaauuuguugaaccugugguaggcacaucucuuaggauaaaugcaaccaauacaguccacagauuaaacuuuuuaaauguguuucauuaugaaaagacaaaaugucaucaaagugacagauaaaauugucuuauguagcaaugugcauugaucucaaugagauauuucuauuauucucuuacaugagaauauuacagcaggaagaauuaaguuuaguuugcuucaccauguuaauacaugaucacaaaaugugcaugaguguuauugacuuaucuuguacaguacuaggauuccuguaaccacucuuuuuuuucuucgcuguauugaaacugguucaguguuaaccaggcaagcauaguuauucacagguuauuuacuuuauguuuacuaauucugcuuaguuauuguugaauauguucuguuccagauuauuuuuauuguuuugauguuuaaaacauuuugcauacuguuuaucauaaaacuucaugaaguaaauaauuuugcauauaauugcaauaagcacugacuuuugaacugaaaagaaggaaaguguuuuuuugugcagugcuucugagguucauauaauagucuuguacuauaaugugcuuuacuacacgauaaaugacaaaaacaagcccuguuucauguuucauuuagugcaaaaagucagauuuccccaguguuuuguugucuguuguaccugcugaaacuacaguaguugaauauugcgguagcauuucaguucucuuuuuuuauuaaagugcucaaaaauuguuuuuuaaauguuuucaaaaacaauuaaaaacauuuuauauuaaacuga

SEQ ID NO: 192069 - RNA, 152753 nt, Homo sapiens
ucaguuuaauauaaaauguuuuuaauuguuuuugaaaacauuuaaaaaacaauuuuugagcacuuuaauaaaaaaagagaacugaaaugcuaccgcaauauucaacuacuguaguuucagcagguacaacagacaacaaaacacuggggaaaucugacuuuuugcacuaaaugaaacaugaaacagggcuuguuuuugucauuuaucguguaguaaagcacauuauaguacaagacuauuauaugaaccucagaagcacugcacaaaaaaacacuuuccuucuuuucaguucaaaagucagugcuuauugcaauuauaugcaaaauuauuuacuucaugaaguuuuaugauaaacaguaugcaaaauguuuuaaacaucaaaacaauaaaaauaaucuggaacagaacauauucaacaauaacuaagcagaauuaguaaacauaaaguaaauaaccugugaauaacuaugcuugccugguuaacacugaaccaguuucaauacagcgaagaaaaaaaagagugguuacaggaauccuaguacuguacaagauaagucaauaacacucaugcacauuuugugaucauguauuaacauggugaagcaaacuaaacuuaauucuuccugcuguaauauucucauguaagagaauaauagaaauaucucauugagaucaaugcacauugcuacauaagacaauuuuaucugucacuuugaugacauuuugucuuuucauaaugaaacacauuuaaaaaguuuaaucuguggacuguauugguugcauuuauccuaagagaugugccuaccacagguucaacaaauuuagugcaauauaugaaccccagaaaguuugcuggacgaauucaaccaaauuuaaagaguuugcugcaauacuguacaagggguuaaaaauccuccagucuuaauauuuuuaucaaaaaagauuuccauuauuuuuauauuaguaggaagcuaauaauguaaacaagggauuagaauggccucaaaaucuccuuuucagaguaucucauaaagaaaggcucccaucauuugucaggagaaaucacacaguuuccuuuggguauugcauacuuuggugugcaguagugcugugucucaauguacagugaagaaauaacuagcaucaagaaaaaaauaccuaacaaaucaugaaaucaagauaacagcaaacacacacaaaugccaauaacuaagacauaucaauauauaaaccucugcgccaacucuagcaccauuuauuuaucaaaauauguuaauacccuaccuugcaaauuuauugaacaacaaaaccuuauuaaacccuucagcacauuugcuaaauauucauugauuguagucuucugauuggcuuacuaagguaaaggaaagcuuagcuagguucaagguagcauagcaaaugguuuuauguuagcuuuaaaaacaauggcaauuuaaaaaucucuuugaaagugaucuugaaacucacuuaaauggagcuuucaaccagugaguagguuugugucaacaugcaacucauaaauaauuauucacaaaacaaaaugggagccauagagagaaacauuuuaaaacaaauccugaguucuucuuuugcaauugugguuaucacaauaaauaaauuaagcaaguaauaaaaugcucuucuucuucaaguacuauugauauccccuuuguuucaucagagauauaaagauuuguggcuucagaccuuagguggugaaauguuuuuuguuguuuuuuauguuauccuccuuccuguuuuucaaagggauccuaugaucaaacuacauuacuauauucaggaggagugagggagucagucacucaauugaagaggaaaaaaacugauuauuguggaauauuuuaaugaaaaauuucaaaguaaaucucaguuagaaucucaauauguacaugcagccauugugaugaaacuaagagaaugcuuuuguuuuccuucucauuccccuaacuuaacaaauaauaagacauaaagcauuuuucuaacaugcuuguauuuauuauauuaaauuacaaaugccuggaguuacauuugcuuguuuugugugugcgugccugcgcaucuaugugugcuagcuccauauuaaaaucaacauuuaaauauuaaugcaaggucacaaauauaaauggcuacuuguuuuuuuucccuuaaaaauuuuagugcagcuuugcuuuccuuaaaguaauauuuaauuuuccauuauuuucuauuuaagcccuucaucguggguguaaaugguacugaagccccagaaaguccuacagagauuuuucacccuacaguagcucuaugcuucaagccuaaauauuuauaauaaccugaauauuaucccuguuucaaggaagacuuucuugucuacaguucacccuagcuaugauuuuauaucuaaaagauaaugccaacaacaaaacagccuauaccuaaaauugaugguuuauucugaguucugugcagaucaucugaugaaaugaaacuaacuuacacaaaauaaagaucgacugcucuuguaacagcuggauagucaaucaaugugaauaaauggggcacauuauaaaauuuaaaaccuaauacuuguucuucuacagccuacugucuuuagacacuuguuaagaacugaggcaagucuaaccauuuccuacugaagaaaccacuucugcagcaaacgcuuuuaaaaugucacaauuaauaguauuucugcugcgggaggcacuuccauuaagacaaauacaauacauaugucuuuagauacagugugcuacauguuauaaaacacaauuuaacccaacauuucaacaguaggaugguccuugcuuucuauccauucaaaaccugaugaagucauagaauucauggauucacugcaaauuuguugaaauaaugggucauucuuuaauucuuccaguguagcuucaucaucuugucccugcugacgaccuggaucaaacaguagauuugggucuaaaguguucaaaucauugaugcugccugagagcucagaagacaaccugauaucgcuagagaaaucagaugcaguauuagugagaucagaugcucccugaccuaccagcugcugguugguuugcaagcugucuccacucaacaggucuuuaacagugcuauugaaaucuaauuguugcucuccaauuucugauugugcuugauuaucuccaggagaaaaauugaucugaccggugcuauuacuuuuggugagguaagaugguguuuggaacucauaaacagaagugcuggaaucgaucauauuuuguggguuggcacuaggaaaaacaguggaagguuccaaaaucugagugagauucauccgggcuguauaauuagagggcagguuguucauucccaaaccucucacugcaucaucauugucggaaucaaguuuacucaacaaaacauugguuauuuuuuuacuguuugcuugcuucugaagagcguuugggaaggcugucugcaucaugacugucaauggaacugauuggcuucuuugagcuauguuguuggcacaugcgucugugugaacauuugugaaaacaugaacuucugggguaacuggacuuccaaagggggucacauuagaucgugggauauuagauacuggauagagggugcuuccacuaagauuacguuggcgaugaacagcagggcucacacuccggcaucugaaguugcugcuggcagaugaauuaguuccuuuauuaucaagaggggcagggacugcaaaacccuccuguuuguugguguuauuuacaguggcaccuugaugcugcacaggagagacaggagucaaacgaccaaaauuagugucaugaugucuggauugagacugauaagacuguccaggcacagcaaaagcaugagguuuccugaaacggucuuccacuaguuccugauagcuugggagaauaccauggccagaaacugaugaauuaccaaccccacuauacccauuauucauccauucaagcuugguuuugucaggguguguggccaugggucuuugcaucgguuucacaggacuacuugagacaaugcuggcgucaugauaugccauacuggagcuuauuggagugaaugcaaacggauuccugcauucaacagggcugggggggacacuacugcugcaguuagaauguggaguaccaauggguguaugucggcuacuuccuaaagcacuauccacagguguagucugggcuagccuggagcaagggcucucccgugacagacucugagauccagcaaucauuucagaugucgggguugggguugggguuggaguaggaguggguguggguguggguguggguguguggauuggagugccauugcuguggauuggaugauagaagugggugcuggaagugugagaugacauuggagcuccuggaguuacugacugacucugaagggucauucccaaacaguugccguaagaaugagaauuguucauugacauuugcugcuccauaagcaccagcucuuccacaauacuaucuuguguaaguucaucaucaaaaggaaaguagcuuucauuugucugggaaacagaaggcucaaacuccuucaguucagauugcagagguaacugaucugaagaaugugcuuguauuugauuuaaagaagauuccuguaucuggcuauguagcugcuggcuauauguguccuguggcauuccuucuaauucccaaacagauuucucuaagucauugauaucagagugcucaggaauugucauaacacugauaucuugcuguuguucacaacuggcagauauaaacucagaaucuuuagugauuuguugccauccauuuggauuaaagcugccaacugacuuugaaucacuguccaagagaaagacacuuccuucaaguuuuacuuuuauaucuggagaugaugaugggguuguuugcuguuccaaagcugaaucacugauaacaagggcagaggaauucaaggguugauuugcuccuaugugugaacugacauuuacugauaccuugcuaggaaucugagcaccugcuguugaaccuucuguuuucccugaauguggaaccuuuugguccuucuuaacacugccuuguuucugcccuucuaugguagcugcugaaagcuguuccacaauugguuucuuuacaggaggcaccugggucuccugcaauguagaagacagucguuuucuugggcuuuuagugcauaauuuagggucuuuauugauugagucaccauuagguggugagcugcugcuggugaaaguuaaguucugagaagcaacugauagagugauagugcuuugauuauugccuguugacgugccuggcagcauuucauuacagcgacuuuuacauuugguccucuggucacagaccuuaguugcuuuuauuucaaugacaccuucauuugaagguuucugcagugcuccgucuguauuacuuuucugccccaaaagggcacuaggugucuggggagcuuuagccucaucagaguucucuuggcacuguacaggaugcucaucugaugauguuucggguuccacuuugacuuccacagcagauguuccccccgcacugcugcuccuggacccaggagacugaagcgacacgacagaaccauucuugaucuguggaacacuccuugauucuucuguuguuccuguagcacugcugacugaggcagaauguuuaagagggguguuacuguugcugggugugagggauauuguugucauuuucaccacauuuagagaacucaugugugaagcggguacaacagcaguuuugaugggacuacuaguaaagaggacaguaguuggagagcgaauggugagugcacugguguucgcugguuuggguaagaucugaggguaacggugccgggcagaacgauccccaccaggacuggcuggaacguucuggggagucuuuggugccuguuucacagacugcaugugcugagugaccaccuguacauugaggggaagaacuuugccgucagaagaacucauuggacucggugaaguuaccaauugccuaguccgcuggaccuguuaaaagauagcaaaaaaucagauuuaacaggucuagccuguaaauaguaauucauguaucuguauauacuuuuaagucauuuauuaaauguuaauguuaaaaagaaaaaaguuccuauguuagaagagaguucuucuagaccagguucuacacaaucagacacauaaauguaacaaaugcaaccauaaugcauuauaauuaaaaaauauguaagaacauuaaguuacuuuucaauuaagacuaaaagcuucacaccugugaugaauauuugcugaaacaaugauuuaaggggguuacaggaagaagacauaaaaucuugaagaaacauacaacuguaaagguuaccuaccagaaucuaugcuaagauggcucacucauaggggaaacugucuuauaaaugugucuaccuuaaaugucuguaacuaaaccacugcaaauaagauacaacuacugucuacuccaguuugcccuauaaugaauagugcgguuaccauguauuucauauuuuaauaacacgaugaugauaauaggaacaagaaaaacgacaaaauacuuccuaaauauuauuaucaauaauaacauaaagcaccaacuuacucucauuuuaaaagucccuucaucauaaccucaguugugugagauaggaaaggaggagacuguuuccuuaucuacaaauagagguuaauaaacuagcuaaagaacuuggccaagguucuaguccuguaucugauaagccacggauaggccuacauuuaaguaaucauuacacauuagaauuuuacuccaucugaauguaaaaaagaaaagcguuuaaauuuuaaaaaaagacugcaauuaaauuaucuuggcugggugggguggcucacgcuuauaaucccaguacuuugggaggccaaggcggguggaucacuugacgucacaaguucaagaccagccuggccaacuaaaaauacaaaacacaaaaauacaaaaauuagcugggugugguggugaguaccuguaaucccaguuacucgggaggcugaggcagaauaauugcuugaacucaggagguggagguugcagugagccgagaucacagcacugcacuccagccugggagacagagcaagacucugucucaaaaaaaaaaaaaaaaaaaaaaaaaucuuggcucagccagggaugaaacaacucuaaaaaugagaaaauuacucacucuuacauaaagcucugagugguuaugugcauacuuuguaugucuuggaucuuuauauuuucaauaauguuucauagcuuacuuuguaaucaacaacauacauccugaauaaaagacugaaggggaaugaaucuuccuguggucacaaaaucaguuuguggcuacucuuauaccugccuucuuuucaucugccacuuuuaaguaaacaguugauuucccaccaucccaauaaggccaaauacuauuuaauuauauuaccggaaugggacuagggacagcugccacaacgauaccaauagguugaggagaaaggauugaaggauuuccauuaggaagauuagucacuccauugcuuguagcacuuucugacuuuuuugcugcagauucuccuggcaaaggggauuguaguuucuguucuugcugcuucuucuggauuuuccguugcaacugcuguuuagcaucaauuggagauggcaaagucuucaccugaggcugaaaggaauuacuuucagcuguagguauaaaagcagaaggcuggguaauuccuuucauuccugaaaauaaacagaaaggaaagcugcaauaaauacucuccuuuauagaagggagguuccuuugaauuucuuugagaauguagccaucuacuggacaaagcaaccaaaauggcaaauuuuaacucacaauuucuuuaugaagcauuagacuucgaauuuauaaacaauugucaauauaguuuugucaucuuacaauaugguucaacucaggcgacaguuucaguuaacaacaggauuuuaaaaucaggugacaguuucaguuaacaacaggauuuuaaaaaccguagcuauaucguaaaugugcagaagcugagauaaaugccaacacagcauuuuuacauuuucucaaaggucaguaaauuucccuccccccauuucuaaucagaaauaaauacauguauuuucaugauuuuaauauuuagcccaugaggggcauucaauaauucaauaaauauuugcugaagccacuccucauaauggaauaaauuuguauggagaaaacaguuuuuaauccuaccagcaauucauggaaauaggcacuauuauuuuauugcuacuauacaaugauuccaguaugaccuagaagaaauucagaagcagaauuucuuaacaagacuaaaguuaagauauuccaaaaaagugucacugagaaaaccuuuaaaacaguaagauaaacacugaaaaaaauugacaaaauaagcaaaauauaaauuuuaggaaaaauggauuauaaaauaaaaauuuuuuaaaagcucauuucagauuuagggcguggcauugagaucauuagaaaguaaguugugggcaguaaaaacaaugaagagaagaaaggagaggaacaacuauccugcugguacaccuugcccuuucuuuucuuuuccccaucccaauuucugcuuuucaucauucuaguuaacaacaacaacuugguguggggagcaggaaauagacaaugaggaagcuauaacucucuccccauacucaauaaugaugaggaucuguugaacccccagccccuuuuaaaaaucacaauuuuucaucucaaauccagcuccaguuguuuugccccuuuccgaccccaagccucagcucuggcuucucagcaccugcacucuggagagccucugccaauggcucauagcuuggcugucuuauccuuccugccaggguuuugagacaggaaugaguuccaagcagcugacuuacaaaaggacauuuguaacacaaccuguucuuaauauggagacuauauuuauaaaaaaaaaaauucaccuucaaaggauaaaaauuagucuacuaucgaaggucuuuuuugaaaaauauaguaagggcugagaucaaaauuuugagagacauucuaaaaauguuuugaguaaugauacaauugguaaaguauuuacccucucaggcugauugcuuucaaaaauggagugucuuuuuaauauauguaauuuuuaauacuuuuguuaaacucacaccuuuauuugcacuuagaccuuaaaaauucauucauucaauucauucaacauuucccacaguuagacuuugugaaugacagaaauaggaaagagauguuucuuuuccccaugauaccuccuaaauccuucaucuguugauguacucuuuuagguguuggcaggggcaggagaaagacagcagagcaaacugaaggguucauuccuuuuaaagcuuauuuuacuauaugacauuaugauauaauugagugaagcugggcuuuggagacagacaaaucagaauucaaauccuggcuccauuacuuaugugcccauggacaaguuaauugaccuccccaagucuauaaauugggaauaaauaucaccuaucucacaggacugcugggggaauuaaaugagguaacauaagugagcuauuuagcucgauaaggcuggucaagcauucuccugcuggucaguacaaugaauaaacagacuuaggucauacaguuuacaugcagacaggaaaaacucugugacacucuuuuucugaaaugggucuucaauugaccacaaaaggagagguuacacacacauacaucccacauacuaaauguaaaauuagaagaaaacggacucauuauuaauguguaaaagauacuaaaaaaagaagugaaguuaauuaagagacuauaauucuggccaagauaaaucuauuguagauuuuuaaauauucagaauuaacacuuagaaggacaguccuuggaaaaauaagucucugaucacuauaucacuacauuuuuaacagacauccugauuuucuagaauaauuuauccacucuagguuuauaagguauaacugaaauaagauauuuuuaaaaauucaucagaacuguuauuuuacacaacuauuaauuuaggagggagucauucuaacaagacugucaauucccaaaauugucgauuccaaaaacucaucuuugaauaaaaauagucaugaauacacaguaaaaaauaucacucuuguuauuuuuuaguaaggcuuuguacgguuuuguuuuuuugaggcuaaguuaccugucacagugugcaaagauaauuuuauuuauaagcauuaguuucuggaaugggaaucuaacaaguaauuuuaaaauuuaaucuuauuauuuuacuucucuuauuaauuuagauacacauauacauauauguacauauaaaaguacauauaaacacauucuauaaauguaaaaguagcaauggaaaaauuaauaacauaucagcuggggaaucuacaguuucauaugccagcaaagcaauauauagaaacauagcauuaagcuuuauaaugaaaggauuauuauuuucuuggcucaacagacccaucugaauuuaguguuaagcggaguaagagugaacacaugcaaguacuaaaaggaugaaguucuuugaucuaacucuucuuuugcuaccaauucuaaauacaauaauaccucugucaguuuuuagcuuguucacaguaauguuguaccugcuggugcugcugccauuacaguuagagcugccauugacuuggugccuauauagugacuuuuuacaaggaagcgggcuaauuccaagacggugucaaaugguuggcuuaacacuuucugggcccacucacacacaagacggcaagcagaagagauaacuucuucaucaauauuuugaagcugcccagaagguucagcuccuuccaacuaggcaaagaaaaaaggaaauguuaacuuguaaaagaccagagaaauuaaauugaagcauguuaaagauauguauucuuaauuagaagauacaauauaaaucuguggguuaaaguaguaugaauugacccacuggcagacauauaagagcuuugcaaauaagggacucauacccacuagugcacagcagucagcagccuugcgaauauaacauuuuaaaugguuuuuaaacauacaagaagacugauguuuugaaucuuucuaaugucaaaacuaugccaauagccacacauuuuuucuaaaauuccuauaaaacauauuacaugaugacugacuuuuuccucuugacuauacacacauauagucaauauguauuuuggaaauaucgagaaaucaguaacuucuaaacuuuuguucccccaaauuucauguugacguaggucauauacacuaacauuuuucagccacugugugauuuuuuuuuucuuauuuguaaaaggcacagucgcuaggcuuaaccaaaugagacuuugcaggaugcauuucaauguuaauauaaagguacaauuuuacuuauuaaaaagaaaaggcugaauucuuaccccaucuccaguuuugugaaagucaagguugggcaguguuggcauaugaacaaaagcuuuuuuucuuaguccacuguagcaauauguaauaaacaguuaaggucuaaauauucaaaauuaaaugaauugcuuauacagacagcacuuuaaaaguaaccauauaugaaaugagaaaaaaaaaucaacaugacauaacaucuacuuucugaauucuucaguaagaaaaaccuuaauauuaaaaacuugggacacuuuuacucuuuugaaacugaaauaccccuuuagaauguuaaauacuacugucuuaaaugaaaagauucucaucuguuauaaauuuuaugaauaaauguuccuaauaugcugugccagccaccaguaacaaacaggucagaaggaaaggaauagccagauggaaaccuggcacagggaagggaaacuucagcccagggcucugggacaaaaacaacucuuaagagugucacaagggcuuuaaccuuuucguuucucuuuuuccacugaaacauacaggauuaucgccuguaacaugccaaagacacaucaaaacauuuuuguuugcauuugggaagcaagaauaggucgugccaacuagugguuagagaacaccuggaaccauuuuagaaaagcaaguuucuucccuuccccuuccucucaucuccuccauuuuaugcucugaaaaaaagacaagagcuaagggggagaaaauggauguaauucuaauaugauacagagacccucuauuuuacaaucuucuucuaagaggagaaagaacuauaaugaauucuuaauuuuaauuuccuuauuucuguuugcuccuaaguauuucuccaucacaagaaggaccuuuucuguacucuggcuuuaauuuuaauaugggcuuuaaauggauggcugaaaaauacuuguacugaaagauuaguguuucuguuaaaguuccauaagauuuuuuuuuuuuuuuuuuuuuuuugccaaggagauccccuauguuucuaaauuaaaggaagaaacgaagauaagcuagcaucuuucuccacuuuuauucuuauaauuguuaaacauauggcaggccucaaaacuucuuacuguuaaaacaaaggagaucagaccauuaauaacacuuuacauugauagacuaagguaaaaucuaucacaauucuaaucuaugaauaaaccauuauuugcuauuucuuucauagugugauaaauaccugugaaaguuacauuugcaauuauucuacuuaagcuuuugaguugcuuuaauuugaaguuuauuucuaaauaaaguugccaguugaacuacaacaauagauguucuauaacaagugagaacacagagauauuacuaacaccauucugguaaaggauauuuagauuugccucuugugcccaaacgacgugccuucauguuuggaaagacguuuuucaugaucuuuccaaaaucagcagcacuuaauggaugguaaccaagauugucacaauagcuccugcaaaagaaggaaggaccaauuuagagugacagaauucagaauuauaucgcagggugcuauuucaauacaauuugauccuucugacaaagugaagcaaaggaucuuucaagucauuugccacaaugucuaugaucaucacucuuuggugaugcauguuaacucagguuuaguuagcuggcuucaaccucaggguauauaguccugcuuucaauaacauucauaaaucuugcaguaagauacaauguugguacaaaguuuucgaauuacaaucccaaccagugcucauaaaugaauauauccagcucagccaguagggcuguaaguuuccacauauguaucaggcucacauacugggauaauuuccaauauacauaucaugcacaucagacagagauaauacuacuaggugguuuaaaauuuagaaacaugauauguuugaacuaaaagggacccuacgaauacaccaacacucucauuuuacugauaagagaaaaaacaggcaaggggagagguuccaaagguccuaguguuauccuccuucuacccccaccaucccuaguauugcuaggaaaaaaguuacuuuguaagacaguaacuucaagugggaucuggagacacaccaagucuuaacuacuacuggaaucagguguucuguuuuucucuagagcugccagucauagguaaaaugucaauccucuaccaguucagcagcagaccaaggccacaccuuauucuggccaccaaggccuuugggagaaccacuaccugggaaauaugaaugaagaggaagccagaggaauucccuugucuccgccucaccucucauuuagcaucaaccaggacagcuucuugaugaagucaugcagaaaagaaaugaaaacaacuggaacacauggugggcaggguguaauggaaaccaggacuugggucuuuuuguagauugcugaauguccugauaacaucccuaaagugaccuuagcucaagaaguuaaguugggagagacucaagaggaggcagagaccccugggagccuuaauacagaaagaauaaggguagcucuggagacaaugcuauuucucuuguuuguggcuucccuauucccacagcaaauccugcauaccccugggguuaaaagaugggaaggaguagcccagcaaacacaucaccaacaaugcuacgagcagaaagggaacuaaugcguacugaaaguuucccauauagguaguauuagcagcuucauauuuaaauugagacuaaauuugauacuuugagggcucagggggucuugcaagguugaaggagcaaagugaagagguaacuauuuugggugcugacaauggaaaugagcugcaucaaaucauaacaauuucagaagcaaguuaaaugaguucuuuaugguucaaaccggcacaaaaagaaaaugagaaugaggcucuuuugcaccccagggacuugacccauguugauuccucuaccuggaacauuacuuuucuuaucuuucaagucucugcuuaaauuuuaugauuuuugaaaggaucucuuccgacuaaagcaacguccucaugucacacccucaucauguucccuaucaguguaaucuguuucuuuucuuugcaugaguuacaauuacacaauaguuaauuuauuugucuucuucaucacacuaaguucaagcagggcagugaccauaccuauuggauucgccaguguauucucagcacuaggaacaagauuuaagggucauaguaagaccaucuguauuuaaaacuauaauaaacauuaaagaaacacauuaaaagacuuaaaaaagcaaagaagaaacauugccccccuccggauccuaggacagcacuggcagaaaugggucuaaaaaacugaaaucaaauaaacagaggcaguguaaugagacauuugagagauaauauauccauucuauucuccaucuguguuucagauuuugauuuuuuuuuucauuaguaaaccaaaauuuuuuacuuuggcagaagggguaggagaaagguuggcaaaagaaguaauguuaaguaucaucgaccuaaagacauaaagugagcaaaauuaauauaguaguuuaguuuauuugggucaagguugaggacugcagacugggaaaugcugagaagugcuccagagaaugaaggaaaggcucauguuuuuaaagaaaaaaggacaaauuaggagagggggcaauuacaaaaauuguuuguuaagaauucucauugguguagagaaauaacugauuaguaauugcuauacauuguugaacuauaggguaugaauuauggugucuagcauauggcauuguuagguuaguuuaugguuacuugguggugacagucuaaaguccauacagcaggcagauuacuuagcucaaagaggggagugagagaugacuacuuucacauuuuaaugccucacugggcccaguaauuuaaaagagcucacguuccucagauaaaaaguuucuugucuuucuugguauacagaugaccaaugccaaauuuguuuuucaauacaauuuauauugugugguuauuucacaaaaucauccaauuccaucugguuuuugauacuuauucuaccucuuggaaggauauaacaaccucauugucgaauacucugguggauaaauauuaaaaguacuuuguagacauaaauagcucaaauuauuccuccugaaucaugucagaagaaaacugccuaugauucaaaacuuuaugcuuugauaacucauuucaaacagaaaauaaagagggcaucaauguaaaaacaacaagaacaauaccuagaauagguucucaauuucuuuaauuuugugaaauguuagaauugaaaaaauaaaucagaaguuguauaguucaacuuccugccagauguagaaauggucauacucuuaaaugauggguuaccucaacacgaacccuucuuugauggggaggacucuuuauugugagguggccuuauccaauuucuagugguuguaauuuuuaaagaaaaagaauuucaauaggacaccuuuccccauuaagaaaaaucuagauauucaaugauucuuuuaaaaaucuaauuuaguaaguacuuacauaauauuuauucaauuuuguccuauauaacaaaccauuggucauuccaggccauguggagaucuugguuaguuuacaucucauuuuccugcuucacaacguuaacugcagguugaccaagcaagauacagugucaauugacucuuaacucagugucagauuauacuuugcaagacucaaaaaagggugaggaacggagaauguucuguuuacgcgaucacuaacacucuaaugucauuuuaaaaaugaaauaauuucacacccguaaucccaucacuuugggaggccgaggcaggcagaucacaaggucaggagaucgagaccauccuggcuaacacggugaaacccugccucuacuaaaaauacaaaaaauuagcugggcgugguggcaggcgccuguagucccaguuacucgggaggcugaggcaggagaauggcgugaacccaggaggcggagcuugcagugggccgagaucgcgccacugcacuccagccugggcaguagagcaagacuccgucucaaaaaaaaaaaaaaaaaaaaaaaaaagaagaaagaauuguuuuuuuuuuucucuugcuccuuguuuaaaaguacauuuuuaagccugaaauuaagccuaauauucaauaugacuaugaacacaucacucaaaauccaugguaacaauucagucuuuaauauucauucaugucacaaauuuaauuguacaaguuaaagguaaacauuguuuaaugguacaaaaauauaaacaaugaaucacaaaagacuugugguaaaauauagucaugggauaccuaaccauaccugacauuuuuugagugcuuucuuuguguuaaaucauuuaauccucucaacaaccuuaagacagguaguuuuauuaaacauauuuuauagaugaggaacuugcacagagaggugcacuaaucccuuuauuuaacagaugagguauuuuuauugcuaauugauaacuauaagcauacugaaugaauaaagaagaaucaaauagcaauaaaaaaugaugcaggcgauaucgccacugaucccacagauaaaacaauaaaaaaugauaauaaaccaauaaaaaaugauacaggggauaucgccacugaucccacagaaauacaacuaccaucagagaauacuauaaacaccucuacgcaaauaaacuagaaaaucuagaagaaauggaaaaauuccuggacacauacacccucccaagacuaaaccaggaagaaguugaauuuuugaauagaccaauaacacguucugaaauugaggcaguaauaaauagccuaccaaccaaaaaaagcccaggaccagauggacucaaagccaaauucuaccagagguacaaagaggagcugguaccauuccuucugaaacuaucccaaauaauugaaaaggaaggacuccucccuaacucauuuuaugaggccagcaucauccugauaccaaauccuggcagagacacaacaaaaaacuucaggccaguaucccugacgaacaucaaugcaaaaauccucaauaaaauacuggcaaacugaauccagcagcauaucaaaaagcuuauccaccaccaucaagucagcuucaucccugggaagcaagguugguucaacauauguaaaucaauaaaugucauccaucacauaaacagaaccaaugacaaaaaccacaugauucucucaauaaaugcagaaaaggccuucgaaaaaaugcaauaucccuuuauguuagaaacucucaauaaacuagguauugauggaacauaucucaaaauaauaagaguuauuuaugacaaacacagccaauaucauacugaaugggcaaaagcuggaagcauuccuuuugaaaaccggcacaagacaagaauguacucuuaccacuccuauucaacauaguacuggaaguucuggccagggcaaucaggcaagagaaagaaagaaaggauauuuaaauaggaagagacaaagucaaacugucucugucuguagacaacaugauccuauauuuagaaaacccuauugucucagcccaaaaacucuuuaaacugauaagcaacuucagcaaagucucagaauacaaaaucuauaugcaaaaaucacaagcauuccuauacaucaauagacaagcagagagccaaaucaugaaugaacucccaaucacaacugcuacagagaauaaaauaccuagcaauacagcuaacaagggaagugaaggaccucuucaagaacuacaaaccuucucccucucccucucccucucccacucccucugccucucccucucccucuuuccacggucucccucugaugccgagccgaagcuggacuguacugcugccaucucggcucacugcaaccucccugccugauucuccugccucagccugccgagugccugcgauugcaggcgcgcgccgccacgccugacugguuuucguauuuuuuggguggagacgggguuucgcuguguuggccaggcuggucuccagcuccuaaccgcgagugauccgccagccucggccucccgaggugccgggauugcagacggagucuccuucacucagugcucauuggugcccaggcuggagugcaguggcgugaucucggcucgcuacaacauccaccucccagcagccugccuuggccucccaaagugccgagauugcagccucugccuggccgccacccggucugggaggugaggagcgucucugccuggccgcccaucgucugggaugugaggagccccucugccuggcugcccagucuggaaagugaggagcgucucugcccagccgccaucccaucuaggaagugaggagcgccucuucccugccgccaucccaucuaggaagugaggagcgucucuguccggccgcccaucgucugagaugcggggagcgccucugcccugucgccccguccgggaugugaggagcgucucugcccggccgccccgucugagaagugaggagacccucugccuggcaaccgcccugucugagaagugaggagccccuccgcccagcagccgcccugucugagaagugaggagccccuccgcccggcagccaccccgucugggaagugaggagugucuccgcccggcagccaccccguccgggagggagaugggggggucagacccucgccuggccagccgccccauccgggagggagguggggggaucagcccccugcccggccagccgccccguccgggaggcgaggggcgccucugcccggccgccccuacuggaaaaugaggagccccucugcccagccagccgccccgucugggagggaggugggggggucagccccccgcccggccagccgcccaguccgggagggaggugggggggucagccccccgccuggccagccgccccguccaggaggugaggggagccucugccuggccgccccuacugggaagugaggagccccucugcccggccagccgccccguccgggagggaggugggggggggucagccccccgccuggccagccgccccguccgggagggagguggggggggggucagccccccgccuggccagccgccucguccgggagggagguggggggggucagccccccgcccggccagccgccccguccgggggagggggggucagccccccgcccggccagccgccccauccgggaggcgaggggagccucugcccugccgccccuacugggaagugaggagccccucugcccggccagcugccccguccgggagggagguggggggggucagccccccgcccggccagccaccccgucugggagggaggugggggggucagccccccacccggccagccacccuguccgggaggugaggggcgccucugcccggccgccccuacugggaagugaggagccccucugcccggccagccgccccguccgggagggagguggggggggucagccccccgcccggccagccaccccgucugggagggaggugggggggucagccccccacccggccagccacccuguccgggaggugaggggcgccucugcccugccgccccuacugggaagugaggagccccucugcccggccagcugccccguccgggaggugaggggagccucugcccugccgccccuacugggaagugaggagccccucugcccggccagcugccccguccgggagggagguggggggggucagccccccgcccggccagccaccccgucugggagggaggugggggggucagccccccacccggccagccacccuguccgggaggugaggggcgccucugcccggccgccccuacugggaagugaggagccccucugcccggccaccaccccgucugggagguuuacccaacagcucauugagaacgggccaggaugacaauggcgguuuuguggaauagaaaggggggaaagguggggaaaagauugagaaaucggaugguugccgugucuguguagaaagagguagacaugggagacuuuucauuuuguucuguacuaagaaaaauucuucuuccuugggauccuguugaucugugaccuuacccccaacccggugcucucugaaacaugugcuguguccacucaggguuaaauggauuaagggcggugcaagaugugcuuuguuaaacagacgcuugaaggcagcaugcucguuaagagucaucaccacucccuaaucucaaguacccagggacacaaacacugaggaaggccgcaggguccucugccuaggaaaaccagagaccuuuguucacuuguuuaucugcugaccuucccuccacuauuguccugugacccugccaaaucccccucugcgagaaacacccaagaaugaucaauaaaaaaauaaauaaaccaaaaaaaaaaaaaaaaaaaccaaaaaaacaauaccagggcauaggccccacccuaaaaccauuaaaucagaaucagaaucagaaauucugagggcaaaaaccuggauccagacaaguguaucuaaaaguucuccagguauuucucaugugcaaccaggauuaagaaucacuaaugccaggugcaguggcucaucccuguagucccagcacuuugggaggccgaggcggguggaucacgaggucaggaggucgagaccagccuggccaauauugugaaacccugucucuacuaaaaauacaaaaacuagccgggcgugguggugugugccuauagucccagcuacucgggaggcugaggcaggagaaucacuugaacccaggaggcggagguugcagugagcugagauuucgccacugcacuccaggcugggcaauagagggacacuuugccccagaaaaaaaaaaaaaaaaagaaucacuaaccugguucagccuuuucauuuggcagaugagaaaacugaggacucagaaauuaaauaacuugccuaagaugguagagcucucuucaaacagguaacuguaacauagacuggcuaugcacuaguacgguauuuuucaaaauuaaaguaaugcuucauuaguaaauuguaaaaauaaauuuagugcauccugaccagaauuuauuuggaacagaauaaaaaauaucagaguacaaaucaaaaaaaaaaaaaaaaaaaaaaagaacuacaaaccuauuuaagaaaucguacugggaaaacucgcuagccauaugcagaaaacugaaacuggaccccuuucuuacaccuuauacacaaauuuacucaagauggauuaaagacuuaaauguaaaacccaaaaccauaaaaauccuagaagaaaaucuaggcaauaccauucaggacauaggcaugggagaagauuuuaugaagaaaucgccacaagcaauuccaacaaaagcuaaaacugacaacugggaucuaguuaaacuaaagagcugcacagcaaaagaaacuaucaucagagcgaacagacaaccaaccuauagaaugagagaaaauuuuugcaauuuaccuauggacaaaggucuaagauccagaauuuacaugggacuuaaauuuaccagauaaaaacaaacaaccccaucaaaaagugggcaaaggacauaaacagacacuucucaaaagaagguauuuaugcaaccaacaaaaauaugaaaaaaaucucaacuucacugaucauuagagaaaugcaaaucaaaaccacaaagagauaccaucucaugccggucagaauggcgauuauuaaaaagucaagaaacaacacauguuggcaaggauguggagaaauaggaacacuuuuacacuguuggugggaauguaaauuaguucaaccauuguggaagacaguguggagcuuccucaaggaucuagaacuagaaauaccauuugacucagcaauuccauuacuggguauauacccaaaggaauauaaaucauucuauuauaaagacacaugcaaauguauguuuacugcagcacuauucacaauagcaaaaacauagaaccaaccaaaaugcccaucaaugauagacuggauaaagaaaauguacauauacaccauggaauacuaugcagccauuaaaaggaaugagaucauguccuuugcagggacauggaucaagcuggaagccaucauccucagcaaacuaaugcaggaacagaaaaccaaacacugcauguucuuacucguaagugggagcugaacaaugagaacacauggacacagggaggggaccaacacacaucauggccuguugcgggggcggugaggggaggaaagagcauuaggacaaauagcuaaugcaugaggggcuuaauaccuaggugacagguugguaggugcagcaaaccaccauggcacauguuuaccuauguaacaaaccugcacauucugcacauguaucccggaauguagaguaaaauaaaauuaaaaaaaaaaaaaguaaacugaaugcuuguauuguaaccaaaauuacaucauuaaauuuuuuccuaauauuuauaaaaauaauuaagaauuaucaauuuuccauuaaaaggacucuuaagacuuaccuagacccauaauguuauuuuagugagucuuaguauucaaauauuauaaaugacaauaaaggauaugggaauuuugggaggucccaaagacaugguagaauuacauugccuuaaaaguauuaaucaaacaaaacauuugcuagacaaucugaaagacaaaugaaguacaaguaauauggucaaauaucuaauuagcuugagccuuagaaaguggaaaaguuguuguaauccucccuuauuuuuaaggaguaaauagaucuuaagacucuggagagaaaacucuucaaaagugccugacccuaaccauaaagaaauuggucuuuuccaguugagugugguggcucaugccuguauuccuagcgcucugggaggccgaggugggcgacugccugagcucaggaguucaggaccagccugggcaaccuggugaaacccugucucuauuaaaaauacagaaaaaaaaaauuaacugggcaugguggugggcgccuguaaucccaguuacuugggaggcugaggcaggagaaaugcuuuaacccgggagguggagguugcagugaucagagaucacgccacugcacuccagccuaggcaacagagugagauucugucuccaaaaaaaaaaaaaaaacaaacaacaacaacaaaaaaacaacagaaaaggaaaagaaaaagaaaaaagaaauuuaucguuuucguauuguucuguguuuugggcagaacaaugauauaguauguugaacaaugauaguaguacuaguaagcugaucuuagacuaggaucauacuaauauaucaccuuugaaacucauugauaaugcuuuuuuuugugguaacuacacaaugaacaauauaucugaaagauuacuuugcuugaagucaaaacuaaagaagaguuaaauuauuuauauauaaaaaaacuaucauauaugacccuccuuaaccaggacuugccuuuccuuuccaucauuuuggcuaauaauccuacaaaaaagauucagucauggugaaucaugauucacagguuaagaaccuuaaccugaaguuuauaaauugcuaauaaaaaaaaucccauaguuuaugaagucaucugauaaauccucaagauuuuaaaaagaaauuugugucuuuacuuaaucacaguaaaaaguaaaucuuaaaggcuugaguucucauggccuaugaagaagccauuuaaaaugacuauucuuuuuuuauuuuuauuuuauuuuugagacagagucucgcucuguugcccagccuugagugcaauggcgugauuucugcucacugcaaccuccaccucuggguucaagcaauucuccugccucagccucccgaguagcugggauuauaagcgcccaccaccaugcccagcuuaauuuuuuguauuuuuacuagagacagggauuugccauguuggccaggcuggucucgaacuccugaccucaggugaucugccugccucggccucccaaagugcuggcauuacaggggugagccgcugggauuacaggggugagccucugugcccagcuaaaauaacuauucuuuuuuuauuguaugauuccauuuauaugaaauauccacaguacagaaauccauacagacagaaagauuuauaguugacacgugugugguggaaggggaaacuggggcugucugcuuaguguauucaggcuuuuaaaaaaugacuauucuuuuggugaauuuggauuguuauuuuuaaagcaaagacacacacacacauaugugauaaauauauugaucauacucuacauauaguaugagcucucuuuguauacauacuuucauuuuuggauugccugaggucuccguuguuuuaaauuaacugcauauaggcccggcacgguggcucaggccuguaaucccagcacuuugggaggcugaggugggcagaucaugagaucaggagauugagaccauccuggcuaagacggugaaauccugucucuacuaaaaauauaaaaaaacaauuagccgggcgugguggugggugccuguagucucagcuacgugggaggcuguggcaggagaauggugugaaccugggaggcagagcuugcagugagccgagaucgugccacugcacuccagccugggccaacagagcgagacuccgucucaaaaaaaaaaaaaaaaauuuaacugcauauaaaauguccagauuuaugauuaucgacaguaacuaccuauagauuaagaauuaacaaacauugaaagaaggggccuugacccaguaaauuccugaguaaccaucucucaucuuugaauuuccauccagauccaauuauacuacacuuaguuauucaauaguugggaacauuucugaacucauguuaguaaaaggauaaauucaaauuuucacaagguuguauacaugaaaacaaaaaaagccaagagacccuagugucaucugauguaaucauaccauuucguagaugagaaaacuaaggaagagagagguaaagaugguuuguaaaaugguuuguaagaugguuuguaguuaaauaagugguucuuuacugaugacucaaguagaauuucaugcagucaguacucaauacauauuuguugacugguugcacuacaacauuuuuaaaagguucccucugaagaacagugaucagcccucaauuuuacuuuucugcauaaaaucuuaauaaauacauacagcuguaauguaaacaguaugacauucuuauagaaucugugucaguagaaaaugagugagauguaguuaccuaccauucaugaauguauagaagaggugagaaaaaaggacagagacuuaaauagguucuccgcagaagacgauacccaguuggcccaagaacauauaagaaaggcacucaacuucauuagucaucagggaaaugcaaguuaaaacuacaauggaaaaaaggauaauguccguaugcagaagaaugagcuaagaaauuaugguauauauucacaagugggauacuacauagcagugugaaugaauaaacuaaaaugcauaaauuguacaaacauuguacaguuguacaaauuguacaaacauuguacaguuguacaaacuguacaaauauugaguaaaaaagccagauaaaaaauauaguauauuguauaacaucauucauguaauguucaaaaacaagcaaagcuagccuguggcauuagaagccaggacagagguuacccuugaugagagaggugcugguaaagagagugaguguaagagguuaugaggcaggauuaugguaauguuuaguuucugaaucuggaugcugguaauacgaggguauuccuuuuguaaagauuugucaagcuguaaacuuauaaucuguauauauuuucuguguguauguuacuuuccaauaaaaguuacauagagugcuguaaauaaaaugccaugccugagcuagaacuaagggucuaauauuauacggagaaaggagauuuaaacugggccuuagagaacaaguagauuuacucauauggguguuaggguggguggagggugaggcaggucuauuucauguagaggaaagaauaugaacaaaaacugagaagagcagcauaugguuuugaaacuaagaauuucaaaaaagcuaacauguagacuuauguacagugaacagaucaggguaauuagcauaucuaucaucuuaaacaucugucauuuauuuguguugggaacauucaauauccuccgcacuacuugaaaguauacacuacuguuaagcauagucauuuuucaguacuauacaauuuauuccuccuaucuaguucuaauuuuguauccuuuaaccacucucuuccuauccccauccccuuucccagcaccuaguaucuucuguucuaccuuuuacuucugugaaacgaacuuuuaucaacuuccacauaugagugagagcaugcagcauuuaacuuucuauucccaguuuauuuuacuuaacauaaugaccuccagauccauucauguugcugcaagugacaggaucuuauuuuuaauggcuaaacaguauuccauuguguauauauacauuuucuuuauucacucaucuguuggacaccuagguugauucuuuaucuuggguauaaugaauaguguugcaauaaaccaugggggcguuaggugucucuuugauauacagauuucuuuccuuuggcuaaaugcucagcaguaggacugcuggaucauaugauaguccuaucuaucuaucuaucuaucuacacauauuuuaaaaauucuugugaguauauauuagguauauauauauaugggguauaugggauacucugauauaggcauacaauguguaauaaucauaucaggguaaaugggguauccaucaccucgagcauuuauucuuuguguuaccaacaauccauuuauacucuuuugguuauuuuaaaauguacaauuuaauuauucuugacuaucaucacccuguugugcugucaaauacuagaucuuauucauuccuucuaacuauguuuuuguauccaucaaccaaccccacuucacuacugugcccccacuacccuuccaagccucugguaaccaucauccuacuguaucuccaugaguucaauuauuuuaauuuuuagcucccacaaauaagugagaacauaugauguuuguguuccuguaaaugguuuauuucacucaacauagugaccuccaguuccauccaugugauugcaaaugauacgaucucauucuauuuuuauggcugaauaguacuccaucuugccuaugugcuacauucucuuuauccauucaucugcugauagacacuuagguugcuuccaaaucuugguuauugggaauagugcugggauaaacaugggagugcagauaucucuuugauauccagauuuccuuucuuuuggauauauaccuagcagugguauugcuagaucauaugguagcucuauuuuuaguuuauugaagaacuuccuaacuauucucuacaguagcuuuacuaacuuauauucccaccaacaguguaugaagguuuccuuuccuccacauccuugucaucauuuguuauugucugucuuuuugauaaaagucauuugaacuggggugagacuauauauuguuguuuugauuuguauuucucuaaugaacaaugauguugaguaccuuuucacaugccuuuuugccaucuguaugucuucugagaaaugucuauauaggucuuuugcccauuuuaaaucaaauuauuagauuuuuuuucuauagaguuguuugagcuccuucuauauucugguuauuaaucccuugucagauggagaguuugcaaauaauuucucccauucuguggguuaucucuucacuuuguuaacugcuuucuuugcugugcagcuuuuuaacugcaugugaucccaucuguccacuucugcuuugguugccugugcuuguaggguauugcucaagaaauuuuugcacagugcaauguccuggaguuucccuaguguucucuuauaguaguuucauaguuugaggucuuagauuuaagucuucaauccacuuugauaucauuuuaguauagggcaagagauaggggucuagauucauucuucuacauaaggauauccaguuuucccagcaucauuuauugaagaaaccauguauuuccccaguguaugcuuauggcaucuuuguugaaaaugaguucacuggcugggugcgguggcucacgccuguaaucccagcacuuugggaggccgaggugggugggucaaauggggucaggaguucaagaccagccuggccaacauggugaaacccugucucuacuaaaaauacaaaaaaaaauuaggcaugguggugcgugccuauaguuccagcuacuuggggggcugaggcaggagaaucgcgugaaccugggaggcggaggcugcaaugagcugagaucgcgccauuggacuccagccugggugacagagugacacugugucucaaaaaaaaaaaaaaaaaagaaagaaagaaaacgaguucacuguagauguaugaauuuguuucuggguucucuauucuguucuuuuggucuaugugucuguuuuuaugccaguaccaugcuguuuugguuacuacagcucuauaguauaauuugaagguaaugugauuaguccaguuuuguucuuuuugcuuaggauaucucuggcuacucuggcuaucucuuuuaauauaaauuugggauaguuuuuucuauaauauuucugugcagaaugucauugguauuuugauagacacuucauucaaucuguagauugcuuuggguaguauaauuauuuuaauaaugauucuuugaauccaugaacauggaacgccuuuacauucuguguccccuucaauuucuuucaucauuguuuuauaguuuucacuguagacaucuuucacuucuuuaaguacauucuuagguauuuaauuuuauuuguagcuauuguaaauaggauuacuuucuugauuucuuuuucagauuguucacaguuggcaaauaggaaugcuacugauuuuuguauguugauauuguauccugcaacuuuacugaauuuauccauucuaauaguuuuuugguggagucuuuagauuuuuccaauauaaaaucauaucaucuauaaagacagauaauuugacccuucauucccagucuggaugcccuguuucuuuuucuugucugauugcucuagcuagcacuucuaguacuauuugaauaaaaguggcaaaagugggcauccaugucauguuccagaucuuagaggaaaggcuuucaguuuuuccucuuucaguaugauacuagcugugggucugucauauaugucuuuuauuauguuaagguauguucauucuaugcccaguuuuuugaggguuuuuaucaugaagagauguugaauuuuaugaagugcuuuuucauuucuugcuuuuuauuuuucuguguaucuguuguauguuuuuagauuugagguuaccaugaggcuugcagauaauaucuuacaauguauuaaacugauaacaaauuauuggauugcauaaacaaacaagccaaaagagaacuaauaaaaccuuuauacucaaauauugucuccccauuuaaaaacuuguuguuguuucuauuuauauuuuauuguacuaugacuugaaaaguuguguaguuauuguuuuugauuaguucaucuauuagucuuccuacuaugaguaguuuacacaccacaauuacaguguuauaauagucuguguuuuuuucuguguauacacuauuaccacugaguuuuguaccuucagaugaugucuuacugcucaacagccuuuucuuucagacugaagaacucuguuuaguauuucuuguaugccaagucugauguuaaugaaaucccuaagcuuuugucugugaaaaucuuuuuauuuccuuccuguuugaaagauauuuucacuggguauacuauucuaggguaaaauauuuuucccuucagcacuucagauaugucaugucacucucuccuggcuugcaagguucccacugaaaagucugcugccagauguacuagagguccauuguauguuauuuguuuguuuuaucuugcugcuuuuaggaucuuucuuuauccuuuaccuuuuuguauagggcaagagauaggggucuaucaagguccucagauaggaauuugauuauaaaugccuugagguagucuucuuuggguugaaucugcuugcuuuucuguaacuuucuuguacuuggauauugauaucucucucuagguuuuggaaguucucuguuauucucucuuugaauaaacuuucuauuccuaucucucugucuaccuccucuuuaaggccaauagcucuuagauuuggcuuuuggaggcuauuuucuagaucuuguaggugugcuucauucuuuuuuuuauuguuuuuuugucucccucugacuguguauguucaaauaaccuguuucagggucacuaguucuuuuugaucaauucugcaaguaagagacucugaugcauucuucaguguauuaauugcaucuuucaacuccagaauuugcuuuuuaaaaauuauucaaucucuguuaaauuuguuggauaggauucugaauuccuucucuguguuuucuugaauuuauuugagcucccucaaaagagcaauucugaacucucuuuuugaaaggucacauaucucugucucuccaggauuggucccuggugccuuauuuaguucguuuggugaggucauguuuuucugaauggucuugaugcuugugaaugcucaucagugucuggacauugaagaguuagauauuuaucguaguguucacagugugggccuguuuguacccauccuacugggaaagacuuugcagguauucgaagggacuuuugugccgugaucuguuuuuggccaccacagagauaacugcauuugggggcauuacaaguccaguaaugugguucuugcagauucacagagguaccaccuugaugguguuggauaaggucuggaagaauucugugcauuaccaugcagagauucuuguucucuucccuuauuuucucccaaacaaauggagucucucccucucucuaggcugaaaugccuggagcugggggaguggugacacaagcagcccugugaccaucacuacugggucugugcuggguuagaccugaaacaagcauagcacuggguauugcccaaggcucacuguuaccacgacagggcuaccauuuauguucucacucaagcccuagggcucuacaaucagcaguuugugaagccagccagucuuuuguucuugccuucaggguugugaguugccccagaccccagauggguccagagaugcuauccaggagcaggauuuggauccagaaaccuuagaaaucuaccuggugcuuuauccuacugcgguuaagcuggcacccaaaccacaagacaguccuucccacucuuccuuccccuuucccuagucagaggagucuccccguguccaccaccacaggcccacagggaguauugccaggguacugccaauguucacuuaaggcccaagggcucuccagucagccuguggugaaugcccucaaaucugggacucacccuucagaugguauuucucacccuuagaugguauucgagaaauaccaucuaagggccaaauaccauaggucgacaaaaaccaucuaagagccaaggccuggaaucggggaccccaaaagcccucuugguggucuuccccacuguggcugggcuggcaccuaagcagcaaaacaaaauccccuuuauucuucccucugcuuuuuccaaccagaagucuugccuuguagccaccacagcuguaaauacacugggucauaccugaagccagaaugucucagaaucucaccuaagaccucuggcauguacuaccugguuaccacugcuaaugguauuauucagggcccaaaggcucuuuagucagcaagugaugaauccugccaggacuggguccuucccaucaacguaguggguucccuucuggcccagggugugucuagaaaugucauuugggagcuagagccugaaauggaggucucaagacucugcccgguacccuauacuacuguggcugaacugguauuuaagcauuaagauaaaguccucuucacguuuccuucuccucuccucaaguggaaggaagggguucuuucagaguugcaagcuuugcugccucagguugagggaaggcugaugcaggcacucccuuggccacccuggcuggugucucaauaggugguaugccgcccaaguccacugguuccgagcccagcaaagcacuaggaguugccuauacauugcaguccuuguggucuagacugccuuucaaguuuauuuaggacuccagagcacuuuagccugcaguggugaggcuugugggaacucaguuuccaaccacugggaugagagauuuccuuucuggcuagggcuggucugaaugcucuuuccacaggagcuggcugaguucugcccacuguuggcggcacugaguuccaaugcaaaguuccacagcugcugcacucucucuccugcaaguggacucauucuccguggcaggugcugggagaugggggagagguggugucagcaauucaagacuuuuuuuguaccuucuucagugucucuuucaacuuaaaaccagguacuaugaccauucaccugauuucugguucuuacauuuuuguguguguguagauaauuguuaaauuugguguuccugcagggaggaugaucaguggaggcuucuauuuggccaucuugguacaccucucuguauuuuuaagaaacaucugccgggugcaguggcucacgccuguaagcccaacacuuugggaggccgaggcaggcggaucacaaggucaggagauugagaccauccuggcuaacacggugaaacccugccucuacuaaaaauacaaaaaauuagccaggcauggugacgggcaccuguagucccagcuacuagggaggcugaggcaggagaauggugugaacccaggaggcggagcuugcagugagccgagaucgugccacuccacuccagccugggugacagagcaagacucagucuccgaaaaaaaaaaaaaaauccauacuguucuccauagcagcuguacuuuacauucccaccaacaguguguaaguguucccuuuucuuugcauccucuccagcauuuauuugucuuucugaaaguagcuauccuaacaggguaacaugauaccucacugugguuuuuaucugcguuucccugaugauuagugauguugagcauuuuuccacguaccuauggccauuuguacaccaucuuuugagaaaugucuacucauguccuuugcccauuuaacaaucagauuuuucuuugcggcuuaaaugucugaguuccuuguacauaaugaucuggauauuaaucuccuguuuagaugaauaguuugcaaauauuuucucccauucuguaaguuuucuuuucauuguauugauuguuaucuuugcugugaagaagcuuuuugaucugauauaaugccauugguuuacuuuugcuuuuguugccugugcuuuugagcucuuauucauaaaaucuuuuugcaggccaauguccugaagucccuauguuuucuucugcuaauuuuguaguuuuggucuuacauuuaugucuuugauccauuuugaguuaauuuuuguauagggugagagaugggaguuuaguuuuauucuucugcauauguauacccaguuuccucagcaccauuuauugaagagacuguccuuuccccacugaguguucuuagcgucuuugucaaaaaucaguuggcuguagauuguggauuaacuuuuggauucucuacccuguuccauggucuauaugugugcuuuuaugccagaaccaugcuguuuugguuacuacagcuuugcaguauauuuugaagucuggucaugugagccuuccaguuuuguucuuugugguuagcauuuuuuggcaauucugggucuucugugcuuccauauaaauuuuaaggucuuuuuuucuauuucugugaagaauacaaucaguauuuugauaggaauugcauucaaucuguagacugcucuggguaguaugguaauuuuaauaauauuaauucuucugaucuaugagcaugggaugucuuuucauuuauuuguaucuucuuuaauuucuuuuaucacuguuuuuuaguuuuccuuguagaagucuuucgcauccuugguuaagcguauucugaggguuucuucugugugugugaguguguguguguguguguguguguguguguguguguauguggcuaacauaaaugggauuacuuucuugauugcuuuuuucagcuaguucauauauacaguuuuuaaucuuaaaaaagcaugauauuuuuccauuuuacaaaaggauaguaggcaaacauuaaacguuaaggacuuccucauggauacaaaucccaguauaugucuaaauaaauuaggacucaaauuuauauacauauagcuacuuuccaaguccaaucuuucuccccuguauaaguccuccuuccccugaaaaauaaaugguuuggggcuuuauucuguagcagagggaagcauuaaauauaauuuggaaggagucuguuucauaguuuaugcuuuuuacagaccauaacaaagucuuuauaaaggcuuugaucuucuguguuuucauaguuuuuauuucuuaugguuaaaauggcuauuucaauuugcuggaucauuucaguuaauuuuugaauaaagcauggcaacuagaacugaccauuaucugauccaucaacauuuagggauuuaaauuauuuaguuuccuaguaucagugaacugcauaguaaaauuccuaaacugacuccuccauaaaacaauggaaaaucccuggaaauuaaccaaagaccugcagcaaacuggguagcauuuauuuaagaauagcuuugugccauuuuaacuugcccuagucugaucucucauuccccauuaggagccuugaaaacuaauaccccauauucccagugcagucuuguguucacugaaauaaaguaguuggaguguuuugcaaauccucaucacaaacaauugucauuauuucacuugugugguggauucccugaaggaccccaccugauacagaggaacaaaggcaggcauaagacauauagaaaacaaauagcaaaauggcaaauguaaaccuuacuuuaucaguaauuacauuaaauguaaauggauuaaauucuccaguuaaaaggcagggugaauuuaaaauaaaacaucaucaaaguauauguugucuauauacuacauacauacuuauauucaaagacacaaauaggcuguaaauaaaagaaccagaaaagauaaagcauggcuacaguaacugaaaaagaacuggagggcuguacuaauaucagagaagagaacuguuaccaaagauauuaagaugaaauggucaauccaccaagaagcuguaacaaucguaacuuuuuaugcagcaaacaacagagcuccaaaauaaguaaaacacacaaaaaagacaauucagcaauaacagucagagacuucaaugcuccaauucaauaaugaauagaaauaagcagaugaucaauaaggacacagaugacuugaucaacacuauaaaccaacuagaccuaaaagacaucuacagaacacuccuccagccaacaauagcacaaaaagcauucuucucaagugcauauggaauauucuccaggauacaucauacuuaauacauuuuaaaaaaaacugaaaucacacaauguauuuucccuggucauaauggaaagaagcuagaagucaauaacugaaggaaaaggaaauucacaaguaugugaaaauuaaauuccuacauaaucaauggaucgaaaaaacacaagagaaauuagagaauacuugagauaaaaaugaaagcauaacauaucaaaauauaugggauguagucaaagaagugcuuagcaggaaauuuauagggacauaugccuacauuaaaaaagaagaaaggugucaaaucaauaaccuaaucuuccagguuaagaaacuagaaacaaaagagaaaacucacuccuaaacaagcagaagaaggcuauaauaaagauucuaguggaaagaaauauaauagggaauauaaaaacauuagaaaaaaaaguaaaccccaaaauuguuuuuuugaaaagauuuuuuuuuuuuuuugagacggaguuucgcucugucgcccaggcuggagugcaguggcgcgaucucgacucacugcaagcuccaccucccagguucaugccauucuccugccucagccucccauguagcugggacuacaggcgcgcgccaccaugcccggcuaauuuuuguauuuucaguagagacgggguuucaccguguuagccaggauggucucgaucuccugaccucgugaucugcccgucuuggccucccaaagugcugggauuacaggcgugagccacugcgcccggccgaaaagauuaacaaaacuaacaaauguucagcuaagcuguccaaguuuaaaaaaaaaaaaagagagaugacucaaauaacuaaaaucaugaaugaaaacggagguauuaacuacugacuuugaauaaaauguacuacaagggaauacuaugaaaaacuguaugacaacaaauuggauaauauacaugaaagaaacaaaauucuagaagaacacaaacuaucaaaauagacucaaaaggaaauagauaaccugaccaguaacagagauugaauuaguaacuuaaaaaguaccuacaaagaaaagcccagaccaagaugguuuagcuggugaauucuaaucagucuuucauaaacucuuugauaguuuagaagggaauacuucuaaacucauuauauuaaggccaacacuauccugacaccaaaaucagacaaaagcauucugagaaugaaaaccacagaccaauaucccucagaugcaaaaauccuuaacaaaagacugacaaacugaaacuagcugcauacauaauggauuagauaucaugauuaagugugauuuaucccagaaaugcaugauagguacaacauauaaaaauaauaauguaauacacuauauucaguucaucuaaaaaaaccuuugauauaaucaucucaauagaugcagaaaaaacguuugacagauauccaacaaacuaguaacaaaauggaaauuccuugaccuaacaaaggccaucgauaaaaacccacagauaauaucauacuuaauggcaaaagacugaaagcuuuccucuuuguaucaggcaacagacaaggaaggggguguccacucuuaccauuucuauucaacacuguacugaaaguucuagccauggcaaucaggcaagaaaauaaaugagaagacauccagauuagaaaggaagagguaaaauuaucucuauuuucagaugaaauagauaaaaaaauccuaagaaauacacuaaacccuauaauuagagcuaauaaaggugagcaaaauugcaggauacgagaucaauauacaaaaucacucuuauuucuauauauuggcaacaacuaauccaaaaguguuauuaaaaauaauuccacuucaaucaaaaauauugagcaauaaauuuagcaaaagaagauuaagauguauacauccuugaaagaaauuaaagaucuaaguaaacaaaaauauaccccauguucauggaucagaagaauaacuuauuuuuuccuagguuaaaaacaggaccaggcacaauggcucacgccuguaaucccaacacuuugggaggccgaaguggguguaucacuugaggucaggaguuugagaccagccuugccaacauggugaaacccaucccuauaauaaauauaaaaauuagccaggcgugguggugcaugccuguagucccagcaacuggggaggcugaggcagaaauaucacuugaacccggaaggcagagguuguagugagccgagauugcaacacagcacuccagccuaggugacaagagugagacucccccucaaaaaaaaaaaaaaaaguuccaaaucagguaauagaugaauuuuauagaacucauguuaaguuucuuagauguaaucaaaguauuauaaaagugauugucuuuauucuuaggagaaguaucauauccacaacuuacaaaugguauaggaaaaaaacuguugaaccuaugugaagcacauaggaauauggauauucuuacaguauacuuucaacauuucuauuaucucugaaaauuuuuguaacaggaaguuggagagcacacugcccugaaaacaaagcagucgcccaggguaggugaugauggcaaugaauacaaagugaagagaucuaaaaaaguaaugguauuucuaaaacuaggaauucauaaaggucuugcaaugucuacuuggcauaguucaggcugagguaucuggcauuaucaugguuuuguagaagggugaaacguuucugguuuugguauuuuucugaugauguuuccuaugguugaucuuuuuggccaugguacauguggcugcuucucccaggguacaauuuguaaagauuuuccuaagccauuuguaaaugguagcugaaaacucccuauccuguaauacaguuaauuuucuuauauguacuugcauuugccuaaaauuaauuuuauugaaacucuacuaaggauacaaaaucaugaaacuuuuguguuaauccuaacauuuguaaagcaaaacucauaaaaaauacaguaaggaacugugauaaagaaucucacaucauuuuugugagaaauuuacucaguugaagaugagcaguguguuaacagacaaaaagaauuuuuuacagaauuugaaaaauauuaaaaaguugaauuagugcaaucaauguaauauacagagcuacagaaagagaaugucaaaauauuuuaaaaauugauaauuuguuagacugaaaguaaaucucaauaaaaauaucagaaacuaagccccauucucugaccacaauuuaauaaaacuaaaaauaugaaaguguaaagcaaaauaaaaugaaauaaacccucaaacaccugaaaaauuuaaaaagaaaacaaacuucuaauuuaggucacagaaaaaagcaaaacgauaauuccacacuauuggaaaauaauggcaauuauaacaacucauaugcauaucaaauggaauacagccaaaacuauaaugagaggcaaauucauagauauaaauguuccuauccuaaaugugaaagaaugaaaacaaaguuaagcauuccauuuaaagaguaagaaaaaaacccaagaaaaccagaaggaccaaaaauaaaagcaccuaauaaaugaaaaaaagacaagaaaauaaaacauaucagauuuuacuugucuaaaaaagaaaaaucuaaaaaauaaauuaggcuaagugaaauaugaaaaaagaggaaaauucaauguacaaaacuagaaauaucaaaaagcauauaagaagauacaaaagauauuaaauuuaugagagaaacaaaugaccaaaauugaugaauaaaguaaaaaccuaaccaguguaaaacacaaaaauugucaaagaauuaccuccaacaaaggcuccaggccuagaugguuuuguaguugaguucuuuaaaacuuucaagaauaaauaagucccaugcuauauaaacuguuccagagcacagaaaauuagggaaagaguuccaauucauuuugcaaagcuggccuaacccugauaucaaaaccugacaaagauagcauaaaaaaaaaaagaaaauuacagaccaaauucauuuaugaauguagaugcaaaguuccuaaauaauacacuugaaaacagaacucaaugguacacuacaagauaacacgucuugacauaaggaggacauucauucuagaaauaagagauuauauuagguaucuuuuuuuuuuuuuuuuuuuuuuuuugagacaggaucucacucugucacccagguuggagugcauuggcuuacugccgccuccaccuccugagcucaagcaauccuccaacucagacucucguauagcuagcacuaccggugcaugccaccaugcccagcuaauuuuuuguagagacagggucuuguuuuguugcccagucuggucuuaaacuucuggccucaagugauccucuagacuuggccucccaaaguguugggauuacaggcaugagacacugugcccggccuauauuaaguaauaucuuuauaaaauacaucacauugacaggucaaauaagaagcacugcaaaauaaucucauuuggaugccaaaauauuuaaugaauuccaauauucacuucucauuaaaaagaaaauaaagucuuguucaacuauaagugauacauacuuaacaucagugaacuuacuguaagaggaaaugaugucuaucacugcuauauguaaaauuggaaggaaagucuauuaaauguaauaacaaaguaaagacaaugaagaagauucacaggauaaacuaucuagaaaagucaaaaguaacaacuaaaaauaaggacuaaacaaaauccaguaaauauaaaauguacaacauaaaaauaacagaaaucuaggaaguuccuauaaaccaaaacaaauagucuuuuucauauuuauucauuuuuucauauuauucauauuuuucacaauaugaauagaaauuaccgaggauuauguuaaaggagaaaauaagugaacuuaauugagggaaaaaagggaaaacauuaaugaagggcaugaaagaaacauguaaauuaagaaacauauuucuagucuguaguuaauuuuucuaaaauuuucaguuaauguguuugaaucaaaauccccuuagaguuuccuuuuuuaaaaucagaaaacugauucgcaacuuccuauaaaaaaaauuaacuggucagaaaauaaaaccaaggaaacuugugaaaaagagguauaaggaggaaagauggguccugucagcuauuuaaacauuuaauagcuaaaauaucuaaguaguauaguauuaccagaagaacagagaacauaaagaaagaaaauugaguccagaagccuuuaguaagguaacaguacauuauagauuaguguuaagacagaaaaauuauucaauaaaaaagcugggauaauuaaccauuuagaaaaaauuaaaauaaguaccuuaucuaauagcauuuacuaaaauaaaucacagauagacucaaggcuuauauauaaaaaauaaaauaaaaaauaccuaggaaaaauauaugugaguauucagcagcugguggcauggaguuuuuucuaagcauaauaguaauguuacaagcugugacaaaaguguacagaucagacuacuuauuuaaaaauuaacuaaaauuaacaaacagcaaucuugaaaaacauuuauguuuuaauauuuaugucuuuaauaaauggacauguaaaaggcuagaacaaacauaucagaaagaaaugcauuuagugaauaauaaauaacaguauuuagccagcaaucccaauuuugauaauuuacauuaaauuauacagccaaggauguucacugcagugcuauuugcaacuacccucucacccaagaacugcauaaacaguggggccaaauuugguuaaacaacaacaaaaauguauacauuaaagaaggcauuagaaaaacuauaaggaaauaaaaccagaugguuauuuucagauagugagauuacaggugcuaaauuucuucuuuauacauuuauaacuauuugcccaaacuuucaugaugaauauacauuuuauaauuagaaaaacaguauaaaaaucaaugcacuaauaauuuuccugaagacaugaauauuagaauucaaaaauuucaacaaauaaaaaagcucaaaaucauuuguaaacuaaacuguuuuugcauacugaaagcuccuuaaagcuuuuuauuucuauuaauaucuuaauuuagcaugaaaacacaguuaaaagaagccagucuuuacugucugagauuacaacuucauuuuuuuccucaaagggauuuugcuuuuaaugacuauuaaagggauuuugacacaaauacaucuaaauacacugaaaugaauuauaaaaggguccauacacaacaggaauaacuuaaaaggauacuucauauuaauaacaccauuucuuucauugaguauugagaacacagaaugaucagucuuaaacugauccuguuaaguuuuuguucgggaaauuucauuuaggcacucuaaacaggauaaugagugccuaaugauugugugucuaacugaaaucucuccugugauuuaaaacucuuguucuuaaaauauauagcuauauucuauuuaguuuucuuuagacaacauaauuguaaaacuuuuaacuguuuucuaauacuuugaucuacauuuugccuuucuguaguguuucuaccuuuuuuaucucuuucaaauuauuuaaacccaaauggcaaauuaugguuuuaggcaauguacaaucaaauaacagaacaacuugaagcuucuacaugcuguaauucuauggaaacaccaacauucuuucuuccuagcacaugucauguuguuaugcugugucucuuacaauaaccauauuauuuguaugcacguauacuaaccauauguaaacuaauucauacucugagcugcuuauuuaucuacaccaaguggaaguccuggccaaauaauauuagcaguauuucuaacuacuuguccaauguuuucuacccacucaguuugauauuacucaacuuuaacacgcuuaccuucuuaaccuauuaugaacucacucaugaaaucugaguucuagucuuagaucugccccucacuaguuuugucacacugguagagucacuuaacuucucuagguuucaaauguuuucaucuauaaaaagaggauaggaacauaguggaagaccuacaaggucuguuacaacacaaauuuuauuaucauugucagagaucagguuccgcucuaaucacucuuacuauaaaauuagugccuacuauguggaaaugcuaugggggaacacuacaguaaauaagugaaauauucuuagugaaauuuuuugaacuaaaauacccagacucagauauuuuguguauaguacucuauuaauuaucauuagaauaauucucuccaauuccaugaacagaacuggcauuucuuuccuaaucaugcuauuauaaaaacucucccuuaccuacuacugccuuuuuaaauuguagccuaucuaaaucacuuucuuuuuuuuuuuuuuuuacuuucuuuuuuuuuuuuuauuauacuuuaaguuuuaggguacaugugcacauugugcagguuacuuacauauguauacaugugccaugcuggugcacugcacccacuaacucgucaucuagcauuagguauaucucccaaugcuaucccuaccgcccuccccaacaacaguccccagagcguuauauuccccuuccuguguccaugugaucucauuguucaauccccaccuaugagugagaauaugcaguguuugguuuuuuguucuugcgauaguuuacugagaaugauguuuuccaauuucauccaugucccuacaaaggacaugaacucaucauuuuuuauggcugcauaguauuccaugguguauaugugccacauuuucuuaauccggucuaucauuguuggacauuuggguugguuccaagucuuugcuauugugaauaaugcugcaauaaacauacgugugcaugugucuuuauagcagcaagauuuauaguccuuuggguauauacccaguaaugggauggcugggucaaaugguauuucuaguucuagaucccugaggaaucgccauacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucauuguaguuuugauuugcauuucucugauggccagugaugaugagcauuucuucauguguuuuuuggcugcauaaaugucuucuuuugagaagugucuguucauguccuucacccacuuuuugauggggcuguuuguuuuuuucuuguaaauuuguuugaguucauuguagauucuggauauuagcccuuugucagaugaguagguugugaaaauuuucucccauucuguagguugccuguucacucugaugguaguuucuuuugcugugcagaagcucuuuaguuuaauuagaucccauuugucaauuuuggcuuuuguugccauugcuuuugcuguuuuagacaugaaguccuugcccaugccuauguccugaaugguaaugccuagguuuucuucuaggguuuuuaugguuuuaggucuaacauuuaagucuuuaauccaucuugaauugauuuuuguaaaagguguaaggaagggauccaguuucagcuuucuacauauggcuagccaguuuucccaguaccauuuauuaaauagggaauccuuuccccauugcuuguuuuucucagguucgucaaagaucagauaguuguagauaugcggcauuauuuuugagggcucuguuguguuccauugaucuauaucucuguuuugguaccaguaccaugcuguuuugguuacuguagccuuguaguauaguuugaagucagguagugugaugccuccagcuuuguucuuuuggauuaggauugacuuggcgaugcgggcucuuuuuugguuccguaugaacuuuaaaguaguuuuuuacaauucugugaagaaaggcauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaggauuuggcucucuguuugucuguugcugguguauaagaaugcuugugauuuuuguacauugauuuuguauccugagacuuugcugaaguugcuuaucagcuuaaggagauuuugggcugagacaaugggguuuucuagauauacaaucaugucgucugcaaacagggacaauuugacuuccucuuuuccuaauugaauacccuuuauuuccuucuccugccugacugcccuggccagcacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuuguguauauugaaccagccuugcaucccagggaugaagcccacuugaucaugguggauaagcuuuuugaugugcugcuggauucguuuugccaguauuuuauugagaauuuuugcaucaauguucaucaaggauauuggucuaaaauucuuuuuuuguuaugucucugucaggcuuugguaucagaaugaugcuggccucauaaaaugaguuagggaggauucccucuuuuucuauugauuggaauaguuucagaaggaaugguaccaguuccuccuuguaccucugguagaauucggcugugcauccaucugguccuggacucuuuuugguugguaagcuauugauuauugccacaauuucagauccuguuauuggucuauucagauauucaacuucuuccugguuuagucuugggagaguguaugugucaaggaauuuauccauuucuucuagauuuucuaguuuauuugcguagagguguuuguaguauucucugauguuaguuugcauuucugugggauugguggugauauccccuuuaucauuuuuuauugcaucuauucgauucuucucucuuuuuuucuuauuagucuugcuagcggucuaucaauccuguugauccuuucaaaaaaccagcuccuggauugauuaauuuuuugaaggguuuuuugugucucuauuuccuucaguucugcucugauuuuaguuauuucuugccuucugcuagcuuuugaauguguuugcucuugcauuucuaguucuuuuaauugugauguuagggugucaauuuuagaucuuuccugcauucucuugugggcauuuagugcuauaaauuucccucuacacacugcuuugaaugcgucccagagauucugguauguugugucuuuguucuccuugguuucaaagaacaucuuuauuucugccuucauuucauuauguacccaguagucauucaggagcagguuguucaguuuccauguaguugagugguuuugagugagauucuuaacccugaguucuaguuugauugcacuguggucugagagacaguuuguuauaauuucuguucuuuuacauuugcugaggagagcuuuacuuccaaguauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucauugaucugucuaauguugacagugggguguuaaagucucccauuauuaaugugugggagucuaagucucuuuguaggucacucaggacuugcuuuaugaaucugggugcucuuguauugggugcauauauauuuaggauaguuagcucuucuuguugaauugaucccuuuaccauuaugaaauggccuucuuugucucuuuugaucuuuguugguuuaaagucuguuuuaucagagaauaguauugcaaccccugccuuuuuuuguuuuccauuugcuugguagaucuuccuccauccuuuuauuuugagccuaugugugucucugcacgugagauggguuuccugaauacagcacacugaugggucuugacucuuuauccaauuugccagucugugucuuuuaauuggagcauuuagcccauuuacauuuaaaguuaauauuguuaugugugaauuugauccugucauuaugauguuagcugguuguuuugcccguuaguugaugcaguuucuuccuagucuugauggucuuuacauuuuggcaugauuuugcagcagcugguacugguuuuuccuuuccauguuuagcccuuccuucaggagcucuuuuagggcaggccugguggugacaaaaucucucagcauuugcuugucuguaaaguauuuuauuucuccuucgcuuaugaagcuugguuuggcuggauaugaaauucuggguugaaaauucuugucuuuaagaauguugaauauuggcccccacucucuucuggcuuguaggguuucugccgagagauccgcuguuagucugaugggcuucccauugaggguaacccgaccuuucucucuggcugcccuuaacauuuuuuccuucauuucaacuuuggugaaucugacaauuaugugucuuggaguugcucuucucgaggaguaucuuuauggcguucucuguauuuccugaaucugaauguuggccugccuugcuagauuggggaaguucuccuggauaauauccugcagaguguuuuccaacuugguuccauucuccccaucacuuucagguacaccaaucagacguagauuuggucuuuucacauagucccauauuucuuggaggcuuugcucauuucuuuuuauucuuuuuucucuaaaauucccuucucgcuucauuucauucauuucaucauccaucgcugauacucuuucuuccaguugaucgcaucggcuccugaggcuucugcauucuucacguagcucucgaaccuugguuuucagcuccaucagcuccuuuaagcacuucucuguauugguuauucuaguuauacauucuucuaaauguuuuucaaaguuuucaacuucuuugccuuugguuugaauguccucccguagcucagaguaauuugaucgucugaagccuucuucucucugcuccucaaagacauucuccauccagcuuuguuccguugcuggugaggaacugcguuccuuuggaggaggagaggcgcucugguuuuuagaguuuccaguuuuucuguucuguuuuuuccccaucuuugugguuuuaucuacuuuuggucuuugaugauggugauguacagauggguuuuugguguggauguccuuucuguuuguuaguuuuccuucuaacagacaggacccucagcuguaggucuguuggaauacgcugcagugugaggugucagugugccccugcuggggggugccucccaguuaggcugcucaggggucaggggccagggacccacuugaggaggcagucugcccguucucagaucuccagcugcgugcugggagaaccacugcucucuucaaagcugucagacagggacauuuaagucugcagagguuacugcugucuuuuuguuugucugugcccugcccccagagguggagccuacagaggcaggcaggccuccuugagcuguggugggcuccgcccaguuggagcuuccuggcugcuuuguuuaccuaaucaagccugggcuauggcgggcgccccucccccagccucgcugucgccuugcaguuugaucucagacugcugugcuagcaaucagugagacuccaugggcguaggacccucugagccaggugcgggauauaaucucguggugcgccgcuuuuuaagcccgucggaaaagcgcaguauucgggugggagugacccgauuuuccaggugccguccgucaccccuuucuuugacucggaaagggaacucccugaccccuugcgcuucccaagugaggcaaugccucgcccugcuucggcuggcgcacggugcacgcacccacugaccugcgcccacugucuggcacucccuagugagaugaacccaguaccucagauggaaaugcagaaaucaccgucuucugcgucacucaggccggagcuguuccuauucggccaucuuggcuccuuccccgcuaaaucacuuucuuuuaucucuguugcucucuacugaacuguaaauuaauugcucaaaauuggaguucucacuacuccucccaaacaaugugauguuuugggucucuuuuguuuaaaaaauccuuuaacuuuuuuuagaaaaaaaaucauaagaauuuaugggaaucuuugaaaaagauuucaaggaaaaauucaaauauuauaggaaaacauaaccaugucuugccaaaggcagaaaacuuuuaggaauauaaggacugcuuucaugggccaggaucacucuuccgcaaaugcagcaugcucucucuaagguaucaugaaggguggugcagauuaaagucaucacuucaaaaauuauaugaauacucuguauucccucauuagucuguuauggaauugucacacauuuauuugcccaaugugccuuuuggaaaaccagcaagacaucuuuggauaauuaguccuuuaacauucccuacuugagacaacuuuuagaauuuuagagcuaaaagaaaccucaguuugggcaaugguaaaacucuuucucuacaaaaaacaaaaacaaaaguuagccaggcauggugaugcaugcccauaguguuagcuacucagagggcugaggcaggaggaucgcuugagcccugggggugggggugggagugggaguuaaagcugcagugagcugugaucgugccauugcacuccagccuaggugacaagaguuaaacccugucucaaaaaacaaacaaacaaacaaacaaaaaaaccaaagaaaccucauacaucuucaacugccucauuuuauagaugaaccaacugacaaagacugguuaaaaugcuugccuaugucacacaaguuuaauggcagaaucuauucucuugaucuucaauccagaguuucaacauaucauacaaguuuaccugauuucuauaaccuuuuacugaauucaaauuugcuucuuugaaguuucggaggggucuauuuuaacuaacuugaauuuaaugaagaaucuaugcuuacucuaaauauauauauauauauauaugcauauaugcugaauaagggcaagggcugugacuguuuacaauuguauccugagaacuuaucacagggucuggcauauagguauucaauggauuguuguagacugaaugaaugaacaaguuggaucacaugcacucucaguuuuaaccuuuguaaagagaaaauaaaucuagaguccuucaguuuaacuuuguucucuugaucauuucagauauuuuuaucuagacuuucuucuagcuccauuauguuucuuuuggugagguaguaagaacugugaauagauaccaauaaucucaauaaguacaauuuccuucgcauuaccuuacacugguuagcaauagcacuuauuugacacuuuuugccccaaauuuguaaguacaacacauuaauucuuguuggucugaccuuucaauaugcccucaaauuugcuuuuauuuacucugcuggaauaaauuccuccuuccaaaucaauuauaaaaauguuaaacgagacuauauuuagcaccuauuaaccuuuuucuaaccagaagggcucaucagccucuguauuuuuguauccuggauuuaaauaaauuguaaauacaaccaaauuugagugucuaacaugugcaaggacaacucucuuguccuugauaaauaauauacaauauucuuugguauggagaagaauuagaagacuuuuagauucaugaaaagggccuuuaaaaaguccaaguaaaaaaucauguuuuaguuucgccuuauguauugauuuauuuauugccuuccacucucuaaccccagauacacacuccuaucauaccuaagaauucuauaggaauccuuuuauucaccaauccuacaccacuguccuugcacucucugaccucccuccugucauccugaagaacucuacagaaauccuuuuauucauuaauccugccccccuuuauuauaaaugcuacuacagaagcuuagagcuggaaugaaucuuaagagauuucuaaguguaauucccauauaccagcuugauauucaccaauaauaaaacaaaucacuauggccaaguauaguauuuuaccucuuuaauauaucagcaugccauauuacacauacuacuuacuuguacucaucauagacuuccuguuugggcagugaagucuccggauguuccucuaggguauuccgaauccaggaaaaggcaugcauuuguugugcccgacuagaugacauggcauucugaucacuaauagaaugaaaacauguuuuagcugaccagacagcaauucauuaacgauuuuugagcuaggccuaaauguuccacuaaagaacuguauacaaauacacuaucaacgaccaaaccaaacuuaggacaucuaguagauaauuguccaccuaugguugugagcuguuugcuauagcuaguguaagacugaaguuacugcccugcuccaucccuccccaugcaggugauagagcacugacaaaguauuuguuuuggucaaaaaucaccuuuaaguggguaucugcucauguacuuaccuguucauuugccuacacuuaccaaauaaaucaucaaacuuuaaaacaaaauuauauaaaaauugcuuauuucuauuugcucagcauucucauauaauauauauauauacacacauauauauauacacauguauacacauacauauacauauauacauacacacacacacacacacacauauauauguauauauaacuacuuggaaaucuuacuaaagcauucugugcuccagaauggaauuugcaccagagagauccugaacagacaaaucucccccuacaauccuuccuaaagccaggcccccugccucagccugacauauccauuaaacacuguaaacuuuuacuauauggaaguauuacuuauaaauaaauaccgaaauggacaccaaagauaggacaagggaagcuacucuacugauugugacauccaucucagcuaucuguaagaauaauuuauuuaauuucaaagaaaacacugagcaagugucuaggacauaacaugauuaaaacagugauaaaaguuggucugagggaaaaaaagauaaaacucaaauaauuugcauuucauuuauuucuauauacaguuuuaaaaaauagaaugauaagcauaauuuauaugaaugagaugaauucugagaaauacuuaaaagguuaaggaaacucuuuuaaaaauuagaaugacugaaugaacagcuucucuccacaguuucuauaauuuuuaaugaugaaacuauaguaauaccccaagcacuuaacacaccuuacauuuaugaauucauguuucauacaggcaauuucacuuuauuuucuguuuuauauucuaugauguguuuaucugauaguaccuaaaaaaacucuuauaccuuauuccuuaugauacuuaucuguuuauucuuugguuuucuguucaauuuucacaaucccucacacugcauaaacauagucaucugucuaugaaacaaaacccaaauugcaugucauagcauuuacccaauugcacaaauaaauuaacaaaaacugcaaguaaauacuuaaccaaauaucaccaaagacuaaaaugauguauuguuuugccaguauguuuucuaaucauuucaggaauauugcaaaaacucuaacaaccaaaacauacagaccucacauauauccuagggacauccuauaaacagcauaauuauagcaaagacaagaauagauauaccuuuucucuccauugcugagaccagaaggcagcugaagguagagguagaguuucucuaggucuguaaacuucucaacuucuugcuauuuacaaaggauuaaaaagaaagaucauuuuuaaaaaacacucauuuuuccccaaacaaaauuuacuaacaucucccuaaacgauaaugacuauuuaaauuuaaaacagaugaaucaucugucuuuucucaucacuaaaauaauacaaugagguuauuugauaaauuuauugcauacaaaaauuuaauaaaagaaaauggcacuucccuauuaguucuuacaucaugggcauaaauagaauuauugaccaaggcucaaaaaaagcuucucauuuuuaaucacauuuaaagaaggaggguuuuacuuguccuauaggacaaguacuggaccaggaaucaagagaaacaguuauuaguuaacuaaccguuaacuggcuaugagguuuucagcacuuuuacagcaaauuuucuguagaacuauaaaaugaaugacauaauuucuagaauccguuucuaauuuucaaauauuuacaacaugugacugauggugcuacuguuaccuguggauggaacugagguuaaaaacacugaaauaaaaccaguaacucuuuccagaccuuacagauguaauuauuuguuggcuugccaacaguagcuauuuagagaaucuacuuguaagauuuucuguugcuacuguucugcaacuaugucauuuugucucuaaauguaaccuuuaaaauaauuuuugccuuccuaccuuucuucuaaacucaguuugccauaauggcuccaaaugugccacaaauccuauuauaauaaaaauauucauaguaaaauucugguagccuaaucuaagcaaaauuccauugcaaugaaaaauguggacagauuacuggcauuccugguagaauuuauucuuacuuaauaaagcacaguuuaaacagagauucaguuuuugaaaauacuuaacaugauauaaccaagccuauucuuagucuuaucagaagauauccacaaaaguuuaaucuuagaauccauccacauaaugauuuaaucaaucacaugcaaauagcucccaaauuuacauuuuuaaaaucccauggccuacagguauuuuccaauuggcucuugcuccaauaccuaauguuaucagcuauacccuuguguagcucuccccucaaagaaaacaaacacacauucucuucuuaauugcuacuuaucaucaccuucuuuucucuaguuuccacaguguucaguuugggaguguguuuaacucuuuuucucuuggugcauuccacauuaauccuuuauuuagcccucuaacacucugccccaucuucuuccagucucgauuuuucacugccaccacaguagucuaggucuucagcugucuuucuuucaagaauaaggauaauucguuugcuuaugcauuacuuuuguuuucugcuauguuccacaaguggcauaaaauaacuaugaaccuauacuauguaucacaaaucauacaaagagugaacaauacaacaaagaugaacaacacaccaccaccacaguucuugcccuuaaugaacuuuuaaugacacuuaaauuucuaaaaugucuaaccagcugguuuuccuaccuccgaugucaccccacuuuaaugucuuaaauaugguuccugaaauuuuuuuuugucaaauuguuuuuuuuaagagagucucacucuguugcccagauugaauugcaguggcuuaaucauagcucacugcagccucaaacuccugggcucaacugaucaucccaccucagccucccaaguaguuggggccagaggugcgugccaccacagccacauaauuuuuuaauuuauuuuuuguagcuuguugcuacaaaauuguugccuaggcuggucuggaauuccugccuggccucaagugauccuccugccucccaaagugcugggaugcuagguaugaacuacugucaaauauuauuaacaucacccacuuaaucacaccaaugccaaucauauuaaauuaagagaagguuauaauaauaaaauaccuaauauuaugagccaugucugagaaaguguaauaaaaauaucauuuuugaucauaaagaaaaaaaucuacuguuggagaaaccuuggauucuauauagcuuucaaauuuuaaauauacuggaaaaaagaauagaaaagaaauuccagaacauagaagaaauuucagaagauguucuaaauuaguauuaagcaccaaagagaugauuuagaagauggcaaaaaaaaguuuugaaaaagauuaaagucaguguccuaauuuuuuuuaaaacaaugaaaacuuguaacuguucaauuacuguuuucauugccauaugggguacaacacauagaagaaaaaauuuggagagcagcaugaaaacugauaauaacaaaauucuauaaagcaaacaaaaaaaaugacucaaguguauagugauggcauuucaguccagcaaggcugggcucaucaucaagauuucugguuuuggauauacugugucauccacugcuaauuaguggcuucugaaacaaugcucacugguuuaggagaagacccuaaccuugcuugauugucaaggcaagaguaucauguggcaaguauguuaaacaucugauuauuugauaugcuuuaugacaauuuaaaugauaagaauuaaaaguuuucuguucuauguugaaauucguugguggucaaaaaaaauuccuuuggcuggauuuauaaaauaaaucauaaugguauucuauuuuuggagcaccagagaaaagaccaacuucauaaacuuuaaaaauuauaauuuuuuauuuagccauaaaaggaauggaguacugauacaugcuacaacauggaugaaccuugaaaacaucgugcuaagugaaagaagccagacacauaucaugugauucuguuuauauuaaauauccaaaauaggcaaaucccuagggacagaaagcagcuuaguguuucccagaggcagaugacugcuuaaaggguacugaguuuccuuuuggggugaggaaaagguuuugaaacuagauucagaugguacuuguacaacacaguuaauguacuaaauaucacuaaugguaaauuuuaugcuauguauauuuuacuacaauaaaaaaucuaauuuuuuuuuuuuugagguggagucuugcugugucgcccaggcuggagugcaguggugcaaucucagcucacugcaagcuccgccccccggguucacaccauucuccugacucagccuuccgagcagcugggacuacuggcacccgccaccaggcccagccaauuuuuugcauuuuuaguagacacaggguuucaccguguuagcgaggauggucucgaucuccugaccucaugauccgccugccuuggccucccaaagugcugggauuacaggcgugagccaccaugcccagccuaaaaacucuaauuuuuaacagagauuugcacauuuggaaaacauaucugaugauucgaagugaaacuuaaaugacaaacaacauuuguagacuuaaaagucuucacuuacuugaguugaagaaguucucaaagaaaagcuagugaaaacgguuucaaauuuaggcagaaccucaaauauuauucaagucuuuugaaugagguagcugauaauuucauacuauugcaguugaagaucuugccugaaaacuuaaaagaccucuuucucaugcacuucaaucuuugcaaaaagauauuaaaaaggaaucuuugaacucaaguuugauuuauaugucaaacacauuccaggaaacaauuuuggagaauuuucaaaaaauauccuugguuauuuccagcaagugagccgaccuugcaugucaucaucccauuuucauaagcaaagauuuaugaagacgguuuuucugaacuuuuagcuaugaaagcacaacaaugcuacaaacuuaaugacgauugagaugguacuuugaccuuucacauucuggacagaaaagccuguagcaaacaaucagauucaacauucauuuuuauauuaugugaucaaggggaaaaugaaggcauaguguaagaucaaguugcuuuuggagguugaagguggacuuugguguuugaauccugccacgcaacccccuucccuucuaaaacuuugguugacaaaaaauacugacauaagaacuaguaacaugaagcuaauucuuucuaugaggugcaaguguagaggugaagaaaacaugggacagagacaguauuccaucugcucaccuacauuucucaguccacuuugcaguuagcuuguagucaugugauuauuaugaaucugaucacagugauguaauucacuacucagcugacaguuaagaaucaaugugucggccgggggcaguggcucaagccuguaaucccagaacuuugggaggcugaggugggcggaucaugaagucaggagauugagaccauccuggcuaacacggugaaaccccaucucuacuaaaaauacaaagaaaauuagccaggcgugguggugggagccuguagucccagcuacucgggaggcugaggcaggagaauggugugaacccggaaggcggagcuugcagugagcugagauugcgccacugcacuccagccucagcgacagagcgagacuccgucucaaaaaaaaaaaaaaaaaaaaucaaugugucaccccaucccauuucccccucuguggcaccuuggaagccauguguugcacuggugaagcuauaacaugucagccuuccugucaauguugguucugagggauuauuuggaacaguggucuucagugauuucugcugcauaugaugugaaugaaaauacauuuuugugguuaggccacugguauuucaggcuuaguuacaacaucauagauuagcccauccugauuaauauaaaaauuagacucuuuccucuagcaccuuugaggaaacugaaggauccuuuuuacauaugcagauaaaaauguggaaacagacaggaacagcaccggucugcaauucccagcgagauugaugcagaaggcgggugauuucugcacuuccaacugagguaccugguucaucucacugggacugguuggaaugugugugcagcccacggagggcgaggcgaagcaggguggggcgucacuucaccugggaagcacaaggugucggggaauuuuccccccuacccaagggaagcugugagggacugagccugaagaacuccagcacagacacugcgcuugucccauggucuucguaacccacaaaccaggagauucccucuggugacuacccuaccagggcccuggguuucaagcacagaacuggcuggccaauugggcagacaccgaacuagaugcaggagcuuuuuuuuuuuucuucuuugccauaccccaguggcauguggaaugccacuaagacagaaccauuuacuccccuggaaaggggcgcugaagccagggagucaaguggucuggcucagcgggucccacucccacggagcccaggaaacuaagauccgcuggcuugaaauucucgcugccagcacagcagcaaucugagaugcaccugagacagucgaccuuggucgggggguugcgggguggggcgggggggucggccauugcugaagcuugaguaggcaguuucacagccacaggauaaacaaagcugcugggaaguucaaacuggguggagcccacugcagcucagcaaggcugcgguggccagacugccugauugccccucucuggacagggcaucucuguaaaacaggcagcagccccagucaguggcuuauagcagacuuaaacaucccugccugauggcucugaagagagcagcagaacucccagugcagcguuccagcucugcuaaggcucagucugucuccucaagugggucccugaccccuguguauacugacuaggagacaccucccagauggggccgacagacaccucauacaggagagcucuggcuggcaucuggcaggugcuccgcugggucgcagcuuccagaggaaacaacaggcagcaaucauugcugcucugcagccuccgcuggugauacccagacaaacagggucgggaguuaacacauccacucaaagaccccacuggaaggucaccaacaucaaagacaaaagguagauaaauccacaaagaugagggaaaaccaacgcaaaacggcuaacaauuccaaaaaccagaacgccuuuccuccuccaaaggaucacaaccccucgccagcaagggaacaaaauuggaugcagaaugaguuugaagaacugacaaaaguaggcuucagaagguggguaauaacgaacaacuuugagcuaaagcaccagguucuaacccaaugcaaggaagcuaauaaccuugaaaaaagguuaguugaauugcuaacuagaauaaccaagguagagaagaacauaaaugaccugauggagcugaaaaacacagcacgagaacuucguguagcauacacaaguauuaauagccaaaucgaucaaccagaagaaaggauaucagcugaagaucaacuuaaugaaauaaagcgagaagacaagauuagagggaaaaaaaaaagguacgagucaagccuccaagaaauaugggacuacgugaaaagaccaaaucuacauuugauugguauaccugaaagugacagggagaauggaacuaaguuggaaaacacucuucaggauauuauccagaacuucuccaaccgagcaagacaggccaacauucaaauuuaggaaauacagagaccaccacaaagauacuccucgagaagagcaaccccaagacacauaaucgucagauucaccaagguugaaaugaaauaaaaaaugguaagggcagccagacagaaaggucagguuacccacaaagggaagcccaucagacuaacagcagcucucucggcagaaacccuacaagccagaagagagugggagccaauauucaacauucuuaaagaaaagaauuuucaacccagaauuucauauucagccaaacuaagcuucauaagugaaggagaaauaaaauccuuuacagacaagcaaaugcugagggauucugucacugccagaccugccuuacaagagguccugaaagaagcacuaaacauggaaaggaauaacugguaccagccacugcaaaaacauaccaaauuguaaagaacaucgacacuauuaagaaacugcauuaacuaaugggcaaaacaaccagauagcaucauaacgacaggaucaaauucacacauaacaauauuaaccuuaaauguaaauaagcuaaaugccccaauuaaaagacacagacuggcaaauuagauaaagagucaagacccaucagugugcuguauucaggagaccuaucucaugugcaaagacacacauaggcucaaauaaagggauggaggaagauccaccaagcaaauggaaagcaaaaaaaaguagggguugcaauccuggucucugauaaaacagacuuuaaaccaacaaagaucaagagacaaagaagggcauuacauaaugguaaagggaacaauguagcaagaagagcuaacuauccuaaauauauacgcagccaauacaggagcacccagauucauaaagcaaguucuuagagaccuauaaagagacuuagacucccacacaauaauaguaggagacuuuaacaccccacugucaauauuagauaaaugagauagaaaauuaacaaggauauucaggacuugaacucggcucuggaccaaguggaccuaauagacaucuacagaacucuccaccccaaaucaacagaguauacauucuucucagcacuucaucacacuuaugcuaaaacugaccacauaauuggaaguaaaacacuccucagcaaaugcaaaagaagggaaaucauaacauauagucucccagaccacagugcaaucaaaguagaacucaggguuaagaaacuuaccccaauccguacaaauacauggaaacugaacaaccugcuccugaaugacuacuggguaaauaacgaaaugaaggcagaaauaaagauguucuuugaaaccaaugagaaugagacacaacauaccagaaucucugggacacauuuaaagcaguguuuagagggaaauuuauagcacuaaaugcccacaagagaaagcaggaaagaccuaaaauugacacccuaacaucaaaauuaaaagaacuagagaagcaagggaaaacaaauucaaaaacuagcagaagacaugaaauaacuaagaucagagcagaacugaaggagauggagacacaaaaaacccuucaaaaaaaaaaaucaaugaauccaggagcugguuuuuugaaaaaaaaaaaucaacaaaauagaccacuagccagacuaauaaagaagaaaugagagaagagucaaauagacacaauaaaaaaaugauauaggggauaucaccacugaccccacagaaauagaaacuaccaucagagaauacuauaaaaaccucuaugcaaauaaacuggaaaaucuagaagaaauggauaaacuccuggacauauacagccucccaagucuaagccacaaagaagucgaaucccugaauagaccaauaacaagcucugaaauugaggcaguaauuaauagccuaccaaccaaaaaaaguccaugaccagacggauucacagccgaauucuaccagagguacaaagaggagcugguaccauuccaucugaaacuauucuaaacaacagaaaaagagggacuccucccuaacucauuuuaugaggccagcaucauccugauaccaaaaccuggcagagacacaacgaaaaaagaaaauuucaggccaauaucccugaugaacaucgaugugaaaacccucaauaaaauacaggcaaaccgaauccagcagcacaucaaaaagcuuauccaccaugaucaaguuugcuucaucccugggaugcaaggcuuguucaccauacacaaaucaauauacauaauccauucacauaaauccaauccacauaaacaacaaacguaauccauccacauaaaucaauaaacauaaucccauccacauaaacccaauccacauaaaaagaaccaaugacaacaaccauaugauuaucucaauagaugcagaaaaggccuuugauaaaauucaccccuucaugcuaaaaccucucaauaaacuagguauugauggaacuuaucucaaaauaauaagagcuauuuaugacaaacccacagccaguaucauacugaaugggcaaaaacuggaagcauucccuuugaaaacuggcacaagacaaggaugcccucucucaccacuccuauucaacauaauauuggaaguucuggccagggcaaucaggaaagacaaagcauaaaggguauucaaauaggaagagaggaagucaaauugucucuguuugcagaugacaugauuguauauuuagaaaaccccaucaucucagcccaaaaucuccuuaaucugauaagcaacuucagcaaagucucaagauacaaaaucagugugcaaaaaucacaagcauuuguauacaccaauaauagagacccaaaucaugagugaacucccauucauaaucacuacuaagagaauaaaauaccuaggaauacaacuuacaagggacgugaaggauuucaaggagaacuacaaacuacugcucaaggaaauaagagaagacacaaacaaaaggaaaaauauuccaugcucauggauaggaagaaucaauaucaugaaaauggucauacugcccaaaguaauuuauagauucagugcuauccccaucaagcuaccacugacuuucuucacagaauuggaaaaaacuacuuuaaacuacauauggaaccaaaaaagagcccgcauagccaagacaauccggggcaggaaaaacaaagcuggaggcaucauguuaccugacuucaaacuauacuacaaggcuacaguaaccaaacagcaugguacuggugccaaaacaaauauacagaccaauggaacagaacagagcccucagaaauaacuccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuuuacaaaaaucaacucaagauggaucaaagacuuaaacguaagaccuaggaccauaaaaauccuagaagaaaaccugggcaauaguauucaggacauaggcaugggcaaagacuucaugucuaaaacaccaaaagcaauggcaacaaaagccagaauugacaagugagauauaauuaaaacuaaagagcuucugcacagcaaaagaaacuaucaucagagugaacaggcaaccuacagaaugggagaaaauuuuugcaaucuauccaccugacaaaggacuaauauccagaaacaaagaacuuaaacaaacuuacaagaaaaaaaacaaccccaucaaaaaaugggcaaaggguaugaacagacacuucucgaaagaagacauuuaugcagccaacagacauaggaaaaaugcucaucaucacuggucacuagagaaaugaaaaugggaaccacaauaagauaccaucucacggcaguuagaauggcgaucauuaaaaagucaggaaacaacagauucuggagagguuguggaaaaauaagaacgcuuuuacaguguuggugggaguguaaauuaguucaaccauugcggaagacaguauggcaauuccucaagaaucuaguacuggaaauaccauuugacccacaauauuacugggcauauacccauaaaucauucuacaauaaaggcacaugcacacguauguuuauugcggcacuauucacaauagcaaagacuuggaaccaacccaaaugucuaucaaugauagacuggauuaagaaaauguggcacauauacaccacggaauacuauacagccauaaaaaaggaugaguucauguccuuugcagggacauggaugaagcuggaaaccgucauucucagcaaacuaucacaagaucagaaaaccaaauacugcguguucucgcucauaagugggaguugaacaaugagaacacauggacacagggaggggaacaucacacacuggggcccgucggcggguguggggcuaggggagggauaacauuaggagaaacaccuaauguaggugacggguugauagguacagcaaagcacuagggcacaugaauaccuauguaacaaaacugcacguucugcacauguaacccagaacuuaaaaaguauauuuaaaaaaauguggaaacaagaaaaagucuccuccccauaauaaaaaaggcuuucauucauucauuuuuuagauuaguauuuaacuuauuuugaauuucaaaugauauuaaccaagaauauaauuacauuuaucagaaugggguaugggcaaaaaaugguuuauaagcaccaguuuagaauauacagccuucaugcucucuuccaguuaacuuuuacuuuuaaaaaaauccaaaaacugguuaaaaagucagcucuaauaaguuuacuacacaugaaccugcaauaugccaaucuguuccucuacuuugggccguacguagcauuuacucaggaaaguaugcagcuuaucuucaauuaaucugcauuuacugauuguuuuaaaaaauguuuuccagugucugguuacgacccucaacuauaaugauccugguuuguccaaacuaaauccaccuuugaggcagaauccugaaagauaagacacagccaaauggaaacucuuucaauauuuuaauaucucauuuaauuuuuaaaaauuaaaacuacaaaguauuucaaacacaguagagaaugugcacaugcaugcaucaauguccacauuuacaagaugcuaaccuuuuggcauguuugcuucugaucuuggacuuaaucuauuuaacagcauauagaaauaguauucuaugaaacaaaaccacaguuuguucaugucucuacugauagacaauauguuauaacaaaguuucacuauuucagauggugcuguaauggaaauccuuuauuugugacucuuguggccuugugugagaguuuuuuccuaagguauguaacuuaaaaguacaagugucugguaacaaagaauguauauagucaaccuuauuggauauuuucaaauugcucucuaaaacuuauaccaauuuauguuccuaauagcaauacuacaguuuauuucuccagauucuuguuaaaacuuaaguuuuaaaguuuagcuaaucuuauggguaugaaaaaguaucuaauuguuuuauacuucucugauugaugaugagacugaaucuuuucauauuauuuaucauuugaguuuaacagaguagcucuaaaauuuuaauaugcaccagauucacuuagugagcuuguuaaaacaaagagugcaugaccccacuuccagaguuucugauucaguaggucucaaguggggaccugaaaaucuggacuucuaacaagcaccuaggagaugcugcuaaugcuggucagaggauuacacuuggagaaccacaauguucaaggaacugcccguucauuucuuuuacucaucuaaauaugcggauauuuaucaggcagucuggauacuaauccucuagugguugaaagugcugcuaauaucuucuccuaguuguagccugucuauucacuuuguuuuugaagucuugugauaucgaaguuugucauuuccaggcagucaaaucuaucaaucuuuucauucauaaucugagcuuuuggucuuuuguuuuugaaauuuuccccuauuucagugucauaaagauaguauccuauauuuucuuuuuaaaguuuaaaaauuuuguuuuucaugugugggccuuuaauuccucuggaauuuauuuuucuguaagauauaaaguagggaccuaacuaaaaauugucccaguaucacuuacugaguauuucacacuuucucuacugauuuuuugugcuacaucuauaucaugggauucuuuauuacagaugaaaaagaaugccacuuuuauguucagcauaugaaaacgucuuucucugaguugguauucaauuuaggaaaaaaaccuaacaauuuuuauuuuugagacggagucuugcucucuugcccaggcuggagugcaguggcacaaucuuggcucacugcaaccuccaccucccagguucaagcauucuccugccucagccuccugaguagcugggauuauaggcgugugccaccacgcccaguuaauuuuuguauuuuuaguagagaugggguuucaccauguuggucgggcuggucuugaacuccugaccucaaugaucugcccgccucggccucccaaauuucugggauuacaggcgugagccacugcgcccggccuaacaauuuauccuuaagauggucauacagcaaaauguaugauucacugacucuucuagaacuuaugucauagagacuucucauauaagaauaucacccaguaacugauuagcagaguaauaaaaguagcuuugaugaagcuuuuauaaaucugagguuaauaagcaagucuccuacugacaaauuaauaauaaagaauaacccauauuacauaagaccuauaauaaggauaugacauauauauaaaauagaugaaugaagcagcuguuacuugaaauugaugucuauaucaagcaguaagcuauaguggguaagguauaggauauagaauuagaagacccagaucugaguuccagauuugccacucauuagcuuuguaauauuaggcaagcuuuuuaagcugaguaucaauuucaaaauauaaaacacagcgacaaaaugcucauaauuuuugugauauaaaacuuaugauagguaguguuauguaaauguuauuauuuuaaaaauauguuauugcuuaaaaucagaucuuuggcagaagaguuuauaauucaaauucuaucaacaaguauagaaaauuugauguggcaaaguaaggcauuuaaaacauuaaaguagaaaaaaauuuuuuuuuacagagauagggucucacucugucacccaggcuggagggcagugguacaaucacaaaucacugcagccucacauauuuuuuuauguagcugaaacauuuaaaaucuacucucauacccugggcaauauggcaaaaucccuucuuuacaaaaaauacaaaaauuagcuggugugguggugcauaccuguagucucagcuacuugggaggcuaaagugguacaauugcuugagcccacagaggucaaagcugcagugagccaggauugugccacuacagccuggguaacagagcaagacccugucucaacaaaacaaaacaacccacccccaaaacccaaaaaacaacucuuuucacaauucugaaauauacaacacauuauuguuauaauagacaccauucugugcaauagggcacuacagcuuauucuuccuaucuaacgaaaacuguguacccuuugaucaacaucuccccuucccauaucccucccugccaccucccagucucugguaagcaucauuuuacucucuauguaugugaguucaaccuuucucgauuccauauauaagugagaucaugcauuauuugucuuucugugccuggcuuauuucacuuaguauaaugccuucuagguuaguccauguuguuguaaauaacagaaguuccccccuuuuaaggcugaauacuacuucauuguguauguauaauuacauuuucuuuauucauucaucugaugauggacacguaggucgcuucuguaucuuagguacugugaauaaggcuucaacgaacuuaggaguagguaaggcaucuuuaagaaauucaggacguauuucgccugguaaucuccacuaacuugguuggaauaccacaagagcaagaguccuccagauuuuauaggugaccaucagacuuggucacucaucauugaagauuauguuacacaaguacuggcuucccuuagggugagugcagaaaagggcagauacuauuuuuuccuaagcuaucgacauauaauugaaguuaguaaauauuucugacaacagcugugcuacuagagagaaagaaauaaucaaucuaagcagaauaguucagaaauaacuuucuccagguucgucugggaacaaaauggguaacuuuucauuucucuucugucauaaagaaauaccugaaacaauauucuauauugcaaauacuaauuuuucgguguuccuguuugcuccggacaucuguuucugaacugucaauacauaccagauggacuacagagaaccagagagaguuuuaaaugucuuauuaccagaacuuaaagaccuuuaagcagaugguaaggaacuauguuuucauuauuuauuggcauaauauucaauuuaaaaguagccuaaauggagagaucugcuccuguuuuuagggaccacugugaaaaagugaagcaucagguuuaagccacaacuucacaaauguuaaugaaaagugauuucccuuguuugaaaucuguagugauuuguuuccuguaacgacaaucuucccucucauguuauucuguuugguuuuguuuuuuuaagcaagguuaaaaaaguggggaagggcugaugcuuauaaagagcauaacaauuaguacuucacugaggagcuuucuugcaaauccuugauggugaaauuauaucugaggaucauuauuuccagaauuagcagaaaugcuuguuugagacuuauaaacaccuuccaaaguacuggccagguugacaauaaaugaguucugguggaagaugaucaaucaggguaucauguccauaauuaguccaugaaacuuuucuuuucagauugguaucaguaaaaaguuuuuuuuuuuuuuuaaguuuuaacuuuguguuuggaauagucagcuuaaauuccagaaaccuaaauaaucaaguuuaacuguuucuucaguugaguuaccauauauggagggaacauaaauacacuaauaauuaugcuugaauuugucugcccuugauuuaagcuucaaaaacaaaacuccaaaaagaaauacuaauuuuuccccccucaagcgacacugauucaggagcaguuucuaaaaggacucuucuucaccagaucacuaacagaaggaucaaaaaggagaaaguauaaggaucaaaagggagaaaauauaaagcuuauucuguugccucuuuaaauuuauggaaacaaucaacauaccugauauuauauucucucaggccccagcaguucuuccacaggauugaguaaggaagauagagaaaaaggucagguaugaggacucuauuuuccaugcuuguugcuuagaauucuuaauuuucagcaauuuucaguuuccuaacuuguuaugaggaccacuggggguggcagggauaagugauuuucuuuuaagggcuaccuacuauaaacaauguaagaggaaauuguuuuucuauucucaguucuagggggagagcaauuuuuacuguacuguauuaucgugaggauuugcccuuuuauuuauaaaccuauugaauuagguauauaaaugaaaauggcuuaauuuucuguucaaaauauucugcucaaagauaaggaguaugaucugagucaauuugaaagacaucaguacuuagagaacaguuaaggaaaagugaugcaaugcugacaagcaaauuucagcaaaacccaaaaccuguuucucacaaugcuucucuuccuaauccugcuggaugaccuagagaauuuacugcaaccuaaaaacaagcuaaacaauaaaaaaauucccuuugaacuucccucaacuauaaucaagccuggagaaauuccaauauuaagaagccccaaggggcugcaacauuagcacugacaaauucuuacuccaagauagacauguaagauauuacuaaguagauucugugcuuaauauugagaaguuucugcacauaaaacuaagaaaugauuauauuacauuauaaaagaaaaaaguagggacauucauugguaauuuuuaugaaugugcucuaaaauauauuucgguuuucuuagcuauuuauauuugccuguuuaauacuuuaaagaaacugaguucauaaauugaugauaaaucaaaagauaaauccggaaagaaacacaacuacaaugaauuuuuuagaacuuaauaguaaaaaaggaagcugaaucucugaaacugagauaaugaauaacacgguagaaaguaccguaguaucauaguaucuuuggcuucauaagugccaaaguaagaaccaaaugaaaugcuuagacaagggcauacugcuaaaacacucauauaguaggaacuaugguucaaauagccaaaggguaccaaagccaaaauauuucaguccccuugaaauagaauucaaaugagagccaucuuaagaacacaucuucccauuguuaaauucuacaaaaacugaccaucauaggaucaucauguaacauuccccuaaauucacucugaaucacucaggagaagccaagguuauuaucaauguuucugugugcuauuugaaaagaucacacaguucuacuagcagguggggauggguggugguaucagcaagaaggauaagguuuagaucuuucuagucacuguguuuuuaacuuuuuucagcauguaaaaaaaugaugguacuugacaguccagcugccacaaugcuuucaaaaaacuggauuucuacuggauucuucaagauuacaaaguuacagccuuaacaaacagguaggccauugagaggaaaagucaauucuuuagucucuguuuucucuguuccuaguaaccuuuccuucuuuucuccccuagaguuuacuuuucugcaaguuugaaaugacuuaaagugcaaagauagaaaaauuagaauacuguaagaauucauuuguuuccaucagagcacacuuuuguguauuaugucauucuuugaauauaaacauauuaaugaaaauugcauuucuuucugguaaugaugagaaauucccaucauauuuuugagacaauguaauaaauuugaaagcuagcugacaaugguuagagcauuguuuauaaucaugaaacacaaaaguuaccagaacuuauuuuuuuggggcucaguggcaauuuaguccacucgagucccuaacaggagagaaaaaaaaaacauuaauaaccauguuuuucucacauacuaaaggaggauacaauaacucaaguguuuaauguaaaaaaaggaaagaguaaaagguucacaauccuuuaaauggcauggccuuauauaaauuauuucuuuuugugauacuaaacaaaaccaaacaagcuauuuaaaucuggccccacugccaaguuuucucauucaaguaaauucugcacagacaugcucuucauuuugaaaagugccuauuucuucuccacuaagugaauagaaagaaaaaauaagauucugagauaaaucuuacuaacaguaacuccagugccguaucacaaaauaaaugugaucuucuacccaugagccuuuuucgagcaguaacaggugaauuuuuguuauuuauuuauuugauauauuuuaauuagauaaugcaaacaaaauuuuaguuucaaucaagucugugucggugaguugaccuuggucaccauuuaguauucauuaaagcaaggauuugaggugagaaagcaugcuuucucuuguaaagggaagaagauaauuuuuuggaauugcauacuccacacauccauaaccccucacagaugcagcauauaucucuggagggcaggaaaguaauuguuaagaauuacuacuggagugaacuacucaaauuuauugcugggagugugucaccucuuagaaggccccauucuaauaguaggucuguuucucaggaacacuuuagcaguaaguaaaugaagaagacuggcuucugauuuaaaacacuaaaccaugggacagacuuggaaaguuuaaaaauuaaacaacauuauucauuuauauauucaucuagcaucaagugccuacuaugcucuaggcacuaucuuauauuuuaguaacaggaagacauacaauaaaauuuaaaaguaaaacauauguuacaugaugaugauaaacgcuaugaagaaaaaguguugggaggguauguuaaaccacaauuuaaaauagaguaaucaaggauggucucacaggaaagugagaaggcaacauguuuuacacaguggcugaucuauagcagagacucaaaacaguuaucauuauucuuuguuauauacuauuuuugcuuucuauuggcuggccguuguaauggcagcuaaagcaggaacugacaguaaagacuccauauuacuaagaaauaaaaacagaggcuuucuucccauuaucuauccucauauguaccauuauggguccccaacccuguaaagaauagcucuuauaauaaccuugcccccaaauaaucuaacacaaaagccacaaacucaaacgccaggcacguaaugcacaugaguacaguagaacauagguaagaaaaaucugaugagguaaaagcaugguggggacuaagaggauuaaagagugcaugucauguuuaaaaggaauaaccacuacuuagguucaacugcugucaugcgcaaacaaggguucaguguccuguuuucaagagaaaagagaaaacaaauaccuaaguuuuucugugaacuuuccucuuucuaaaauauggcaaccaauccaaaaauuuuagaacaucagugugggccaaacaaaacaauuuuguggaagagaucuagcugugggucucaaguuuagcccuucugguccaucuacagggucaguagcugauuccuuccagggccauaagcaccagaugcuugauuugcuggaccacaccuguuuguuauuaccauccagacuauaucugagcaaucauauguuuuaauauccaagaucugugaaacauacagcacuuagauauggagcaagccauaccaauaagauuccauuaagccaagauggagaugagacuaggaagguuauacccagggaaauaauaucuauugcagugucccagauaggauccuggugagaacucagguacuacugaaauuccacacagauaaccaugauacaugaacagacuuccuaccaacagacugcuugcacugccuuccuuugccugauuuuaacuaugcuaaaauuggauuuuucacaugggguaguuaguaccucugccgcgauuuuuuuucuuuuuuagguuuuagauuuuuguaauggacaacucaugugugcccagaaaguugguucuuaagguuuaucucauaauaggcuuugcuguucacuaaaguaggacaguuuuuagagaacacagcuuaggcuguuaauuuugaucauuugccucaggaguacaaacacugugccaguagaguuggaagguagaaagaaaaagucuuuuaaagcaaugguccccaagcuuuucaguaccagggaccaguuucacagaagacaauuuuuccauggaugggguggggauuauggggaugguuuugggacguaacuguuccacuuagaccauuaggcauuaguuagauuuucauaaggcacguauaaccuagaucccucacaugcucaggucacaauaggguuugugcuccuauaagaaucuaaugccgcugcugaucugacaggaggcggagcucaggcaguaaugcuugcucgccugcugcucacuuacugcuguguggcccgguuccugacaggccaugaaccauaccuggggaaccccuguuuuaaaggauuacauaaucaguguuuaaaacuuaaaauauaccaacuacaaguuuuuuacuauauuccccugcaagaggacaucacuaagacuucuccccuggaaggaaccugacucacuacacaauuaucuaaaugauggcaucuguuaccuaguuucaggaagugacaauacccuuaauccuccagaagcaacagguauucugguaaccccacaucauuuuucaaauuuucucuccuaaugacaguccuagaaaauccuccuuuggucaguucucaugaauaaacccuacccuaguagagcugacuuaauucagaaagccauauacguaccaaugagaaggaacucauuagacacguuccauuuuugaccaggugaguuuacuuggccuuccaggugcugagcauagcauggccuguaaagcagaugcuuuacuaggguaugcuaaguuaccaaaaauauaggcuaccugcauuuuuuaaaccuagaaauagcuggcaaaacauaaaaaugcuuucuuagaacacuggcugguuagaaagccuagaaaauaagaugguacacucuuccuggaagguauguaauacagacuuaaaugaacuuaaaauacucagccucuuuuaucccugguuuuaagccuuugaucucugcagccaggugauaggacagggucucauucugucacccaggcuggagugcaguggcacguucauggcucacugcagccuuugaccuccugggcucaagagauauucccaccucagccucccaagcagcugagaauacauguucaugccaucaugcccagcugauuuuuuauuuuuuguagagaugggaucucccuauauugcucaggcuagucucaaauuccugggcucaagggauucuccugccucggaaaguguugggauuacaggcaugagccacggcaaccagccuagguugucuacucuucuaaaaucuuacuaggauugcguugaauuacugaauccaugagauagaaauacuucucucuuguuuucagcugaauuccuggcaagcuaaauguuauuuaauuuuacauuagccuugcuaaagggaaccaaaauauauagcccucuuaaccuuuauuuuuucuaauaacuccaaagcaaaacuagucaauuuaggggacccaaacauuagaauuaguugggagacugcuuccuguugguauacacaccugaaggcaguaauauaaacaggaaguucucaacauccuguuacuuaugaauaauauguaaaaaguaauuucucuuucuaugcuagaaacuugcccuauagaccuuacuauuucauaaauauuguguuucauaacaccaguuucaugagaaguuguaugaggaaaagggugaagaggaauucagagcaaaaaaauuuuggaacauacugcacaaauaagguugaugacauguagcagcugauaaagcauuuaagacaucuuuuaauugauuucauaaacauacuugacuauggaacuuuuuuuuuugguuuaaagagauggggucuugcucugucacccagacuguacuguggcggcacaauuguagcuccugcagucuggaacuccugagcucaaguaauccacccagccugaguagcuggggcgacagcuaccaugccugguuacggaaccuuuugcauaacauauuccuauuuuauggaauuacuauuccaaggagcauauuuugggaaacacuggauuacuauuucccauccuccuuugguugacucucagcagacuaggccuuuuguacaccacauguuaagaauucuuucucaugggaggcugaggcaggaggaucacuugaggccaggaguugauucaagaccagccuuggcaacauaaugaaaccucauccauacaaaaaaacaaaauuuuuuuugccggguuugguggugugcaccuauagucccagcuucucaggaggcugaggcagaaggaucacuugaguugagcucaggaauuugaggcugcagugagcuaugaucauggcacugcacuccaaacugggugacagagugagacgaugucucaaggaaaaaaaaaguuauuucucuuacauuuuagucccuaacuauaccucuccgauagaccaacguaacugaaguaaaauaaggggacucgguaauauagacugagaaacuuacacucagcuggguuuagcuaauaaugcucugguguuggauauaucaaggguaaaauauuacccucacuaguaaacuaauuaugaaaaauguaacuggaucagcuuuacaaguguauuaugacauuauacaucuaaaaauguuacaacucaaauaagaaauuuaguuuaagauaugcugcuuauuguuaaaaauuacauuuucacugcaaaagcacuaaaacauuaacaaaaaaaucuauucauauuuaugcuacuacaaauauuuucauuugucuuuaccaauaaacagauaaauuuuuucauagcuuuaaaacuagaaaaguacuuuauauuuuuuacuucuaguagauuucauauugucuucauaauuggaaucaacuuaaauaucuaacauuauuguagcuauuucacuuuagugagcacacuguaaguuuuuaaaauggcauucagacaaccugcuuauaaaaacagacuguguuuacaauuauugguuaccaaaauucaguaagaugaguccaguuuuuaauuuuucauuucagauuacuuucuauuuggaaaaauaaggaacauuuucuugauuauaagcucauacuucagaaaaucuguaaagcaugauauagcauaguuuuuuaaaagucugggaucugaagucagauuaucugaauuaaaugucuaacucuaccaauaaguaaguuuuaaaaccuuagguaaauuacuuaaacuugucugagucuguuucuucaucugcaaaaugacaaugaugacacauuaaccucacaggcaaauuaugaggacugaaugauaaaacaugugaagccuuugucugccucauaguaauuaauaaauacuaacaauaacaauaaaaaacaaagaaacuuuguuuaggggauauuaugugcauauuuacuuacuuuuugauaaucacuguuuguaaauaacgauccaguaaauauuuacugagugucuuccaugaaaagacaguguuaaaguacuagggauauagagacauaagucccagcccuuacuuccaaaacuuauuucuggagaagaaaacaaauuaagcuggcgauagcauaguacaugguaauagcuuugauagggauauacacagaguacaagaaaguuggggcccuuaacacuggacagcaugacuaauauguugucucaugacacauauguugcuaaccaccacauucuuuuucuuccucugguuuagacuagaaaacaaaagauguccuaguuccacuugcagguagggguagccauguugacauuacucuggagguugaaguuccuaaagugguuuuccugaauauaaggagguguccugaauaaaaagauggcuucccuagaagaaagcccguuugcccuucuucccuuuuuccugccuuagucuuuggacuaaaggcauagugguacagcagcccaucagugaugugacacaacaaaagauaacauagcaaauaaaaaagagacuaggacucugguggcauugcaguuauugcaauacucuugaaugccuaacuuuggacucuuuauuuggugacacaaauucuuacuacuuuaagccaccaguuguuucauucuauaguuaggauuuucuauuaucugcagauaaaugcauaguccuaguagauaaagauuuccgaaaaugguaacuucugagcuagugcaacaaaaggaguagaacuuaggcaagugaagaaacucaagaagagcacugcugguaaagugaauagcaccuacaaaggccuggagagggagggagcaugaaguguucuacaguaagcaccuuccaguuucuuggauggcuuuagccaggugauuccaaacuuucuccaucuuccaccugcuuauguuuaagaacuucaauacucugcccucaguaauuccauauggugagcauuuauuuuuaaacaguaaguucugugaugaugaacauaaaaugcaauccuugacuaauguuuagacuuagaaacauauauuuauggaaauuaagucacuuugauccacauuaugaauuuacacauauaacaccuucaacuaaagcugccaugugugcuuaugugcuaugcacuuuauuuacacuaauuaucucauuuaauauauaugacaacucaguggaauagguacuauuauccuucuuuauacccaccuaaguuagguuagaauuaugggaauucagaaaagaauggcaggacaagaauucaaacucaguucuguuucauucuauagccucugcucugagccacucugcuauaaugcuagucaguucuuuuuuuuuuuuuuuuuuuuuuuuaguuucuagucucuuugucccacuucaccugcucaaauccuuccugcauuuaugcaauaaaguuuuaguuccccacgagcacucuggggaugagagugggguggauugguuaucuuuuaacaggugaguauggaaggaaggggcauacuaaacuaaguagagcaggagcaaagggaagaauggcagaaacagaaaaaaaaaaaaguucuucccuucuaaaggaaugaguuaucuuuacuuauuggcaaaccaggaguaacucccaaaaauauuuccaaauauuuuauaaguguaugaucucuaaaagguauaaauuuaagguggcaacacuucuauuuuaaaccgcaguauguuuaaugauugauucauuaguuuauauucguucauacauucaacaaauauugaucacguucaugugccucuggguauauuccaaugcauauguuccuauacucaagaagccaagaccaaauaaaaaugccaauuauaacuaccauaaagguuauuguaucacacaaauaagguaaggauauaauggaacagaaaauauaaaauucagaccugagaaaucauagaaggcuuuccagagggguugauaucuaagacgaauccuaaacuauaaguacguguuacgaacaaagaaggaacagucuagaauagaguuucuuaaccucagcacucugaccuuuugggcuaagucuguuaugggggcgggggacauccuguuuuggaggaugcugaaacagcauccuuggccucuucccaucugauaccaguagaacucaccaagugugaaaacccaaaaugucuccauauauugucaaauguccccuaggggcguggagggcaaauauugccucugguugagaagcacuguucgagaucucuguugucuaaaucauuaccacuagccacauguggcuauuuaacuucaaauucauuaaaauuaaacaaaauuaaaaguucaauuccucagucacacuaaccacauuucaaguauucgguagccacacauggcuacugauuaccauauugaauagugcauauaugauauaaaacauuucuaccaccacagaaaguuccauggauaaugcucuuacagauugagggaguaaauauugucuucuauuccacaguuugcugauaggcuguggggagaguggagaaagaugagguuggacaaaaaagguaaggucugaguaugaagaaucuuccacaccauaaggcagaacaauggggagccaaugaaagguuuuaagcaaaggugugaaauaaacagaacuuuauaaagacgacuaugaugauaguguggagaacgaauguggaaagacuagaagcagaaaaagaguugcaguaucucaaauaauuaugaucuggauuaaugcaguagcaguaggaauacacaaaaauagagcaaccaaggagucagaacugauaggaucuggugacugacuaguuguaaagcaggcugaggaagagucaagacugaccucuagguuuuuagguuacaugagugaguaccauucacuaagauaguaugauaggauaaugaccccagaaauguucaugucuuaaucuuugaaccccuggaaauuugcauggcaugggaccaaaucaaggaccuuaagauggggagauuaucuuggcuucccugaguaggaucaauguauacucagguauccugauaaaagcgaggcugaaagagauuugacuacaaaaaagagcccugucagaaugaugcaauguaaaaaggcucaagcagccauuaauggcuuugaagaugcagcuacuggaagcuaaaaaaggcaaggaaacauauucuucccuagggucuccagaaaaaaaacaaaacaaaacaaaacaaaaaacccauggcacugcuaacaacuuaguuuuauccccgugaaacccaugucagacugcuggcacacagaagucuaaaauaaucaauuuguguuauuuuaugcagccucuaaauguauguuaauuuguuauagcagcaauaggagacuaauacagauaguuauagaaguggggguaugauacaaguuuggcucuggaaaaguugaguuugaaguacuuaugugacauccagguaaaacugaucagcugauaaagaguuggauuauaugggccuagagcuuaggauggggacauauaauuaggagucauugguauaaugagacuaauugaaaccaucaaaguagaugagauuauuuuggacaaauauagacaaaaugcaaagcaacagacacccuugaagggugugagaaggaacggccuaaaauguaacaggaaaaccaggauagugugacaucuuaaggaauuuuaaaaaugagaauguaccaaacuggggggaugaggggguaguguguguauggaaauggucaacagagugaacugaaaaaaggcugucauuuggaagugauauuaccuauuauauucagcagugaggggucaugguauccuuuauaaaaguuucagaggagugguauuaaagauuuuuguuacugggguucaaaacugaauggaaggugaggcaugagacuaauucaaucaacacuuugacuaaacuuugacuuucuucuuucaaagggaagaagauacagugguagcuagaggaaagguuguggguuucaggaaggauuucuuuuuuaaauauggggguaaaauuaagcauuuaacuauucaugagaauaggcuaguaaaaaauaagaaaauaaagaaguaggagaaagagaaugaaucauaacaugaauucugagauaggaauggaugagaccuagaggguaggcagagagagaucagcauucagacaggcagaaggacaacucuucuguugagagauaagggaaagaagacaagaacagguauagaauugagcaaguauuaaguuagggacaagaaauguauuaauuugguggaguaccacaaggcaacuuccuauuuucucagagaaguagaaggcaagaucauuuaccggcagcaagaaaagaagaggcgaguuuaguagcuugagcuaaagaagucugaaacagguuuaguggagaauaguggaaaauaaaucacuaaagaaaaagagggugugaaggggccuauauauuuuauugaauccuuaaaauagcuguuaauagacuucugcauguggccgcaguggaguaccugauacugcagcaacucucccagcaccaccaucucaaaacaugaacaaaauaucagaaacaaguguuuucagaaauuggacaacaaaaagcauagacuguuagaccugaaaaagaaaaaaacaaaugagacgauucuaucugaagacaacuugacugucgugcagaaagaagcaacuuaagcaaagcaaggcaguacugcagagcuaaagagaaggagguuaguguucgagguggcaaagaaucauauggaagaaaaauaaacagcuucaaaauuuacacaaaucccuauguagauuuggaauuuggaaucuauagcugaaaacuaaacuguauauauguagauaaaaacuccaaaaggcugggcaaagagcuaccagggaucuacaaguggcugacacauguuccaguucugcugaaacaaacuucaauacacuuuaaaggaagagaagaacaaacuucaauacacuucaaaggaagagaagaaaacucaaaugcucaaaaaccauaaaaaucaguguucagcacuaaauuaaaaaguauuacauaugcaaagaagcagaaaauuaugaccuguaauugcaacgaaaaucaguaaauaaaauggaccacaggccggacacaguggcuuacgccuguaaucccaacaguuugggaagccacggcaaguggaucagaugaggucaggaguucgagaccagccuggccaacauggugaaacccugucucuacuaaaacuacaaaaaauuagcuggguguaguggcggauaccuguaaucccagcuacucuggaggcuacuccggagguugaggcaggagaaucgcuugaacccaggcagcagagguugcagugagcugugguucugaaaugcauugcagcccggacaacaagagugaaacuccaucucaaaaaaaagggaccacaaaaaugauagagauaauacaauuagcaaucaaggaauuuaagacagguauuuaagacagaaacaaaaugauaagaugauagagaaaaugauaaacaaaugauagagauacuacaauuagcagucaaggaauuuaggacagguauuuaagacagaaacaaaauggaggauauaaaaacuucuauaaaaaaguggaauuucgcucacaccuguaaucccagcacuuugggaggcugaggugggugcaucaccugaggucacgaguccgagaccagucuggccaacauggugaaaccccgucucuacuaaaaauacaaaaauaagccggguaugguggugagcgccuauaaucccagcuacuugggaggcugaggcaggagaaucacuugaauucaagaggcggagguugcagugagcugagauugugccacugcacuccagccugggcaacaaaagugaaacucugucucaaaaaaaacccaaaaaguugaauuucuagaacugaaaaaaauauaagaucuagaagagaaaauuuauuagaugggauuuauagcagauuagauaguucaggggaaaagaauaagaaaagugauaauagagaaacaaacuauuaguaaguauagaaaaauuguuggauaaaaaucagcauguggcugggcacgguugcucauaccuguaaucccaucucaaagcacuuugggaggcgaagguaggcagaccaugaggucaagagaucgagaccauccuggacaacauggugaaacccugucucuacuaaaaauacaaaaauuaguuggacacggcggugcaugccuguagucccagcuacucgggaggcugaggaaggagaaucgcuugaaccugggagacagaaguugcagugagccgagauugcaccacugcacuaaagccugguugauagagccagacuccgucuaagaaaaauaaaaaaaucagcaaguaacuaugauuuuaaaaaaaaaacucuuagcaaaauagaaacagaaaguaacauguuuaaccugaugaagagcguccaugaacaagcuaauguuaacuucauauuguauggugaaugaaucacuguuuuuuccuuaagauccggaacaaggcaaggaaauucacucucacauuucuauuagccuaucucccagagguccuagcaguacaauaaggugagaaaaagaaauuggcauauaaauuaacaagaaauuaaaacucuuuuuauucguagauaauaugauugaguggguagaaaauccuaaagacuacauaaaagcuacuagauuuaauaggugaauguagcaaguuugcagguuacaagaucacuauaacuauuagcaauaaaacaauggauaacaaaaauuuuuaaaugccauacucaguagcaucuaaaaacuuuuaguuuuaauaaaauguguacaaaaccuauacacagaaaauaacaaaacacgcugaaagauauuauagaagaaccaacugaaauggagauacaccaagcucaugaauuaaaauuuguuaauaagacaucaauuguguccaaauugaucuauaaauuugauguaaucccaauaaaaauccaaguagaacuuuuuuuaaaaauaaaaauugacaaaguaacucugaaauuuguauggaaaugccaaaaaauauaugaaccauuuauauaucugauaucaagacuuucuauaaagcacaguaaacaagacaguguagugaugucauaaaggcagacacagcaaucaauggaaaauaagagccuagaaaaacacccacauauaaugauuuuugauauaggaagugacuggggagaggcagacuuuucaauaaaugguacuggacaacuggauauccauccauauuguaaaaaauaaaccuugaaguucaacuuaaagcaaacacaaauuuaacacaaaaugguucaaacaucuaaaagaaaaacacuacaacuauaaaacuucuagaagaaaaccuaauaaaaucuuuaugagaagauugagauaucuggaaaaggaaguaaagaggcuggccaauccucccuacaaacaaguauaaaaugacacaaaauggucagaaacuaggcucuggaaacuaacuacaggcaaacaacauauugggaaguguuuagucauuagugacuacugaacuuuagguaguaguaacuaugagagucuauuauucuugcuuauggcugcugccaugaccuaucccacaugguuaaaauaguaguguugcuaggaugaggcagccuguguuuaaacacgcaaagaaaaacacaaugacaaagaaucagacaacaggaaaucuuaauagagaaacuagagcacaaauaaagauaaucagagaaaaaaguaaauagagcuucagagagaagagaauaauaacaucaaucauuucaacauacgugaaaugggcauuuuagaaggggaggagagaaucaagggacugaaaaaguauuuggaaagauaauggcugaaaacaucccaaaccuaacuaaucuaugugagcucaacaaagcccaaguaggacaaacaugaagugauccacuauauacguagucaaacuguuaaaagucagagagacaggagaagugaaugagugacagaaucaaucuaggauaaaucuuaauaccaacaaaagaaaacuuacguacaggcagacauuaauauaauuaauggcugauguccaaaauguaauggauuaacauauucaaaacaaugaaagaaaaaacaagcaaacaaaacuguaaaccagacauucuauuuccagcaaaaccaucuuuuaaagcagaaggcaaaauaaagacauucauagauaaacacagacugagaaaauucauuacacacaaaccugugguauaauaaauacuagaagaacugcuuuagacugaaaggaaucauccuugauuccucuguuuccccuccacauugaaucuaucagcaagcaaggccuacuaguuuuauauccaaaaaugccuuaaauccaucuacuuacaaaaaaaaaucuuccauugccaucaucugagcaagagccuugaauuaucuacugaacuucugcaauagccuaacuaauuuuccugcuuuuacucauaucccccuacaauccacuguuccaacaacagccaggguauuaaaaaaaaaaaaacagauugcacuauucucugcauaaaauccucucaucagcuuucaugcacuuaggauacuacuugccaugacuaaauauguaauacaugaacuacuuccugcuugaacuuuucuaucauucucuacuuccuuccguaaguuccagcauacugggauccuguauucuucaaauaccgcaaacucauucccagcuucagauuuuuuguaccuacuguuccuucuaccucaugugugucaccaggagaucaugacucaagcuggcuucuuauuacucaggucggcacucaaaugucaucuccucagagaagauucucagagaagcuuuuccuggccacccuaucuaagguuacccuacccaccaucacuugccucccuuucccuuuuaaaaauuguggaguaucauuuaucguuaucugaauuguaaugcuuaauuauuuagucacuuguuuaaugucuaccucacccaauaaaauaaaaggaucaugagaggagagaucuuaguaucuuguucaucacuguauguccaggaccuaacacaauauuuuuuaauuacugaguaaaaauuuacauauauucuaaaacuuagacuaaaauguaaacauuucugaacucuuaaaagacuuuaaaaagaacuuuguucuuauuuaguauuuuauaagugucauauuuuauaauuuauaccagucuucuaccucuucuuaaugaagagaaaaaagugagugauccuccaaaguuaucucaaguauugcaaagagaguggguggccauauauagacaagaacugugucugucuugcuuaccacuguacucucguaccaagaacagggucuaguauaugauaaacaugaaauaauuacagaaugacacauuaacaaugagacucuuaagaguuggaagacagaggaaaugcucuggggguugguggcaauguauuacucccuccacucccagucaccacuuuucuaggucuuaagaguagucuugaauauaucucucuauaacagacuaaauuucuuaagggcauggaauaugucuuuucuguuuuguauuccuuaugaguaaaacuggcagacagaagauguccaauaauuuuaauaauuuuuugaaugaaaugcaagagcauuggugucuucauuuguaaaagggagguaacaagauuaccuacuucagaggauuauuauaagacaaaaaaaaaaacucgaaaaccaaaaaacuacacacacacacacacacacacacacacacacacacacacacacaacaaaaagaagaguaaaugaaaggaaaaagaaaaacaccuccacaaaguccucuuuuagcuagcuauuagguuagaaaaguguaagagaacugauuaaauuuccucuucuccuauaaacuauuccuauguauucagcuaccuauagaauaauaagcuaauaauaauauaagcuaauaagacaucauacuauuucagcaccagacacuguaacagaccaccaccaccaccaacaacaacauagucagguuagcuuauaagcaagacccaaacuuggauaagagaacuucccaagucacaaguggggaaagagaacuaacuauacugacaauuuggggaaucuaacaguauagagccuucguguguucuaaagccuagaggcuauccuuuugguagagauuuuaugaaagaaaucagcaguauuccagaugucccaguagcugcaaugcuccuucccucacacguuuaaaagaagaccuaugaaacuacuacuauacuaacacaaucuaaauuuaaacuauuauuguggcuuuaaaucuugaaagcuggcaaccccacaaaaacuaauccacuaagcaucuuaaaagcuguuuuugaaaacaaauuuuuacaauucuauuaaguagaaucuaaacuuaaacuauuauuauggcuuaauuccuacaggcugccaaccaaaacaugaaaaacacacuaucucaacaaaacuaacccauuaaacaucuucaaaaacuuuucucuaaacaaauucucagaguuauuagaauagaaaaauaaauauccaauuuaauuguucguuuaagcagucuuucaguaagagccaguuaagauucaaaaacauguaauuaccucagauugugauuuuauuauugaugagauacagguaaguaucuagguagcuuauaaacaauucacccgagggggcuguaauuaaaauaucaaauuuuauucacuggaguuagauuauauuuaaaaucaauauuuacuugaaaacuguauauuuuauaucgucauaaaaaccuuauugcaaaaggauuuuaauauuaguuauuucacuuaccaaaaugcaguccacuuuagauuguacaguuuugcuaaaagaaagagaaaguuagguuaguaaaaugaaaaguuuauuaacuaucugcaauauucucaaaaagaugugguaauuuagucuuccuuacuaagaaaaaaauaaauacagcuuccuauuaagauuagggauuguagccuaaaucuguguuuuucacaaagcaaaacaaaaaucuauuucccauuuacuguacuaaauuuaaucuuaaagcaugguuaaaacauuuccuaaguuuauuuugaauaaacaauuaaauuuuuaacaguguauaagugcagauuuauuacuauacuuacaaguauggcccagagcuuacaauaauuaugauuuuuacugucugccugccacucuggacaauaauuugcuuagcacuuaaaagucauaacgauguacuacaaucuguagcuuguaagauuugauacauaaaagauucuguucccuccucucucugucucaacacacacacacacacacacacacacacacacacacacacacacacacacaccaguaacaggaaucccuagacauaaaagcaauaauaaaagauuaacuaauauaguaauaaauugggagggcagaaaaauacacuuagaaauaaauaauacaauaaagccacuauacaucaauuuaacugaacuacugaauauaagugaacuguuaauauauaacacaaaugaagccaguauaaaauaauuuaaacaacuauccuuuggauuuuguuguaacacauaggaaagugaaaaugcaaagaaaucgugcaaaauguucaggaacaguuuacacacaaucuuuaaaagauguuaaaaccaaauugucuucuguaaaaaguuauaaagccaaauauauguaaaccaaaauugguuauuugccuuuguauguagccauacagcuaagcuauaauauaaaaaaaauuaguauuuaaaucucauuuaacacaaucauuaauaacaaaauuuuaugccuguacccagauuucaaauuucauuuucuaaacaauaaaauaugacuggauucaguuuaacugcaaaguucagaacgacuaaaaagagcaaaaaaaaguaaaggauaaaggauagguuaagagguacugaaauccccuucccacaguccuacaaaagauuuuuagguuuuaaaaucucuuuguauagcuuauaauucauuggcaccuaacuuguacuauuuuuucucucuucucaauaacucccaguuuccucugagaugugagaguaaucuacauauuaagaauugcugcuaaaaagguaauauauccaggauccaaccaucucucaucaccuuggucuaaacagucauuacuggccaggcgugguggcucaugccuguaaucccagcacuuugggaggcagaggcagguggauugccuuggcucaggaguucgagaccagcuugggcaacacgguaaaaccccauaucuacuaaaauacaaaaaaaaaaaaaaaaaaaagccgagcaugguggcuugcaccuguagucccagcuacuugggaggcugaggcaggagaauugcuugaacccgggaggcagagguugcagugaggugagauugugccacuguacuccagccugggcaacagagcaagacuccgucuccaaaaaaaauaaaacaaaauaaagaguaauuauuucuugucuaagguguuacaauaaccuuuuaacugguuucucuguuucuaucuuugcccuaucaccaaccaccacacccugugggcuacucccaacaaaguggccagagugauucuuuuugaagaugacauuaguccuuugcuccaaagucuuuaccauggccauaaaaacccaguaugacccaauccucugccaucuuucugaucuaaucucauacuagucuauucuucauucauucagcucuagccaggcagccuccgugauagcuccgcggcaggagugggcccugcacuggcuugcucugucagcuucuaggacuuuucucccauauaacuuaucccuuuacuuucuuuguuacuugcuccauguuaucuucaacagacaguucuucccugacuuccccauauaaaauacucccagucacucgcuauagcucucauccugcuuuauuuuucaucauugcacuuaucaccagugauguuauaauuuuauuaauuuguuuaccagcuaucuuccuugacuagaauuuaagcuucaugauagcaggcuuugucuguuuugcucauugcuguaucaucugguauauguaaggaguucaauaaaaucuguugaaugaauaaaugaaaaaaaaaauuucagucccccagaugaagaaaaaguccuuggaaagacugggaccacuuaagaaugaguuuuuauauaaauuaguaugaaaaugaaauguuuauuuuauaacauauagaucucaauauauuuucauucuaccaguaacugacuacucuaugggauuaucuaaggaggaugguucuauccaccuaucacaaacaacuugguaaaccucuaaaaaauauauguaaaugauagccuuuuaaagcaggguccccaacucucaucccuguuaggaacggggccacacagcaggaggugagcaaccaagcgcauuacugccugagcucugccuccugucacaucaguggcaacauuagauucucauaggagccugugaacccuauugugaacugugcaugugagggaucaagguugcaugguccuuaugagaaucuaaugccugaugaucugucacugucucccauugcucccagaagagaccacuaucuaguugcagaaaaacaagcaggcucccacugauucuacauuauggugaguuauauaauuauuucauuauauauuacaauguaauaauaacauaaauaaacuguacuauaaauguaaugagcuugaaucauccccaaaccaucucccccaccccuccaucugugggaaaauuuuuuaucuuccaugaauuuggucccuggugccaaaaugguuggggacugcuguuuuaaaggacagaguuauaaagaaaauugaaagcccuucugguagaugagggcccuggaaucacuuaacuuagccccuugauuauuuuuacuuuauacuuaaacauaauagaaaaauauagaugaauuuuaaguuccccuuuucuucugccuagccuuauaccccucccuaccuucucaaaggcaacuaucauuaauccaauauguaaacuuuccaguuguuacuucaaguuguuacuuguauuaaacaaaaaucuauaagcaacauacacuguucugugaagcuuuuaaauguuuauguaaauuccaucacacuguacuuuucuacaauuuuuuaauucaacauuguuuuugagauccauccauguugauacacuuaaaugaaauucauucauuuuaacuacuaaaaauuaucccauugaaugaauaauaaaauuuauucaucuauuccucuacugaaagguaauuauguagcuuccaguuuuucuacaaacgauacugccauaagugucuuuguauaugucucuuggcauauaccuguaagaauuucucagcuuuaaaucuagaagucaauuuucuagggcuuauaaaugauuuuuuucuauuuuauuuuauauuaacaaauuucucucaaacacuuguauccauuuauacuuccauuagcaguauaugauaguuccuauuuucuuauuaccuugcauauauaugccauuuauacaugauauagguaauacauauauacuaaaaaguuacuauuccaaugggcaugaaauuguauuuuuuuaaaaaauugucuuuuccucaauuacuagcaauguugugugccuuuuuaccugccuguuagacauagggauuuucuccccuaugaauuguuuguuccuauccuuugcauauuuuuaagcggagcuauuucuuauuacauuauagaagcuuuauauauucuggauacuaauucuauuauacauauuuaacuuuguuaauaacuuuuauuaaaguuaacauuuuugaucuagucaauuuuuuuccuuuaugaguuauuuuuaugucuuauuuaagaaauccuaucuagcuaagguuaaaagcagucuauauuuuauucuaaaaguuuugaaguuagcuuuucucauuuugaucuuuaaucggaauuuauucuuguauaugguauaguguaauauacaguauauacuacuuccaucugggagcccauucacuauuuuauuauacuaaauuucuguacacgcuugaaucuuuuucugggccuuuucuguuuuauuauuaaucuacucaccuaucccuaaguuaacaccacacuucaaauuuauuacuguuauaaaauuuaggucuauuuauuugauugcaugaccccccuuguucauuuccaaaacagucuugacaauucuuggaccuuuguuuuuccaggugaauuuuucaaucggguuuucuaauuucacaacaguccuccuaaacuuuauguaggacuuuauuuuuggacuguauuaauguuauagguugaaugggagaagaugacugauaauuugcauuuuuuuaaucuguccuuaaaaugucauuuccuuucugaauaaaucuuuuguuagaaagaguacaaggcaacuuacagaugguauugugaauuuuaucuguguguugauguucaggcaaacuauugguuuucuauguugaccuuaucuccagcaaccuucaugaacucuuauuaguucuaacagcauguaguuguuuuuuuuuuuuuugagacagaguuuugcuuuuguugcccaggcuggaaugcaguaugccaucgcggcucaccgcaaccuccaccucccagguucaagcaauuguccugccucagccuccugaguagcugggauuagaggcaugugccaccacaccuggcuaauuuuguauuuuuuuuuuuuuuuuuuuuuuuuuaguagagacggaguuucuccauguuggucaggcuggucucaaacucccagccucacaugauccaccugccuuggccucccaaagugcugggauuacaggugugagccacugcgcccggacaguucuaauaguauguagauucucuuguagauaaucauuucauuuauaauuaauauuuuucuuccuuuccaaucuuuaugucucuuucucccuucuuuuucuuaucuaauuacuuuggcuaaaaucuccaauauaauaaagaguagcagugauagaagauauccuuguuuuguuuccgcauuaaagaauuuacuucuaaacuuucuguaaucaagaauaauucugguaacaucuguuuugguaaauguucucuaucaauuuaaggcacucuucuuuuaguccuacuaguaugauaguuaaggcuuuuguucuucuguucucucugccaaggaacacucuucaaaagugcuaucugccuggcuugcucccuuacuuuucugugcucagugguucaaacguuaucuccuuagaaaccuucccugacuaucuugucauucacguugcuuuauuuaucuuuauuauaauuacugccacuggcauuuaucuguuuguccaacauccccacuagcuuauaaagacagaaguugguaugauuugcuuacuacuauauucccaacgcaaggaacaguaccuggcaaagagguuuaucuauguaucuuuuuaaaaaacuagcuuugaguuuucuugaucgagcuuuuuugacaucucaucaguuuuuauuuuuuguuuuucuucugcauuauuuguauuuaugcuguuaaaguugaauacaaaacacauuuuccucuuaguucuuuguuuuuaauaagcacacaaaagaaagacuuuaucuuucuauuccugaaaaauuuccauuaacuggaaccuacaaauuuugcuacguaguauuuuguuauuuacuuuuaaauauuuuguaacuuaguauuugauguccauguauauguauguauuuuauuuuuaaacuaucuacuacucaccaauuauuuuuucacuucagccagggaauaugguuuucaugaugaaaacuuccuuugggacccaagucacagucauauuuuuuaagaaucuauguauccuuuaaauaaaccuauauucucuauuuaucugcuagagggauuuccauauagaucuauauuuaaucaaguuuauuaauuaugcuguuuaaauaauucauugccauuuuaucuaccaguuucugacauauguuaaauauccaacuacaacuggacauuuauuaauuucucuuuggaagugucaauuuuugccuucuuaacucuaagacuauacugcuaagacuacauucuauauaaauaagacuauaauuuuuacauuuucuugguaguauauuccuuuaaucaugaucuaguguccuuuaaacucaguaaugccauuuugucuuaagcucuacucugcugcauauuaauuuuguuaaaccaucuuucuuuuuguuuucugguuuuuacuacugaugagaaguuuguggucagucucccuuucuuuguguaauuuaugcuuuuuaauuuaaucaugaguucauuuuaagugaggauauuuucuccauggaaguccuguauaccuggauuggcauuaauuucucucgugauuugaaauuuuuuaauuaugaacuuaucuucacaaagauuauuuuucagaggagucucauauccuguggguuacagaagcaguuucacauuugucucugcugaauuucuaaggguuuaaugguuccagaccaauuuguauacggauuuauugauuuagaguccuuguaccagaaggaaacuguuauaucaaaugaaacuccacauucaucuacaaaacaggcuuaaggcucugguucucauauuuuacccuucuacaugcccugagcaaacagcaagcuuaccugaaacuuccugggucugucuguggguucccuguuuuaguccuauuucacagguaaaaaucucucuucagguucuaugcuuuaguucaucaguuccaacuacuuugugagggcacagaguauguggccuagacauuccuaugaacauuaagacaucaauccccagcauuuaaggucuguaugaggacaugaaaaccacuaugggucauuuagaaauuaguuccugcuuacgaccuuucuuaaguaagcuccccugauuccuuguuacuagcaccuaugaauuuaauuucucuuucuugauuugaagcuuuuauauacguauauaaccuuucuguauauaucuuaucaaaaguuuauguccggaguguggggugaaaauccugccacaagagcucaacuauacugucuaggagucuuuuauuauauggguguauacauauacuauauguauaccuaugaacuguauacauguguguauguguauauauguauaauauacacacauaucuauacauguguguauaauaaacacacauaucuauacauauauguguguauaauaaacacaccauaguuuuauaccaguguuaauggaauauuuuugaaaacuucccccaaauuccaccacuacaaccaauaaacucuuuccuucuuucccauauucucuccuguauguauucaugaacauaucuaauuuuuaacacagcuauaaucaaagcaggguauuauuuaaauuuaccaaaaucauguucuacuaagagucuucaaauuuuuaauguaauguauuuuuuguaauauuccauuuaguggauguuucaguuuccugaacuaacaccugaauauacuuugaguguuucaauuaaaauaaugcuucaguguucugcuucagauaacgacaaguuaacauauauuaaaauaaacuugcuacacauaacaauuauacauucuggacaaaauauaaaaacaaacauuaaaucaaaagaguaaucaaaagcaggaagcaacuggaaggaaguuagccuuaaaugagaaaacuguacugguagaauuuuuuuuuuuuuuuuuuagauggagucuugcucugucacccaggcuggagggcagaggcacgaucucagcucacugcaaccuccgccuccuggguucaagugauucuccugccucggccuccugaguagcugggauuacaggcgcauguugccacaccuggcuaauuuuuuguauuuaaguagagaugggguuucacuguguugcccaggcuggucuagaacuccugagcucaagcaauccaccugccucggccucccaaagugcacuaguagaauuuuuauaaggcuuuugccugaggguacuuaucagcccauguggcaauggucacuuagacugaagcaggaaucuguugucuugcuagcuuaaaaaggacaaaguuugggguugccaaggcagcuuaaaagugaaaggugaaaucccagaaaggaaagugcuccaaaauuucuauaugaacuacgcccaguauuugaaugacccuaguuugaggaagacuccaagguucuucacaaaaagaaacagcuggaagguggaaggauuugagaugagauuucugcugcugccugucacagaaaaaauaaaguugggguuugaauccagccacauuagaugucuacuaaaacaaaaagucaacacucaucagagaaaaagaacagaauccaaagucuauaacauaucacugauaaugcccauuacacaagcaaaauacacuauagugaacaaacaggaaaaaaagaccuagagucaagagaaaaagcagcucacagacacuaaauccugaaugauccaaagugucagaauuagcagacaaggacuucaaagcaaguauuauaaacauguucaaguauuuaaaggaaaauauggucauaauaaauguucgcauggggaaaucucagcugaaaaauggaaguuaugaaaaaaaccaaauggaaguucuagaacuuaaaaguuauaaugucugaaaugaaaaauucauuggaugaccuuaauuugagaucagauggcagaaaaagggucacuuaacuggaaaaucaauaggucuauugaaugugaagaaaagauuuuuuaaaaauaauaaacagagcuucagaaauuuaaagugcaauaucaaguggucuaacuauguacaaugggagaggagagauaaugagacagaaaaauauaauguuuaauaaauggccaaagucuucccaaauccuaugaaaaacacaaacuucuagaucccagaaguucagcaaauuccaagcaggauaauuauaaagaaacccacacauugucaaaaggaucaaaaaacaaagauaaaaagcacacugugaaagcagccagaaaaaaguaacauugcaugcagugaaaaaguuguaugaaugaaaccugacuaaugauaccugacuucuacauaguaaacugauuugcagcagagguaccaaagcaauucgagggacaaaagaaaauccuuauuacaaauccugguggaguaacuagacacaucuguaaacaaauguacaaaccucauacuauagaaaaauuugagcugaagcuuaaagugucuagaagaaaccauaggagaauaugaugugagagcugacaaagauuucuuaggguuacagaagcaauaaacauuuuuuuuucuuuuucuuuuugagacagagucucacuuugucacccaggcuggaaugcaguggugcgaucucggcucacugcaaccuccaccuccgggguucaagugauucuccugccucagccuccccaguagcuacgccaccaugcccagcugauuuuuguauuuuuaguagagaugggguuuucccauguuggccaugcuggucuugaacuccugaccucaggugauccgcccaucucggccucccaaaaugcugggauuacaagcgugaggcacugcgccccacugcaauaaacauuuuuaaaaaggcuuugggaagccaaggcggaaaaauugcuugaggccaggaguuugagaccagccugggcaacacagugagacucuauuucuacaaauuuuuuuuuaaaaagccaggcgugguggugcaugccuguagcccuuagcuacuuggaggcugagaauugcuugagcccaggaguucaaggcuucagugagcucugaucauguuacugcaauucacccaggacaacagaacaagacccuguuucuaaaaauaaaaauaaaucagaccccaucgaaauaagaauaaacuucuauucacugaaagacaucaauuaagacaguaaaaaaaaaacaacuacauaaaauacucgaaaaacauaucugacaaaagacuuaugcccagaauacauaaggaacuccuacaacuccauaguaaagacagguaacucaauuaauaaagagcaaacaacuggaauagauauuucacaaaaaagguacacaaauguccaauaaacacaugaaaagauguucaaggaaccaagccaccaaggaaauacaaaucaaaaucgcaacaauacaccaguaggaggcuuaaauuuaaaauuccaaaaacccaaauauuggcaaggcuuugaagcaaccauagcuuucauacauuuauggugggaaugugaaaggcaaaaccaccuuggacuaguuuagcauuuagacauaaaccuaccauaaguauuuauccaacaggaaucaaacuagauguccacaaaacagauguugaagaaaaagaauguucauagcaucuuuauaauuccaaacuggaaucaauccaaaugaugucaauguaagaauaaauaaacgcuuuguggcauagucacacaauggaauacuacucagcaauuaaaaguaacccauacauacacagaggaacauggaugaaucuaauaaauauuauacugagccauauaaaacaccuagaaaaguucauucuauaugauuuuacuuauaugaaguucuagaguagauaaaauuaauccaugguaaaggaaaaauuagaaaaaguaucugucucaggaugaggcuucccugcucacugggaaggaucauguacagacaacauaaugcaaugcuccauuuccccuuuucaggaaagaauuuuguccacugcugggagugcagugcagugcagcacaaagccaugggugucugucagcauucagugucuguacccuuggguaugauugcuuaggcugaaggaaauaucacuucucaaggucauaccaauuuccagggacagcccauaucuagacacuaaucaacauggggauauuaaggcccagccccuucccccaaccugggacagcuuugauuggucauucuaucuucagaacucuucagcauuacaguucaacuucaccucugcccaagcuguuuccuucccauccauucccuuccauagauaugaaucacaaaagcauucccuaauaaagcaguucuuaaaaaaauaugauuccuggacuaacgguaucaguauuccugggaacuaguuaaaaugcaaauuuaugggucccacuacagaccuacugaaucagacagcagaagcaccaucuacacaugaagagcuuccuaucaacuuuuugugccccacucuuaaacauacucagauggacagacaacuggaaaaaacucucuaauaugaaagacaggaaaaaagggggugaaacccuuacuuggaagaaauaacacugugcaaaaagaaaacaaaauuuuaauccucacaaagguuaagggaagacacggcauucaagaaacacaaauuggauacuauauacauauauuuuuaaaguauauucagaaaguuaaaaagagacaucuuagaaauuaaaucuauuuaggcuggcuauuuucuguuugcucuuugaaaucacucucuacccucugugauaacccaggaagcuggacuuuucaccaucaguagggcucccuuccucucuggccaauuuuugucacuggacagagguagggauguaaaagaagagaaagcaccugguucucucugacaggcaaugaguuagugguuuggguaacugugguuuuuguuagcauguuuuguaauaucuuuuugagucaauaaauuauaaguuccuaaagcuuugauuaaaaaauuaaauauaugaaaauucaaguaaauaaaauuucaaauaacaaaaccucaaaguuaucaaaaaagaaauggaauuaccuauagacaaaggaguuagaagaauauauuugcaauuaucuaucuuuuuaccauuacuccaacuaguuaagaaagcauuuucagcagcuggaaagauaugcacaaaaauacacguaucacucaauaauaaaccaccaaugcacaucugagccugcacuuuauaaaagcagauaacauuugacuuuuaaauauuucauaauuuaaauguucauuuauuauuuugggguuucuuaaacauuuuuauuuuauacauguuuauuucaauucaaauuuugacagacuaaaagacuguauuuuauuaguccauuuauaggcaauuuugcaacacugauuucuugugggaaaaaaaaaccagacagauaguaauuauuacgaucuguggaacugaaugaccaggaaaaccgaccucuuacugcaaaccaagcacauggaaagcccacccaugcagcagcagugucuugaugaucagcugaauggagauauaacaucuuauguugugcccagaagguaggguaaggcucaaggcugcaaggggcaaaauguucucauaaaggcaagauucaggugcugcuugcugaagcacuccacagacacacccugucugucccaauggcuugugacugccacacagcaacaaugaacacaauauacucucacucucacucucagagcaaguaucuuccccuuaugagagaaugaauucaggcaauucuuuacaaaaaugacagcauuuguuccaaagcaccaacaguauaacgcuuuuuagaaaauacacagaaauaaacagacuaaacaugggaauuaguucuuaaugguggaaucuguuacuacuguaucuagcguaauaauaacuucggauagauuacaaucaaaaugcuuaucaaauagacugugcugugugagggaaugucugaccaaagaguauucucacaggcacuuugggugcuggcugguaagcgcucacagggauucuucucagugccagagaagcugagcaucacauguauuuguaaaauccuucuccagacuucuugccaagcuucuucucugccaucagcuuuuucaaggaugggcugggcugaaauaugggguucuuuguaucuauuucaugccauccauccaugaugaacugcacagaauccagcccaacguaaucuagaagcucaagugagcccaugggguaccuggcuccuaacuacauagcagugucaguguucuccuuggauacaucaccucauucaugcagccugacugcuuccaugagguguugaauccugagacagcugacaauaaacccaggaguguccuugcaaggaacaggaugcuuucccaggguuuugcucaaguuuaccaaagauucaaaugucuuucggguggucacugguguuuuaaagaccucuacaaauuucaucaggggcacuggguugaguaaauggaggccagcaaaucggucuuguuuggugguagcauuggcuaugcuuguaauuugcaaagaggaagugcugcuggcaaacuuguauguucagcaacaaacuuguccaaccucuuggagagcuugauuuucaccuuuagauuuucuacaauggccucuaccacuaggucugugcuguggacuacggauauugcaucugugcugguugauaugcugcuuaggguuuucuccacaaauucaucaaaagccuuaggguuuucuacaaacaacuucuuugucacuuuccuaaggcuuuucucaauucccucuuuauauuuugccaagauguccucugucuggucuagcaacacuacuguguggccggucacugcagcaaccugugugaugcugaugaccaucaugugcuugaugaugauuuuucuugcccaagguuguggacaaggaagacaaagagugcaugaacugccuggugaugaaagccauggugcaguggcggcggcgacugcaacaagacccaggcaggaaaggcgcgugugguguugggaccagcagacgggcagccucugaggccauuuucuauuuuugaauaaaaugauacuacuaauuuuaucugcaaauaaguuuuguucaaaugacaauguaugcucaacauuaauauuuuucuaauuuuuuaaauugaugauuguugauaauugauaaugacaggcauugaacuuccuguuuugcugauuuuuaacuuuuacaaaaauuuuaauuaaauaguaucagucugguauuuugguauuagauuuuaaaaaacaaaauuucaguaccauaauugugcugugguaucauaacuauuacauuuauggaacaugcuaacuacucaucuucuaaaucuuucaagauuuacaucucaagucauauuaccagaauguuauugauauaaaguaguagggaagagggggaaaacaucagcaauaaagcagauaaaaauuuaagcaacagagauggcuugagaaagcauauuguguuuucucuaaaucaaacuauagggugaagcuagauaaagcuuucuuauccaggggggcuacacaaaagaaauaauaaauuuuaggaagcauguguuuaaaaauuaaaaaaacuuagucuaauccuacuuucucacaaagaaaugucacaaaaauaccauguaacauuucccuuuauucaaauuuaaagaugauacaauaaauaaauuagcagucaugggccaaacauauauaauauauaauacaauguaagcaauaguaucacagaaagaacauuuagauaucuuguuugcuagaaacauuucagaaacuuuccccaguuucaacaaaucauugauaaacuauuuuuuacugcagaaaauauucuaggagacucucacuugucccuuccaacaccaaguuuagccucuauccaaaaguucaaugcuauuuuuacauuuauuuggaguccucaagucugaagucagagugacucacaacuccuauauacuugauucaaauuucuuguguuauagaaacagagguaucugugaauaccagauacuagauuuaacccaaagacaaucugaaauagaggagguauacuauaauagaucaacgagaagaagcucuuacauucuauccuuaccaggacaaaucaaacucuuagcuucuaccccuauaaaauaauuaauuccguuaaaaacacauugacuucagaucccuuuuguagguugugacuuggcucgcaguccaucauagcaaaacuuauuuuuaccuuauacuugcuuauauuaaaugaaaacuauuuacuuuuacuuuuguuugcucauaugcuauaaaacaaaauuuuuuauauuuaaaaaaauaauaauagucauaauaguggcuaaugcuaaaaagguguagccagaaaaaaaggaaauaaaaaacauucggaaucacaccaugaagacauuuaaauucacuuacuuugucuucuuaaaaauaauggauucuguugguaaggauggggagaaauuggaauccuugcacauugcuugugggaaugaaagaugauauggcugcucuugaaaaacuugacauaucuucaaaaagcuaaaacagagaauuaccacuugaccuaacaauuccacccaaagaaauaaaaauaggaaugcaaacaaaaaccucuacacaaaugggcugauguucauagcagcacuguucacaagagucaaauggaggaaacaacccaaaugaccauaaguggaugaauggauaaacaaaaugugauauauuauuaaaaugaaauauuauucaaccauaaaaaggaaugcaguaucaacaaaugcuacaauauggauaaaccuugaaaacuuuaugcuaagugaaagaaggcagacauaaaaggucacauauuguaugacucccuguauacaaaaucuccagaauagcuauauccagagagauagaaagcagaugagugguugguugggguugcggaaaugaagagugacugcuuaaugcauauuccuuuuggaugaugaaaaauguucuugaacuagauagaggugauggcuacauaacacuguaaaguuacuaaaugcuacugaaucauacacuuuaugugguuaauuuuuauguuauuaauuuuacuuaauaaaaaauaauuaggaucauaaaauuaagaaaaaacuuccuuuagauacuacuagugccuaaucaacagauugcaaacuaucaauucuguuucucucuguaauccaaguugccuuugaaauagucauuguucuuaguacuugccugcucuuaugaauuuuagagacucuacuuuucaugaaaggaaauuaaccaaagacccguguuucucaaccagguacugacauuuaggauggcacccugcuuuacuuuauggguuuaucaaaugcauuauaagauguuuggaaucauacagugguguucacuaaaugccagcagugcuuccuagacauucugacagcuaaaauugccccacauuauuuccacuuguuucuaguugagagccacugcucuagaacaaaaugacauaugcuauguauuguguuacauuauaagaaguucccuaauauacgcaacucaaugcucuacaaaugagucauuucaaaagcucacacguuuuuauguauggaaaguaaacaucuugcuuuugacauaggaugcuauaaagauuuauugauuuuauuguuguucuaaacauaaaaucuaauuucagccagaagaaugaacuuuaucauaagguaacuugugccugauauuugauuacuagaucauauuacacaaaugaauuuucaacuucuauuaauaacauuauuucauucauauauuuucuuugcuuuuuaaaaaauauuaucagguuccaaauauauaggaaaguuauaaagaauaauauaacacccauguaccugcuagccaguuugaacaaacuucaacuuuuuccuuuuuucuuuaaggaagaaaacuuuacagauaaaguccccaugggaucuuuuccuaucucauuccaccauuccuuucucaguggugaccgcuauccagaaguuguuauuauucccaugaauguauauacauuuacuacaaaugcugacuaucuccauaaacaauacaauaguuuuguuuacuucacaggcaugaaguucugcggcauguaucacucuuuuuuuuaaaaaaauuuacuuaauaggcauuagaaguuuaucuauuuugauacauucuaguuuacccauuuuaacuguuacauagaaguguggauucaauuguguguccagaccccuccccaaauuuguauguugaagcccuaacccccaagugcuguaucugauggaacggauacagcacucggaaggaaucaacccugcuggcaccuugaucuucgaccucaagccaccagaacugguaaaaauaaaauaaaauaaaauaaauuucuauuaagccaucaagucugugguacuuuguuaugguugcccuagcaaacuaauaugcacgguauuccauugcuuuauuuauucuuuaauaaugggcucuuaacgguauuuccagcucuguacuguaacauacaacauugcaacaaauguuugguauggagaucuuguuauucauauugcaggacuuuuucuuggacacauacacaaauauucgcacacacacuacaguauguugaucuucaacuuucuaauuauugccaaauugccuuucaagguaauuuuggccaaucuauacuccaucagcuguguauaagacugauuucucucuauccucuccaaaauugguaaugacagacuucugccaaucggauggguaugaaauauuuuguuuuaaaaugcauuuuuuuuaaucagugauguugaacaccuuaauguauuugcugaucacuaaguuuucuucugugaauugccuacucauauccuuuaccccuuuuucugcauggugguuuuuauuauuuuauuuacuaauagaagcucuuuuuauacuuuagauacuaaucuuuugucaacuacuugaguuacaucgccaucagcggcauguugcuuuuuuuaaacaguguucauuguccaaggaaaauuuuuauuuuaauauagucaaauauuuuucuuuaugaaaagugcuuuugacauguuuuuaaaaaucuuccuuaccgugagcucccaaaguuauuuuauuuucuucuaaacuuuugcuuuucacauuugggggcugaguuuuucuggauuccaugugugaugugauaguuuuuuuuucauauagauaaugaaaugucccagugggccaucccuucccuugcacacaaggccuaugucuuguuaaccugcuuccuaagucuagcacuuugccugguacacguuaggcaauuauaaacaugugaccaauaaaaggaaggauggaagaaagagaagggagagaaagggaagcaaaguagggauaggaguguggaaaaaaaguauuuggaucauggucuuugauacaaacuauauauuugaaccacagaagucaaaggguauuaaaacagauucaagggguggacugcaggaagaugggcuuuccaggauucuggaaugcuagagguaaauauaccacuuaagugcaucugggcacugacucugcuuucucucccccaggaugagaauauggucuugcuagugcugaauuaguucaaaauccagaaaauugugauguuauaaauaucauuuauuaagucuuugcagaauguucaagaaagccuagguacaaaaaggcaaugauauauucagaacuugauacagcaaugcuagcugaaccuuucucguagggacgguggcuauauguaccacaggaaaccuaaagagaugggaaaaacuuuuuuagauauacuguauuugcugcuauucagaauagucacuugguuucuacauucuuaacuaaauaauuuaggagcauacaacagguggguaauagccucuucccaacaaucccuaaccugaaguucaaagguggaaugcuguaguggaggcaguauaaaaaagaaaaaaaagaaugggaccuagaaugacuuuugccucagacgcccucaaaagaaaaacaucucucccuagagcaacguaugucuaguucaguauagucaaggaaauauguuccauuagaguaaaagggacucagccucccaauguaaguacgcaacaccaccuacaaaguauucuugcugaaauauugaaacauaucucuauuuaacuaccaauuuauaguaauaaaggggaagaggaauaugcuacauagcaccaugaagauaaaaucagcaaauccagacugugggaaacuccauaggacaaaggauccaauuucuucaacaaauaaaaaacuucaagaaaaaauuuuuuaaagggaucuacaguuugagagauauccaccaguagccauaaggacacugauucaaacaaacuguaaaugugauaugaugucugggauucccuucaaaauaaccaaugaagacuuacagauaaauaagauuagcuaugaaacuaauuguuaaaguugaauaauaaagaccugagaguucauugucuuuucucuccuuuuguauacauucgaaauuuuuuacaaugaaaaguuaaaagaggggacugggugugguggcucaggccuguaacccagcacuuugggaggccaagauggaaggaucacuugaggccaggaguucaagaccagccuguucaacauagcaagaccccaucucugacaaagaaaaaaaaaaaaguuaaaagagaggaaggacuuagcagauccuuuuaaaaggaaaagcaaauaaaccauguaggaccuacagcuaagagacugcagucugacaccuaaaaaccuucugauguugauuuaaacugugaaaaacuuaaaauuuacaagagaaggcuguaaaucaaagauucaaccacuauaaccagucuacugagugacuguuaaucaguauuuacuuaaguuaccacugagugauacugaaagaauauuauuugaaaguguaggauauaaugacucauuuuugcuuucuaaugaguuauuuuccuuuuuugcuguccuuccacguauagguaucuuuccuuacgugauugcugguugcuccaaaugcugaauuuuaccauuguaauauuuaaaaauagcuaauuugcucuaacaggauuguaaaaauauguauuuuggggaggcagaguacugaacaaauugugcugcucucuuuagccucaaucuauaugccuucccuguuuucuuuaaugcaagcauuuucagguugauauuaauauuaaaagcucaaagagucaacaggauucaaauaugucaaauaacaggaaagcauuugcacauauaauauacuccuuaaaguuaagaagaucuucaaauaaauuuauuuaguaagaaacaccaugguaaauauagcaggaaccaaaaacauggucuugacaggaagaauuccaauucugcaacuacuagcuauaugcccuugacuuagaagaaucauuuuucccgaggcauacuacaucucgaguuuuuaaaauaaagauucaacauuuacauaaaaagccauauuguaauaacaagcauguaauagguucuuaauaaaugcuacauuaaaacuaaaucuagucuaacccuuucauuuacaaauuaggauaaaaaaugacuuguacaaggucacacacugauuuuuauuuggcuccauuauccaguuaaaaaugcuaugauuaugucugauaauaaugccuccacuuuacacugggauuuuaaucaagaagaauauuuugugccccagucuuaccauuuuggaacuuccucugucauagaaacauuauauauugucaguaaauaagcugaauuaaaggucagugcccucuagugcugaaccuucagagguaggugcagguuccaaauacaggcaaauuuaccuagucuacagaacaggaaacaaucuccauaaaaauaaugaaaugaaaacaugagauagcuacaugcacagcgacccaucuguaaggaugacuguucucucugggagaugagauuuuaagccuuuacuuucuuuucaaacauuuaaaaagcuuuuaaaacuuuuuguuauuguuuaaguuuuuauaacauauaaaacauuuaaaaagaagcuaaaacacagggcaagauaacaucacuggauugcacaguggggaaaacaacucuucuucuccuacugcauaguuucagaggaaguuacaaaccaugcagcuuaguaucuaauguuacauuaagaaaaagucguaaaagugcuguaaucccagcacuuugggaggccgaggugggcggaucacgaggucaggagaucgagaccauccuagccaacaugguaaaacccugucucuacuaaaaauacaaaaauuagcugggugugguggugcaugccuguaaucccagcuacucgggaggcugaggcaggagaaaugcuugaaugagggagucggagguugcagugagcagaggucgcaccacugcacuccagccuggcaagccucgccgucucaaaaagaaaaaaaaagaaaaaguugugucagagauaaggcagaucuuuaaauugagaaaaacaagaggauaaaugugacuucaauuuuuugaauguacuuuaggugccacuaauaggugacaugcuauguauguacaagucuuuuuuuuuuuaacugaaaagcauuaaaccagcccaugguauuaggugcuuaaaugauuauaaaaaagaaaaccaaaauggaaaugguuuagagagcugaaguuaaaaugagaauuccauuaagguggcauauccagguaauggugcuuaaugggaagacuacggacuauaccagugucucauauaaauuaauaugagaacauuucuuaaaacuguagcuaaaauggccuacagguauacuuguaagacaugacuuauuacucuuuucuagaguuaagaguuuauuagggcaguaaaggguucaguaucccaaaucugguccaaaaaauaaagucgccaaguucaauguccuguaguccuccacuuaaacccaagaaucacagaacuuuucuuaucacaaaaggcaaaacaauucgaaaaccaauuugauaguuaauauuaaaauucucuuccacaaggcaguaauagaaccaaaggaaagaaaauccagccuaaaagcauuucaaucuauaaaggagaaggcuaucuaaggagaucaaaaaauuacgaaguaaucuccucaauguucaaaugaugcucuagagaggaagauaccaaaacugauauauuuuuaaagauagaagaguuauuaguggaaauagguaaaauaauuuauuaaggauauaguuagauacgucuagauuuuucauuuuccuuccugugccuaaagcauaauucuauguaggaaugucugguaguagucucuuuuugggcuacuucaaagcgauguauggauaagaaaucauuuguuuuuuggccaaaaguuuaaaaaacacuggccgggcgugguggcucaugccuguaaucccagcacuuugggaggccgagaugggcagaucacgaggucaggagauugagaccauccuggcuaacacggugaaaccccgucucuacuaaaaauacaaaaaaauuagcugggcacgguggcgggcgccuauagucccagcuacuugggaggcugaggcaggagaguggcaugaaccugggaggcagagcuugcagugagcugagaucgcgucacugcacuccagccugggcgacagagcgagacucugucucaaaaaacaaaacaaaacaaaacaaaacaaaaaccacacagccacacagaaaaacugccaaguaacacaauuuuuccccagaccagaaagcuuuauaaaaaccuagauaaucaggcuuagucucugaaaccuaucacuucgcgggagaagugccuacagucucacuauccaauagaaauauaauacaaaccauagaaaucuuaaauuaccuaguacauuaagaaguaaaaaacagauauuacauuuaguaaaauauuuuagugugucaaaauauuaacauuuugauaugcaaugaauauaaauauugagguacuuaagaucuuuuucauacuaagucuuugaaauccaauguguauuuuauacuuacaacacaucucaauuugauuuagccacauuucaaguauucaacagccacaugcaacuaguggcuacuguacuggacaguguaugucuauggcacagcaugucucaugagcuauacuuaaaaguuugggccagcagcuauagcucacaccuguaaucccaacacuuugggaggcuaaggcaggaggauugcuugaagccaggaguuugaaaccaacuucgacaacacagcgagacccuaccucuacaaaaaaaauaaaauaaaauaaacgagccagguguggugaugugugcuuauagauccagcuaugugggaugcugagacaggaggauggcuugagccaaggagucugaggcugcagugagcuaucauugugccacugcacuccagucugggcgacagggcaagaccuugucucuaaaaaagaaaaagaaaguauaaugacugucucagaggugagcauacagagacaaaagaggucaucuguuauucugacagggcuuacauccaaaauguacauaaaacugccaaucucuuggguagagugccaucaaucaugauacaugcagauuaauuccuuucuagauuuuacuaggacagcaaagugaucaguaucucaauaucugcccuccccccaccaaaaaaaagugacuaagcuaauaucuuauugcucuucacuuaaaaccaagaaucacaggcacagaucauaaggcauuuauguauuacagucaguaagggauuauaauagaacaugggcaggaguaaguugucaaguauaaaagguaucugaaaacgugagaagccaaccauaugacaaccuggaacagauagaaaacugcaaaguuaguacagauuagugacauauugcccguauucuagaaguacacuuugcgaagacacuucuuccuaauaucuguagguaacccacagagaaaguggcuaauguucagguaaauuuaggaauugcuggguuaaauaaaaugagccaggauuuuaauauuguuuaaaauuggauuuuaauuuaaggauuaaguuccccuauccuuauaauacaagacugaucaugaaacucucagagaugugugaaccagagcaacuccaucuuaaauaggagcuggguaaaaugaggcugaaaccuacugggcugcauucccagacauuaaggcauucuaagucacaguaugagaugggaggucagcacaagauacaggucauaaagaccuugcugauaaaacagugugcaguaaagaagccggccaaaacccaccaaaaccaaaauggccacgagagugaccucuggucauccucacugccacacucccacccacaccaugacaguuuacaaaugccacggcaaugucaggaaguuacccuauauggucuaaaaagggaagcaugaauaauccaccccuuauuuagcauaucaucaagaaauaaccacaaauauaggcaaccagcaguccucagggcgucucugucuauacagaagcuauuauuucauuccuuuacuuucuuaauaaacuugcuuucacuuuacucuaugguccugcccugaauuauuucuugcauuuaauccaauaacccucucuuggggucugauugggaccucuuuucuguaacaaaaccuuuuuuuuuuuuuuuuuugagauggacucucacucuguugccccaggcuggagugcaguggcccaaucguggcucauuguaacuucuaccucccggguucaggugauucuccugccucagccuccgaguagcugggauuacaggugcguaccaccacgcuuggcuaauuuuguauuuuuaauagagaugggguuucaccauguugccuaggcuggucucgaacuccuggccucaagugaucuguccaccuuggccucccaaaguguugggauuaugggcauaagccaccgagccuggccugaucacgaaccuuaauaugcuaacauacguuguaucuauuugagaguggguugaagagcuaucccauacaucauuucccaaacuaaugaaaaaaacacuuuauuuucauggaucaucuugagaaacuauuagaccauguuggggaaugcugauuuaaaagcacagguaaggcuacuccuacaaacccagggaaaaucagugccagaguauuuguaagcaauaugagaauauuguaggcuaaagcuuugagggucuagauccuuacaauauuuuaauguaaagucuaauaacuaaaugaucaggaacaccuuuuugauuugaucaaaaccaaaagguaaugaucuauggagcuauacuaucuacccauaccuacauucaaguaauaauggcaauggaauauaguaugaguguaauuaaaaucuuaccccaaauaaucuuauuuuagucuuaugcucuuaagaccaaaaaaggaacuuaaugaaaucaaaugcgagucagggucaugcaccuuacucuaaaccugcuacaguucaaacuaggcgugcucaauaaucugugaaccucaaagcacaaaguuuaaagaaguaacugaccaaugagaauaaguaguauacacagaaacaucuaaaacgaucauauugucuagaaccaaaaggcaccugaaugccuauaaaggcaucuauuaagacaauaaaggcaaaagaagaguauuuuccccuaagaaagaagaguuuucuauggcuuguggagagcauuucaaaaauuuaagacaaagcacauacuccaaaaaauauugucuaauuucuccaaaucccuggucugaauuaaaugcucuuucuacaucaccaaaggagagagaacauaaaaugaaguugugaguaacacuuuaguuuucagagcagauagcuguaauugccaguagcaggaaacucaaguuuugccaauuccaguggguaggaaaaggcugucuuaauuugccuuucccugagaacuaacaagucugaacaaguuucucuagguuuuugaacacauuuccuuuccaugaaaugccugauuaugcuuuuugcccaaauuuuguuucucucuuagaaaucuguaaaaugucuuuaucucaaauacuaaccuucuuucaguuauauugcaacuaucuucucucacuucuccucccagagugauuuuacccuuucacucucauuauguugacacaaguuugacuaacaaaacuuuaaaauugaauguaaaugcccagauguuuucacuagagauuucuacuaaacauuuaagaacuaacaccaauucuacacauuccuuuacagaaaacagaagaugagagaaaacuucccaauucauuuuaugaagcuagucacuacccugcuauuagcagagggacagaaacauauauuagugaagcaugacuaagaaccuggaaauaaacucacucaaauaugcucaagugaguuuugacagaagugaaaguuauuaaauggaggaaagacagcuuuuccaacaaauggugcuaaagcaaucagacacucacagguuaaaaaaagagauaccaccccacauccauuaggauagcuacuauuaaaaauaaaaauuauauaaaaacccagaaaauuaacaaguguuaguaaagaugugaagaaaguggaauccuuguguacugcugguagggauggaaaaugguguagcuguuauggaaaacaguauggugguucaucaaaauauuaaaauuaccauaugauccagcaguuccacuucugaguauguaucaaaaagaauaaaugcacagacuagaacagaccuuuguacacuaauguugagagcagcacuauucacaauaaccaaaaaguggaagcaaugcaugugucuauugauggauaaauggacaaaaaaaaaugauacacauauacaauagaauauuauucaucagacauaaaaaagaaaaacauugugaugcaugcuacaauauaaaugaaucuugaagacauuaugcuaaguaaaauaagccagucacagaaaaacaauaacaaaugcuggcaaggauggggagaaaagagaaaccacauacacuguuagggggacacaguggcuggugcacaaucaugauggagaauaguuuggaggcuccucaaaaaacuaaaaauagagauuccauauuauccagcaaucccacugcuagcuauauagcccaaagaaaggaaucaguaugucaaagagauaucugcacucccauguuuacugcagcacuauuaacaauggucaagauauggaaucaaccuaaguguccaucaacagaugaauggauaaugugguacauauacacaauggaguauuauucagccauaaaaaagaacaacauccugucauugcaguaauauagauggaacuagaggucauuauuuuaagugaaauaagccauguacagaaaaaaaaaacaguacauguucucacuuacuuguggaagguaaaaauuaaaacaacugaauucauggggagaaagugagagagagagaagaaggauggcuaccagaggcuugaagguugggguugggggugggguguggggaaguggggaugguuaauaguuacaaaaaaaaaauagaauaagaccuagcauuugcuagcacaacagggugauuacaguaaaaaauaacugaacauuuaaaaaucacuaaaguaugacugggcuguauguaacacaaaggauaaaugcaugagaugauggauaccccauuuacucugaugugauuauuacacuuugcauuccuguaucaaaauaucucauguuacccauaaauacauacauguacuauuaaaauaacuaugucaaauuaaaaauuaaaaaagaccccaaacuagacaaacacuguaagauuucacuuucaugagguaccuagaguagugaaauucugagauagaaaguagaacuguggguaucagagacuagaaggaggaggaaauggggggguauuguuuaauggguacagaguuucaauucugcaagaugaaaagaguucuguggauggcuaguguugauggcuacaaucaaugugacuguacuuaaugcuacugaacuguucucuuaaaaaugacuaaagugguaaauuuuaucuuaguugcauuuuacuauaauuaaaacaaauuuuuaaaaaauuaacaucaagcuaagccucauaccuuacagaaaaauuaacucaaaauggaucacagacuuaaauguaaaacauagaaauacaaaacauuugagaaaaaaagcaauaaacucuuucagaucuagggcaaagcaaaguucuuagacuuggcaccaaacauauuauccauagaaagaaaaacugauaaauuggacuugugcucuacaaaagacuguuaagcagauuaauuuuuuaaaaagagcuaggacuucugguuucugguccagcauguaagaagcuguaagucaacacuaagcccuacaagauaaaaagccgaaaaaaacugaaaaaucaacaacucuucuuaggauuugucagagugguaagaucaggggucaaaucacaaaccccccaaaugggaaagaccaauaggaaaaugcagagaauuguagcuugcuggagcagaaacccacaagccacaaaccugcaugagaaucuguaccaaaggagguaaacaaacuauaacugaugaauuacaagaggcucagaaugaacaagucugagauaaacuccagggaaauccaguaaucaagcaucuccacacuuuuaccuccaagagcuugaccagguuuucccagugaauauuuaagaaaaaccuccucugaauauuggagauaacuuucaugccuuagacaagggaaggagaaaaggaaucauugugaaauaugccaaagcauucuguuccuaauaacgcuacccucaggagaaauuaaaucaaccagagccuauccugcuggagcuucaucagagcauaacugaccugggcaaaaggcaaaacccaacuccagaccagucuagccauccuguuccaaguaagggggcacuggagagacugagaagcacuugugaaguuuacagggcagagguacaggcuuuccaaaagacugagaccucaagauaacauuauagaaugcucccccacauaccuuacuaccacauuacuaaaggccuauuuacagcagauccuuuuauucaguaacucgcaccugguuauuaagaaaaaguuauaaggcaguaaaaggcaaaauccaguuucaagagcacagcaaacagcaaaaacauaguccaauguggcagggauguugcaauuaucagaccaggaauuuaaaaugauuaugauuaagaugcuaaggguucuaauggauaaaguacacagacugcaagaacagaugggcaauauaaauaaauagaaauuauaagaacuaaaaagaaaugucaagagauuagaaacacuaccagaaauguuugauggacuuaaugguaggcuggacacagcugagguuagaaucucagcuugagguuuaacuugguagaaaccaccaaauuugaaaagcaaggagaaaaaagacugaaaaaacaaaagaaaacaaaacccagaacagaguauccaagaacugugggauaacuacaaaggguguaacauauguguaauggaaauuccagaaggauaggaaaaagaguaauacaugaaauuucugaaacaauaaugacaaaagaauuuccccaaacuaaugucagacaccaaaccacagaucuaggaagcucagagaacgucaaccaacaucaaugucaaaagcaaaacaaaacaaacaaaaaaacuauacuuaggcauauaauucucaaaacuacagaaaaucaaagauagagaaaaaaucuugaaagaagcuagaggaaaaacauaccauaccuauacaggagccaagauaagaauuauaucugauucucauaaaccaugcaagaaggagaguggagugaaacacucgagagugucaagagaaaaaaaaaaaacccaaccuagaauacuaacaccugcaaaauguucuuucaaaagugaagaagaaauauuuucucacaaaaacaaaaaucgagggaauuuguugccaguagacuugccuugcaagaacuguaaaaggaauucuuuagagagaaggaaaauaauaaaggucaaaaugcaaaucuguguaaauaaggaaaaagcaucagagaaggaaaaagugcagguaaaaucaaguuuuaaauguuucuuauuuuuaauugauccaacagauaauuuguucaaaacaaucacaggaacaauguacugaauuauguaugcucuuauacagacacauaugcuucuauauaaacaaaauuaaugacaguaguaauauaagaaaccagaggcaggaauuaggauuauuuuguuauuauaauguauucacaguaccugugaagcaguaugacguuaacuaaaaguggaccuggauuaguuguaaauguauacugaaaacucuagggcaaacacuaaaaaacgcaaagaaagaaauauaacuaguaugccaauaaaagagauaaaauagaaucaaauaaaaugcucaaucaaaaccacaaaaggcaaaacaaaaaagagaggaagacaaaaauaaaaacaaagaacaaggacgauaaauagaaaauaacaaauaugauaaauauuaauccaacuauauaaauaauuacuuugaaugucaauggucuaaaugcaccaauugaaagacaccacugucagaguggaucaagaaauaagacccaauuauaugucgucuacaaaagccaacuuuauuaaauacaaggauacauacagauuaaaaguauauggauggaaaaagauaugucaugcuaauacuagucaaaagaaaguaggaguuaacauauuaauuucagauaaggcaggcuucaaagcaaggggagcauuacauagugauaaauaggugaaugcuucaagaagacguaacaauccuaaauguauaugaaccuaauaauauaacuucaaaguauguaaggcaaaaacagagaacugcaaggagaaacagaauagacuauuacacuugaagaguucugaagaguucaauaucccucuaucugaaaugaacagguccaacugguaugaaaucaggaaggacagaguugaacucaacaccaccaccaaugggauauaaaggacuuuuauagagcacuucauccaaaaacagcacauucuucucaagcucacauggaacauucaccaagacagaucauauucugggcauuaaaacacaucuuaacaaauuuuuuuaaaaauagaaauuauagaguaucuccccucagaccacagaggaauuaaaucauaaacaaagauugcugaaaaauuccaaaauacguggaaauuaaacaaugcacuucuaaauaacgcguaagucaaagaagaaauuuugagagaaauuguaaaauacuuuaauucaaaugaaaacgcaacaugucaaaauuugugagaaacaacaaaagcaguacuuagaaagaaauuuauagcacugaauacauauauuagaaaagaagaccuaaaaucaauaaccuaagcuuccaucguaggaaacuaggaaaagaaggcuuaaaaaagaaaaagauacacagauuacuaaugcuggaaaucaaagacgggacaucacuacagauccccuggcauuaaaaagauaauaaaggaauuacaugaacaauucuaugccaacaaauguaauaacauacauuaaaugaacuaguuccugggugacacaaucugcaaaaucagaaaagaaauagaaaaugugaaaagggcuauagcuguuaaagaaaaugaaucaauaauuaauaaucuuuccaaaccaaaagcaaagggucuggauggguucacugguaaguucuaccaaacauuuaaaaaagaaaguauaucaauccucuacaguccuuuucagaagagucacagaaauauagccaacugaucuuugacacaggagcaaaggcaauacaacaaagaaaaaacagucuuuucaacaaauagugcuagaagugaauauccauaugcaaaaacaaaacaaacaaaaacacuagagacagaucauacacucaucacaaaaauuaacucaaauggauuacagaccuacauguaaaaugcaaaacuuuauccuagaacacaacauagaagaaaaacuagaugaccuuguguuugugacuuuuuagauauaacaccaaaugcacuauccauaaaagaaagcauugaugagcuggacuucauuacaauuaaaaauuucuguuuugcagaagacacugccaagagaaaagaaaguugagcuacagauggagaaaaaaauauuuacaaaagacacaucagauaaaagacuuacccaaaauacagaaagauucuuauaaucaaccccauuaaaaaaugggacaaagaccugaauagauacuucaccgaagauguacagauggcaaauaagcacaugaagagaugcuccauaucaugagucaucaggaaaaugcaaacuaaaacaccaaugagauacuaaacauaccuauuaaaauggccaaaauccaaaauacugacaccaccaaauccugacaaggauguggaucaaccagagcucgcauucacugcugguggggaugcaaaauggaagacauuuuggcaguuucucacaaaacuaaauagauuccuacccuaugacccagcaauugcacuucaugaaauuuacucaaaggagaaaaaaauacauucauacgaaaacugguacacguuuuuaguagauuuauuugcaacagucaaaauuuggaagcaacacaaaugucaucgguaggugaauggauaaacagugguauaucuauuaauggaauaugauucagugcuaaaaagaaauuagcuauacaagacaugaaaagacaucaaagaaacugaaauguauacuacacuaagugaaagaagcaaauauaaaaaggguacauacugugugauuacaacuauugacaugcagggaaaaagcaaaacuacagagacaguacaaagaucagugguugccaaggguuagaggggagggaagaauguauagucagagcacagaggacuuuuaggguaguaagccuacucuuuaugauacuuuaaugguggauacaugucauuauauaucugaccaaacccauagaauguguaacacccggagugaagcuuaauguaaauuauggacuguggguaauacugugucaaugaagguaaaccaguuuuaacaacuguaccacucuaauguaggauguugauaauggggaggcuaugcauguugagggcagagaauguaugggaaauucuguaucuucugguucuucuuuugugugaaucugaaacugcucuaagaaauaaaguuuauuuuuuaaaaaaaguuaauuaaagaagacaagcuuuaguguaaaaaaacauuucauacguauauccaacaaagaaauauguuaaaaauagaguauguuaaaaauacucucaaaacucaacagcaaaaaaagcaaucaaauuagaauguaugcaaaauacuugaaaaaauauaucaccaaagaguauacacaaauaguacagauguuuguauaaaugguaaacaacacaugaaaagauauuuaacaucauuagccauuagggaaauacaaauacaaccacaaugagauaucacuguauacuauauaccuauaagaacagcuauuagagagugucaaugccaaauacuggcaaggauauugaaaaacuggaucacucagacauugucugugggaauguaacaugguacagacauucuggaaaaguuuugcuauccuuuaggaaauuaaacuugcaacuaccauaugaccaagcaauuguacuccuugguacaguacauuuguacauuucuccauuuaucccagagaaaugcagauuauguucacauaaaaaccuguacauaaaugucuacagcagcuuuacucauaagggcccaaaacuggaaucaauccauauauccuacaaugggagaaugguuaaacugugauauauccauaucaugaaguacuauuccauaauaaagaggaauaaauuauugauagcuagaacaaucuggaugaacacccagugaauuaugcugagugaaaaaagcccaucccaaaagaugacuuaugauccuaucuacauaacauucuugaagugacaaaagcuuuagaaaugggggaacagauuagugacugccaauaguugagggugaaagguaagaaguggguagggauauagaaggauaccaugagggauauuugcagugacaaaaacguuuugucuugaccguaucaauguuuugguugugacaguguaugacgcuacagauuugcaagaugacaccacugggggacuggguaauaaaggguacacaugaucucucuuuauauuauuucuuaugacuagaugugaaccaacaauuaucccaaaauaaaaaguucaauuagaaaaaauuaaacauacauauguaaucauuuccuuccugauaugugcauuuguaucccucccuacucuaaaacuaucuuuuguccuguaaaaacaaguauauauuuuauucuaguauuuuuuaagauuuucuuuuacaaucuuugucaccuacaauugauuguggaucaagggguaaacuuggauccauuucacuuuuuuucuauauugauagcccgugaucuuagcaccauuauauagcccauugcugccauuaucugaaagcucaccucugucuuauaucaaguauccaucaugcaugaguuuuuuucuaggcucaauucuuuucccucaucuccaguuauuuaaccaugugcaaauaccaaaccgccauaaauacuguaauuauaguaacucuuggcauuugguauggcaaguuccuaacuuuguccuucuucuuuaggagcacuuuggcuauucuaggccauuuuuucuuccaccaaaagcuuaaaaucagacugucagguuuuuugaaaaauauuuugauuaaaauuucauugaauuuauaaauauauuaagaaauaaaaaaucugcgauauuuauuucaaugaacauggaacaugucuccauuuauuuaugccuacauuauugaaaaucuuucaauaagguuuuaaaaucuccuauaauaggucaggcgcgguggcucacgccuguaaucccagcacuuugggaggccgaggugggcggaucacgaggucaggagaucgagaccauccugguuaacauggugaaaccccgccucuacuaaaaauacgaaaaauuagccaggcgcgguggcgggcgccuguagucccagcuacuugggaggcugaggccagagaauggcgugaacccgggaggaggagcuugcagugagcugagaucgcaccacugcacuccggccugggcaaaagagcgagacucugucucaaaaaaaaaaaaaaaaaaauucuagaauaaagucuuacauaacuauagcuacauuuauuuccaagaaccuacuuguuauugaaaauguuuaauuacacuaucgauuuuuauuguauacagaaaugcaaaugacuuuugcuacauuaucuucguaauucuguguagauugaguuuuccauguagacuaacguaugguaaguuagcuucuaauuauuaaguuuuacucauuuuuuuaacuucugaauauacuaagaaaucuguacauuucuuguuucuaauuuuaaagacaguguuuuaacuacaacuuuuucacuaauacguacaauugucccuugguggguaucaagguacuaguucuaugacucccauggauaccaugaucugcagaugcuuacaucucuuuuaucaaauggcacaguauuugcauauaaccuaugcacaccuucauguauguuaaaucaucuccagauuccuuguaaucaauacaauguaagugcuauguaaauagcuguaucauguuuuuaaaaucuguauuauuauuguaucauuuuauauuucuuuuuucaaauccaguugguugaacccacagauacagagggcugacuguuaaaucuauuguagucuguagauaccauucaucaaguuaaagaaguccccuucuguuccuaacuugcuaaguguuuuaucauaaaacagauauucaguguuauuuauuuuccugcaucaauuuagauaaucaaauaacuugacuucccucaucuguuaaugugguaaauuauaugaacagauuuucuaaugaaccgacuuugcccuccuguaacagacucaagcuggcuaggauguuauuaccauuuuuauacacuuguggcuucaauuugcuaauuuuuguuuuagauuuucuguuccuauguuuaugagugggauaguaaaauuaaaggucauucuuauauucuauuuggauaccaagauuauaccagccucacaaaaugaguaggaauguauauuugcuauuuauugcuguauaauaaacuacucaaaaacuuaaugguuuaaacaaacauuuuuuaucuaauaguuucugugucagaaacuuaggagucacugagguggguggguucugucuaacagucuaucccgagguuucagucaggauaucagcaggagcugcauuaucauuuccaagauggaucacucacacugcaggaggccuuauaccucaucacaagagccucucugugggcuucuuaccucaugaugugguggcugccuucugccagaacaaacaauucaagagagugaaaauggagcugcagugccuuuuaugaacuauguucugaagucccacaccaccaugucugcuuuucuucuguuagaauugcaugauuagguccagcccacacucaaggcaaggggaacagggcuccaaaauaucaagagauuguaaacauauuuuuuaacuaccacagagaauuccuuccuaaguucugaguuuguauaagauuagaauuauuuguuccuagaaucuuggguagauuucacuuacaaaacuauggugauuugguauuuucuuugugggcaauuuuuaaagaacuaacuccauuuccuuaauaguuaaagggcaauuaaguuuucuaauacugaaguaauuuaaaguauucuuagaaugcauccauuguauucaaguuuuaaaauuuauuggcaucaaguugcuuauaauauucuuauuuucaccucugcugcauccauaguuaugacucauuuuuauuucuaauauuauuugcaccuacuuuuuucuugaucugucacuucugaccccggaacauuuaauacaaguuugcaaagaaaccaaauuagaugcuacugacccuaucauacuuuaauuuucuauuuaaucaauuucuaccucuuaccuucuuuagguuaguucuguucauuuuuuaucuaaaauucaaagcuuaacucauuaauuuucaacuuuccccccaaguacaagccaguuaaaucacaaauuuauaaauaucaauuagcuacaacuacaaguucugauguggaaucuuuucauuaucaucaaauuuucuacaucuucuaauuuuugucaugauuucuucuuucuuuuuuaaaaaauauagauagggucucgcuauguugcccagacuggucucaaauuccuggcucaagugauccuccugucagccuauagaguagcaagaauuacaggcacacaccaccaugcguggcucuacggauauucuuuggagguauauuuuuaauugccaaguauuugcagguauuuuccaacaauuuauuaacauaaaaaugguuaaaacaaaaaaaauuagaaagaauaguacaaccaaaaacuauaugcuucaccuauauugaccauugucaaauuuauuuucuuucuauauagacacauauguacuauaauacauucauuuugcugcacuauuuuaauaguuguauacauuacaauaccugacaucuccuaagaauaagaagacaaauguaucuacuaagaauaagcaaaaucuccuaaauaacaauuucauuaugccaucuaaaaacauuaacaauaauuccacaauauaucaugcaguccacuuucgcauuuucccuaauuaucucaagaaugucuaacagagcuuucaccccuagaaccagaucaaaucuagguucauacacuguaaggggcuguuacaacuuuuuuuuuuuuuuuucuacaauacucccuuucugaagagcccaggacaguugucuugagaaugucacauacucugaauuugugugauugcuuucucuugaugucauaaaggaaugcauguacuauuauaaaacacacacuuuauagacuuuauauagacuuuauagacuuuauauccuucauaauacaugggcaucuuuuccacuaaauguuuuaacuuaugagucaguauccauacaacuugaguacuaguuaugaagucugacuacacauuagcugaagugcaugauauguacaauuuauuuaauuauagcuuuaauuguacacaguuuuaaugauaugcauagcuguuauuugguagcaacauauucaggcauaaaugcuaaauaacucaugaaaugacaguaauccauauucuuucacucaaucgagccaaucugucguguuuuaccuuugauuuuuauuaguucuccaccugggagacuggcgaaaacccagcgagcauuauguaaggauauagucagcucuaucuguaaauucugcauccauggauucaaccaaccacaaauugaaaacacucagggggaaaaaaaagagaugguugugccuguacugaacacacccaaacuuuuuuugggucaucauucccuaacaauauaguauaaaaacgauuugcacagcauuuacauuguauuagguauuacaaguaauuuagaaaugauuuucuuuuuuuuuuuuuuuuuuuuuuuuuuugagacggagucuugcucuuguugcccaggcuggagugcaauggcgcguucucggcucacugcaaccucugccucccggguucaagcaauucuccugccucagccucccgccaccaugcccaaguaauguuuuguauuuuuaguagagaugggguuacaccacguuggccagacuggucuugaacuccugaccucaggugaucugcccgccucagccucccaaagugcugggauuacaggcgugagccaccacacccagccuagaaacaauuuaaaguauauagaagaauguaugcaguuacaugcaaauauuaugucauuuuacauaaggaauuugaacaucccugguuuuguuaccuauggggguccuggaaccaauuccccacagauacagagggacugcucgcuguauggcaucuaggccucuagaggugaggaggcauggcaguaguuauucuauuaggaaaagcggaaagccaacuuuaacagcauguguagcgagcaacaaagaaggcgauaaucaccuccauccaaaccaagcaaaaaaacucucucaaauaauaaugguaucauguauugagugccaauacauugugcuuuauguacauuacuugcaaaaugagguacaaauacaaaucuagaaaugaaaccaggacugaaauccaugucugucuuauuacaaaccuacaauucccacuacacaccaauaucagauaacagagagaucgaauugcacaauuagagaauaaauguauauuacaacagugaauaaacaaauggaaaugagugaaggaaucaaauuagauaaaaaaguagugagcaggaugacacugggagaaaaagagugaaaacauacaaacauuaauaccuucugggguuuauuauaaaaaguuaaaguguaauaauuucuuaauuaauugacaagacuacaaaauuaacuuuuacuucucccuuuaguuaaaucaguucuuacuucauauacauugacacuccaauauuagauauaaauaaauauuuaggauuuuauguuuuucugaugacugguacuuuuaucaucaagauauauccacuuuaucacuggcaauaaucuuuauccugaagacuauuuugucugguauuaauagagccacuccagcuuucuaaugguuaguguuugcuuaguacauguuuuuuccauccuuuuauauuuauuguaaauauuuuuuuaacuuuuauuuuagauucagggguacacgugcaggucuguuauauagguaaauugcuaugucacagggauuugguguacagauuauuuuguuaccuaggcaauaagcauaguaccugauagguagcuuuuuuaacccuuacccucuacccucaaguaggaccuagugucuguuguucucuucuuugcguccauguguucucaauguuuagcucccacuuaugagugagaacaugcaguauuuaauuuucucuuccugcauuagugugcuuaggauaaugacuuccagcuacauccacgucgcugcaaaggacauaaucucauucuuuauuauggcuguguaguauuccauaguguauguuuaccacauuuucuucauccagucuaccauggauugucauuuagguugauuccaugucuuuguuauugugaauagugcugcagugaaaauauguguguacaugugucuuuaggguagaaugauuucuauuucuuuggguauauacccaauaaugggauugcugggucauaugguaguuccguuuacaguucuuugagaaaucuccaaaaugcuuuccacaguggcugaacuaauuuauacuuccacuagcaguauauaagcauuuccuuuucuugacagccuuaccagcaucuuucuguuguucccugaccaggaagcauaaccuuuuuuuuugacuuuuuaauaacagccauucugacuagaugguuuugauuugcauuucucuaaugauuagugauguucagcaucuuuucauaugcuuguuggccaugugaaugucuucuuuuaacaagcaucuguucauaucccacuuuuuaaugguuuuuauuuuauuucauuuuauuuauuuuuuugagacagaguuuugcucuuguugcccaggcugaaaugcaguggcgugaucucggcucacugcaaccucugccuccuggguucaagcgauucuucugccucagccucccaaguagcugggauuacaggugccugccaccaugcccagcuaauuuuuuguauuuuuaguagagaugggauuucaucauguuggccaggcuggucucgaacuccugacgucaggugauccacccgccucggccucucaaaguguugggauuacagcgggagccaccgcaccuagccaaauguuuuuuuuuucugcuuaauuuaaguuccuuacagacucuggauauuagaccuuugucagaugcauaguuugcaaauauuuucucccauucuauaguuugucuguuuacucuguugacaguuucuucugcugugcagaaguucuuuaguuuaauuaagucccauuugucaguuuuuguugcaacugcuuuuggccucugucaaaucuuuccuuucccgguuccuaugaccagaauguuauuucccaggucaucuuccaggguuuuuauaguuuuagguuuuacauggaaguuuuuauuccaucuugaguugauuuuuguauaugauauaaggaaauggguccaguuucaauucucugcauauggcuagccaguuauccuagcaacauuuauugaauagggaguccuuuucccauugcuuguuuuuguagacuuugucaaagaucagaugguuucagguguauggcuuuaugucuugacucucuauucugguuccauuggucuauuuguuucugugcuaguaccaugcuguuuugguuacuguagccuuguauuacauaauaguuugaagucagguuaaugugaugccucccgcuuuguucauuuugcuuaggauugccuuggccauucaggcucuuuuuuagguccacauaaauuuuaaguuuuuucuaauucugugaagaaugucacugguaguuugauacaaauagcacugaaucuguaaaaugccuugggcaguauggccuuuuaaaaaacauuaauucuuccuauacaugagcauggaauguguuuuuccauuugugucaccuaugauuucguucagcaguguuuuguaauucuuguuguacagaucuuucacuucccuaguaagcuguauucuuagguuauauuuauuccaaaucuuuauauuuaaauauaauauacacuuuaaaguauaucucuuguagacaguauauaguuggagcuugcucuuuuaucuagucugaaaaucucugccuuauaaccauaauguuuaacccauuuaaaguaauuauuaaugauuaaguuaauggucuuguuuuuuauucauucuguuccacuguuccucauuuccugucuucuuuauuauucaucugauauuuuuuaguauuccauuuuaucaccucuauuggcuuuuuaccuguaccacuuugacaauugcucuagggauuacaauauauauccuuaaucuaucacagucuaccuucacuuaauauuguaaguucaucaucuuacaacagugcaauucaaucugucuuacuacuguucucugugcuguuucacgaucuuuuacuucuacaugauauaaacauuguuaacauuuuugcauuaaacaaaaaacugucuuucacagaaaauauguacuuuaaaaaagucauuuauauucuccuacagagagaucaauucugguucucuucaccccuucauuugaucugaguuucugacuggcaucaguuuccuugagacugaaggacuuauuuuagcauuauuuacagugaaagucugauggugaugaauucuuuuagcuuuugcucaucucaaaaugucuauuuuguuuacauuucagaaauauauuuuuguuugauuuaaauuuccagauugacaacuuuuucuuucagcacuuaaaagguuccauugucuucuagccuccauuauuucugaugagaaguuggucuucguugcuguuguuucccuauguauaucacguaucuuccccauuccugccccucuagcugucuuuaagaugcucucuuuauuuuuaguuuuaaguaauuguacucguugugcuacuaugauuucuuuugugauuacugggauugguguuugcugaccuccaaugauauguggguuuucuucaaauucauaaaucuuucaauaaucauaucuucaaauuauuuuucugcuccaguaucuauucuucugggacuccaauuacacauauauuggcccacgagucacagagacuuguucauuucuuuuuccucuccuuuuuucucucuguaguuaacuucagugaaguuuucuucguaguuuccaaucugucauuuagcauauucagugaauuuuucauuucagauauuacauuuuuuguucuagguuuuccauuugauucuuauuuagagcucuacuuuggcugauauucucuaucugugcauggauacuguucaucuuuuccuuuaaaucuuugagccuauuuaccagagacaacauaaaauaguuggcugcuaauuccaugucucugucaucucugggucuauuucuauuuuuuucccuauaguucccugcuucuucauuuguuuaguaauuuuuuauacagcuggucauuguggguacuauguuguggaacauuuggaauucuuuuaaaguauguuuuguuuuugcaugaaguuauuuacuggcaguuuaaccuaguauuuuuaaagguuagcuuuaugcuuuguagaauugaucuaaaauaauucuuacucuauggguaaaguagcccuagucuuuaugcuauagacauccugaagucuuaauuaaugcccaaggugcugagcgagaccucuccaauuuagcuguuugaaauuaugucuuucagcacuguguaaucuccagaaccuccuuuugacuacaggccccaacaguuguucuuagaagagacuggcccugcacacguggaguucggcauucaguuaaagauucagaaugauccccauaaagguuucugaagcuucucuaagcagcucucuuccuuccagcagaagccuuacaaauccaacugcuucagcagccaugcacuccaaucacuguuuccuuuauccuacuaaaccucuagucucuauuugggcauuauuucccucagcuacaguuuggauagccagggugagcuuaccuauuggauuucccuucuccuaaggaucauagcccuaugguuggcuaucuaaugccaaauaaaacccaguugcuucaugucuuuuauccacuuuuacaguugaucauggagggaggguaaguuuaacacccauuaccccauuaaggcugguccuggaaguuaaaauguaucaauuaauuuuuauauacuuuuaaaguuuaauacauacucaucaagaaaacugaaaaaaugaacaauuuuucaagaaauuaaaaaaccaagcccuacaaagagcaucuguuuacuucggguauauuuucuucuacuuauauauuuguaacaucuuucaagaccaugauaaaugcuaccucaguuuacuuuauacuuucgacuguuuuguuuuguuuuuucccccauuuaacauaugaauuugaagaaaacccacauaucaguggaggucagcaaacaccaaucccaguaaucacaaaagauaaaacuaguuuuuuuucccauuuagcauugcaugguggacauuuucucaagacauuauacauaaacaacagaaucuuuuuacagcuauacaguaaaauccuggcguaauuuaaaaauaauaagcagucuuuuuuuuuuuugaaggauaaccuucagggauaggcaaauaacauaaaugugugaugcagcuggaccuaauauaaauaagauguggugggccauguaguaaaauggaacaaguugaaggcauucacauuaaaauuuuuguaaaauuuuguaaaaugaacggugccaguccugguaagggaaccguguguaagagaaaggaggauagagaagauaagcugaaaacucaaguugcaaagaaauuaugaaguauuuuaauucuguaagcaagcaauuuuaaaguaaguauuuuuaauguaaacuguucaucucagaaaggcuaaaaaacacauuaaaaagaagaaaauaaauauuuugaaaacuguaucaucacucccaacauuaacaaaaagcaacauuuuuugguguauuuuucuuccacucucuuuugccaagauuaggauuuugugugugugugugugugugugugugugcaguucucuguguaaaacuguauuaacuauacggcauuuuuuaaccccacuaauauuuuaacaaaagaauuuacuaacguaguuacaugaagucguuaaacauuuuaaugacuacauagccauucacauuuucccauuuuccucuguccugucuuuuaauagggauucaguauaagugaaaaaaacaccuaaguuuuuuuggggguuuucauuauaaguaguaacuucuauuuucacuuguuuguucugagaugucuucuacuuaauagagaaaacuuuucauucuaucagaaguucauuucuauuuuguccuacuuuuugaaaaucaucccacuguuguuugcauuuaacuauguauucaucuggaauucuguugauaacuguuagggguugaggcuaauuuauucucucucucugccuguuuaaacagcuaaccaacugcacuaauaccauuucuuaaauaauccuccugcugauuuguugaugccuccuuuaucacugauuuguauuaguauuauaacaaaaauacuacuuaagauucugaauaaaaaaagaacaagaacagcaguaacaaacaagauuucacaauuagauauuacugaauguaacauuuuuacauuuggaacucaagggaugaacaacuguaguccaaaacagccaaaauaugcaggucuaaaauauaauuguuuuguuuuuuaaucugccacaauaacuccagagcccauuuaucucuuuuaagucauagcaaagauuaacacauguaaccucagcuauauaaacaaguaacaaacacuguacaacugacaucccaaaacaauuucuuauaaaaccggauuucucuugcuggguuucaguuacagucccucaugggucauugucuucauuauggaaagcccugucugagcuaccucuccauuguuuauacugcacugccagugcuggaauaugcacuccaacuuacuuaaaaacugauuuuaaacaauuauagagauuuuauucuauuauuuaaagcaagacauaaaucguacuucucuccaaauaggcugaaaauguagguaauucacaacauuucacaucucacuuuagaagucaggaaucccaaucacaucucacuuuagaaguuaggaacuccaaaaugucuuucuagcuuaauuccucucugccuucaacaggugccugcaacagguugaaauuugguaucuuuauaucuggagacuacaagcaaguaaacuaucuagcauaaccguuuccuucuauaaaccugcuugcugacucacaucuucccuauaggacauuauuaaaugauuuuguaauaauauuuuuauaucaaaggcuaaucacauauuuucuuagacaaccuaauuaaacuuugaaacaaccuaauaaaaagcuguuaacuucucagauucuaaauguuaaaagcagacacaauacuuuuauaaauuauaugaauaacuauuuucuuuuaugaugggagaggaaguggaagacagagaaaaaauauaaaaagaggacgggaaaaggguaagaacaagagaggaaaaacaagaaaacaaaaaggggauggagaaaaauucaaggagcaacaaaagacagggagacaaaauaggagguucugaauuuuccacuacaaacacucuguacuacagaaguguugaggaaauacuuccuuucacaauuuauuggcuauuaucuugugucuuuagacuagauaaaaauguaauccauauuuauuaaacacaagcuuuaaaggagauguaauaauacaccaaugcaaauauuuuggggccaccuacagagucuaccuaucauagugacuaucaggaaagguggggaauucaugauuaauuaaaagaguaaaaggaaauacaaauguagguauucaacaggaauaccuacuaguuacccagagggaagucauguaaagaaggauuaaaagcaagaaauaccuuuggaaagagugacaaacagauacaguacacccuaggggaaauuaguucagggaaacuguuaaguaacaaacucugaucaucauuuucaggaagccaaagacugggcacuuaauuucagaggcagagcuggaggaaaaagaacaaagugauaaaaggagcugagaaagaaaacccaggcuuaaaugggcuagaagcaaagauggaauaagaaaguaauacagagagaaaauuguaaauacuuaagcauugugauaagaccugcuauuuaauaaaagugggacccugauguaaauuacccacuacuuuucaaguuuguacccaaugauuuccuuauuaccaugaauauaaugaaagcuauaaauagcugaaacccuuuacugaggaagggcaucaaaaguaaacugcagccccaaagaaagguagcacccaaaacucggaugggagugggaguggccaaccaucaaagaacaaaagggagcuugcuuucuguuuggagguuccucaaaucuauuuaauacaggaaaaacucuuugguauguaaauuaucucaaucaaccuguuuuaaaaaaaucagaauccacauaagaagugcucaauaauuacuuguaaaauuaauucuaaguagaaaaauuaagugguuuauacauaacacuggcaccaaauauggccauuuccucuucaccucuguaauuuaagcacuuugccacuggcuuauaguauuuugcaaagguucucaacuucaguguuacaacacauucaugaaauauauuacaaguaauugguuacuaaaugauaaaaugaaauugguuacuguaaaggauaaacuugcagacaacauauaguugagucuuguuuuuuuauccacucugacagucuuuuaauugguguuauuuaaaacauccacacuugaaaugauuacugauauaacugaauugauauggaccauaucuuuaacuuuuuacuauucauugaccauguuguuuccauuucucuuuugucuuccauucugaauuugagcauuuuauaugauuccauauucucaagucucuuagcaaccaauuacacuuccuuuauuaacaaauuuuuuuuauugguugcucuagaguuugcaauauacauuuaugacuaauccaaguccacuuucaaauaacacuauacugcuucacgauuagcgcaaguaccuuagaguauucucaauuccuucaucccagcagugaaugacacuguuguuauucauuucgcuuauccaugagcuguacucaaugaauacaguguuauuauuuugaacuguuaucuauuagaucaaguaaauauaagaaaaauaaaagguguuauuuuauuuucauuuauuucuucucacucuuccuuuauauagaacugaauugcugaccuuuaucauuuuccuucucucugaagaccucuucacauuuugugcaaggcaguucuaccaguugacaaauuccaaguuuuguuucucugagaaagucauuauuucucuuucacuuuugaagaauaauuuugcuggauacaaaauucuagguuggcgguuuuacuuucuuuuucuucaacaccgauauuucacugcacuuucuucuugcuugcaugcuuucucaguucaaauaugauauaauucuuaucuuuauuccucuguagguacagugguuuuuuucucucuggcuuuucaagauuuucucuaauuuucuacagguugaguaaaauaugccuaggcauauuuuuuuuugguauuuaccaugcuugguguccucugagcuuccuggauuugguguuugucauuaauucugggaaauccucaaguuauuauuacuucaaauauuucuucuguuccuuucuuucuuccacuucugauauucccauuaugcuuauguuacaccuuuuguaauuaaacuauggaauugaacuauggaauuauguaauugaacuauguaaaugaacuauggaacuauguuccaucuuuuucauucaacugaagcagcaaaccaagcaucagaaccagacucagauaugacagauuuuggaauuaucagacugggaacuuaaaaaaacuaugauuaagacacuaagugcucuaaagaaaaaagaagauaaugaugacuaaacacuauguguuuaauuuuuuucaucaguucauuuaauacacaauuacugacacuaaagauuuuaguuuagaggaaaaguguauacuuacaauacuuuaaacuuuuaaaaugaggcuguaggauuauauucaaaaacauuaaaauuauggaauuaugaauuccaccuuggaggacuuaagaaugauugaaaauaaaguaguccccccucauucucgagggauaucuuccaguacccccaguggaugccugaaaccacagaugguacagaacccuauauauacuauguuuuuuccuguacauaccuauaauaaagcuuaauuuauaaauuaggcauaguaagagauaaacaauaacuaaugauuaauuguaagaacaaaauagaauaaauaguaaaauaaguaauuauaauacauaguaaaauaaggguuacuugaacauagcacuaccauacaccuaacugugaugacuaucaagugacuaaaggacaggauggagcaggauggcacaagauuucaucacacuacucagauuagggagcaauuuaaaacucacaaauuuuuuuucugguauuuuccauuuaauauuuuuggucugugguugacugcaaguaacugaaacuucagaaagugaaacugcagauaaugggggacuaccauacuauaacuuugcaacaugagacuuuggccuaauuguuguuguuguuguuguuuuguuuuuuugaguuggagucucgcucuguugcccagguuggagugcaguggcaggaucucggcucacugcgagcuccgccucccagguucacgccauucuccuaccucagccucccgaguugcugggacuacaggugcucgccaccacgccugguuaauuuuuuguauuuuuaguagagacgggguuucaccguguuagccaggaugaucuugaucuccugaccucgugauccgccugucuuggccucccaaagugcuuguuuuguuuuuaagaagaugacuccucuaauccaguaguuucucaaacuucgguuucaguuagagaaugagaaucucccggaagacucguuaaaacaaacacugcuaaccauagcccaagaguuucuguuauagcaauucuggguugggggagcccccaaauuuaaauuucuaacaaguucccagguggugcuaauagggucauaauuugagaaccacugcuguaaccaaguagcacaauauaaaauacaauuuuaaagcugaaagggucuuuaaaagcaagaucuuuggaccccugccccccacccaaaaaggaaggaaggaaagaaagcucuacaucaguagccaggguagccacuuguaugaauuugaaacacuucaggcccucacaguuguuuuccuauuuuaguccuauuucuuccauacuucccaaauaaaucuaccuccuuccuuaucugcccucaccgacaggcuuccuuugccaccuucaggcuuuggccauaacucaaacaaguuaucuuagccuugggucuugucuccuaaaaaaaaauagcucaaacccucugcuaggaccaaacuuaaaaaagccaucuccaauucaauguuaaggggucuuuaaaauuccaaguuuaucucuugggaacuaggcuggaauacaaaauaacuaaccaguccauaaaacccuaacuacuguuguauacucagucacgaaagguugcugaaccaugugguagucaucugcucagugguuuuuagaugaaggacacaauggcuuucauuuggaacacacauuauuaaaucuagguacauagugaaagauaugggauugggaaaacugaaacucucaacaaaugauuacuucaguuucacaaaugcaauuuuuaaaaguaucaauugcuguuaaguccuuuauucuguaaaguguaacaucaguuuaauaucuuguuuugggagaaaauuaccacauuauguuaucaaauacagaaacaauauguagaaaaaaauaaaagugccucuaagaaugcaguaaacaaaaaaagauauucacuaguaccuaccacuaggugaaaaauaaaaagaugcaaaauuguuguccccaccuucaaauagcuuguuuauuagaacagcacuggaaaaaaaaugagugauuaagugauaaauuguacagaacucacuacacacuaugaagucaagaaaaggucaauguguacuacaguagcuaacgaauguuucagaguacuugagcuauggcuucaacaaugauuaagauguaauuaaauggcugggcgcaguggcucacgccuguaaucccagcauuuugggaggccaaggugggcagaccacgaggucaggagaucaagaccauccuggcuaacacaguguaaccccaacucuacuaaaaauacaaaaacaaaauuagcugggugugguggugggugccuguagucccagcuacuagauguaauuaaauaggguuuggagacaaggaaaugauguaaaacagaaaagauguaaagcaggaauuaaaguaggaucacagaauauaaggcaaacagugagaugccugagggacugaaguggauguugaaugcuggugaauagcaagaaggcuuauuuugacugcaauauacagcauagugcaguggggaaaaaggacaaggacacagaacagcuauguugcugcuguaauaauccaggaaugacauggugaaauacugaauuauggucuuggcagucauauuagucuguuuucaugcugcuguuaaagacauaccugagacuggguaauuuauaaagaaaaagagguuuaauggacucacaguuccacauggcuggggaggcuuuacaaucauggcaaaagucucgucuuacaugguggcagacaagagaagaugagagucaagugaaagggguuucuccuuauaaaaccauuagaucucaugagacuuauucacuaccaugagaacaguaugggggaaaaucgucccaugauucaauuaucucccaccaagucccucccacaacacaugggaauuauggaagcuaaauuuaagauaagauuugggugggggcagagccaaaccauuucauuccacccugccccccucaaaucucauguccucacauuucaaaaccaaucaugccuucccaacagucccucaaagucuuaacucauuuuggcauuaacucaaaaguccacuguccaaaaucuuacccaagacaaggcaaaucccuuccaccuaugagccuguaaaaucaaaaagcuaguuacuuccuagauacaauggggguacaggcauuggauaaauacuaccauuccaaaugggagaaauuguucaaacgaaggagcuaaaggccccaugcaagucccaaauccaguggggcagucaaauuuuaaagcuccaaaaugaucuccuuugacuccaugucucacauccaggucacacugauucaagagguggguucccauggucuugagcggcuccgccccuguggcuuugcaggauacagccucucuuggcggcuuuuaugggcugguguugagugucugcagcuuuuccaggugugcagggcaagcuaucgguggaucuaccauucuggggucuggaggauggugguccuuuucucacagcucugcuaggcagugccccaguggggacucuguguaggggcuucaaccccacauuuccauuccacacugcccuagcagagguuucaugagggcuccaccucugcagcaaacuucugucuggacauccagcuguuuccauacauccucugaaaucuacguaaagauuuccccuuuuagccauggcuggagcugcugggaugcagagcaccaagucucuagguugcaaagagcagggaggcccugggacuggcccaugaaaucauuuuuaccuccuaggccgcugggucugugaugggaggggcugcuaugaagaccucucacaugcccuggagacauuuuccccauugucuuggugauuaacacuuguuuccucguuacuuaugcaaauuucugcagcaggcuugaacuucuccucagaaaagggguuuuucuuuucuaauacaucgucaggcugcaaauuuucugaacuuuuaugcucuguuuccuuuuuaaaacugaaugcuuuuaacagcacccaagucaccucuugaacgcuuugcugcauagaaauugcuucugccagauacccuaaaucaucucccccaaguuaaaaguuccacaaaucucuagggcagggguaaaaugcugccaguaucuuugcuaaagcauagcaagaacccaguucccaacagguuaaucuccaucagagaccaccugagccuggauuucacuguccauauuauuaucagcauuuuggucaaggccauucaacaagucucuagggaguuccaaacuuucucacaaaguuccaaacuuucucacauuuuccuaucuucuucugagcucuccaaacuguuccagucucugccuguuacccaguuccaaagucacuuccauauuuuuggguuaucuuuacagcagugccccacucuaccaguaccaauuuacuguauuaaucuguuuucacaccguugauaaagacauacccgagacuggguaauuuauaaggaaaaagagguuuaauggacucacaguuccauguggauggggaggccucauaaucguggcagggaggccgcacaaucaugguggcaagugaaaggcacaucuuacauggcagcagacaagagagaaagagagagcuaagugaaagaaguuucccuuuauaaaaccaucagaucucauuagauuuauucacuaccaugagaacaguaugggggaaaacugcccccaugauucaauuaucucccaccaggucccucucacaacaggugggaauuaugggagcuacaauucaagaugagaucuggguggggacacagccaaaccauaucagcaguggaaauaggaagacaaggagaaauuuaagcuacacugcaaacugggaaacuuguuaaaauacuggacacgaggaugagagaaaaauaaaagaugaaaccaaugcugccagacugauggaaagaaggaaaagugauaucuacuaucaaaagaauuagaguaacugaaaugaguaaugaaaugaaaguaaaugaaaugagaguaaaugaaagcaauuugagguggcaagguacuaaggcauagaaaaaucgugguugugaaaggccaaguuuaaggugacauugguuguggcaaccuguacucugguacucugcuccaguucccacccagcucacauccuuuucuucucuacuauuacuuuauauucuuucuucuacuuguacaucgaaacuuaacaugagaggauugugauuaguuaguggaaauccuauuccuuagucaagcaaauuuucucccaagccauuuuccucuauuuauucacauuauuggcaaagcucacugucaucauaacucugaaucuaauuucugcuagugagauuaacaaugaccaaguaaguauacuguuaaguguguuuggauuuauagcccaucccuugauuuuucauuaaggccacuauccugaauuuugucaguaaaaauauuauguccucacugaaucucucccucaccuaauucuguauuuguuuauaccacugcuuauacgccauuauugcauuuaacaaaacuuacuuuugauaaacucaauugaugagucucccacaaaagagggugaauguuuuaaagugguaagaaugucuuauacuuuuuuaaccuuuuuaugccuuguauguggcagucauuaaaacaaauguguacugaauucaguuuucccugacuacaugauucuauaaauucagaauuuaucguugaccuucugacuucuuaaaaaccuguacauguagaaucugccuaaaaugcugcuugcuaguggcuccugcuucagaaaaaaggacaugcauuuaauaauaugacaguuaaauuuugaucauagauugcuuugauauaucuuauuaauagauguaaugacugcaaucaaauuacggaagugauucacuuacauuaacuaaagcaucuuguuggaauacguuucucagguucccagaagcaccaacuuuacucuaagcaagaugucacugaagugacacucauccaauuaaauuuuuaaauuucaugcuuacugcaaaaacaaugguaaguucuugguguugccauauagaaauaacauauuuuacugucauauuguagacuacugauucugcaagugauuacuuuguuucagauauauucaaucuccaaauuccuaucaacuuuacauauuagaaaaugagaguguuucauuuaaauucaguaaaaacucacuaaaauggacuuaccuuaggaaaggccagucuaaacuacugaaaaaaauuaaauuacacaacucagaucauuguuccccugggaguugacgaaagguucgugagacauguuucacaagcuggaucuuaaaguuagacacuuauaucagcagaaacaacauucuuaagguagcagguaaugggaccagaccagcacauacguaaguagagaaauaagauaauggaagcaaagaaaaaggguuauggauagugcaaauugaagcagccaguucauacaguaauccccuguucucguuuguuguuuuuuuuuuuugagauggagucucacucugucgcccaggccggagugcaguggcgugaucuuggcucacugcagccccugcuuuucccagguucaagcgauucuccugccucagccuccugaguagcuggggcuacaggccccgccacugugacuggcuaauuuuuuauauuuuuaguagagacgggguuucaccauguuagccaggauagucuugaucuccugaccucaugauccgcccaccucggccucccaaagugcccuguucucaucuuguagcuacuugacaauacaggugcucaaaacagaaaagccacagaaaaacagaaaaacacacaaaccaagugcucuccaugcuugguuuauaccuuaaaacuaggcaucauaaauggcaagacaauagcccuagugacucucccuccccaagauagccauugcuguaaugcuucaucuauaagagagcucaaauuaaaaauuacugauuuuggaaagaaaaaggguggcaauuauagggcauguguaucauuacuucuuauucccaugcccuugcuagaaauaucacuaaucaaucagacuuagcaugcaaguuccaaucaauuugcuaaucccguguuggaauggguguaaagguauccuuugcuaucuaaaccuuugcuauucaaauuuagacaacaaauggguucagauaauuuauuuuuuuuauuucagauaaggcuauuuggaagacaugguaguguguaccauauggacucaugccucccaaaaauccaagacauaacagauuggaaucugucacuuucugaucuuucacuuucugcacucaggaaaaaagcaagacucaaauaguaaggaauaucagaauuuuucaguuugugcucaguuacgaggaaauagaaaauuucaccucccacacaacuuuuuguuauauauauaugagcuacgguaauagaugccugauagagagguuguacauaauuaaccaaaccucauguuucuauuuugucuuauaaauaggaggcauacaguuagugaaauagaaaaaguaaaugccuauuuacagucgcaaaaaaagaaaaaucauguuuuaagguauuuauuuauguggguugagugccaaauaucuuaaucucauagucagcaaguaagugcauuaaggccuuaguguuuauuguuccuuauuuuauuauccuacccaaggcaggaagauucuuccuccuauuggcccaugcuucucaucuuuaacucgaacuuagaacccuccaaaaagcagaagagaaagcaacuaaaagacuaaacagaaagagaaugguagaauaggaggcacuggacaagaguggucuacuuugcucagagauguagaauaaccaucuuacuaucauguuccuuauaauuuacaaagaacauucugucacgauuacuuauuaaaauaucuauccuagaugaagaggaauagcugugaagcucaacucugcacuaaauuauucugaaagaguacauacuuuucuuauuuauauaauugaaucuacaauaugacauucacugccuuaaaauauuacauuacuauuaugggauaagguuaaacaucucuuuauaaagaagacaaaacaaaagcagcacacaaacagccucccuacuacaaucucucaaccagcaguuaguaaacuccccaacaaccaggauuacugcauagccuuacuuuugcacaauaaacagcucuuaacuacuuuaaauguaauauaugcucaauaaagauuugcacaguuaaucucacauaacagaacccuugcacaagguagcaauaagcaaguccuccucagcuaacacccaaggaaacacugacaaauccuaauaauucauccaaugaaaauguucuguugauugccuaugauaaauuaauuauauuagucuuucauugugcuuuugguuuuauuauuguugucaauauugauuuaguaacaguguuagaaucucaggaaccuucacggucacuuaguaaaaaucucucauuuuguaaaugaggaaacuaaggucuacuuuuuccacagugcauuaccuugacacuugucacuucuuuuccugguccccuaacugaauaaaagagaaguuuuauugcauauuuuugcuuaggucaauuuuacaagguuaauauuacaagugaaugggcauuccucaaaugccagucucuggcauacuuuguauauagcagauacucauuuaaguacuuacaaacucuucuugcuuaaaguccucaaauauaaguaaaugauaaggcuuauuuuaauuuucauuugcacaauuuuagcaugcaauauuauuuucuaauggaaaaaguaaugcaacauaauucuuaauccaaugcaucuuucauaacaagacacuucucucuuuucuaccacuaugaagcucauuuuccccaauuaauaccaaaaauuuacaguuagacauaaaccaaaucaguccugcacauaccaucauucaagacaccuuucaauggagagagcaaauuggucaaucauuuaaauauguacauauccacuacccaaccuaaacaagacaagaaaaucaacaggcuuggaauugcuuaacuugcaauuaacuuuugucaauagggaagacaauuuuaucaguuuaaaaucauaggagagcaaggaacugccuuccuucuggaaccagaaaccauguugggacacagcuagccucaauacggauaugcaaaaugcaucuuaagucuuuugugugcuugguauugaagacaggcuaaacucaggguagguaggaggucaaccuacuaaucaaaaauacauggaagccagcugaugugcuagucggucuguauuuuuaaagcaaaaugaaaaucauagacuuucaguuaaaguaaacucuaaaguuaugaauuuauaguacauguuuuccacuguagcugaaggaacaauauuucucaacagaguuaauaaacuaccugauucaaaaaccaagaauaaaacugaaccacugcauucuaggauggcggacuguaaucagaacuaauauggcaucacuauguaaaccuucuggaucaccaaacacagcucccuguaacuaagauggaaacaagagauuaaucacuuaauaucuagauguugauugucaucaucauaagaaaguaaaacaaaauuguucaauuuggguuuuaacuagaauucagaaaacauccaaaauagaucauauauauaauucuacuuuuauuauaaucuucagccuaaaauauagcagauacagaaguauguaugccuuacaggauugaauaaagauaaggaacucugaccccagcauuuuuuccagggucuaauaaggaaucaguagaaucuuauaggucuucugucauuguuuaucucuuuccauaaagugggcaaaacgauagaucuuauaugaccguuuuaagaagaggcuuaugaggucuugccugcaaauaaaguuacagaaauaaaaacaguaauugauaacaaauucuuuuaagaaucccuaaauuugaguaaaugcaguauuggaauauuuucuaaaauaaaacaucaggauuucuuuugaauuuucagguacaaguuuaauacaaguugacuaucucuuaucugaaaugcgugggaucauaugugcuuccgacuuauuuauuuauuuauuauuuuuaguuuuuuauuuugaaccagaguccugcucugucgcccagcuggagugcaguggcaugaucucggcucacugcaaccuccaccuccuggguucaagggauucuccugccucagccucccaaguggcugggacuacaggcgcacgaugccacaccuggauaauuuuuuggauuucaguagagacgggguuucaccguguugcccaggcuggucgcaaacuccugaacucaggcaaucugcccaccuugaccucccaaaguguuaggauuacaggcgugagccacugcgccuagugugccuccaauuuauuauuuuggauuuuggaauacuugcauauguguaaugagcaucuuagggauguaacccaagucuaaacaagaaauucauuuauguuucauauacaccuuauacacauaaccugaagguaauuuuuauacaauuuuuuuuuuaacggaguuuugcucuuguugcccagacuggagugcaauggugcaaucucggcucacagcaaccuccgccuccuggguucaagcgauucuccugccucagccucccgaguagccaggauuacaggugggcaccaccacccucggcuaauuuuuuguauuuuuaguagagacgggguuucaccauggccaggcuggucuugaacuccugaccucaggugauccgcccgccucagccucccagagugcugggauuacaggugugagccaccgcgccuggccuauacaauauuuuaaauaauuuugugugugauacaaugaagucagguguggaauuuuucacuuguggcacuaaaaacguuugggauuuuggaguguuucagauucuggagcaucuugaauucugggggauuuuggauuagggaugaucaaccuguaucuauguuacagccucacugcaaauauguuauucacucccacucauguagguaugaucucaauucacaaacaggcagaaaccaucucaauccuauuuuuuccacagcaauuuuauucuaucaggguuucaaguaaaacugccuuaaaaagguaaauaaaaggacuuaguaaauguguuuacuguugcuuacacuaaaaaauuuucacuaaacuacgaagacacugagagauaagaggaagggaaaacuugcuuugguauuucuuuuuuuuuuuuuuuuuuuuuugaaguaaccaaagagggguacaauuuaagcuaaaagaaguuugcaguuagguuggguuguggccuuguuuuagguaaaaauacauggguuacuaguuuucuuuuuuuuuuuuuaacaacaaaaagcuaauuuuggaauucuacuuuuuagaaaauacaaauaaccuuacagcauauucaauacuaaagcacaugccuacuaagaaaucuccuuucuagugaauagugucagugauuuggaccuuuugucuauggaguaagaaugaguaaggguaagaaacaugcaagcuuguuaaccuagaguuaacuugaagguauucauaaccauauuauagaaacauaacaacauugucaauuuuguacuaaccuuauuuucuauaauuaccuuuaaaauauauuuccaacucuuuuccacucaacuuugaaugcuuuuuuuccagacucauuuaaugccugauauuucaaugcacauacuuuuaucaaaccauauuucaguuuaauaaacagaguaaauuaugaacugauaacuuauuguccaaaggccuacaucacauacuauauuuauauuuguagaguaggaggacaaguacagacuuguuugugauaugcaagcccaguaauuuagaaacuaugauaaaccaaaugcaaaacccauuugauaauuuuuaaaugucacauuucuuuugaguguaauuuuaaacucucauuaauaauggcaccaaaggaugauucaggaaguaguacaaaacugauagucucucagaauauuaucaggugauaaaauaauuuguaaaauaauauuauugucucaaaaaugugaaauaucuaacugcaaucaucuauuaaaaaugauuuaauacauauauacuauuucuuaggaauauaugguaguaaaggaguuuucacuuuugauaucuuuauuuuacauagucacuugaugaauaauauaaauccauucuuguggagcaggggguaugacacuauuaaguauauuuacuaauuuuguuuauuaucuacaaauguuguuuauuccgaaauuuuaaguauauaaaaaucauuuuugcaaauaggauuucuaaaguugaucauuagaugccaauaaguguaucauuacaauuuuaaaacaaaaauauaaauuuucauauuuugggauucacguguuugcugcccauuauuuuuucagagcaaguaccaaaaacuggagugcacucuacuucagaaguuuuucucauguuaaagucagagcaguuaggcuguaauggaugugccaauauaaaaaaaaauuaaauuuacacauuauuugccaaaaagugcacucgacuaucaucauuauucaaacauuucagucaguugccuccacaacucacuuauuuuaaaacuauaaagugaagauuccuuuccccucuuguucucauaaucaauuaaaauauacauuacucauucaacuuuuaaaauuugucucucuuaaaagauuuuaguccauuaacuuggauuucccacaucugaauguaaaaccaaggugcuuaauucaauuuaaugaugauuucagaaacacaaaguuacgucacguuacuagagguuaaaaacacacacacauacacacugguuuugugaaaaccuugauggcaagcaagauauucaccaucucuucuuuuaaauuauagcuuuaaaaagggggugaggguauccauugaagaauaaagccugcuuucugucacacacacacacacacaccccaaucauaucuaucagaccuauucaaguugccacaacaugacuauugucaaagccaaaaaaauucuccuuuaaaauauuuaaacuucauuuuaaaauuaaaacugaaagcaagauacucaacugccaacuacuguugaugaaacuauuaaagccugcacugaccuacuucauaucagcaucaugacggcauggaugcaugccaagaaaauaaugaaaauuacuauauaacuaaccuaaaucuuguauuuaaaaauugucacuuuaaaaaugugcaaauacuguucaugcaacgccaguugcuuuacgauauguuuucaaaaugagaaaaugaguuuugauauuuuaguacucauauucaaugauggcccugcaaagauuucauuuccauuuucaaaaucaaggcuuuuuaaaauaccauauaaaauucuuuuuaaacuucuauuaaaagcaaucuuagaccaaauuccaaauauuacuuuccauuuaaaaaauauugcuacacuuaaaaaaggcaguuaaugaagcauccuacaaaacaaugcaaguucauguucaaagaauauugcaauggcucuaacaguggauggacuuaguguauuuaauuauuaaaagauucccacuagacuuuaggaguuuaaugcugaaauauuggaaauuuucauacaagaaaguaaaauagcgaaagauauuccaucaaugguuucuuuuaaaaagacauacaaauggcaagacauuugauucccuauauuuuaauuuaaaaaaaaaccacuuuguuguaaacuaccaucuuaaaauauuuuauacuaaaaaagcacuuucuucacaaucaaugcaaagaauaaacucccugaaaaagaaauuuaauauuaggauaagggaggcaaaaacauucagaaauagcagcuaacccaacugaaaggaagagacacauuagguuuugugcugcauauuaauauucuuacgcacaguaucuguuuggugaaaauucacaauacacuucuuccuccuucuauggcugcaaaaaggaguaaacacauuucacauucuccaguuccaaauucaugccaccaucaugcaauaugacuuaauuucgacccauauuucuguuacaaugagugaaaaaauaaaaccaaaaaacuuguuuaucugcacucacaauugaggaagggguaaaagcauuuuuuagcuaagaagacaggggcugauugaugcaaaguccgcacaccuccagagauccuacaaaugugcacccgacuggggaaagccacauucaaugaaugcaucagccuccuccuccgcuccccccgcccgccgccccccacccacuuugcagcagaaaugugccugggcuuuuucacgcgagcgauggaggauccucuuaccagauggaguucuugaucuuguguugcagcgcgcuggccucugucccuggcagcccgggcacaagggcuggcagggccacccccgaguugggggcgcuggggggaagcugcugaugggcaucaggcugcugugguggcggcuguuguuguuccucugccau

SEQ ID NO: 192070 - RNA, 166714 nt, Homo sapiens
cucccgcuucuccuccuccuccuccacaguugccugcccugggcgggggcgagcgcguccgguuugcuggaagcguucggaaauggcaacuugcgcgguggagguguucgggcuccuggaggacgaggugcggggaccgcggggcugcggggcgggcuucccuucggguuauucagcagccggacccggggagguagcggcggcggccacgaccggaggcucugcugucagccccuccucccucggcgcgagccuggggagcgcgcgaggcgccgcggggacugugggggcggcucggcgcgcgggcgcugggggcucgcuggagggagcaagcuugucggguccacacccgccccuucccggagcggccgccgccuuacuugucaguuuccuucaggaaguguugaggagggggcuaggcggucggcgggggacccacaucaccgcgccagccccuuccugccacccccgccgggugugcggagcucccaggcguugggagacggucgcagcauccccgcuguugauuugcuugcucuggcggaggccgggccgacuuaacuuuacggacuucggucuggagaguuccaagugaauugucauucgcugguuuguuuuuuucuucuuuaucugaaauccuuuuuaauccccuaacuagagacagggaugggagagcaggaacauaaauuuuccuccuccucuuuagcaacaagugucuagugugagaaguucaugcuuuauuucaccggucgucguugauguuaaaaagugaagccaaaaaaguauaaauacuuuauaaagaaguuaccacaucuguucccuuugaaaacuagauuaagcucugggauuugaagaaggcaaagcuguuucuuuucagcuaaauaacuaaugcugauuaugccuaugcuuauuaaaaauauuguacgaccauuuggaaagguuguuccgucguaaaugauauguggcuucuguguguucuuggagauugucucaaaaaugcaaaugggugggagaugaaaaggcugcauguagucuaacagugacugguuccgagugaaaaaaaucaaguuuuuugcuuucuuguuggcugacuaagcugccacauguaccuuuuaucaagaugagacccaguuaacugaaaauccaucaaccuaauuuauacugcuugcuuaaguauuguaauauuuaaguuguauaguuccuucucuuaguaccuuggugucgucaaacauuuuacacuucucuugagaguucuuuguuuauaaagggugggcaauuuguuaaugcaguuauuucaggauauuuugagaaugcuuacgugaugcgauuagaauuuaauuuccuagcuauugcugccagaagagaaauaaagugaugauggacaaaugguggcggcucauagucccucagaaacaauagucaauguguuacagcuaaagauaucauucuagcuaauggcaccuuuauucuguagacgagaucagaagauaauacagcacuucaccuguggucgcuuucuuaucagucagauuucccugcuugcuacguagacugcccagugcaguugacuucaaggugguguccaacccaaucaggcugaccuuggacuuucuuucccugcuauauucacagguaggcccugcuaauugcagauuucucaucucaccgccuuccagcagagccaguugaucuuaaagaaaauagugccaaagguaucauucaccaucuguuuucucccucuugguacaugaucaguguuuuuaauuaucuacuuuaguaauuucucuguuuucaaucaucaccccucugcccagcugaaauaaaacuaauuguggcaguuaauggguggucgguaaggaacuggggccaaaggccagaaacuccacccuuugaaauguggauuuccugaacuugcugaaggauuuguacuucuaggaaguuucauggacuguggccuaucccauucacauucugggaguucuggcugucaguuccaugacucuaauuugcuucuguccccgcucuauuuuguccacauugaggaagggagugagauaggaagauaagagacaugaugaugaagagucuuccacuucuuccauuguaauuggauuauucauucaacagacauucauuuacuguuugcucuguaccaugcauugugcuaggcaccagggauagagagggaaaaaagacagucucagccucggacugagggaaagauaaaagucacuuuuuuucuuguggagguugcccucuccacuaucauuugccauuuauuuucuggucuaucacaaaaguaaaagaaggauugaaaccacacucccccauccuccccacccccaaacaccccuuuuguuaaaggaagaaagcauugcagcuaugucacuucuaaaacucacagacuagucuggaaauaggcagcccucugcuguugauuaaaaguaaagugcuuuuucauuacaacaaaaggagaggauucuuauuuuaaauuugaaacuaaaacagggagaaaaauaauuugaaaugggauagaagauagugaaagaauuguaauuuaaucaguauauagugaauagucgcugagucagugucugagcauauuagcacugaaguaugcuaaaauguagaucauaauaccuuucucucacuuuucagugaguuuuggcucuucuuccacauauaagugacuuauaguaagagaucacccuggcugcaugugcaggauuuuaccuuuaaaguguuaacaaacaaaggaggaaguguaguauaauuuauaccagauuugcucuggucacuugagauucacaguagagaauaacaugcacugaucuuuauuggagagcagugugguggaugcggggacuggaauugagcaucacuucccaccuccuucccaugcaccucccugugauauggaggugggaaaacuaaacacuguuucccacacuccauugaaauuaauggacuggauccaaaguaggcuccccaguuaagugcacuuacuugagauuugcagaguggaaaugagguggagcauauuguuuuguuucuuuggcuuuuucugcugauaagcacagucauguaaacaucuaaauuuucugcgaaaguauuccaguaucugguaacuugcuuuguacauauugauaggaagucaccgaaguaguggugguaguggcuuccagacgucaagauugauuauauucuugaagucaucaguucuggugaugacuccugaucaucuaccuuucugacugggagagguaguagcuuccuggaugggucaguucugccauguuucugaucuucuagaacugcaguccccaacuguuuuggcaccagggaccgguuucauggaagauaguuuuuccauggaccggggaugcgguccagugguuucaggaugauucaagcacauuacauguauggugcacucuacuucuauuaugauuacauugugauauguaaugaaguaauuauacagcucaccguaauguagaauuagugggagcccugagcuuguuuuccugcaacuagauggucccaagugugggugacgguaaugggagacagggagacagugacaaaucaucaggcauuagauucuuauaagggguacacaaccuagaucgcuugcauggacaguucacaauaggguucaugcucuuaugagaaucuaaugccgcugcugaucugacaggcagcagagcuccggagguaaugugaucggugaggaguggcuguaaauacagaugaagcuuugcucacuggccugccacucaccuccugcuguguggcugguuccuaagguuggggaccccugcucuagaaguccagccuagcaccuacucuuccagcucuuccaaaaauuuuguaagcaucuaauccccuguauuagcuucuuucuucuuaaagcaucuagaaugauuucuguuuccuauaagaaaggcugacugaagcaaggaaaagaaggaaggaaauaaagaggaaagaguucagagucuccgcuaucgguauggagagugcaguuugcacauacagaauaauagaugccccugguggcagcagccacaacagugcauaaguagcaggguaagaagggcauauucugauacuucuggacccacuaaggcugagcagaaacugacccuuacucagucugggaacaaacuucccaaaccuuuauguacuacacacaaaggaggagaagcauagguuaagcagcagcuguauuaguaauuucucccaaucuuucauguauuguuuuugccauuagugcuuuuuugcaacucuuuaauuccaggaucauuguaaaguauuuuucauggagcagggacuaaagaagugaauaaauauaguguauuuuuaaaauaauuuauuuuuaaauuauguauuuacuuuugagacggagucuugcucugucacacaggcuggagugcaauggcgugaucucagcucacugcacccucugccuaccagguuccagcgauuuuccugcaucacccuccaggguagcugggauuauaggcacgcaccaccacgcccagcuaauuuuuguauuuuugguagagaugggguuuuaccauguuggccaggcuggucucgaacuccugaccucagaugauccgccugccucggccuuccaaagugcugggauuauaggcgugaggcaccgcgcccguccuauuuuaaaauuauuuuaaaccaucagaaaaguugaaaguacaacacaaagagcuccaguauucuucucauacagauucugcaacuguuaaccuuuucacugcaauuguuccaucaccuuuuuuugccauuuucauuaaucuuuuucugaaccacuugagagcaagcugcagacacaaugccccaucaucuuuaaauacucuaguguguauuuuucuaaaacaagaauacuuuccugcauaacaaccauacccccuuccaagcuaggaaauggacacugauacaacaaugccauucaauccacagauaccauccaaauuuugauaaauguuacuaauaauuucucuuuuuccuuuucuggucuaagaaccuaucugggaacauauauugcuuuuacguggcaugucuuugcagucucuucuaaucuguaacauuuccucaguuuuucuuuuuuuuuuuuuuuuuuuaauuuuuuuuuuuauuauacucuaaguuuuaguguacaugugcacauugcgcagguuaguuacauauguauacaugugccaugcuggugugcugcacccacuaacgugucaucuagcauuagguauaucucccaaugcuaucccuccccccucccccgaccccaccacaguccccagagugugauauuccccuuccuguguccaagugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaaugacuuucuucacagaauuggaaaaaacuacuuuaaaguucauauggaaccaaaaaagagcccgcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccacauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacaguuuuucuuauccuagacaguuuuaagaaggacaggccuuggccgggcgcgguggcucacgccuguaaucccagcacuuugggaggccgagacggguggaucacgaggucgggagauugagacuauccuggcuaacauggugaaaccccaucuccacuaaaaauacaaaaaaaaaaaauuagccgggugugguggugggugccuguagucccagcuacucgggaggcugaggccggagaauggcgugaaccugggaggcagagcuugcaaugagucaagaucaugccacugcacuccagccucggcgacggagcgagacuccgucucacaaaaaaaaaaaaaaaaaaaaaaaaagcaaggacaggccuuacauccuacgauguuucucauuuugggucuguuugggucuguuuaguguuucuugaugaccauguucaggucacgcucucuuggcaggaaucauagaaaugaugcuguguucuucgcaugcaucacaccaggggacacaugaugcugacuugucccaacacugucagugaccuuaaucacuuggucaccuuggugucugccagguuucuucucuguaaugucaccuuuuuucucuuuauaauugauaguauuuucaggggacauaucguaagauuaugccaauauccuauuucucgucaagucuucauccucaguuuuagcauccauugaugaauucuaucugaaccaaacaccacuauuuuguuuuauuuccaucucuguuaguuggcauucuauguaagaagagcuuuccuuuuccugucauuuauuuauaucagcauagacuuguaaaaucccacuuuauucagcagguuguaaucaguuacugucauuaaauauuuuauugcucauacugucccaguuuguccagugggagcccuuucaaggagguuccuaggucuucguaacaaguccccaucauucuuugaacacuuucuggcagaaguuguuccaggcuucucuuguauuuugcuuggcucagcuaucuacaaucagccauuuucccuagaagcacugguccuauuuaguauaaaaugguuuuuacaugcuacaauuuggguacuuggugugcucauuguuacugggauauacucuuggaccaucucugaacaguuaagcguguguguguguguguguguguguguguauguguacucuacacacauauauaaguauacacaaagaucuauagcuauuucuauaucaaucuguaaauacauaaauuuaaaaaucaugaauucauacugauuuuuuccaauucaaaccuaauaccugaguuccuuuauagccauaaguaccuuuucuaacagugaaaaaauuugacuuuuauuauccuuaauauauuuguucauugacuuauguguucaguguaacuaacuuccugaccacgcagacaucuccucugccacuucagcucuucacauccuuggaugccagugggaauauugcuauucucuaugcagcaucccugugcaacgccguccuccccuccucaguacccuugccagugggcacccuucugaugcaucucuguaugguaucucccuccuccccucagugccccgugcuggcgagcaugccaaccaugcaccucugugaaauucacccucacuccacagacauuuucuguaguggccugugauugacugcucugcgccaggaacagaaaaggagaaggaacuauaauuucuuuuauagguaauuaggaauucauauaucacauaggaguagaaucuuugagcuggaagagaccuuguaaauaaaucauuuagggugagcagggguauagaaaaugggauucuuuuguguuggaauucuggcccugucacuuacuuggugaaucuugcauaauuaaacaucagucagagcaggauauuuaagucugcugauucucccauccccuugcugucucagaaauauucuauagcauuuggagacaugcaggaaccaguugaacacaauugcuucucaaucuaucaugguuaucuacuccagagcugaaucuuuaagucagauagcugauuugaauugcugaacccauuguucugcugaauucuguggcaauugauguuacuucuucuuuaggacuucuauuucuucuggccuccuugccaauaguaucaaaguuuaagaggauaaaugaauggggaggggauaggagaagucuggagauaaaugcagggagaaaggcacagcacaaacaaaaagcauuuugauaaggcuuuucugaaaguugaguaaauaugucuguagcccauuauuauaacucauggcuggacucaaaugucuggcuucaacugaugcgagacauguuggggcaaugaagagaguaauaugaacaaacaaucauggccgucaauaaagaugcuuuagugaaaguauucuccuuugggaaaaagagucaaccuaaauaaauagcaacugccuuuaacugaauacccacucugugccaggcaccagguuagauuuuuucauacuuuagcuguaaucaucacaacauuauugcagaaguaggaaguauuacccccauuuuagagauaaggaauaugagauucugauuuguucaagaaccuucucccaguagggagaaguguuauauucauaacaaacacuugguccuuccacuuuccugcuacuaauacgcaaauaaaauaauuuaacagaagagacuuuuucucaggaauaugaugaaugugaauggaaugugugcaaaauuaacuuguaauuguuaugcucucauuuccacaucuucugucuuuucuugauaaagcuuuuagguggaccucugaaguacuugauuucuguauuugcuuaacaaauauuugaugaacacuauguaucaggcacgugggucagggcaugagguauaaugauauagaauauacuuuaccgauuuuauagccaagagggagagagaaacauuaaauaaauuaucacacaucaauauuuuauaaguguuauuaaggaaaacaguguaagaugaaaguauuuauaacaggcugggcgcaguggcucacaccuguaaucccagcacuuucggaggcugagauggguggaucacuugaggucaggaguucgagaccagccuggccaacauggugaaacccugucucuaccaaaaauacaaaaauuagccaggcaugguagcauauaccuguagucucagguacuugagaggcugaggcaggaaaauuguuugaaucgggagguggggguugcagugaaccgagacugcgccacugcacuccagucugggcaacagaagaacacucugucucaaaaaaaaaaaaaaaaguauaucuaaaaauuaauuaauuuuauaugguguggagaagggagaaaauaucaaggaaauugaaacuaaggaugaauaggaguuagcaggugaagaguggggcaauagaaccccauugaguaaauagaaccacaugugcaaaagaugggauggagacgaacaggaagguuggagugcuaaaacaagaggcacaacgucagcagaugaggcuggagaggauagccugaucaggcaagccuggcaugccguguuaaggauuuggaauuguauaccaaguagcauggaaaucaaaugcacgcacgcgcgcgcacgcacacacacacacaccauugucgucaucaucaacauuauuuuucauaguuaauauuuguuccucauaugcuuaacauuuguuugcuaguuauuucuuuauuucuucuugcuucuucaccuuuccaucuaggaucacuuuuucugccuaaaauauaucaccuagaauuuuuuuuuuuaagagauggaguuucacucuuguugcccaggcugaagugcaauggcgcaaucucgguucacugcaaccucugccuucuggguucaagugauucuccucccucagccucccgaguagcugggauuacaggcgccagucaccaugccuugcuaauuuuuguauuuuuaguagagacgggguuucaccauguuggccaggcuggucucgaacuccugaccucaggugauccaccuaccuuggccucccaaagugcugggauuacaggugugagccaccacccccagcccuagaauuuauuuuacugacuguuuguuggaauugaacuuucucaguuuuuguuuuugucugaaaauguauugauuuugccuucuuuuauggaauggggguggggaagagugaaauuuacaaagagugaaaugcacagauuauaaauguauaauuugaugauuuucaacauguaaagccaaugacccaauuaugauacagaauauucccaucauuccagaaugcucccuugggcccucuuccagucaauucugcccgucuacucucuauaggcagccuuuugucaccauggauuacuuuugucuguucuagaacuucauguaaauggaauguacauuauguacucuuuugugucuugauucuuuuuuugagagucauccaugggguuguuuguaucaauagcucauucuuuuucuuggugaauaguauuucguuguaugaauauauccauucuccuucgauggacacauugauuguuuccaacuuugggcuauuaugaauaaaccuacggugaacauucaucuauaaaucuuuucauaaaaguauauuuuuauuucucuuguguaaauaccuaggaauggaauuucugggucauaggguuauauguguuuaacuuuauaagaaacugccuaacagucucccaacacgauuguaccauuuuaaucucccauugguaauaugugaaaguucuaguugcugcacauuguuucagcaacauuugaaguuucagccaaagcccuccuccuacuccugucucccagccuucucuaguaaccuagguuaucagcuccaucuguauccuuccagugauacuuuguguauaaaaaacagauaugguguuaucacacuuaaaaguagugauaagauguaaaguaaugaugaguuguucuuucuuagaaauuauauaguauugauugaauaaagucuaguauuuuaaaugaggaauacuuccauaaccacguuaacugcagcaguuuucuuuccuacccccauguucuguaccugugguugucaacuuuaguguccaucugaaucaucugaagaguuguuaaaauacagacuaccccacagugugugauucaguaggugcaggccucaacauuugcauauguaacaaauuuccaugugauguucauacugcuaguccauggaauccacuuugagaacuacugcuugcuccuaaauccaaggauucuggauauuucuucuuuauuaugguuauuacugucaaaaacucuugaagaauucugacucaugcauguggguaucauagacuccagcuuuacaaggacacuucuaauugauuuuauuucucaguuaugggugaucuuccacuuauauuuuuauagaucguuucaaauaaauuuacauaccagaggaagaaaacugcugucaauccauagguuccaguguuuaguuuggaaaauacggucaccguaagugauguagcauguugcucaaaagaaaaaaaaaggaggccgggcgugguggcucacaccuguaaucccagcacuuugggaggcugaggcggguggaucaccugaggucaggaguuccagaccagccuggccaacaugguggugaggugauauaugagaaucccacauaugucucuacuaaaaauacaagaauuagcugugugugguggugggcaccuguagucucagcuacucaggaggcugaggcaggagaauugcuugaaccugggagguagacauugcgagcagugagccgagaucauaccacugcacuccagccugggcgacagaggugagacuccgucucaaaaaaaaaaaaaaggaaaaaauaugcaucccucccuagcaauuuuuuuuuguugaauauuuuguuuuuaccuuauuacccuauauaaauacaguauuauucacaucugaaucacuauauuauguuuauaauuauuuauuucacauuuuuuguuugguuuaguuuucuguaugucugucacaaauuuaauugcaagcuguuggacagagcuuuaaaaccauucagugcgguaaaaauguaacacacacacacacacacacaccccuacacacacacuaaaaaugaaugcuagccauuuccuuuuccuuguucuuguugaagacagccucuugcuauguugcauuccaucuggacuguuuguucuguacaccuguuguguagccaucaucugugggcuuccauuugccaucauugugagaauucacucgaucucuuuucuguguugaaucuacuguuucuuuaauuucuuguuuucuucuuuccaaauuuauuccuuuguuugguggcuuacauccucuguacgaggggcggguacuguugacuggagccucucacaguagaaugaucugaaccuaccauuucacugugggauucucacauaucaggauuuauagcauuuuuuuuucccuuggaucacccaguucgcucaaucuucuguuuaguggguacagcagccgcuguucucagacccaaguugggggaugaggcuucuauuuucagcuacuuuagaaagguuucuuguuaauccagaauuugucagccccuacugugcgccaaguauucuguuuguuucuacagagggguauaaaguuaaugaaaagauggccaggugcaguggcucacgccugaaaucccagcacugugggaggccaaaggcaggcagaucaccugaggucaggcguucaagaucagccuggccaacguggcaaagcuaaaaauacaaaaauuagcugggcauaguggcacgcgccuguaaucccagcuacuugggaggcugagguaggagaaucacuugagccuaggaggcugagguaggagaaucacuugagccuaggaggcagagguugcagugagccgagauugcgccacugcacuccaaucugggcgacaaagcgagacuccaucucaaaaaaaaaaaguaauaauuauaauuauaaaaguuaaugaaaagaaaguuuccaaaaucucaguuuuaaaaguggagaaaggcauaaaguuuauugccucagauacaagauaguaugugauaaaugcuacauaaaugagccucugacaaugagaagauuaauuucaucuaaggcuuuuagaaaagauggcauuugggcuuugaagaaaggacagaacuuucuuuaaagaaaaaauagaauguaaaauuuacaaaauguuuaagaaguaaaaacuuucgccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaagagguaaaaacuuucaugaucuuauuacuuuaauaacuuuauuuuugcauauuuccuucuaaucuuucugugugugcuuuuacaguugucauagauuucagcauucuuauuuuuucaauuaauauaauuauucuguuauaauaauaauuacuuuuugaauggcuucaaaggauucugccuagaugauauaggauuuuaauagugaacuaguaagggaauccagcuuguauaaaaacucagagauaaguaaaaaugggguauauauauauauuuuuaaaaauagacuuacuagggugggggacaacagaggaaugggagaaggaugaagaauaacaaaagauaaaaucucucaagacuugugagaaauggaaagacgugcagcccuguguuuucuguucuuguuuuuuuuuuuuuuuugcguugucaagaaauugaagagcaguuaguagaugucuucaugaauuguggagaaaaucucagccuuaagaagcuaccuuuuaauuauugacgcugcccgcauagauaacacauuacaucacauuaccaauuuguuucuccuugucauucaaaaaagccacaucucuuugccuguaauuugcaacuuucuauuuuauuuucaaaaaacaauaaagcucucuuuacucaugaguuuggaagagggaaguuucaagcuuuagugaagagcccuggucugguauaauuuugucccuguuuugauuacggaaaagguguuuaacuuuuguuacuuuuuuauuuauuuaagcacuauccagauuucuguuaauagugcucaggaucagaauucuaaaauuauugaagagauuuuucuauaguugcagcauuuaugcugcuuucccuccuuuucaaacaugugagagauuacaaucucaacacaugaaagugauggaaaagacuaauuugacaauucucuagaauaaaaucauaaaaugaaguuaaaaccaaugcaaauauuaaaauaaauggcacuuaauuuugaaagaaguuuuuaaucaguauagcuuaucaauuaaucuuagcauuuaaaauaacuaguucugauuuuuguguugggaaaugcaaggagaaagguuaaaaguuaaauguaucugggauagcuguguuauuuauaauuccccuggaauuguuuuugauuaaugcuuguuacauuuuccccaggaggcuggggaguguuucagucgaggcuaacauggaugguuuuuaauaucaggagcuccacaaauauggauuaacuuuuuagagauagaugguaaucucuuuucucaguuaaggucauauaaauuauaacugcuaccugaacuuagaaaaaauaagauaaguaacauuauuugcuguugucacuuucaauuauacuuuaccacuugagagaaauuguacuuguuaauuaagucaucacagaagagauuuuuaauuggcagaauucaguuuuggagauuccuaccuguguaacguaguauggcuacuuuccaguaaacugguauagugagaauuugaccaucagggcccauggaauauuucaguuggccuguuuauucagugaccuuccagaaaaaaaggauaaucuuuuuaaauuaaaaaaaaaaacaagauuaaauaaaaucucccauuuuugugaaucccuccccucagaaaacugaaauuuccucucugguuuucaauuccaucuuuauuucugauaccugaggauuucccuucuuucuugaaagaucagcuauauauuuaauuuuauuuggugauggaagaaaguuauuuuuaucuagcaucuccagucagaguuuuuuguguuguguuaauuuaccauauggauuuuuagaauuaguagaauauuuacagucaugcauugcuuaacaacggauacauucugagaaaugugucauuaggcaauuucaucauugugcaaaugucauagaguguaguuacacaaaccuagaaaguauagccuacuacacaccuaggcugugugauauagccuauucuuccuagucuacaaaccuuuacagcaugauacuguacugaauacuguaugcauuaguaauacaauguaaauauuguguaccaaaacauagaaaaggaaaaguaaaaaugugguauuuuaugggaccaccaucauauaugcuguccaucauuggccaaaauaucauucugcagccaugacuaucuuauuuagcgaggccuccuggaacagggauguuuguaagucuuuagaagaaagaagguuaaaauaaauaaucuaugauaugcauauuuucucccacucagacuucuucugagaaaggcauacaagcuacugcuugccaguggaaucauuuuagaauagaaucaguuaauuugcuaucucuugugcuauaauauuucauauuuguugaucuuuuaaaauuuuaaaaauguuggcuaggcacgguggcucacaccuguaaucccagcacuucgggaggccaaggcggguggaucaggaggucaggagaucgagaccauccuugcuaacacggugaaaccccgucuguacuaaaaauacaaaaaaaaaaauuagccaggugugguggcgggcgccuguagucccagcucuuagggaggcgaggcaggagaacggcgugagcccaggaggcagagcuugcagugaagugagauugcaccacugcacuccagccugggccacagagcgagccuccgucucaaaaaaaaaaaaaaaaaaaauuuuugcccagauuggauaaggguaccccuuuugccacguucuugccagcauuuguuauugcccaucuuuuggauaagagccauuuuaacuggggugagaugauaucucauuguaguuuugauuugcacuucccugaugaucagugauuugagcaccuuuucaaauacuuguuuuccauuuguaugucuucuuuugagaaauaucuauucagaucuuuugcccauuuuaauaucagauuauuggaguuuuuccuauugaguuguuugagcuucauauauuuucuagugauuagucucuuguuggauaguuugcaaauauuuucucccauucuguggucugucuccuaacuuuguugauuguuuccuuugcuauacaggagcuuuuuaaguugaugugauccaauuuguccaguuaugcuuugguugccugugcuuuuggguauuacucaagaaaguuuugccuagaccaguguucuggagaguuuccucaauguuuugauuugauuuuuguauaugacaagagauaggggucuaguuugauucuucuauauauggauauccaguuuucccagcaccauuuauugaauagacuguccuuuccccauuguguguucauggcaccuuugucaaaaaggaguucacuauagauguauagauuuacuucuggguucucuauucuguuccauugguuuguacgucuguuuuuaugccaauaccauguuguguuggauacuauaacucuguaguauaauuugaaguccaguaauuaauuugacuccauuuuguucuuuuugcucaggaugacuuuggcuauucugggucuuuugugauuccauguauuuuaggauuguuuuuucuguuucugugaaguaugucauugguauugugauaggaguugcauugaaucuguagauugcuuuggguaguauggacauuuuaacaauauugauuguuccaauccaugaacauggaauauuuuucccuuuuguuuuuuuuuuggugucgucuucuaucucuuucaucuauaguuuucauuguagagaucucucacuucuuugguuaaguuuauuccuaguuguuuaauuuuauuuguagggauuguaacugggaguuacauucuugauuucuuuuucagauuguucacuguuggcauauaaaaaugcuacugauuuaauaccuuguuucuuaaauuaaaauaaaugcuacugauuuuuuguguauugauuuuguauccugcaacuuuacugaaugugcuuaucaguucuaauagcuuuuggguggagucuuuagcuuuuccaaauauaaguucauaucauucucaaauaagaaaaauuugaugucuuccuuucuaauuuagcuucccuuucuuuuucuuaucugauuucucuagcuaggacuuccaguacuauauucaauaauagugguaaaagugggcggccgggcacaguggcacacgccuguaaucccagcacuuugagaggccgagguggguggauugccugaggucaggaguuugagaccagccuggcuaacguggugaaacccugucucuacuaaaaauacaaaaauuacccgggugugguaucgcacaccuguagucccagcuagucgggaggcugaggcaggagaaucguuugaaccugggaggcagagguugcagugagcugagaucgugccacugcacuccagccugggugacagcaagacuccaucucaaaaaaaaaaaaaaaaaaaaagaaaggaaaagaaauggacauccuuaucuuguuccagaucauagaggaaaggcuuucaguuucuccccauuuaccauggcacuagcugugggucugucauauauggcuuuuauuguguugagcuauguuccaucuauagucagguuuuugaggguuuuuuuuuuuaucaugaagagauguugaaauuuaucaaauacuuuuucagcaucaguugaaaugaucauauggguuuuguccuccauucuguugauaugacauuugacuuucauuuguguauguugaaccauccuuucaucccugauaugaaucccacuuggucacgaugaaugauuuuuuuucaauguguugucaaauuugguuugcuaguauuuuauuacggauuuuugcaucaauguuuaucagagauauuggccuguaguuuucuuuuuucaauggaucuuugucugguuuugauaucagaguaauauuggccuuauagaaucaguauggaaaguauuccuccuccucuauuuuuugaaauaguuugaguaggauugguauuaauucuucuuuaaauauuugguagaauuuggcagugaagccaucagguccuaggcuucucuuugcugggagacuuuacuacagcuucaaccucauuauuuguuacuggucuuuuuauguuuuggauuucuucaugguucaaucuuggaagguuguauguguauaggaauuuauccauuuccuuuagguuuuauaauuuauuggcauauaguuguucgcaguagucucuaaugauccuuugaguuucuguggugucaguuguaaugucuccuuuuucaucugugauuuuauuuauuugggccuucucuccuuagucuaguuaaaguuuuuucuauuuuguuuaucuuuucaaaacaccaacauuucauuuuguugauucuuuguauuauauucuguuucaauuugauuuauuucugcucugaucuuuauuauuucuuuucuucuacuaauuuuggaguugguuugcucuugauuuucuaguucuuuaagaugcauagcuagguuguuuuuuuuuuugaaguuuuucuacuuuuucauguagguacuuauagcuauaagcuucucuuuuaguacugcuuuugcucuauuccauagguuugcuauguuguguuuccauuauuauuuguuucaagaaauuauuuaauauccuucuuaguuuuuucauugaucugccaaucauucaggagcauacuguuuaauuuccauuuguuuguauuaauuuccaaguuccucuuguuauugauuucuaguguuauucuguuguagucagagaagauacuuuuaagauuuuaauuuuuuaaauuuuuuucuuuuucaagacagggcuacucuguugaccaggcuggacugcaguggcacagucauggcuccuugcagccucaacucuugggcucaagugauccucccaccucagccuccugaugagcugggaguaccacucugccuguuuuuuuguuguuguuuuuuuguuuguuuuuaagagauagggccugacuguguugcccaggcugguuucaaacuccugggcccaagaaguccucccaucuuggcgucccaaaguguuggaauuacaggcaugaaccauugugccuagcugaauuuuuaaagacuucuuuuguggcuaacaugugguuuauccuugagaaugauccauaugccaggagaagaauauguauuaugcagccauuggaugaaauguucuguaaauaucuauuagguccauuugguuuacagugcagauuaaguccaacauuucuuuguugguuuucugucugaaugaucuauccagugccgaaagugggauauugaaauuuccaacuauuacuauauugaagucuagcugacucuuugacuuuaacaauauuugcuuuauauaacuggguauuucaguguuggaugcauauguauuuacaauuguuguaucuucuuguugaaaugaugccuuuaucauuguguaauaaccuuuuuugucucuuuuuuuaguuuuuguauugaaaucuauuugaucugauauagcuauuccugcucuuuuugguuuucauuggcauggaauauuuucugugugccuuuauuuucagucuaugugugucuuuauaggugaaguguguuucuuguaugcaacagauuguuggguacuguuuuguuaauccaucaaccacucuaugucuuuugauuggagaguuuaguucacuuacauucauuguuauuauugauaaguaaggacuucugccauuuuuaauuuguuuucugguuguuuugugcuccuuuuugugaaaguguuuucuuuagugguaugcuuuaauuucuugguuuaucuauuguaugucuguuguagauuuuuuaacuugauguuacaugaggguugcaauuaacaucuuacaaugcauuauuuuaaacugauaacaguuuaacucugauugcaaaaacaaacaggaaaagagaaaacuaauaaaaacucuacacuuuauccuucuugcuuuuuaacuuuuuauuguuucuauuuuugucuuauuauauugucuaugacuuuagaaauuguuguaguuauuauuuuugauagguucaucuuuuagucuuucugcucaagauaugaguuuacacaccacaauuacagugauauaauauucuguauuugucuguguacuuacuuuuacaugugaauuuuguaccuucagaugauuucuuaucgcuuauuaauauccuuuucuuuuagacugugggacacccuuuagcauuucuugaaggcuaggucugauguugauuaaaucccucagcuuuuguuuguccaggaaagucuuuauuucuccuuuauguuugaaggguauuuucaccggauauacuauucuacaauaaaaauuuuuuccuucagcacuucaaauaaaucaugccacugucuccugccuauuagguguccacucagaaaccugcugccagauguauuggagcugcuuuguuuuuuguuuuguuuuguuuuguuuuuaauuuucucuugcugcgucuaagauccauucuuuaucucuggccuuugggaguuugguuacuaaaugucuuaagguagucuucuuuggguuaaaucugcuugauauucuauaaccuuucugugccugaauauugauaucuuuuucuaggccuagaaaguucuuuguuauuauuucucugaauaaacuuuuuaccccaaucucucuugcuaccuccucuuuaaagcuaauaagucuuuuuuuuuuuuuugagacagagucucaccguguugcccaggcuggagugcaguggcgcaaucucugcugacugcagccucugccucccagauucaagcauuucuccugccucagccuccugaguagcugggauuacaggugcacgcugccaugcuuggcuaauuuuuguauuuuuaguggagacgggguuuaaccauguuggacagacuagucucgaacuccugaccucaagagauccacucgccucagccucccaaagugcugggauuacaggcaugagccaccaugcccggcccaauaacuguuaacuuugcccuuuugaggcuauuuucuagauccuguaggcaugcuuuguuacuuuuauucuuuuuuuauuuuuacaccucugacgguauauuuucaaauaaccuaucuucaagcucgcuaauucuuucuucugcgugaucaauucugccauugagagauucugaugcauucuuuaauuugccaauuaauuuuuucaacuucagaauucugcuugauucuuuauaagaaucaaagagguuuuuaaucucuuuguuaaauuuauuugauaggauccugagauccuucuuugaguuuucuuguauuucauugagcuuccucaaaacagcuauuuugauuuaucugagaguucacguaucucugucccucuggaauuggucacuggugcccuauuuaguuuguuuggugagaucauguuguccuggaugauguugaugcuuguggauguucacuaaugucugaacauuaaagaguuagguauuuauucuaaucuucacagucugggcugguuuguacccauccuucuugagaaggcuuuccaaguauucagagggaaucuuaagucuuuggucacugaagccauaugugagcauauuaggggguaccccaaggccaguaaugauaugacucuuguagucucauagaggcaccaacuugcuggucuuggguaagaucugggagaauucccuggauuaccaggcagagacucuuguucucuucucuuauuuucccccaaccaauuggagucucucccucucucugucucucucucuguucugagcugccuggaguuggcagaagggugacacaauccuguggccaccaucacugggacuguguugggucacaccugaagccaacacaguacuggauuuugccuaaggcuuguggugacuauuuccuggcuaccacuuguguuuauuuaagacccaauggcucuucagucagcaggagaugaauuugccaggacugggucuuucuuuucagugcaguagguucccuucuggcccacggugguucuagaaaugcuguccaggaguuggggccugggauuagggacuuuaggaaucugcuuggugcuuuauuucacuggggcugucaugguacccagguuacaagacaaaguccuuuuuauucuucccuuugauuuucucaagcagacagagucucugcccauggccaccacugccccagaccuguggcuacuauagucuggcuacugcugauauuuauuaagggcccaacgucucuuuaaucaguagauggugaguccugccaggccugggucucucccuuuagggcaguggguuuccuucuggcccagagugggucuagaaaugcccucucggagcuaaggccaggaaucagugacuuuaggagucugauuggugcuuuauuuuacugugacugagcugguacccaaguugcagacaauuuuuuuuuuuuuacuuuucccucuccuuuccuuaagcaggagucucccuguggccgccacagcugggaauguguuggaucacacccgaagucagcauaauacugagucuugcccaaggccuguggcaacugcugccuggcuaccccgauguuuauucaaggcccaagagcucuuuagucagcagguagugaaaucuggcaggacuggguccuuuccuucaggguggcagguuccccucuggcccaggaugggucuagaagugucugggaguuaugaccuagaaugggggcuucaggacucugguugcugcuuuauuuuauugugggugugcugguauccaaguuggagaacauagucuccucuacucuuaccucuccuccuggagcuaugaacugugcugucugaaguuggaggaggggugacacaagcacacccuuggccgccccgucuggugucucacugguucaugugcaucccaaaucuacuggcuccaagaccagcacaguaccaggacuugcucagggacugcaguccuuauggucuagacugccuuuuaaguuuauuuaggaucuuggagugcuuuagccuacaggggcaaggcuugcccaaacuuagccuuaaacugcugggauggaugauuccccucuggcugaggcuggucuaaauacucccuccaugggugcaagcugacuucugcccucuguugccuuccacugcgacagggcagcacugaguuccaaugcaaagucccacaaucacuuugcccuucgucccgcaaaggcauagauucucucucagccaccacacugcacugccagggcaugugggagggguggugugggcaauucaagacugucuuuccuacccucuucagugccucuuuccuugauacgauguugaaacuagguacugugaucagucaccugauuuuugguucuuauguaggugcuuucuuguuagaauaauuguuuaauuugauguuccuugguggggacucucacuggaggguucuaaugagccaucuugcuccgccuccuccuccauauuuguugaucuuaaaaaaugcuccuguaaauacuguuguacuuaaguccuuguguacauagauguacauuuaucuagggaaacaucuaaaaauacaguuccuggguuuuuauuuuagaacuuuaguaagcaugucaaacaucucuuuagaaugauccaucaauuuacacucccaccaacagugcauuuagaacucuuucugcugaccggugagauuaucuuuucauguauuucuuagccauucuauaugguaucuuguacuagguuaauuauaucuuacauauugauuuuuaggaguuauucacauauucuggauaauuaucauuugucucaaugauguauauuuuagauacuucuguagauauuuuagauaugucuacaggaagaaguaucuaaaauauccccuuguuuuuuucauuuugcacaugauauuuuuucucauacuaaagguauauaauuuuauuauuguggaauuuaauaauuuuugcuauuaagauuguauuuuuuaaaucuuuccacaugcuaaagaacuauucuaaaauuuuaaaugaacuuuuaaaaauuucuuuucacuuuuagacuuuaucuggaauuugguuuuauguuuuaguauaagauagugauugaauguuauuguuuacuucuuuacucauuuuuacuccucucuaugaauuuuggaauuauuuguaaagauccaugaaaaaauuugaagggagaaugggaauaguauuaaauuuauagauuacuuuggagaaaaaagauaauaauauuaaauauuuucacacguaaacauaguggauuucuccauuuauugaaggcuucuuuacauucuucaauauuuuauaaauuuuuuaaaauaaggucuugcucugucacccaggcuggagugcagugguguucauagcucacuguuaccucaaauucaggcaauccuccugccucacccucucuaguagcugggauuacagacacaaguuaucaugccuggcuuauuuuuuggagggauggggucuuguuauauugccuaugcuggucuugaacuccugggcucaagcaauucucucacguuggccacccaaagugcugugauaauaggugugugccggcauaacuggcaauauuuuauaauguuaucuaugaaguuuuuuuauauuucuuauuaauuuuauuucuguucuaauaguuuuguaacuugugaauuuuuuaaaaaauauacauguuuuauaauauuuucuuaccuuuuuauuuugaacaauuucaaaccuacagaaccauuaaaagaguaauauaaguaguacaguguacaccuguauacccaagaacuagauccacaaauugguaacguuucgcuuauuccccuuuauuuguauacacacacauacacacacacacacacacacacacacacacacacagcauaguuauguucaguuuuuuauuugcuaaguuauuugaaaauaaguugcaagcuuuaugauacuuuauuccuaagcacuucaauaugugucucuuaaaucuaagacacucuuuauaaaaccucuaugccaucauaucaaagauauuuaauauuugauacauuauaauagccacacauuauuauauacucuguugucuguugaaugggauuuaaaaaaauaaccuuuucuaaguaguuauuacaaauuauuaugggcugggugcagugucucacaccuguaaaucucaacauuuuaggaggcugaggcaggcagaucaccugaggucaggaguucgagaccagcccagccaauggugaaacccugucucuacuaaaaauagaaaaauuaucugggcaugguggcgcaugccuguaaucucagcuacucaggagguugaggcaugagaaucgcuugaaccgggaggcagagguuacagugagccaggaucacaccacugcacuccagccugggcaacagagugagacucugucucaaaaaaaaaccaaaagccaaaugguuaugaacuuucgauuuuguguacauauauagcaauaauuggaaauuccuauuaguugcaauacuuuggcuuuagauuuucuugagcgcagcgauaaauucuuauucaguguaauaaguugacucaaguuuuugcuuaucuuuguaaauaaucaggucaucuacaaauaauuuucuuuuuuucccguguaacuuuuaauaaaauuaauuauugaaaaagauucuucaauuaauuuuaauauccuaauuacuuuauuugauauauauuuuuuaaaaaauugugucuuaguuaacuuauaaguacaugaaaaugaaaucuaaauuuuuguauuuuaggaaaauucacgaauugugagaguaagaguuauagccggaauaggccuugccaagaaggauauauugggagcuagguaaguauaucuauuuggauuauaauuuuaaaacuuugcauuuguuaauuaguuuuuuccaaacuuugguuaaauuagaaaucaaauaguauuaguaaauuguuguggaaaguauaauaauaauauuaccaguuggugguuuacuaaaucucuugguaucugaauuacuaaauuugugaaauuaggcagaaguacaaaugauagcaauagucacaagauacauuauugagcucugcuucuggaaauuugcaaaauucuaacagacuaauccuuuagcagauaacaaccauaaacucuggacuuaauacaaaaagcagcaaccugaaggcaguggagagugaacagagcaggcagauucugguggggaguucauguuuggaagaagggaauuguacugagugaguuccugauacuaugaauuggucugagggcagguagaaucagaaccuggaaaaauuguagucuucauggccugggaacauagcagaauccaaacuuugguucaauuaaaaaucaaauagggccaggcaugguggcucaugccuguaaucuuaguaauuugggaggccgaggcaggcggaucaguugagggucaggaguuugagaccagccugaccaacauggugaaacccugucucuacuaaaaauacaaaaauuauccagaaaucgcuugaacccaggaggcggagguugcagcgagccaagauugugccacugcacucuagccugggcaacagagugagccucugucucaaaaacaaaaauacauacaaacaugcaugcauacauacauacauacauacauacauacauacauaccaaauaguauuaguaaguuguuguggaaaguagaauaauauuuccaauuguugauuuacugaaucucugaaucugaagaaaacauggcagugguaaggauucuggaagagagagagcugaagagcucagcaacucaucugaagacaaaagaucugaacagagaucacagucacugccuaagaaacgggguuugggagacugaggcagacagguugcuugagcucaggaguuugagaccagccugggcaauauggugaaaccugucucuacaaaaaguacaaaaaaucagcugggcaugguggcgcaugccuguacuccuggcuacaugggugacugagucaggaggauugcuugagucugggugguugaggcugcugcagugagacaagauugugccaaugcacuccagccugggugacaaagugagaccgugucucaaaaaacaaacaaccaaaaacaggauuuguggcucuuguccaaacaggaugauuaguugcaugauagucuuauuauguuuaguguugcuauaacagaauuccuaagacuguguauuuuguaaagaaaagagguugauuuggugaguggaaaguucaagacugggccuuugcaucuagugagggccucaggcugcuucaagucaugacagaaacgggaaggggaccuagcguacacaaagaaaucacauagcaagaguggaagcaagggggaggugugccagccucuuuuugacaaaucgagaggaacaaauagaaugagaacucacucacuuccgagggagggcauuaaucuauucaggagggauuugcucccaugacccuaauaccuccaaccgagacccaucuuucaauauucccacauuggaaaucaaauuucaacaugcgguuugaaggauacaaauauccaaaccauagaaugauaagcagacacacacacacacacacacacacacacacacacacaccagcagcaaaauucacacacacacacacacacacacacacaccagcagcaaaauucagucuccaaaacuuaacauuuauaauauauguccaggauauaaugcaaaauuacuuaucuaaaaagaaccaggaaaauggaaggcauuuuuaguagagaaaagaaaauauggccacaauaaauuuuaaaaauaugaaaugaaauggaaaccauaaaaaaaugaaaauuccaggagugaaaaauacagcauuugaaauuaaaauuguuggguagauuugucagccaaauggagaagaggaaagauuaacugaacuuaaagauagaucaguagaaauuguuacgcaguuggaagaugagagagaugagagagacaaagauuggagaaaaacaacaacaacaacaacaacagagccuugaggauuuguuagcuaauauauaaaagucuaacauggauaucauuauauaauaucuuacagucuaacacagaaaggggagggaaaagaagaaggcacaauauuuuuugaagaaauauuggccaaguuuuuuuccaaauuugauuaaauuuauauaguauuuaaaaacaccaagcaggauaauaaacauuaagaacacaaugaagugcauaauagucaaacuguugaaagccaaguauaaagagaaaaaucuugacaaaaagagaaaaauaugacacuuuauauaugggggaacuacaauucaauuaauuacugacuuccuacccaaaacuacggagaccaggagaaaauggaacaauaaaauaacaaccaucaauccauaguuuuauauucagugaaaauauccuuuaaggaagaugacaaaauaacauuuuccaaaaaaagacaccuagauaauucaucauuggcagaccugugcuguaagauaucuuaaaguccuuucagcugaagaaaauugaaaccagauagacacucagguccuuagaaaggaauaaagaguaucaaaaauaguaaauaucugggaauauacaaaacauguuuugcuuuucucaucauaccuuuuuaaaauaaaacauaugccuguugaaaucacaaguuaaaacauuguuuuuuaggauuuauauuguuggugaauggaauacauaaaacaacuauaacauaaaggauggagcagguauaaguuauagaccuauuugguagaaugguacaauacuaaguauaaguugaauaaaagauuaaugauguauauuguaauauccagagaaaccaauaaaaaauaaugcaaagaauuauagauaaaaaacaguagaaauuuuaaaaugaaguuguugaaaaacuaaauaaaaaagccaggaacuugagcccagagguucaagaccagccugggcaacaaagugggacccugucacuagaaaaagucaaaaaauuagccagguaugguuguaugcaucuguggucccagcuacaaaggaggcugagguuggaggaucgcuggagcccaggaggucaaggcuccaaugagccaugauuuugccacugcacuccagccuaggcgacagagugagacccugucucaaaaaaaaaaaaaauaaaaaagagugccagaaaaggagaagcaaaugauuuaaaaaaguaacggaggccgguugugguagcucacgccuguaauccuagcacuuagggaggcugaggcugguggaucaccugaggacaggaguuugagaccagccuggccaacauggugaaaucccaucucuacuaauauacaaaauuagcuggguaugguggcgcgugucuguaaucccagcuacucaggaggcugaagcaggagaaucaguugaacccaggaggcagagguugcagugagcugagaucacaccauugcacuccagccugggcaaaagagcuaaacaucaaaaaaauaaaauaaaaaaaauaaaagucggaaaaggaggaacaaaugaacaaaaaaaguaaaagaggcugggugcgguggcucacccuuguaaucccgacacuuugggaggcuaaggcggguggaucaccugaggucaggaguucgagaguagccugggcaacauggugaaaccccaucucuacuaaaaauacaaaaauuagcugugugugguggcaggcaucuguaaucccagcuacucaggaggcugaggcaggagaauugcuugaaccugggagauggagguugcagugagccaagauuaugccacugcacuucagccugcaugacaagagugaaacuccaucucaaaaacaaacaaaaaaacaacguaaagggcagugacaauggaaaacaaacaauaaaccuguagacuaaauccaaucauaucaauaauuacaaggaacauuaauggauuaaaauaaauaugagacagauguuguuaggauaaauuaaaaaacaagacccaacuauauacuguccuacgugaugcacuuaaaauauaaagacauagcuaauuugaaagaaagcggacgcaaaaagauaugccaugcaaacaguaagcauaaaaagacugaaguggauauauucguaucugguaaaauagauuucaacacaaaaauuuucaaacauuucaugaugauaaagaauaaagucaaucaggaauauauaacaaucauaaaugugugugugccugcuaaaagaacuuagaaaaauaugaaucaaaauuugacggaauuaaaggggaacuuuuuaaaacucccaccgucauaguuggaggcauuaacacuucucuuucagcaguugauaaaacaacuaaauaaaaaaaucaaaaacauaaauuuaaacaauauuaugaauaacuuugaccuaaagaacacuauuucuaacaacuuucuuuucaaauguacauucuuuucaaguguacaugguacauucacuagcauagaccacacaugggcuguauuaguuuauugcuucauaauaauauuaccacaaacuggccaggcgcgguggcucacaucuguaaucccagcacuuugggaggcugaggcgggcggaucacaaggucaggagauugagaccauccuggcuaacacuuugaaaccugucucuacuaaaaauacaaaaaauuauccgggugugguggugggcuccuguagucccagcugcucgggaggcugaggcaggagaaugauaugaacccgggaggcggagguugcagugagccaagauggggccacugcacuccagccugggugacagagugagacugcgucucaaauaauaauaauaauaauaauaccacaaacuuaguugcuuaaaagaacguacauuuauugucucacaguuucugugguucagaaguuccugcauuguuuaacuggguccucugcuacagggucuuggaaagcugcuguuguauuuuuuuuucuacuuuuuuucuaauuuuuucuaauuuugcagucuugaagucucucacaugagaguggcuguaaacucuagcccugcccugaugagacucuaggaauuuggacauagauguuuacagugugccuuucauggguauucuuaggcaagugcccucaugccuaagugucugaccuaugaccagaugucccucucacagcaaacuugcauauccuggcagaugcucuuauagcucuugucuguguccaguuuguuccuaccaaaauagcagauagccacucucuaggagaauccugacaaacaaguuagggucgaguguaucagucaggugagacacgggaggcaacucaacaaaacacaagaaauaacagcaguuuauuacuuacagaugccagagagaagagggcagcaugccucccagggccaacaggaaguggggagccaucuaggacaugcacagucaacuaguggguggggaacagggcaaagaguacaagugaccugugggcugaggcuuuuacugggguccagggcauuuuccaagcagguuucccucagggaguuguaauugguggguuuagagcaaguaggcauaaauuucauggagucaugcugugucugagaaaucaguauuaggguucucuagggggacagaacuaauaggauagauauauauaugaaggggaauuuaguaggagaauugacucacaugaucacaaagugaugucccacuauuggccaucugcaagcugcggagcaaggaagccagucagagucccaaaaccucaaaaauaggaaagccaacaaugcagccuucagucuguggcugaagguacaagagccccuagcauaucacugguguaaguccaagaguccaaaagcugaagaacuuggagucugauguucgagggcaggaagcauccagcacgagagaaagaugaaggccagaagacucagcaagucaaguccuuccacguucugccugcuuuauucuagcugcccuggcagcugauuagauggugcccacccagauugagggugugucugccucucccaguccacugauucaaauguuaaucuccuuuggcaacacccucacagacacaccuaggaacaauacuuugcauccuucagucuaaugaaguugacacucaauauuacccaucacagagaggugguuacuguggcuuauuucugcaguccuuuggggguauggggucaguggagcaagucaaguagguugaaucugguuguuucuuagggagaugguuaccaggaggcaguuguguaagguaguuaucuggauugaccacauugaggagcugagaggagguagagaacuggaaacugugcuaagggugacuaagaccugcuucugguauaaaaauguccaacuuaacauucauuauggaugcugaggcaacauaaaauuauaggaauucacuucagcugucauuaagguauugguagggcuguggucuuagcugaggcuugcuuagggaaggauucacuuccaagcuaaugugguugcugguggcauucaguuccuugcaugcugccagucugagcguuuccauuucuuacuagcugucagcuggaggccgucucagcuucuugccauucagcagcucacaagcugccaguuugcuucuucaaagcuagcaagagucuccuagcaagauggauuacaaucuuauguaauguaaucacauacuuuuugucacauuugccauaaucuguugguuagaauauauagaucugucccaugcuuaagaggagaggaacacaaagaacaugaauauuaggagguggggauaauaggagcugcccuagugucuggaugccacaauauuccgggccuugaaacaauaaaccacauucuuuugaaaugcacaugguacguuaaucaagauagaccauguguggguccauaggacaaguuucagagguuuucaaaagauugaaaucauauagaggauguucuuugagaacaguggaauucaauuggaaaccaauaauauuaagaucuagaaaaacugcagauauuuggaauuuaauuaguauacuucuaaauaaucuauaugucaaagaagaaaacauuuugaacugaaugaaaaugaaaauacagcaauaucacaauuguggaaugcagcuaaaguuauauucagagggaaguuuaugucuuuaaaaugcuuaacuuagaaaaggagcaagauauaaaugaauguuuugaguucugaccuuaauaaauuagaaaaagaagagcgaaugaauucuaaaauaaguagagggaagaaauaauaaagacaagggccaaaaucagugaaagagaaaguggacaaugguagaaaaaaaauuauuguaaucaaaagcuuguuauuugaagacaucaauuaaaguuuuaaaccucuagcuagaaugaucaagaguuagagagaaggcacuaauuacugguaaugagaaugaaaacuggggcauugcuauagacccuguggaaaugaaaaagauaaaaagaaaacauuuuguacaauuuuguaucaguaaagaaguacacacaauuuagugaaguagauaauauucuugaaagacacagauuucagaacuagccacagaacaaauacaaaacuuuaauagauguuuauuauugaaagaaauugaauuuguuguuaaaagaaauugaauuuguuguuaauuaaauugaauuuguccuucccacaaagaaaacuccaggcccacaugauaucacuggaugcagcuaucagacauuuagggaaaaaaaaauaaaaauucuacacaaacacguucagaaaauggagggcauuucccaacucauuuuauuaggcuaauauuaucuugauccccaaaccagacacagacaucacaagaaaacuuaaaaccaauaucugucaacauagaugcaaaaaugaaauuaaacauuauguagcaauauaucaccacuuaggauuuuuccuacaaaugcaagguuuguucaacauuaaaaaaauuaauuaaugcaauucacuguauuaauacaguaaaguagaaaaaacacauggucauuucacuuggcauggaaugugccuuugacaaaauguaacacccagucaugauaaaaccucucagcaaacuaacauaaaauacaaagguggcuuaacaucugaaaauuaacugauguaauacacuguauuaauagaauaaaagaagacagucaucuuuuuuuuauuauacguuaaguucuaggguacaugugcacaaugugcagguuuguuacacauguauacauaugccauguuggugugcugcacccaucaacucaucguuuacauuagguauaucuccuaaugcuaucccucaccccuucccccacuccacgacaggcccuggugugugauguuccccacccuguguccagguguuauuguucaguucccaccuaugagugagaacaugcgguguuugguuuucuguccgugugauaguuugcuuagaaugaugguuuccagcuucacccaugucccugcaaaggacaugaacucauccuuuuuuauggcugcauaguauuccaugguauauaugugccacauuuucuuaauccagucuaucauugauggacauuuggguugguuccaagucuuugcuauugugaauagugccguaauaaacauacaugugcaugugucuuuauagcagcaugauuuauaauccuuuggguauauacccaguaaugggaucgcugggucaaaugguauuucuaguucuagauccuugaggaaucgccacacugagaagacagucaucuuaauaaaagcagaaaacacaacugacaaaauucaacacccauucauaauagacacucucugcaaacuaggaauagauggaaauguccuaaaccucaucagggguaucuaugaaaaaacccaguagcuaaccaccuacuuaaugguggcaguuugaagccccucuacuuaacucaggaauaaggcaaaguugucugcuuucauguucuauccaacauuguacuauauauuuuagccauguaguauggcaaagaaaaaaaaaucacacagucaaaaaggaagaaguaaaacugucuuuauuugcagacaacaugguuuguacguagaaagccccaaggaaucuacagaaaaaacuacuggaagaacuaauaaaugaauuuaacaccaccacaaaaugcaaagucaguguuuguauaacccaaaaucaguuauauuucuguauccuaucauugggccauuggaaaauacaauuuaaaaacguguuuacaauuguauaaaaguuaaauauuuagaaauaaauacaacaaaagauuuguaauaaauggacacugaaaacuauaaaacagugcugagagaagucgaagacaacauaaaucaauggauacauaugcuguuuucauuagaagacucaauaguguuaggguggcauuuuucuccaaauugauuagauuuggcacaaucccaauaaaaaucucagcaaguuuuuucagagaaauugauaagcugauuucaauauuuguauggaaagucaaggcacauagaauagccaaaacaauuucaaaaaagaacaaaauuggaagacuuacauuaccccauuucaagacuugcuacacaguuauaauaagacagaguggcaguggcaugagaauagauauauuguucaguggaauggagaguguaaaaauacaugcgcaugugugugugagagagcgagagagagaauauauacacauauauaugaucagcuccuguuuaacaaaaaaugcugagguaauucaagggaaaggguagucuuucaguacacaguacuagaacaacuggucuguauagaaugaaaugaaucuugguccuuaccacacaucauacagaaaauuaguaugagcuaaaaugauaaaacuucuauaggaacacauaggaaaaaaaucuuugcucuauuggguuacacaaaguuuacgugaacaguaccaaaaaggaugagccauaaaagaaaaauguugaaaggaacuucaacacaauuaaaacuuuucuucuuuaagaaacaagguuacggaaaaugcaagccauagauugggaaaaaguaucuuuagacauauaucuggaaacaaccuaaauguccauugucaaaugaauggguaaucucauguaccccauaaauacauacaccuacuauguacccacaaaaauuaaaaacauaaaaaaaagaaaugugggcugggcaugguggcucacaccuguaaucucagcacuuugggaggccaaggugggaggaucacuugagcccuggaguucgagaccagccuggugauaagacccugucucuacaaaaaaauuuuugaaaaauuagccagguguggugaugcacaccuguggucccagcuacucaggaggcugaggugggaagaucacuugagcccaggaaguugaggcuacagugagccguguuugugccaccuuacuccagccuaggugacaaagcgagacccugccucaaaaaaaaaaaaaaaaaaauguaguauagauccuuuuguaguuuuuaagugucaugaugggguguccaugcacauguguaagaugugccacucuugaagcuuguuacaacaugggcagauuaccaaucucacaugaaaagaaaaaaaaaagaaauguauauacauacaguguuuauucagccuuuaaaaagaaggaaauucaugugacaauauggauuaaucauuaggauauuacacuaacugaaauaagacagucacagaaagacagauacugcauguuuacauuuauauaucuaaaauagucaaauucauagaaucaaagaguggaaugcugguugcuguguuggggugaggggugagggguaaguagaaauggaaguuaauaauuaacaggcauuaaacuugagucaagcaggaagaauaagcucuagagaucugcuguacaauguugugccuaaaguuaacauuaauguaugugcaauuaaaaauuuaagaggguagagcugccagguaugguggcugaugccuauaaccuauaaucacaccacuuugggaggcugaggcagguggaucacuugagccugcaaauuugagaccaucuugggcaacauggugaaacccuguuucuacaaaaaaacacaacaauuagucaggcaugguggugugcgccuguaguccccgcuacuugggaggcugaggugggaggauugcuugagcccgggaggcagagguuucgagugagccgagauugcagcacugcacuccagccugggcaacguugcaagacucugucucaaaaaaugcuggaaugcagugcagugcagugcagugcaaugcaauacaaugcagugcagugcaaaauaggguagaggucauguuaaauauucuuaccacaagagaaacaauuaaacaaagauaucugaagaaggccauuaacccccuauauauaugaaaccucuuacaacucaguaauaauauaauuaaaaagccaauuaaaaauggcaaaacucggcuaggcacgguggcucacgccuguauucccagcacuuugggaggccaaggcagguggaucaccugaaacugggaguugaagaccagccugaccaacacagagaaaugccaucucuacuaaaaauacaaaauuagccagguguggugaugcaugccuguaaucccagcuacuugggaggcugaggcaaaagaaucacuugaaccugggaggcggagguugcggugagccgagaucgcgccauugcauuccagccuaggcaauaagagugaaacuccaucucaaaaaaaaaaaggcaaaacucuugaacacagugucuguguauuguucaaguguauuuguuuagcuggauggugagauuagggauagauacauaauuacauuuacauuuuguauuuauauuuaauaguauauaguuaguuguaaaaaaccauggauaagacuggaaagggaaaauguagagagaacagagggcuggggcaauacuuagggaauaucaguauuuaacuggcagauaguagaagaggugccuaaguaagccaccgaaggaacaguucgagugguaugaggagcacuagaagagaugugucguagaagcaaaaugagaugaguguuucaaagagaaaauggucaguaguaucuaaaaacauaaagagggccaaaaaaagaaguaucuggaaaauguugauuacuuuaacaagacugaugacuuuacaacagccuuuucauaggaguggaucuaaagggaagagacagaaaccagacuguaggguuuugaaguguaacaugaauuaaggaaaugaagaaaaggaggugguaugcuauagucguuaagaguauaggcugggaggccgaggcaggagggucacgaggucaagagauugagaccauccuggccaacuuggugaaauccaaucucuacuuaaaauacaaaacauuagccaagcgugguggcaggcgccuguagucccagcuacucaggaggcugaggcaggagaauugcuugaacccaggaggaggagguugcagugagccgagaucgugccauugcacuccagccuggcgacagagcaagagaguuuaagccgggcauguuggcucaugccuguaaucccagcacuuugugaggccaaggcgggcagaucaccugaggucaagaguuugagaccagccuggccaagauggcaaaaccgcgucucuacuaaaaauacaaaaauuagcugggugcgguggcgugugccuauaaucccagcuacuugagaggcuguggcaggagaauagcuugaacccaggaggcagaagcugcagugagccaagaucgcgccacugcacuccagccuggauuacagagugagacuucaucucaaaaaaaaaaacaaaaaagaagauaaaaaaagaagaguauggccucuggagccaggugcuggaguuucaauccuggcuguccgcuuucuagcugugugaucuguaugaaauaaagaaaggaauaguaccuaccucacaggugguuauagagauucaaagaauuaauauacgggcucagcgcuauggcucacguggguaaucccagcacuuugggagccaaggcgggcggaucaccugaggucaggaguucaagaccauccuggccaacauggugaagcccugucuguacuaaaaauacaaaaauuagccgggcgugguggugugcgccugcagucccagcuacucgggaggcuuaggcaggagaauggcaugaacccaggaggcagagguugcagugagccaagacugcaccacugcacuccagccugggcaacagagcaagacucugucucaaaaaaaaagaaaaaaaaaaagaauuaauacacgaaacgugauuacaguggugucuggcacugaguaauugcuauauaaguguucuuguuuuuauuauuaaaaacugccucugaaaagguuugacugggaauggaagaaaaggauguauuuugcuuugcuggagaagggagggaaagucaaggggaggaggaguuuaaaaacauuuauaugccuagagaaaccuagaucaaagaaaaagccaaaggucuaaaagagagcagugagaacagaugacgcaaggcuccaaaguucagagaacugaacaagggggaugagacucaaaacaagaggacuccugacucacuagguuagggguaaggauggauucugauaaauaccaguauguugcgaguguucuggugccuucgaguuuggccaauuaagagguaacgugguaugaggaaauggaguugggggaaggauaguuuggauuaguuuggaggguacuucguggagaauggugaguacuuuggauacccgaggaaaacaggagaaauuuaacaauggacaaguaaaguguccaaagucuugugguuuacaacccuauauaucacaagaauuuccuucuccaugucuccuuguagaagugguuacauaacaccuaguuauuuuauuuuauuuuauuuuauuuuuugagacggagucuugcucugucgcccaggcuugagugcaguggcgugaucuuggcucacugcaagcuccaccuuccagguucaugccauucuccugccucagccucccgaguaguugugacuaaaagugccugccaccacgccuggcuaauuuuuuuuuuuuguauuuuuaguagagacgggguuucaccauguuagccaggacggucuugaucuccugaccucaugauccgcccgccucggccucccaaaguacugggauuacaggcaugagccaccgugcgcggccacaccuaguuuuuguuuuuuuuuuuuuaagugaaagcaguuugccuuuacuuuauaagaagaguuuacacccaugagauaacuugagacaaccugaagucuuacaaaaccagcgucagaaucauugaauuaaccaucuuaucucaaaagaagaaagaauguaauaaaaaucaaacaaaauuuuaaaaaucuaggaagcuuauaaucauuaggccugugauuaaaagguuuucuuucuaguucuuugugucuuucacuaacaugguacuucagguuuuuaacgagaugcaaaaauuacuuuaauugcuuaccugccuaagaauccugacuuuuaaauucaggaaauaauuguagauauaacuaacaaggaaaacugugaauuuuauagucuggguaaucugagcuugggguaagcaauaauuaaaauuuuucuuucuuuuuuuuuuuuuuuuuaacagugauccuuacgugagagugacguuauaugacccaaugaauggaguucuuacaagugugcaaacaaaaaccauuaaaaagguuagacuuagcaauauucaaaaguuuuuaauguacuuuguuuuauuuuuauaagacaaaaccuuauuuaguuauacuauguuuauuauuuuuuagaguuugaauccaaaguggaaugaagaaauauuauucagaguaaguauauauuuuauuuuacuaaaguggaaaaaguaaguuuuuuucuuaggagguuagaaugauaaauucucauuuuuaauauuugaagauguaucucagaauuugccuaaaguugugaaaauacaaaaggaauugaaauuuugucuuauaaaaaacauaaauguaagauaauggagagguaaaagacuagaauuaucuuauucuaguaaaacugauuuagagacuguacaguagucuuacuccaguugagcagauucaguguuuucucauaaagaugaugcaaauuauauuuaugucuccccagucauuuauuauuaaacagauuagggccuaucaagugaaugcauuucuuuuuauccacacgucauugacauugcugccuuuccaccccaucugccucauuuaccauaaaagcaaauuccaaucagcaguuauuuccaauuccucagcaaggcccucagacugacagugucuccuuguaccuauuuaauaucagaguacuuacuguugccagaaucgaaacccuaccagagcagugguagagaugcauuuuaggaauuuccccucucuggauuauucccacuuguaucaucccuaaaauguucuuccuugaccccauauuccccuuuagcuguugagucguuucucuguucaccugaauaaggaacauucaugggagaguugucugcccucgucauuucugcuucuccgggacgcucguuaacccacuguacucuaaauccccaucacucaaaugaaacugcuguuauucgggucaccagugacuucccugcugccaaguucaucuuaucucaucuuacucaugcucuuugcagcauuugacauggcagaucauuccugaaacaccagccucucuggaggcuucugugguaccauacuugauuucaguaaggaaaacagaagccguucuucuguacuucauguuuaaagauuuuuuguuugucuucuuuuguucaauuuuaauaaagugaauuugaagggaagaaauugcugacauuaagggcaaggaagcuguugcugaagauccagccaaaggcaucaauuaaguugcuucuguuuuuuugguuuggaguaagauuuuccccacucuauguaguaugacauaaaaacaaccuuuuaaaucgguuuggaaauuuuggauucuugaggaaaugguauugaaucaauuggaucgucaaaugaagaaaaaugaagcuaaauuucuguuuuuacuauuuaaccagaauaaauuccagacuugauaaugucugguuuugauugcuuuuuuggcacaaguguugguuaggagaguguuuuuaaauucccaaguuguugaguuauuuauuuauuuauacuuuuguuuuauuuuacuuauuuuguuacauuuuucuuagaaacauauguauuuucuuuuuuuuuuuaauuauacuuuaaguucuaggguaccugugcacaacgugcagguuuguuacauauguauacacgugccauauuggugugcugcacccauuaacuugucauuuacauuagguauaucuccuaauacuaucccuccccacuucccccaccccaugacaggccccagugugugacguaccccuuccuguguccaaguguucucauuguucaauucccaccuaugagugagaacaugagguguuugguuuuuugucccugcgacaguuugcugagaaugaugguuuccagcuucauccaugucccuacaaaagacaugaacucauccuuuuguauggcugcauaguauuccaugguguauaugugccacauuuucuuaauccagucuauuauugauggacauuuggguugguuccaagucuuugcuauugugaauagugcugcaauaaacauauguaugcaugugucuuuacagcagcaugauuuauaauccuuuggguauauacccaguaaugggauugcugggucaaaugguauuucuuguucuagauccuugaggaaucgccacacugucuuccacaaugguugaacuaguuuacagucccaccaacaguguaaaaguauuccuauuucuccacauccucuccagcuccuguuguuuccugacuuuuuaauguucgccauucuaacuggugugagaugguaucucauugugguuuugauuugcauuucucugauggccagugaugaugagcauuuuuacauguguuuuuuggcugcauaaauggcuucuuuugagaagugucuguucauauccuucgcccgcuucuugaugggguuguuuuuuucuuguaaauuuguuuguguucuuuguagauucuggauauuagcccuuugucagaugaguagauugcaaaaauuuucucccauucuauagguugccuguucaugcugaugguaguuucuuuuguugugcagaagcucuuuaguuuaauuagaucccauuugucaauucuggcuuuuguugccauugcuuuuaguguuuuagacaugaaguccuugcccaugccuauguccugaaugguacugccuggguuuucuucuacgguucuuaugguuuuaggucuaacguuuaagccuuuaauccaucuugaauuaauuuuuguauaagguguaaggaagggaucuaguuucagcuuucuacauauggcucgccaguuuucccagcaccauuuauuaaauagggaauccuuuccccauuucuuguuuuugucagguuugucaaagaucagaugguuguagaugugugguguuauuucugagggcucuuuucuguuccauuggucuguaucucuguuuugauaccaguaccaugcuguuuugguuacuguagccuuguaguauaguuugaagucagguagcaugaugccuccagcuuuguucuuuuugcuuaggauugucuuggcuaugugggcucuuucuuggcuccauaugaacuuuaaaguaguuuuuuccaauucugugaagaaagucauugguagcuugauggagauggcauuaaaucuauaaauuaucuugggcaguauggccauuuucacaauauugauucuuccuauccaugaguauggaauguucuuccauuuguuuguguccucuuuuauuucauugagcaguaguuugaguaguucuccuugaagagguccuucacaucccuuguaaguuggauuccuagguauuuuauucucuuugaagcaauugugaaugggaguucacucaugauuuggcucucuguuugucuguaauugauguauaagaaugcuugugauuuugcacauuaauuuuguauccugagacuuugcugaaguugcuuaucagcuuaaggagauuuugggcugagacggugggguuuucuaaguauacaaucaugucaucugcaaacagggacaauuugacuuccucuuuuccuaauugaauacccuuuauuucuuuuuccugccugauugcccuggccagaacuucuaacacuauguugaauaggaguggugagagagggcaucccugucuugugccaguuuucaaagggaaugcuuccaguuuuugcccauucaguaugauauuggcuauguguuugucauaaauagcucuuauuauuuugagauacgucccaucaauaccuaauuuauugagaguuuuuagcaugaagggcuguugaauuuugucaaaggccuuuucugcaucuauugagauaaucauaugguuuuugucuuugguucuguuuauaugcuggauuacguuuauugauugcguauguugaaccagccuugcaucccagggaugaagcccacuugaucaugguggauaagcuccuuguaccuuugguagaauucagcugugaauacgucugguccuggacuuuuuuugguugguaggcuauuaauuauugucucaauuucagagccuguuauuggucuauucagagauucaacuucuuccugguuuagucuugggaggguguaugugucgaggaauuuauccauuucuucuagcuuuucuaguuuauuugcauagagguguuuauaguauucucugaugguaguuuguaguuuguauuucugugggauugguggugauauccccuuuaucauuuuuuauugcgucuauuugauucuucucucuuuucuucuuuauuagucuugguagcggucuaucaguuuuguugaucuuuucaaaaaacuaccuccuggauucauugauuuuuugaaggguuuuuuaugucucucucuccuugaguucugcucuuaccuuaguuauuucuugucuucugcuagcuuuugaauguguuugcucuugcuucucuaguucuuucaauugugauguuagggugucaauuuuagaucuuuccugcuuucucuugugggcauuuagugcuauaaauuucccucuacacacugcuuuaaaugugucccagagauucugguauguugugucuuuguucucauugguuucaaagaacaucuuuguuucugccuucauuucguuauguacccaguagucauucaggagcagguuguucaguuucuauguaguugagcaguuuugagugaguuucuuaauccugaguucuaguuugauugcacuguggucugagagacaguuuguuauaauuucuguucuuuuacauuugcugaggagugcuuuacuuccaacuauguggucaauuuuggaauaagugugguguggugcugagaaggauguauauucuguugauuugggguggagaguucuguagaugucuguuugguccacuuggugcagagcugaguucaauuccuggauauccuuguuaacuuucugucucauugaucugucuaauguugacagugggguguuaaagucucccguuauuauugugugggagucuaagucucuuuguaggucucuaaggacuugcuuuaugaaucugggugcuucuguauugggugcauauauauuuaggauaguuagcucuucuuguugaauugaucccuuuaccauuauguaauggcuuucuuugucucuuuuggucuuuguugguugaaagucuguuuuaucagagacuaggauuguaaccccugcuuuuuuuguuuuccauuugcuugauagaucuuccuccaucccuuuauucucaugagccuaugugugucucugcacaugaggugggucuccugaauacagcacacugaugggucuugacucuuuaucuaauucgccagucugugucuuuuaaugggggcauuuagcccauuuacauuuaagguuaauauuguuaugugugaauuugauccuguaauuaugauguucacugguuauuuugcucguuaauugauggaguuucuucauagcaucgaugaucuuuauaauuuggcaugguuuugcaguggcugguacugguuguucccuuccauguuuagugcuuccuucaugagcucuuguaaggcaggccugguggugacaaaaucucucagcuugucuauaaaggguuuuauuucuccuuuucuuaugaagcuuaguuuggcuggauaugaaauucugcauucaaaauuauuuucuuuaagaauguugaauauuggcccccacugucuucuggcuuguaagguuucugcugagagauuugcuguuagucuaauggguuucucuuaguggguaaccucaccuuucucuguggccgcccuuaacauuuuuuccuucauuucaacguuggugaaucugacaauuaugugucuugggguugcucuucucgaggaauaucuuugugguguuaucuguauuuccugaauuugaauguugucaugccuugcuagguuggggaaguucuccuugauauuauccuguagaguguuuuccaccuugguuccauucucccugucacuuucagcuacaccaaacauagaguuggucuuuucacauagucccauauuucuuggaggcuuucuuugcuucuuuuuauucuuuuuucucuaaacuuguauucucacuuuauuucauuaauuucaucuucaaucagugauagccuuucuuccacuugauugaaucagcuacugaagcuugugcauguaucacaaaguucuugugccaugguuuucagcuccaucaggucauuuaaggucuucucuacacuauuuauucuaguuagccauugggcuaaccuuuuuucaagguuuuuagguuccuugcaauggguuagaacaugcuucuuuagcuuggagaaguuuguuuuuaccgaccuucugaagccuacuucugucaacucaucaaagucauucuccuuccagcuuuguucuguugcuggcgaggggcugcgauccuuuggaggagaagaugcgcucugguuuuuagaauuuucagcuuuucugcucugguuucuccccaucuuggugguuuuaucuaccuuucaucuuugacguucgugacauacagaugggguuuugguguguauguccuuuuuguugauguugaugcuauuccuuuguguuuguuaguuuuccgucuaacacucaguucccucagcugcacaucuguuggauuuugcuggagguccacuccagacccuguuugcuuggguaucaccaguggaggcugcagaacagcaaauauugcaaaacagcaaauauugcugccucauccuuccucuggaagcuuugucccagaggggcaccugccuguaugaggugucuguuggccccuacugggaagugucucccaguuaggcuacacgggggucagggacccacuugagguggcagucucuuguuaucagagcucaaaucccaugcugggagaaccacugcucucuucagagcugucagauagggacauuuaagucuguagaaguuucugcugcauuuuguucagcuaugcccugcucacagagguugagucuauauaggcaguaggccuugaugagcugaggugggcucugccuaguuucagcuucccggcugcuuuguuuaccuacucaagccucagcaaugguggacaccccuuaccccaccagucugcagacuggcaggucgaucucagacugcugcgcuagcagugagcaaggcucugugggcaugguacccgccaauccaggcaugggagagaaucuccuggucugccaguugauaagaccaugggaaaagcacaguauuuggccagaaguguccuguuuuuccagguacaguuuaucacagcuucuuuuggcuaggaaagggaaauccccugaccccuugcacuuccgaggugaggcaaugccccauccugcuucggcuugcccucugugggcugcacccacuguccagccaguccaaaugagaugaaccaggcaccucagguggaaauguagaaaucacccgucuucugcgucaaucauaccgggagcugcagacaggagcuguuccuauuuggccaucuuccaaucauuacaucuuaaagcuccaaaauaaucuccuuugacucugugucucacauccaggccacacugaugcaagggguggguuccgaaaggccuugggugucuccaccccugugucucugcaagguacaaucccuucagcugcuuucacaggcuaguguugagugccuaaggguuuugcaggcaaacagugcaagcgguuagucaaucucccauucuggggucuggacgauaguggccuacuucucacagcuccacuaggcagugucccagugggaacccuguguggggacuccagucccacauuucccauccacacugcccuaauagaaguucuccaugagggcucugccccugcaauauccagacuucuguguggauaucgacacauuuccauacauccucugaaaucuaggaagagcuccuaagccucagcucuugcccugugcccaccugcaggcuuaaaaccaugugaaagccaccaagacuuacgguuugaaccuucuagagcagcggccugagacauaucugggcccuuuuacccacagcuggagcuggaguggcugggacucagagagcagugucccaagguuguguagggcagcagggcccugggccuggucuaugaaaucauucuucccuucuaguccucuggggcugugauaggaggagcugccacaaagaucucuaaaaugcauucaaggcaucuuccccauugucuuggcuaugaacauucagcuccagcagcuggcuugaauuccuccccacaaaauggggcuuucuuuucuaccacaugaucaggcugcacauauucccaacuuuuaugcucugcuuuccuuuuaaauauaaguuccaguuucagaucauuucugugaaugcauauaagcauaugguuagaagcagccaggccacuucuugaacacuuugcugcuuagaaauuucuucugccagauaccguaaaucaucucuuucaaguucaaaguuccacagauuucuagagcaggggcacaaugcugccagucucuuuguagaagcauagcaagagggaccuuuauuucaguucccaaaagauuccuugucuucgagaccaccucagccuggacuuuccuguucauaucacuaucagcauuuuggucacaaccauucaacaagucucuaggaaauucuaucuuuccaucauccuccuuucuucuucugaucucuccaaacuguuucaaccucuguccauuacccacuucuaaacuugcuuccacauuuucagguaucuguauagcaaugccugacuucccauuaccaauuuucuguauuaguuuguucuugcauugcuauaaagaacucccugagacugagcaguuuauaaagaaaacggcuguaauugacucacaguuccacaggcuguacaggaagccuggaugagggggccucaggaaacuuaacaauugugacagaaggugaaggggaagcaggcucaucuaacauggccagagaaggaggaggagaaugaagggggaaguacuacacacuuuuaagcaaccaaaucucauaagaagucgcuuacuaucaccagagcagcaagggggaagucugccuccgugauccggucaccucccaucuggccccuccuccaacauuagggauuacaauuugacaugagauuuuggcagagacauaauuccaaaccauaugagauaccauacaaacaccagaaaaaauauguuaaugguuguauuaacauuagccaaauuagacuucaggacaguauugccagagauaaagagggcauuucaugauuauaaagagugaauucaacaagaagacauacaaucugaaauguguauggaccuaguaaucuuuaaaauuacgaagucaaaauugacagaacuaaauaaauaaacaaauccacaauaguugauuuuaccacuucuaguaacugauacaacaacuagacaaaaaaaaaauaguaaauauauagaugauuugaacaacacuaccaaucauguuaaccuguuugacauguauaguacacuacagcuaauacccaaguguauauucuuuuuauaugcccauggaacauuuaccaagauagaccacauauugggccacaaaccgaguuucaguacaguuaaaaggauugaaauucaacaggauuggcugggcgcaauggcucacgccuauaauccucgcacuuugggaagccgaugcaggcauaucacuugaggucaggaauuugagacaagccugaccaauaugaugaaaccccgccucuacuaaagaaaaaaaguauacaaaaaguagcugggugugauggugcgcaccuguaauaccagcuacuugggagacugggcacgagaaucgcuugaaccugggaggcggagguugcagugagcugaaauugugcugcuggacuccagccugggugacagagugagacucugucucaaaaaaaaaaaaaaagaaauuuaacaggguauguucucugaucacagcagauuuaaguuacaauucaguaacacacguauguauaucacaaauguuuagaaauuaaacaaguuucuuuugaauaagccauggaucaaaaaagaaaauaaaagggaaauuaacaagcauuuuuacugauugauuguuaaagcauaacauaccaaaugugggaugaagcuauuucagugcuuagagauuaauuuauaccuuuaaauacuuguauauaaaugaagaaauauucaaaaucaaugaucuaagcuuccaccuuaaguucuuuaaagaaaaagaaggaaggaaauaagaguggaaaucaauggacaagaaaauggacaaaaaguagagaaaauaaauaaaaccaaggauggaucuucaaaaaaauuaaugaaauugauauacaacagcuggccuuauaugagagagacagagagaguacucagaugaccaauauuaggaaucagaggagggaaccuacagauacuuuuuaaaagguaauauuguaacuaauuuuaugccuguaauuuuaacaacucaguuuaaauggauaaauucuuauaagccaaaauauacuaaaaccaauauaaguagaaacagaaaauauggauaucuguuagaggaauuaauguuauaauuuauuuuuuauuuuaaaaaauuuaaggugcuuauaauuuaaaaauauugccauucuuuuugaugaucuuauucuuuuauuagaaagaauguuuggccuggcaugguggcucaugccuauaauaccagcacuucgagaggccagggugggcccccuaaaaguuuaaggucauccugagcaaaauagugggaccccaucucuaccaaaaaaaaacgacccucuucacaaggcaugguggcacacaccuauagacccagcuacuuuggaggcugacaugggagacaauucuuugagccaaggaauucgaggauaccgugggcaacauagugagacagucccaaaagaaagagacagagagaggcagagaggcagagagagagagagagagagagagagaagggggaggagggaaggaggaaggagggagagagggaggaaggacuacuuuggaauuagagauguuaaugagaaaaauaagccauuuaaacaaaauuuuaacugauuuauuggggguauaguucauauagaaaaagccugcacauauuuaauucauacaguuugauagguuuaaacauaugcauacagcugugaaaccaucaccacaaucaaagucauaaacauauccaucaccuccaaaaguuuccuccuaucacccccuuuuuugugguaagaacacuugauauguacccucuucacaaagguuuugguguauaauauaguauuaaaccaccauucuauucucugcuucuaugaauuugacuauuuuagauacuuuuugugaguaagauagucaguauuuguucuucugggacuagcuuauuucaccuaggguaguguccucaagguucauccauuuuguuggaaauggcaggguuuccuuuuugaaggcugaauaauauucuauuguauguauaugucacauuuucuuaauguauccuucaauggguauuuagauuauuuccauaucuuggcuacugugaauaaugcuguaaugaacgugggagggcagauaacuuuaauugcagugauuuuauuuccucuggcugcauaccuagaagugggauugcuggaugauccaguaguucuacuuuuuaauuuuuuggggaaccuuuauacuguuuucuauagaggcuauacuauuuucuguagaggcuggagcauuuuacauugcuaccaacaugugcagggauuccaguuucuccacaucuucaccaaaacuuguuaacuaaaaaaaucuaaaaauuuuuguaauagucauccuaacaggugugguuuugauuugcauuucccugaugauuagugauuuuugagcaccuuuuuacauaaagagugggccauuuguuuguuuucuuuggagaaaugucuguugaaguccuugguucauuuuuuaaauuagguucuuuguugcuuguauuaguccguuuucacacuaugauaaagauacuaccugagacuggguaauuuauaaacaaaggagguuuaacugacucacaguuccacauggcuggggaggccucagucauggcagaagaugaacaggaagcgggcaccuucuccacaagaugguaggagacagaagagaaagugaagggggaggaacccuuuguaaaacugucagaucuccagagaaugaacucacugucaugagaacagcaugggggaaacugcccccgugauccaaucaccucccaccaguucccucccuugacacguggggauuacggaucgagaugagauuugggugggcaacagagccaaaccauauuauuguuggugguggguuuuuuuguuuguuguuguuguuguuuucgagacacggucucacucuauuauccagguuggagcgcaguggcacaaucauggcuuauugcagccucaaccuucuaggcugaaaugauggccuaccucagccucccuaguagcugcaaacacaggugcacaccaucacgcaccaccauuuuuauuuuauuuuauuuuuuguagugacacacuguuuugcccaggcuggucucagacuccuggauucaagugauccuccugccuugcccucccaaagugcugagaucacaggcaugagccacugugccugggaguuuauuuuauuuuguuauuguuguuguuguugaugcuuguuuuuuuuuuacuauuggguuaugggaguuccuuuuguauguaauuuugaaguuuggagaucaacucuuuaucuuauacauggucugcaaauauuuuucccauuuuguacggugccuuuucacuuuguugauuguuucuuuugucauauagcuuuuuaguuaaauguagcugcacuugucaauuuuugcuuucauugccuuuguuuuuggugucacccaaaaaaucauugucauugucaagaccaaagucaagaagcuucuucucuguuuucuucuauggguuuuacagugucgggucuuguuugugucuuuaauucauuuugaguuuauuuuuguguuuguuuuaagauaagggucaauuucuuucuuuugcguauggauauccaguuuucccaagccauuuguuguuuuuuuguuuuguuuuuuguuuuguuuuguuuucagacagucucacuggaaugcaguggcacgaucucggcucaccgcaaccaccaccucccagguucaaaugauucuccugccucagcuuccugaguagcugggacuacaggcacacgccaccaugcccagcuaauuuuuguauuuuuaguagagacaggguuucacuacguuggccaggauggucuccaucucuugacuucauuaucugcccaccucagccucccaaagugcuaggauuacaggugugagccacugcgccuggccaccauuuguugaagagacuguccuuuccccuuuguguaugcuuggcaccugagucaaagaucaguggacuguauuucuuggguuuauuuuugagcuaucuauuucauccgucucugucugucuuaauuccugugucauacuguuuuaauuacuguagcuuugugauauauuuggaaaucaggaacuauuaugccucuagcuuuguucuucuuucucaagaugcagggucuuuuguaguucuguaugaauuuuaggauuauguguucuauuucuuuaaaaaguaccauuggaauuuuggugaguguaacauugaauuuguggauuacuuuggauaguauggacauuuuaacaauauuaaguucuuccaauccaugaacacaggaugucuuuccauuuauuuuugucuugaaagaaggcuauuuguaauugacaaaucaggauuaggacucuacugccauuuccuuauuuuuuauuuuauuuucuauaacuucccuauuaccaaauguuuuagcuaguuacauuuaccaaauauuuacuucauuuuugggaucacaggcuacacauuuguuucaauuagaaauucugcuauuuuauuauaaggauaacuagauaaauuuguguggaucaaugcuaauucauuaugcuuagaaaaaaacugaaaacauacggugaaauaucuucugugcaaaggacauuauuaugugugguccucuauuuuccucuuugucauuuauaucaucauuuuuauauagcccagaauguuuugaacugaauguauucgccauaaaaaugucuguugagauaacauauuacagcaaaaacuugguucuugggcauucggccaaauggaaauuguggucagaaguugaaggcaguuuuauaucuuugagaaaacaugaaguucaaaaaaaguuuuugugaaaaacuguuauugacaacacaaacgggaaacuccaaguugaaguuagugcucaauagcaaauuauggccaggcacgguggcucaugccuguuuucccagugcuuugggaggccgaggaggguggauugccugaggucaggaguucaagaccagcccggccaauauggugaaaccucaucucugcuaaaaauacaaaaaucagcugggcaucauggcgcaugccuguaaucccaacuacucaagagggugaggcaggagaaucacuugaaccugggaggcagagguugcagugagccgaguucacaccauugugcuccagccugggugacaagagugaaacucugucucaaaaaaaaaaaaaagaaaagaaauagcaaauuauaauuaaaaucuacacuuuacaugcuuagagggaaaaaagugcaacacauuaggugcaaugcacauguuauuuacucugugcauaagaauugugcuugggcaucugaaaaagccucaccccauuuccuacauucugcaggugcucuguguauauuuuuagcauucauacucaauauauuagauuuauguaauguauauauaugcaaguguauguuuauauuauguuauagaaguaauauaacuuaugcaagauaguuuuuuuaauaaagagaaaugaaaaucagccauaauuucaucucgauaaaccaccacugauaauaugcuuuucugggauuuccuauguguuuuuuuuucuuuuguauuuuuauggauagggggaaaaaacuuaccuacauacgcacacaaauuuggcgugauuuuuuucuauaccuauuucucaggcacuuugcuaugauuguuaaugagauggccacaguaccuacccucaaugaaacuuacugucuaguauggaccagugugaacagguaacucauaauuauuaccagugugcugagcuuuauggaagggaaaacaaugauaccggagaguaaauacaggguugggggaucacuuagucuaggagguuuaggagggaccccucugacaaaguguaucauuuaggaugcuuuuagcuucaaguuauagacuugaaguagcaaugaaaacugccuucacaauaagcacacugauuagcuuuaaucauaagaagcauagaagaagguuggucauugcagcaggugaaagaagucaugcuugacccagcuucucugggauucucuuggcuuucucucuguggucacagauacuuacagcaguuccaaagacaugaugauguccagaggcugaaaagggagagcuuuuugcugaguaucuuuuuuuuuuuuuuuuuuuugaaacagagucucacucugucgccaggcuggaguguaguggcacgaucucaacucacugcaaccucugccucccggauucaaaugagucuccugccgcagccucccgaguagcugggacuacaggcgcaugccaccacgcuuggcuaauuuuuuguaguuuuaguagagacaggguuucacuguguuagccaggauggucucgaucuccugaccucaugauccgucugccucagccucccaaagugcuaggauuacaggcaugagccaccacgcccagccuuugcugaguaucccuuuaaaaaaguaaaaaaccuuuuuccagaagacuuuggaucuuuuucucuugggccagaauuguguaaugugcauauuuccuaccccauuguuggugaggaaaaugguguuacccuaaggcuuagaggaaucaaaauucagccccugggagagaggaguugcugucuaucccugacagacauagucacccaauauuugaauaaaauuauaauucuuuuagcuaggaagaaggcaggacaccccaucaguggagcaguaaguaaauuaugauacauucauacaacgaaauccuaaucuacuguuuaaaaagaggcagguuuauauguuguuauagauaauucauuucagauuauacuaaaugaagcaagaaaaaugcagaacaaggccagacaugguggcucaugccuguaaucccacuacuuugggaggccgaggaggguggaucaccugaggccaggaguucaaaaccagucuggccaacauggugaaaccccaucucuacuaaaaaugcaaaauuagccaggcaugguggugggugccucuaauuacagcuacuugggaggcugaggcaggagaaucacuugagucugggaggcagagguugcagugagccgauauugugccacugcacuccagccugggcaauagagugagacuccauuucaaaaaaaaaaaaaaaaaaaaaaaaaagcagaacauuguauauaggaauauauuauuuguguaaaaccagaaaaauuuuuaauaaaauaaaauuuuaauaauaauaaaauuucuuauaugcugguauuuuuagaaaauaauucuggaaggaccuaagaaacuguuuacuguauuugcucugggggugggacaaagguaagacagagauuuauaauuuacuauauauccuuuuuuacuguuuggguuuuuucuccguggccguauaucuacaguuuauuuuuauauuuauugauuaaacuauuugcauaaagaaauaaaguggaaagacauaaaacauuuaaauuaaaaugccggaauacuuucuauucauauauuguuuuaugcuuaugaaaauacuugucuaauucacuuaacuuuuuacacuuuuacaguguuauuaaaauauaugcacagaaaacuugcgcaccaauguucguagcagcauuauucauaauagucaaaaauuagaaacagcacaaauguccaucaacugauaacaaaaugagauauacacauauaaugaaauaucauucaucaauaaaaaggaaugaaguauugauacaaguuacaacuuggaugaaccuugaaaucauuauacuaagugaaagaagcuguauuagcccauucucacacugcucauaagauaugccugagacuggguaauuuuuuuaaauuaucauuauuauuauuauuuugagacagaguuucacucuuguugcccaggcuggagugcaguggcgcaauuucggcucacugcaaccuccaccuccuggguucaagcuguucuccugucucagccucccaaguagcugggauuacaggcgugugccaccacacccagcuaauuuuguauuuuuaguagagacgagguuucacccuguuggccagaauggucucgaacuccugaccucaggugaccugccugccucggccuaccaaagugcugggauuacaggugugaaccacugccuccagccaagacuguguaauuuauaaaggaaaaaguuuuaauugacucacaguuuagcauggcugagaaggccucagaaaacuuacaaucaugauagaaggggaagcaaacacaucccucuucacauggcagcagcaaguagaagugucaagaaagagguggaaaaccccuuauaaagccaucagauuuuuuuuuuuauacuuuaaguucuaggguacacguacacaacgugcagguuuguuacauauguauacaugugccauguuggugugcugcacccauuaacucgucauuugcauuagguacaucuccuaaugcuaucccucccccuucccccuccccccaccccacgacaggccccagugugugauguuccccuucccguguccaaguguucucauuauucaauucccaccugugagugagaacaugcgguguuugguuuucugucccugugauaguuugcucagaaugaugguuucuagcuucauccaugucccuacaaggccauuaacucauccuuuuuuauggaugaguaguauuccacaguguauaucugccacauuuucuuaauccagucuaucauugauggacauuuggguugguuccaagucuuugcuauugugaauagugcugcaauaaacauacgugugcaugugucuuuauagcagcaugauuuauaauccuuuggguauauacccaguaaugggauggcugggucaaaugguauuucuaguucuagauccuugaggaaucgccacacugucuuccacaaugguugaacuaguuuacagucccaccaacaguguaaaaguguuccuauuucuccauauccucuccagcaccuguuguuucuugacuuuuuaaugaucgccauucuaacuggugugagaugguaucucauugucguuuugauuugcauuuaugcaaacucucugauggccagugaugaugagcauuuuuucaugugucuuuuggcugcauaugucuucuuuugagaagugucugugcauauccuuugcccacuuuuugauggaguuguuugauuuuuuuuucuuguaaauuuguuuaaguucuuuguagauuuuggauauuagcccuuugucagauggguagauuguaaaaauuuucucccauucuguagguugccuguucacucugaugguaguuucuuuugcuguacagaagcucuuuaguuuaauuagcuccaauuugucaauuuuggcuuuuguugccauugcuuuugguguuuuagucaugaaguccuugcccaugccuauggccugaaugguauugccuagcuuuucuucuaggguuuuuaugguuuuagcucuaacauuuaagucuuuaauccaucuugaauuaauuuucguauaagguguaaggaagggauccaguuucagcuuucuaccuauggcuagccaguuuucccagcaucauuuauuaaauagggaauccuuuccccguuucuuguuuuugucagguuugucaaagaucacaugguuguagaugugugguauuauuuccgagggcucuauucuguuccauuggucuauaucucuguuuugguaccaguaccaugcuguuuugguuacuguauccuuguaguauaguuugaagucagguagcaugaugccuccagcuuuguucuuuuggcuuaggauugucuuggcaaugcagguaaagccaucagaucuuauuacaacucacucacuaucacgaaaacagcaugcagguaaccgcccccaugauucaauuaccucccaccaggucccucccacuacacaaagggauuaugcgaacuacaauucaagaugagauuuggguggggacacagucaaaccauaucagaagccaauuacaaaagaccauauauuguaugauuccacuuacaugaaauguccagaauaggcaaaucuauggagacagaaaguagauuagugguuuccugggaagguugagggaaaauggggagugucuguuaaaagacauaagguuucauuuuguaaugguaaaaauguucuaaaauuguggugaugguugcacauucucugaauauauuaaaaaccauugaauuguauacuucaaagggaugaguguaugcuaugugaauuauagcuaguaaagcuauuuuaaagauguaucuguauuguuuguucccacaaccacuggcagaauuuucaagaauauugcuucaguuucuuuaugaacacaauagaaucauauacuuaccaacaccuuuguucuuuuuggaaaacuggauauuuuuuggcaacuuuuuuccucuguuguuuuaugcauuuauagacuaacauaguuauccuuuuuuucaauaagucugucacugauauuuuuauuuuuuuucugcuuuugccuuuccuuaaaauaucaucuuauaaacucuauuuuuugugagcauaguuuuacuucuaucuucaauaaauuuaaaaaaucuugugaaagaauuugcacauaguuuuaaaaugagauaguauaaaagggcuuauaaugaaaaacaacaaauucugguguucuguccucccuccuauuccugcuacccacuuuuuaacuguuucuguuuguuacucugaucauauuucccauauuauuaaaaagcucaugcaugcauguuccaaguugauuuccaacugugauagaugaauaaauagccaacuuauguuuggcuguucauaggauucuugggugaacauaaauuugaagacauugcuuuaucaucuuuuacaauuguauuuuguauuccuguugaaagauauacuuguuccuuuuuucucccucuuuccuucucuuucucugaaaaauuuaauaauuaucuuuacgcccguguuuuaaaauuucacaguuauaugccuuguauguacaguuuuuaaaauccauuguguuuggccuuugguaagugaauuaguccauucugaugcugcuaguaaagacguacccaagacuggauaauuuauaaaggaaagagguuuaauggacucacaguuccacauggcuggggaggccucacaaucauggcggaaggcaaaggagaagcaaaggcauaucauacaugguagcaggcaagagagugugugcagggaaacucccauuuuuaaaaccaucagaucuccugagacuuauucauuaccaggagaacaguaugggggaaacuacccccaugauucaauuaucuccaccuagcccugccguugacacauuuggauuauuacaauucaggugaaauuuggguagggacacagucaaaccauaucaguaagcauuucagucuaaugaauacuguuucucuucaacucuggaaauugugugaauaauuucuucaauaauuuucuucccucuguuuguauuaucauuuggggauuccaacuaguugaauggaaggucaccuagagugauuuucuguucuucucaaucagaauuccucaugugaaccacagacucagaaaaugguuugacuaacuuuuuucucacaucuuccaaggcuagucuuaaccaguaccauucuagauacaugagagaaauuaauagauaacauacagugauugucuaggacgagggucagugaacuuuuucuuaaagggacagauaguaaauauuuucgguguuguagguugggaggcaaaaucaaggcuaugguguagguauuuauauaccuaucugaaauguaaccauuuaaaaauauaaaaaauauucuuaucuugugagccauuaaauuaaaaaguagauggcuagcuggauuuagcacacaagccauaauuugcccagccucuuuuuuuagggcauuagggguuaauucuuucacugacucuguucagaaaauccucuuuuuuauuuucacucauuucccuucaacuuaguuuuuuauuuuaccuuuggggagauuuccacaaauuuuucuuaaagcacuucuauuuuaauucaacagucguuuuucauuccagcacuucuuuuuuguuuuccaguucccuuuuuuaguaucuuguuuuuguuuuauggaugcaagacauuccuaaauguuucuaaggauacuccuuauaguuuuuaaaacucuuuucuuuuguuuccuaaauuaucucuuuuuccuuugaggacaguuuuucuaauuuguacguucgugaucucugguaaucuaucauacuuaacagugauaaaacagaaaaaucaucuguuguuucucuagguaaaaugcauaaacauuuaacaauuauauguuacaauuuuaguuaccauuuauauuuuauauauuaaaacugaugcuuacaggaacagaaaaccaaccaccacauguucucacuuauaaguggaaguuaaacgugaguacacauggauacaaagacaggaacaauagacaccgcggccugcuugaggguagaggagaggaggagggugaggauagaaaagcugccuguuggguacuaugcuuauuaccugggaugaaauaauauguaccaaaaaaacccauaccacacaguuuaucuauagaaccaacuuguacauguacucccaaaacuaaaauaaauuuuuuuaaaaaaggaaaaaaaucugaugcuuauauuuucauuaaaucuccuccugaaaucagacauaaagagaaaaucucuaauaagagggugugugugcgugcgugcucgugcauguguguacauguaccaucuggaggcuaaggugguauuugagacauucugucauuagggcaguugccccuguugcuuugacacucuguucuuucggugguuuucagcuuccucugcccuccaucaucacuuccaucccugcuucaucugucugcuagguaacuguugaaauuacucagcugcugauggcccucucaucuucuuugcuguaaugguuuuauaucuuuuacaaacuauuaccuaugauuuaaauagacucucccaagagagaagauagcuguuuauguucauguuuuaauuaguauuuuuaauuuuuaauuaguauucucacuacacauuuuaaacuauauuuuugcauuuauuauaugcuucugaaauacaaaaagcaacaugaauaagucauuugugauguuuauaacucaguagggagauaucacacauaugccaaauuaacuuuaauaaaaggaaaaaauguaguaaaucugaucaacuacuuugaaaauagaggagugguagugaauggggaggucaggcucuagggagagguuggcauuugagcugggcuugaaugaugagcacaguguagacauguagaguggagaagguguugcaaguggauagaccuuaacaugcucagaaguacaaaucagaaaaugcaagaagcaauuaguagugaguuuccagugugauuacaguauaggguagaugcauauuugguugggcagggggacauuuguaggacacaaggccagaaagggaaauuggacucagaucaugaaggaucauuccauacucaggcuuuuggauuuuguuauuuagaccauuggggacaacuuuuaaguaggguguaaagauggcuuaaaugucuucuagguaaguccgauuacaguacgaaagauagauuaaaaagauaagauaggccaggcgugauggcucacgccuguaaucccagcacuuugggaggccgagguggguggaucaccugaggucagggguucgagaccagccuggccaacacggugaaacccugucucuacuaaaaaaauacaaaaauuagccaggccugguggcacgccccuguagucccagcuacuugggaggucgaggcaggagaaucgcuugaacccaggagacggagguugcacugaguugggauugcaccacuguacuccagccagggugacagagugagaagggaaaaaaaaagauaguugagguagugaauccuguuauaagcuauuaauuacagucugaaccaggacagcagauuaguuucuuagcaauauucauuaaacaucugcagugucugcuagauauuuugauagacauugauacuuuggagguuuuuccucaaaaugguuucuauagcccugucucccucccuacuccaacuggggccauccuaagcaaagcucugcugacucccugccugaguuacuagggcuccagcuccuguagacaccagggucugucuccaguccaauucauuuugugcaccacugacaaaauaaucuucagaugugaccuaaauuaugucauuucuccuuuuaaaacugcuuugaucccccuaccaaucaagucuuaacucuucuucuggaugucaguguccccauccuggcucuacccuaacuaaccaaacuuuucuugccagugucuaaugcaaaaauauucuugugaggccaugacgggaggaacacuugagcccaggaguucaagaucagccuaggcaacacagugagaccuugucucugcaaaaauuuuuaaaaaauuagccgagcaugguagugcaugccuguagacccucaggaggcugaggugggaggauugcuugagccugguugcacugagcugugaucgcaccacugcauuccagccugggugacagagugagacucuaucucaaaaaaaaaagaaucuugucgucuuugucugucucauuuccuuagagcacgcucauucugcccccaugccuucuuuucucaugugaccuugcugugcauguucucuauaccuucucauuuaaauucuucccaacuuucaagucuuagcucaguuacaucuccucaaaaguucuucuacaucuucuuugaaaaaaaaucaucuuacacuguuuuucuuuuucuuucuuucuuuuuuuuuuuuuuuuuuuuuugagacguagucucacucuguugcccaggcuggacagugcggcggcacgaucuugguucacugcaaccucugucccccagguucaagcgauucuccugccucagccucccaacuagcugggguuacaggugccugccgccacacccagcuaacuuuuguauuuuuaguagagacaggguuucacccuguuggccaggcugguuucagacuccugaacucaagugaucugccuuccuugaccuccuuaagugcugggauuacaggcgugagccaccaugcccacccuuuuuuuggggggugugguggaggggaggggacagguuugcacucuguuaucuaggcuggagugcaguggcacgaucucggcucacugcaaccuccgccucccagguucaaacgauucucgugccucagccuccugaguagcugggacuauaggcaugugccaugaugcccagcuaauuuuuguuauuuuuguagagauggucucccuaugaugcccaggcuggucuccaacuccugggcucaagugauccucccaccucagccuaggagugcugggaugacaggugugaaccagcacauccggccgucuuaacacuauuuuucccuccccauguugucuagccuuauguuuggcaugucuauccucaguuacuccauggucacaauacggcugcaggagugccagcuauccuaacaacauuucagacaggaaagauaaaugcaaggggcaaaagggacaucucucccagcugagucagccaccucugaaaagcucuccugaggagugacuggcacuagguuggcuucauugguugcccguagguacaagggauacauuucuagauagacauauucagggucuccauguuaaacaauuccauaggacaccauucacaaaaaaacaauauauagaauagaacagaguauucaauaucuuuaucuggguuugauacauauacguauguaucauauacauguacaguauguauauguauuuuuacauacguauauguauuuuacauacuguauauguauaugauacauacguauauguauuuuacauacuguauauguauaugauacauauguauauguauuuuuacauauacauacuguaugauacaguauguauauguaaaaaguuaucaagcuauauaguuaagauuaguauacuuuuuucuuccucaucccaacauuaguauacuuuauacuucauugaauauguguuguacuucaguuuucaaaaauuagugguuuccucaagaggugugcagugugaugagccugggaacguggcuguagguaaaacuaggauuauguucucagagggaaaaguagacacugaguuagguaucuagauaucuuugucacaagcauaggacuuuuuucuaucaauaguuuugacauguacaccaauguuuuaagauaucacaguguucaauauaauauauauaguaggcgauuuuuauuuugauaucgaaacauucccacaagaaugaaagcauuggcuuugaaaaacaaaauauugcuuguaauuuuuauucaugugcuacaaagcuuaaaccuuaagugaaaacgcaguguauacuuuugacugcuauguacuuuauauaguaaaagcaacauguaauuuuauuaagucaauaauaaaaggauucacaacacuaguuucugaaaaauguccacuuuggguggcucuaaacugauuaauaaaaagcaaguaaauaaaacugaucauaaggugucaaaaucuaaucuguauuuauaagcguuugcaaacauuuaaguaaucuuuugaaauuuucuuuuacuuccuuucguucuguuagaaaaaucugaaaaauaaacaaccagauucacuuuguuguuguugugaaacuacuagaaaaugagugacacaugacuagucugcucuuauuucauguaauuuuaaaaugcauuccaaauaaucggaauuagaaaauggcaacuucuuuuuguuuguuuguuuuguuuuguuuuucuugagauggagucucucuaugucgcccaggcuggagugcaauggcacagucuuggcucacugcagucaccaccucccagguugaagcgauuuuccugccucagcaucccaaguagcugggacuacaggcacaugccaccauaccuggcucauuuuuguauuuuuaguagagacgagguuucaccauguuggccaggcucgucucgaacuccugacaucaggcgauccacccaccucggccucccaaagugcugggauuacaggcaugagccaccaugcccgaccaaauggcagcaucuuuaagcauuuauuucugaguaucuguggguugauguuuacuuguuuuuaaauaaagauuguguuuuucuuagguucauccucagcagcaccggcuucuuuuugaaguguuugacgaaaaccgauugguaaguuauauugugcuuauaugaaauaugaaguaaggguacauuucaguggagcagccaggggaaguggguaagcagucugggauuugagugauggcuugggggugguuauggagacucugggcaaaauggugagggagauagaauuuguuuucuuccuccugguccuacucgcucccuuuccauucuccucccaagcaccucuucugauugccaacauauuauaaggucuuacucaagaccucuugugacaggagaggacagaaaaccaaccucuuuguccugccuucccucucacucgcccaugaccccugguuccuacuccauggcucugggaaucuucccaggguauccuucaguugcgccuccucacuacaguggccuuucuuaggguuaccuguauccaauggacauccuauccacucucucauccccacucuucuacagaggaaaucuguccuuuuuacacugauaaggaaugagcaaauaaagucuucucaaagauggccagcucuuacagaagcaaaaagcaaaguuaaaccugauguucuuuuuauaaaaugauuguucugauuucugaauuccuaaagacucucuuaaaguccuauccuuuuccuaauuuugucucugaggauccaaucucaaacccucaucuuagcaucuuacaucuauauuuuaaaccuguaagauuugaacagguaaguauagaaacaguguuaugugugcaaagcuuaucaguuacaagcaccagaaaaauuaaacaguuuuguucauuuuuuagcuaacagagaaacuagcuuuuuuuuuaaaaaaaagucuguuuuuaguguuaaacuacauucauguuuuuuuugcccucaagaaaugguaauuauacuggcaacuaaagauauugccaaugaaaucuuuaauaaacaucauacuaagcaaaaguacauuauugcugccaaagaagacuaucacugacuugcuauauauauauauauuuuuuuuuuuuuuugagauggagucucgcuuugucgccaggugggagcacaguggcucagucucaacucacugcaaccuccgccuccaggguucaugcaguuccccugccuuagccucccuaguagcugggaccacaggcgcucaccaccacaccuggcuaauuuuugugaauuuuaguagagaugggguuucaccauguuggccaggaugguccugaucuccugaucucgugauccgccugccucugacucccaaagugcugggauuacaggcaugagcugccaugcccagccuggccaucuaauuuuuaaggcuaagugacagauguugcugauuugauuaucagauaugguuaguuacagagcuauuuguuuucugucuguguuuuugcuuguuuaaaagaauauaaaauguuuuccuuuuuuuccccucugaaucuauagaccuguuuuccuuuauuuauuauuauuauuuuuugacagaaucucacucuguugccuaggcuggagugcaguggcgcagucucagcucacugcaaccucugccucccagguucaagcuauucuccugccucagccuuccaaguagcugggauuacaggcacccgccuccuugcccagcuuauuuuuguauuuuuaguagagacgggguuucaccauguuggccaggcuggucccuucuagauggaaacaaauuaaacuuuguauugguggaguuuuuguguguguuuuguuuuuaacucaugaaauauacauacaaaaaagcccacauaauauaaauauuuuaaauaauaagacaaauauguauacacguuacucagcuuaagaacuagaacauuaccaaaaucuuugaaacccucccuagaucccuccuuaguagcaucuucuuuucuuccuccacaaguacuagccacuguccucaauuuuguuuuuaucauucuuugcuuuuuaaaauacuuuuaucacauguauauauauccccaaaaaacacauuguuggccgggcaugguugcuuaugccuguaaucccagcacuuugggaggccgaguuagguggaucaccugaggucaggaguucaagaccaggcuggccaacguggugaaacucugucuguaauaaaaauacaaaaauuaguuaggcgugauggugggcaccuguagucccagcuacuugggaggcugaguugggagacuugcccgaacccaggagguggagguugcagugagccaagauaacaccauugcacuucagccuaggugacaagagcgaaacucugucuccaaaaaagcaaaaacccacauuguuuauuuugcauauuuuuuaauuuguaaaaauaguauaucucuauagacauuccucugauaugcuuuuuugcuuaacauuauauuugugagaucugugauuacacauuucaaugaugcauaauuuucuauauucugaaaaaucauaaugcuauaauuuauguauuuaaccuccuuaauagauauuaguguuauuuccaguauuuugcucuuacaaauugauaaacauuuuuaugucucccuauguacgugucugagucuaucucuaagagauauguuuuagaguugaauugcuagaucaugguauuacuguuauuuuuccuguugccacugauaccgaugugaauuuugccugaucauugaguguauuauuggugaacuauuuuauuugcguuauuugcauguuguccacaaggagggacagcucacauuugugcuuuccaccaugcuuaauugucugguccauuuugccaguaacuuuaguauuugcgugacucuuucuuaauggccagaauggcuguuugucaaacacuaaucagugaauuaacauuccuuaagcauuuacuguguauauaauacuauaaagugugucaugauagguuggaagaaaaaaguauugccuuugauauuaacaguuggauauuuauagauggauaaauaugacaaaauuuuuaaaacuuuuaaccauaugaaaaaacaaauaacacauuaaucaaaauauuguaacaccuguaaucccagcacuuugggaggcugaggcggguggaucaggagguguuccugagguuaggugaacaccugaugucaggaguucgacaccagccuggccagcauggugaaacugcgucucuacuaaaaauacaaaauuuagccaggccugauggugcgcaccuguagucccggcuacucuggagacugaggcaugagaauugcuugagcccaggagguggagguugcagugagcugagaucacaccauugcauuccagccuaggcaacagagugagacuccgucucggcgaaaaaaaaaaaaaguuauuauagauccccacacuaaggacuaagaaauucuauuauaauccugccuuucuuuugggguauuagcuuguaacccuaaacaaauuauucaauccuucuaaaaauaccuucucacauuuaaaaaaugaggacaacaauauuugcccugccuaucucauaagcauauugugaggauaaaaugagacaaugacgaugaaaauacuuggaaaauucuuuaucaugauacaaauauaaaaugucauuuaacauucguagacuuaacgcguuuguagcucucugauaugguauaucuuguguuagcuaagauauaccauuuaguauaucuacuguguuagaugcucuucuaugagugggaaauacagcuuuucuugagaaacucgguuuaccagcaaaacaaagagccaaagauaauuagaacaugguggugugugucauucuaguccucuugauuuguugcuagucuuagcagguaagggagguauagagaugaccugagauguuauagaaccuauagccauugguggaguaacagaccugauuguauagcaacaaaugaccugugucauuauaaaugucauuccgucuuuauucugcugaggcacucacaacuaaauuuaaaauguaccauuuuccuagcaaauucucuuggaaaauggagggugaagaacacaaguauaauauuaagcagaaacaacuuuagucaucuggaaaacguuuguaauguaagugauauuugcuuucaauaaagaguaggcuuauaucacuuuuuuccagccaauuuuaagacuugaguguuauaaaauauugucguuucauuauggugaugguggugguagugguggcaauaaugacagaacauuucagaaugaugugucuuaaaaaaacucuacccaccaaugcaaaaguuagcacugugucaccagucuaagauauacaccuguacacauucagccaccgguuuuaggagccaccuauauucuggguggagacccugugcuucucacguuuagcaguuguauuagugaagguucuccagagaaacagaaacaauagauuguguauauauuuuauguauuauuuauuuuucauauauuuuauauaugaaauuauguauaauauaugaauauauauauuuccacacaauauauauauagugaagacuucaaucugaaaucugcagggcaggccaggaagcugagaacuuaggcagggauucuacauuguagucuugaggcagaauugcugcuucuuacacaaccuguguuugcuuucaaagcccucagcugauuggaugagacccacacacauuguggaggguaaugugcucuacucagagucuacugauuuaaaugcuaaucaugucuaaaugucuucauagcaaugucuauacugauguuugaccaaacaaguggguaccauaaccuaucgaaguugauacauacaauuaaccaccgcagcugacuuuggccuucaaaguucagucaaugauuaagauuacccagagccuauccauaccauguagauaaucacauuauuuuccauguagaugaucaguaaccaacagcucugaaugugagguucuuagcuucaauccuaagacguuaucuguuucauuccggaauaugaaauucuauguaggacuugcauggauucuuuccagaugagggcugccaugucccuccaguucuucuacacuuaagguuaggauuaacacuccuguuuugguauuugcuggacugagagacuacauuuuauagcaaguuccccgauuucccauguaacugcuauaauagcaguauagauccuaugcaauuucagaccucagccagcaaugcaaauuguucagccucccuagaauuuaaacucagacuagagugcuaggaagugcaugugauucucuuaccuuacauuuccuuggcugaaacccucucuguaaauuuuucaaacgucauucuuucuuguccaccugcagugcuuuuugauauuucuuuaaaaguggcggcuggaucaacuucaacaacaacaagaaaaauccugaaagaaagcauuaggcauucagagugacugugaugacaccauccaucucuccauccagacuucuaucuggugucuucugguacuuacuuugagcccaggaugagcucaggagcaucagaagaaauguguaguuauggcccaugcucucuggaaaguuaaaaucuaguuaggggacauggaacugaugcuuauagugaagcuuaccaaagagaagacauuuaucugaccaaauacuuggaguucauuauuuuauauguuaauaaugagaggagcuuuucuuauuuccuggaaguuuuaggccacagacaugaacaauuagaucucauugauuagccuauuagaagggauucauucuuugaguuauuagaccccacacuuaaucccagaaagaacgcugaagucauuugaaggcagaguaaaacaggacuccuccuuauuuaaaagaaaaagauguuaagagaauauugacugaagucuguaaaaucauaaaggaggugguuuauacaaaagcaaaaauaacauaauaauuguauuacuaaguuuucaacuauuguacgcauucaaaaacagggcuguuucauucuagucaaaugaaaugcaaugaauucccauaauucuguuuugugucuuaauugauuaaaaaucuguuuagaaaauucugaucaaaaacagaucuaucuuaagcaguuuuuuuuuuuuaacaaaguaugaguauauguuuuacauauuugcuuuuacuuaggaaaaaaaacuuacuuagcaaaauacaacuuggguguaguagcaugugguauaaacaacggaacuauuuuaccuuuuacuuuccuaugaaugagccaguauauauuuauuacuggaguuccagcuauaaaauuuaggugagggguuuaaauauacccuagaguauuauuuaaaaauaaauuuguuucuuucaaauagaauaccaaccuuggucuauggcauuugagagagaaauuaaaauauuaaauuuugauugccuaguaaacugaaaauaaagguuaaauaaauacaaagcagaaaaaauauauauacaaaaucacaaccucuaaaaggacaaacaguccacuguucucuacugugggagcuuuaucagcacuggugaguaauuccaccucuaggguagggcuagcucucaaaaauguaaacaaguauguacuucguuuauauaaagaaaugugcagcuugguuuguauuucuuuauagauaucaaacagcuaaauggauuguuucaaaguaccagcaggggccagcaaagagcucuuagaguuuuucagaacagaauuggcauugagacauguuuauuugaugugcuaaauccuuuuuagacuucuuuacuuaccacaacacucucuuaagugaaugaauugcagagacaguggaauaaaauauccuguguguucaaacuaucuugggguauaguuuuuuuuuucuaaucugcauauauuuuuauuggaauguuugcuuaggcuauuucuuggcaguuuuaauagucaaaauauaaauggcaucauuuaaagacuguucuacuuggcuggaaaaggccuuaaaauuacaggagaaaaugcuuagugacagcuucucuuaaacuuuuuuucuugaaccuaugcuucaguuuugcaaugguauuacuagguuaauuuuguaguucuguccuuaagcuuucacuuuuuauguaacuagcacuuuggaagcuaaaauauguaucuauuugauguagugcuaaaguuuuaauucauuguaaaguuuugguauuuccaaauuuaccuaacuguuugaauucacacauuaaaaaaaaaaaauuaacagucccuauauuaacuaacuugacuagauuccuaguauggcuacuauuuggaaauucaaucuuugauuugaugcuuaauuacaugggguuuuguuccuaccaacuuccuguaauucuauaccuauggguaaaaauauuagugggcaaagucggcuggagaaaguauaggcacugugauucacauaguuaaauguucauuuaguagagcuggggugaaaaaauacuguuucaacuugaaauguuagaagauuguuguucuuguguuacucauucaugcaaauuggagaagguauaauugaaacaagguuggcuguguuugagucagugugcugcagcugagcucagcuuaaaggucgcuggaaaucaagugcuuuguaagugaaggcauuuugacuacaagcgauucaagacauuuuggaaacgucagucucuggaaugggucgucuuuuucuuucuaugauaucugguaucuaauguuuuacuuaggauaaagacuacuacuuaauagcucuuuuaggcaccacaaaugauuuuuucuuuugaugcagugcagcugcuucuagccugucuacggacagagaucuuuguuaugacuuucagcccuuaacauguuuggaaaugagaacaaauggcacaaagcuuacgauugcacuuugcagccagaagaagcaauacuuacccuuugucagaaaccuccggagaugacuuggauagccauguucacaugugcuucaaaagaccaacacggauuucaacgucuaacguuguucaaaugaagcugacucccagacagacugcacuagcuccguuaauaaaggaaaacguucagucucaagaaagaucaucuguucccucaucugaaaauguuaauaaaaagagcagcugucuacagauuucacuacagccaacaagguacaguggauaucuucagucuagcaaugucuuagcugauagugaugaugcuucguuuacuuguaucuugaaggaugguauuuacaguagugcuguggucgauaaugaauugaaugcugugaaugauggucaccuuguaagcaguccagccauuuguagugguagccuuaguaacuuuucaaccagugauaaugggucuuacagcagcaacgguagugauuuugggucaugugcaaguaucacaaguggagguucauauacuaacagugucaucagugacaguaguaguuauacuuuuccaccaagugaugauacuuuuuuggguggaaacuuaccuucugacagcaccuccaauagaagugugccaaacaggaauacuacuccuugugaaauuuuuucaagaaguacaaguacagauccuuuuguccaggaugacuuggaacauggauuagagauuaugaaauugccagugagcaggaacacaaaaauuccacuaaaacguuacuccuccuuagucauuuuuccuaggaguccuucaacuacccgaccgacuucuccaacaagucuguguacucuucugagcaaaggauccuaucaaacuucacaccaguuuauuauuucuccuagugaaauugcacauaaugaggauggcacuagugcuaaaggauuucuuucaacagcugucaauggacuucgguuaucuaaaacaauuuguacccccggagaaguaagagacauacggccgcuucacaggaagggcucguuacagaagaaaauuguucuuucgaauaauacucccagacagacugucugugaaaagucaucugaaggauauucuuguguuucagugcauuucacccaacgaaaagcagcuacauuagacugugaaacaacaaauggugauuguaaaccagaaaugucagaaauuaagcuuaauucugauucagaguauauuaagcucaugcauaggacaucugcauguuugccauccucccaaaauguagauugucaaauaaauaucaauggagaauuggaaagaccacauucacagaugaacaaaaaccaugguauuuuacgaagaaguauuucauugggaggagcuuauccaaauauuuccugucuauccagccuuaagcacaauuguucuaaagggggaccaucucaguuacucauaaaguuugcaucuggaaaugaagguaaaguggauaauuuaucaagagacagcaacagagauugcacaaaugaacugucuaauucuugcaagguaaguuuccuuuggucuugguaaauguuaauuuauaugagaauaacuuaaugaaauauuuggagaacauuuauuguaaccaagcaguuuuacauauuuuccugguccuuagcuagcaguauuuuguagucauaaauuuuauauuuguaaaucugaagaacucuauguauaguuuuuuacucuauuuguuauuuuaccaguguacaaaauguauauuuuuaaaaaucuuccuaagugauuuaagcuauaaaacuuuucuacaacauaaaaaacuuucuacaacaaaacaaacuuugaauaacagucuauuucauaacauuuuaucuuggcauauuuuuccuuuaaaugauauaguauucuuuuguguagcucaauacuuuauuccuauuuucaaaugaucauuuuguuuucuccucuucuuaaucauuaugaaauagaguaaaauuuagaaugcuuauuuaaaauauuaaacaaaaacccauaucaaaguguaaagaucuuuuuauaaauuaucauagagaaacuauaucucaaauacauguguuuauaagaucauucauaaaaacuauuaugcugcauguuuaaagcagaggaaaaauaaauggcauuuguauuuguauauacccuuaaccacaggaauuuuguuuccacccuauuuuucuuuagccacgaguuaauacugcccucuaaaauguaacucacucuuucaacaauauugaauucuaaguuuuaauauuuuugaauuugguuuaaauugcuaggcauuuaccacaauuuucuauuuaccuuuucauuuuuuugacaauucagcuuuauuauauuaguaauuuaacucuuaugaaucuuagccaaaaguucuuuauguaauuuggccguuccaaaguauuuaaaaugguuugaacugaaauagauuuuuuaaauuucuguauuuggaauguuuuaccagauuccaggaaauuuaaaaaauuuucuaacuaaagcaauuuuacaugacaguacaucauaguuuuggggggaaaaaaccuuaaucuguguuuuuguaacauccauuauguuuauuaaagauuguuuuaaaaaaaaaaacuucuggauaaguaacuuuaggugaauaaaauaguaauugcuaguuuauuuucucucuucugaaaucugguaaauauaauaauuguuaccaaugcccagauguuaauauaagccacuacuuuacuaaggauaaaaaaagaucagauuucaaauucugaucuauaauuuagaauuuuaaauuccauuuaggaaacuuuucuaaaaccagauuuuaggagauuauaaucuaaucaacuguuuuucuuccugaaagaaagaaaugaaguggcacugagaagaaacguuaauaguaugcuaguugaauuaauguuacuuauaaauuuauuuuacacuuaaugaaauaaucugaaaggaauaauucauguagaaauauuuguagaaauaccuuaaaauaguuuauuuugugguaauaauuauaguuuguuguggaugcuuuugagaagaguauuuuaaauguguuuuuuaaugaaauguggaucaaaugccuuuugcauuguuaaaaauauccacuguuacugguuuuauuuaugcuuagguaagcuaacuuaaauauuuuuugugacaaucaaauguauaacuuugugcagauucuaucuuuugguagauuauuggauuauaaaauaauucagaagugugcaguuugcuggagauuuaaauuguccccccguuuaauguuuauuagacuucucuuuauaaaagcauuguaaaccauauagugacaguuaaauuuaauuuaugcuauaucuaaauagaucuaauugauaaaucaaaggcuuguuuuauggagaagauucuaguguuguuuuuucuaaauauagcaguggcaacaauaauggguuuuagaaauaaucuuguguuuaucaauaauuauauauuaaucuaauuauagugguauauuguaacucacuuauaaauaaacagcucccaaaauauuucccaugacuccaguuagucuggguuaguauucugauaugcugaguccggauucacauuuaacaaguugauauuagaguagcauuuaguaaugucagcuaucuguacugagcagccgugaaauuaaaucacugcuuuggucagagaaccugguuucuaaagcacugagagucuacaacuucuuuucuuauauguuuagcuaccagucucuagcaguauaaaauugaguuucuagcuuacuguaaucaacagcuuauuaaugacugauuuuuuaaaucuaaugagaacuuuuaccuguaucugggacacugucuguguucuguguuuacaacuuagagugaagaugagacuuuguagucuaucuccauaauaauguugauuucaggcauagcaaacaacauaacagugacuggcauauguuuauuacauaugccuuuugaaauacaguauuacuuuuguaaaggcuauauaaugacuuuugaucugaaaauaaauacuugauauuuuaacaguauguguaauauuuugucaguucaaucaagaagcagguuaaggagcuaagguacuauguauacaguuacaacaaugauugcuauucagauuucuaaaucuguauaguaguuacuuuucucuacuguuauuuuguuucccccaucuguuguuuucuaaaucuccuauguuauguuguuaggaugcucagagauuucaguacccuauuauuuaaugugcauuagcauuuuucccaagcuugaaugucuuccauucuuuacuuauauucauauuuuuauuagaauuauuuuuuacauuuuuucuuuuuguuauaaaaguuuuuguucauuauauguaacuuaauccuaaauagguaaauugcuuaagccuaguauaguagaacuguaauaaacuuaugucuuaauuauuucaaagccuuuaacacuaaucucaagauuauacauuucaauauuuucuuauuuuauuguucuuccuaaaauagauguuuuaaauauauacuuacuuuaauguuccauuauuuuccaguccuuauuuuacuaaauuuagcagaauauuuagagagauuugguuaaauuuauuuugagcagcacuuauauaaaccaauguaauuuauaaauauucuaaaaugugaugccacaauguuaaugacuaguuuuagaaaguuggugaaaaauguauauuuguacauguauauuucuuagaacugaggaauuguuaauuucagacagauucagagugcugaauuguuugcuugaaaacauuuuguauucucuguagaugugucuuguuuaauucauccaguacacauuugagugccaggcacugucccaagcacugagaauaaaagaugaguaaaauacagucucuauuuaggggagcucccauucuaguaauagggacaugcuuguaaacauaaaaauuuucagucuaggccgggcgcgguggcucacgccuguaaucccagcacuuugggaggccgagacgggcggaucacgaggucaggagaucgagaccauccuggcuaacacggugaaaccccgucucuacuaaaaauacaaaaauuagccgggcaugguggcgcgcgccuguagucccagcuacacgggaggcugaggcaggagaauggcguggacccgggaggcagagcuugcagugagucgagaucgcgccacugcacuccagccugggccacagagcgaaaccccgucucaaaaaaaaaaaaauuuuuuuucagucuaauaugugaugugcuaaauagagguguguaugaaaaaguagaaagaugugacauuauuuaucuggagagaggaccugguugguagaggaagguuucccagaggaggugacauuugaaccgagucuugauagguaaacuggaguucaucaggcagagaaaucaaagagauucuagggcagggauuccccaucucagcauuauuauauugggcuggacacuuuuguagugggggcuauccugugcacuguaggauauuuaacagcaucccuggccuccacccacuaaaugcuaguaacaccccuuucucccagugugacaaucaaaaaguguccccagacauugccagauguccccuaggggcaaaauuguccccuguugagagucacugcuguagguggcagcagcagcauaugcaaggcuagaaaugugaaagaaucuccacuguaaauaguccaguggggcucaagcauaggguagccuggggaugugggaggcggugaucugccagaagugggucagaguccgauuaggccuggugcuucaugcugaagacaaagaagggggucuucggcugauaguuaaguaguugggcaauggaggucuuuauuugagagugugaagugcucucuuuaagguuuuuagaagacaauuuuucaugguuucauggauuauaaaugaauuaaaguuuuccuaacuuggaugacuggguuaacagugauguuaugaacuaagauggagaauucaggagaggggccagauugggagggugaagaagaaaucauguaugaaguuuauguguaucagaggcugcccugauagugcuguuuucaaguagggcaguuggacauacaggaccaaggcucaggagagaagugagaguuggaaauguagauugggagucaggaguauagucaaagccucagauaaggaugaacacguuagggaagguauacagugagaugggaagggaagauaaauuauaauuuuggggaccaccaacuuuggugaggcgguagaagaggggauaaagaagagacuaaggaggaaccacacagaggccaagagagcauggaggcauggagagcauggaggcguggaggcauagaggcaugggugaaaggugagggaaggaggaaagcagacaguaccacagagaacauaaguauccacuggaugugucaguuaggagguccauuagcaagaguaggcucaggagaaugcgggguuaaaagccagauugaagaaagaaucaaacagguaaggaagcagaaacagccagcauagguugcuugcucgaugucauaaaauaagcaugagauagcauaggcaagguauauauguaguuauuguuauacagaaggcauaugugaaguggauauaagauguauaagacaaacucccucucuacagggagaguacagucucuuuuuccuggagaaaaaaauaaagguuacagucuuacguucuuucaccuuggaacuauagaauaagcaaguaugaugagugaaaaggaaauucagcaauaucaaaugaaggaaacagaaaauuauaagugaaaacuugaaaucgcuuaugaauauucacaccucauuuuggacagcauuagucuaacuuucucaguccccucucuaccaccaaaaauaagacgagacaaaauagagcuuccauguagaaaacaagucaagguuuuaaggccuauucccagaaacuacuuggauaauaggcaauucugucuauguugccggcuucuuacaggcuauggagccuaccaugugcuagcuguugugaggccucacccguuuguguccacucucccuuuacaucacaggugacagggaaacaagacagaccaggagaagccaggacaagaggcuuuguaggcugaaggggcuuggcagagucucugggugaggccaggcgauguguugaggucaggaaggugguuagcagaaggagcaaaugaaugcugagaaagggaaccaguugucuugucagcauacccuggaaauaauccaaaguauugcucacacgucugguucaguauccucuguuccuuguguaaaauugggagaccauggucagaugaagacagauacuuagagauacaguaauuucaaaacaagagaugagcagaucugucccaguucaaugagauguuuugggaaggacucaacaugggagcaacuguugaaaagcaauuuuacccacacuaagauugaagcgaacuguugggauagaacaagagcagcagaccugagggcuuagacgagcaaccagcuaguguguaugugcaccuuguagcucgauucaugggugagucacaacaaagaacaccuugaacaaguaaguaaauucauggcauuucuaguuaggcccgaggaugucuguuggugaagaaagagcguaggccuucucuugacuuagagguauuauaaaaccauaacacuaggaaacauuuugauuaccuuaguagaaaaauacauuacccaagcaagauauugaugauauaguagacaaugucuuuaaauucaguuauaacuaaacuuaguuaaguauaguuauaccugaaguuaaguacagauauaccuaaaauaauauuauccaggauugcuuccuuuuauuuacuuuuuaucucaauuguuuuuuuaugaugaggucucauuauguuacacaagcuggauuugaacuccugggcuaaagcaauccucuugccucagcuuccuguguagcugggacuacaggugcacugcuguguccgacucacaggcuacccucuaaugcuuuauuaaggaauuagagaauggcuuauuaagaugucagcugggccagugauuuuuaaauucucaugugcauguaaauaacauggcgaucuuauuaaaaugcagauucugguucugguucaguaggucucagaaugggggccugagauuucuguauuuauaacagaucguaccaaugcugguaauuccccagacacacuuugagaaguaagucuuaaggccauucuuugaugagaacaguaauacaguucaaagucgaaguauccauugagucccugcaaugccauuauuguggccauuaucacgaguaauucauuaaaaacauaucaauaauacuucagauacuaaguguacaugcagcagaaaaaaaaguuaaagauggagauauggcaauagguaggcaaauguaaauucacuagaauugauuagagaaguauucuggagaauggauuaagcaaaucuuuucugggcucagauuugcuagaauacaguucccuacuauagagaacaaugacuagcucaaaauagacacuuaauagauauuuauuaaauuaaugaauaaagccagggacccuuuggaaugagguagagaugacugcagaauccugauaggugaggaugacuacacacagccuugcagaaacagauaaccaaacuaggauauuugagugaugacugugaugaugagugggagcuacgugaugcuucauccuuugcguggaagaguggcacucuuaaaugaauaccuugucccuggggugaaugccaauggaauauuaugaucgugacucaaggauuaguuuccacaguggagucugauucauagccuacauauuccacuaacugguaccguauaacugggugucuggauagaggcucagaucaaguuuccugaaaagaagauugaauggacaaagaucuuuaaggguauucagacaaaagccauuugacuagcuuucuuucaguuuaucguuguuuuauaaaaugacuucccucuagacuuuauuguaagagcugggauucucagacuaguuccuggaguuuuaaguaacuguuucagcuaagaaugaccuuuacuuuuguaacaaggcugaaagacugaacccucuuaaacagucacagagcuuacuggaaacucaagucgucuucaaagcaaaugaguuuaacaaguauuuaucagaaauagaauaugugccugccauaaguggcaaauauucuuccuggaugugaagagguuauaauugaaaugagacaauggcauaauccauagaaaacaaccagagaacaauauaguauaauauauaauaauguuuauauaccuacuucaugcagguaaacaccuaaacauugagauaugugauugcccauaugauuuaauuacuuuuaucaagguaaaacaugugcccauuuuaaaagucagauauuauuucuuugaagauuuucugucuuuuucuccauguuuucucuuccuagaauuccuguuagccaaaguuugcacuuccuggauugaccuuaaaauuuucuuuucucuccuguuuucuguuucuuugccuccuuaaucuacuucuuggaagauuucuuccaaguuucccccuuucuuuaauuuuaaaauuuuguuuauuuuuuauuuuuauuuuuuuuuauuuuugagacagucuggcucugucgcccaggcuggagugcagugccgugaucuuggcucacugcaaccucugccucccagguugaagcaauucuggugccuuggccucccgagcagcugggauuacagguacgugccaccugucuggcuaauuuuuuuauuuuuaguagagaugggguuucaccauguuggccaggcuggucuugaaccucugaccucaagugauccaccugccucagccucccaaagcauugggauuaugggcgugagccacugcgcccagccuaaaauuuuauuuuuuauuuauuuauuuuuuaauuauacuucaaguucuagaguacaugugcacaaugugcagauuuguuacauauguauacaugugccauguuggugugcugcacccauuaacucgucauuuacauuaaguauaucaccuaaugcuaucccucccccagccccccaccccacaacaggccccggugugugauguuccccuucuuguguccaaguguucucauuguucaguucccaccuaugagugagaacaugggguguuugguuuuuugucccugcgauaguuugcugagaaugaugguuuccagcuucauccaugucccuacagaggacaugaacucaucauuuuuuauggcugcauaguauuccaugguguauaugugccacacuuucuuaauccagucuaucauugauggacauuuggguugguuccaagucuuugcuauugugaauagugcugcaauaaacauacguguccaugugucuuuauagcagcaugauuuauaauccuuuggguauauacccaguaaugggauggcugggucaaaugguauuucuaguucuagauccgugaggaaucgccacacugucuuccacaaugguugaacuaguuuagagucccaccaacaguguaaaaguguuccuauuucuccacauccucuccagcaccuguuguuuccugacuuuuuaaugaucgccauucuaacuggugugagaugguaucucauugugguuuugauuugcauuucucugauggccagugaugaugagcauuuuuucaugugucuguuggcugcauaaaugucuucuuuugagaagugucuguucauauccuucgcccacuuguugauggcaugggcaaggacuucaugucuaaaacaccaaaagcaauggcaacaaaagccaaaauugacaaaugggaucuaauuaaacuaaagagcuucugcacagcaaaagaagcuaccaucagagugaacaggcaaccuacagaaugggagaaaauuuuugcaaucuacuuaucugacaaagagcuaauauccagaaucuacaaagaacucaaacaaauuuacaagaaaaaaacaaccccaucaacaagugggcgaaggauauaaaauuuuauuuuuaaaguucuuucuuguuucugaugauuuccuaguccuaacguccuacuuguuuuuaugaauacaaucucuuauuucucugagaauauuuuacuucggguuuggucuauuuucuuucuuaaguuuuguuucagguccuauguugucucugguucccuuuggucccuuugcuguuguuauuguuauuucucuuuaauacuggacauuucccuccagauaucuguuguugauauuugagaguaagucgcuaugaaguugccuggagguucuguaauuauguugggcuuuucaacugguggguuucacuguugggaaaccccccaauuguuagugucuucucucugaggucaauuuguuucuccagagaagaaacuucuaaugauugccaguuauguuuuacagccaugguuagugacaaaucaggagugaaggugauuccuuuauauaaguucugcaacugagugaauuccagguaaaauaugucuuaaaagugauauuuacuuacagaauucuuaacaugcugaugauaauuuaauucauuugcaguaaaugaaaugccugauuuucuuuucuuuucuuuuuuuuuuuuuugagacggaauuucgcucuuguugcccaggcuggaguacaauggcacgaucucggcucacugcagccucugccuccuggguucaagcaauucuccuuccucagccuccugaguagcugggauuacaggcaugugccaccguacccggcuaauuuuguauuuuuaguagagacgggguuucuccauguuggucaggcuagucucaaacucccaaccucaggugauccacccaccucggccucccaaagugcugggauuacaugccuggccaaaaugccucauuuucauaccucuggucugacauaccuuguguauauucuagaagcauauacacuccuagaaagacugaaguaaacacucucaaguagaaaaugugguuuccuuaacguauuucucaacuuuuugcauucuugguaauacauugaagugcaaauaugcauaccugucacucagaagaagagaaucaaccuguuuaaaauguguauggaaauacgccgggugugguggcucacaccuguaaucccagcacuuugggagccugaagugggcagaucacuugaggucaggacuuugagacaggcuuggccagcaugguaaaaccucgucucuacugaaaacagaaaaauuagccaggcguguuggugcacgccuguaaucccagcuacucaggaggcuaugacaggagaaugucuuuaaccugggaggcggagguugcagugagccgagaucgagccacugcacuccagucugggugacagagugagacucugucucaaaaaaaugaaauaaaauaaaagguguauggaaauagaacaaggaggaagagacccuaacagccuucuaguagaguuuaauauuggauguucacugucacuaggacuugaagccucaacuaugauuuuuaacuuggagaaaaccuugauauauucuuuucuuuugagaugcagucuugcucuugucccuggagugcaguugugcaaucucggcucucugugaccuccgccuccagaguucaaacgauucuccugccccagccuccgaaguagcugggauuacuggugcccgccaccacaucugacuaauuuuuuuguguuuuuaguagagaugggguuucaccguguuggccaggcuggucucaaacuccugaccucaggugauccucccaccucgcccucacaaagugcugggauucacaggcaugagccaccgugcccagccaauguguguauauauauauauauauauauauguguguuuuuuuuuuuuuuuugagauggagucucacucugucacccaggcuggagugcaguggcacgaucucggcucauugcaaccuccgccucccggguucacgccauucuccugccucagccucccgaguagcugggacuacaggcaccugccaccacgcccagcuaauuuuuuguauuuuuaguagagcugagguuucaccguguuuagcuaggauggucucgaucuccugaccucgugauccacccaccucggccucccaaagugcugggauuacaggcgugagccaccuugcccggccccaguauauucuuuuuuaaacccuuagccuuauauuuguaaaaguuuaaaacagcauacuucaugugccacauuuuaggaaacugucugagauagugauuauaucuccauauuagaaauaaguagaaaggcccagaaauuuuuaaaugacuugcugaaaaucacaaaucuagcaaaugucauacuucaaccaaaacgcaacuccauuauguauuuuaaagcaccuuucuacuaccacuagccaaaaggacucucaucgggcacugggagaauccuacaggauaaagcugcuuggaaaagauuacuuugguaaaaauagcaucagaaagaaaaaaaagaguugucuaaaggaaaaauuccauuugggcugacuacaaucuaaugaauaauguuuacacucugaagaauguauaguccagaucaaguguuuucuuauggccauuguugagugaaaaaaaaguuuagggauuauuauuaaacauuaccagagaaccaguuucucucgcaaauauuucuuuuuauuuauuuauuuauuuuuuauuugagauggagucucgcucugucacccaggcuggaaugcaauagcacgaucucgguucacugcaaccuccacuuccuggguucaagugauucugcugccucagccuccugacuagcggcgauuacaggcaccugccaccaugcugaccuaauuucucucaaauauuuccuuccuugucuuccaacuugugauuuauaauuacuuuguuuuuuucugauuacuuuuauugauuaacacauacuuuguuuucugccuccuauaacauuguuuaugaauuucauccuuaaguucuuuuuauuuaauaaauguuauaaacuaccuauauuauuauaagcuaguuuuuucccaaauauuuuaaaacuuuucguuagggaaaauuucaaacauacacaaaaguagaaagaauauugcagugaaccccuauguaugccucaucccguucuaaaauauaucaacauuuuguugauuauaucauccaucuccuccucgcuucuccuuuuuucuagaaucuuuuuuaaaaaauacauauuguacccauaaacacguugaaaugcaucugugaugguuaggagccuuuuacauauauaaagccaccaugcagucgugacaaaauuaaugguaaaagcaacauuaauucuaaacuguuuuggcuagauaaaucucuaagucacuaugucauuuuaguauugacaaaauucaagauggauacaucucuuuugacuugcaucugucuaauucaucuauuuucugauauucacaucucuuugggauggagcaugucaguuauuuaccauaggauuuucucuuucuuuaaucagauaacuuuugauaaugcauggguuaccaauauaauugaggccuuccuuuggaaccuaaaaccaagagauuagaguucagauuuggaauuuaucaucuaaccacaucuuaucuaagccuuaauugccgcacuguauuuaggguucaaacaucugggauagcuaccuuacucauuccuaggcagaggugaaaauguacucuauguugaaguaacucuauuaguuccuauuauagcuuuuccaaauccugguuuuuauauuuauauaauauaaaauuuaugaaacauugcaacaguguuucaaguacuggaaauuuuauauguuuggcaaauacuugaugcucaauaaagaguagcucucauuaucuaccuuauauuguugugagagugucugaaggcacuguaaacuguaaagugccaugauauguaacauguaauaauuguuuuuuauauguacaaauggaaucauauauguaauuaugaauccacaugaacaguuaaguaaugggaaaugcaugaaaagaacacauuaaaaagucaaguaaaaauacacagaccacgaaucuggggaagcacuucuucauaagaaaccaaagcaaagaucaaagucuguuuucaaaggaauacaggauuucuaaagccuauuaacaauuaagccacaauucuuuuuacuuauacucacgaauuuugauuggauguauucuuagggacagugucaacacuggauguacugaaggagaacaaaaauaagaauuauacagcaaauuaacaggaguaaauaauuagccagaaaguccuauaugugggccacaagccccacauugaauauccaauaauugguaguucuaaaacgaacucuuguuucuuugaucccccauugaaaauuuugacuuauggagacgauuucauaaauguaaaacauaaaauuguagacuuuuuucucuucaguuuuuaaacuaaagaauucacagagcucucaauaguuaagauaucacaaaggauaaaugcuugaggggauagguacuccaucauccaugaugugauuauuaugcauuucauagcguaucaaaacaucucauguaccccauaaaugcauacaccuaccauguacccacaaaaauuaaaaauuaaaaaaaguuagauaccaguuuucgcuaauagcauucuuuuuauuuaaaugaguuuauuauaugugaaaacauuaaaauaaacaucuuauuuuguaaaaaccacuauuauaacuugguuuuuaucuuacucuugaucuuuaggaaucaguucaucuucuagcugucaucaauguuuuugccucauauuuuaaacaaaauauuauuaauacauuugcaaugggaaauauauccuagugugccaauuuaucuucauauuaaaauguuuaguuggcaguuguugacaggguaaaagcaaaguaauucagcuauuauaauuuuacauuuauauaguuacucuuugagacauacauaaaagcucaauuuuguaugauucauauaagcaacucaauuuugucggucugauagggcuuuuauaaagcucucuuauagcuaucucucccuuuacugaaaguaauuauguauuuggcucuuaggauauuuuuuaaccuucugaaguuaauuuggguaugacccuggcauguuauuuauaaauauuagcaacaggugguaaaauugccgaaauauauuauacugauaccauaauuuuggagcaagcuagucaaaucuguuuacuccauuuaaucugaguuuccuaagcuucaccagccugcagggaccaguagauacaaaauaacaauuauaacccaaauuucacugacuuagcucuucucuucucauaaaagaucccaagcagcuauaaagugcucuucaguauuucugggauucccaggcauggcucccaugcgcucuaaaacaaauccaguccuguggagcaguauuuccaggcauaugcagcgcaccuguugucaccuuggaguccugcugugucccacugggcucugguuccuccuccuuuccuuacgaugaguucuuguccagaagcauccuuaaaaagcuuaucucaaccuuuucuuagguaugaugagccaaacuaguuuaaaaaaaaaaaaaguggagucaugauucugaacacagugugguguggggcaucauucagcuuugaggacaugucugaaucucagagacagcaagaacuaaaacuaagaucuuaaaaccagaaaguacuguuuuacuaaaaaaaauuuccuacagcaccacuguccaguuuaguagccaguagccacauguggcuauugagauuuaaauuagcuuaaauuaaauuggauuuaaaauucagaaccucauuugcacuagacacauuuccugugcuccauagcuacaugugaucacuggcuccugcauuggacagcaguaguacagaacauuuccaucaguacagaaaguucuguuggacaggguuccccuagaacauuaggucucaagcugcaagacauugauaccccuguacuuucacaaugauccaguguauugaggaaaacgccuaaagcugcuguacuaggugguuauggcugaaggaguggagccccaucccaauggcuuuauuuuucucuacugguaccugcccuaauguuuaagcaagaaaauacugguuuuaaagggguuuguugaguuauuuucuuaagcaacaguaacccacauccccguuuuuccuguuuucauugauauguuauagucuucaguaaaaaucauaugaguuuucaacccuggaaaaaaucuuaaaaacuguuuauagaucagcuaaacuuacauuugaucagauaaccagguaaucaaauuguaagaauaaucaguuucuacuucugaaauacauuuuuaaaaacuaauaaaaggcuauucauuucaaaaaguaaaacuuuuuauagaaaacauuuuauucugccacuacauaauguagucuugugccaagguuugaaaaagagagagagagaauuaaaaagaagaagaaaaacuacuuugggaauuauuugauaauuauuuuguuuguuguuuagaaauauucucuggccauauguacaaucuuuacacauacuucuugcaguguguuuauuguacugagaagaaaucuuuguuuucacugaucacugugcaucauuugugcuuacuaccauuuguuaaugaauaggaaaaagacuacuaaaaaucuaacaaacagauuuugcuuuuuaaaggucuuuucuuggccagguacaguggcucacgccuguaagcccagcacuuaggagacugagauuggaggaucacuuuagcccaggaguucaagaccagccugggcaacagagugagaccccugucucuauuuaaaaaaaaauuguuuuuaauuagccaggugugguggcgcuugccuauagucccagcuacucagggacugaagcaggagaaucacuugagcccaggaguccaaguugcauugagcuacgauugugccacuguauuuagccugggcaacaaaguaagaccuugucucaaaaaaaaaaaaaaaaaaaaaaaguucuuuuugugaaauacaaaagagcagaagauauuaucccaacuucugauagggcagucuaggcaaggaagacaaagaacauauauaagauguuuugaaauuauuaaagaaggaucagaguguugaaauuauuguaagcaucaaggcugcuugcccgugaauuaaggaaguuugcaggaggauaaucucaguaaagucuguagacugaaaacuuucauaaauccugaguuguuaacaguguuuucaggcccacuaaugcuaguguuguuuaauacauagaaaaaauugaauaugaaguucaguaguuuguaacuuuuagauucauuuaccuuugaaaaugauuaaaaccggaaucuggagcaauaaaucuaacaaccaaaugaugagcuaaauagugacuuccaacuaugugcaguguguugguaggccuuacacuauauggaaaaacuuaggaauuauuuuuaaccuuccuuuuggaacauuguguaaacauucuuagauuauacuuaaacuauuaagugggguaguuuuaucugaaucuaaguccacuugaguuguggauuucaccucucauggauguguguuuuaauugugggguaaugucaauggaagaucaggguuauaauaucauggcauuugaauaauagaaauucacguaaaauauucuaaucugucaaacuuuaccaacugugugcagauuccacagccaaggaugggaguguggcucauggccacuagagggcaggaaaggucaggaaccggauguggaagccuggggaaaaguauaggggaaagcuuggaucaccccuucguaaggaagacaacuugccacaacuugaagcaaacacaauucagucccugaggcaggaaagacaguaaacgaugcaggaacauaagccacagucaaggccaggaggacacaugggcagggaauuaauaaaccagucuggagcccaaaccuuaccaggcugucaaacugcuggcagaaagcuaaauguaaggccagguugaagaaggcagucagauugcagggaguugagcaggucauucgacccucacuauuauugcuccaaguugaacauacugacccuuuugaaaugggcaaagugggacuuuaagaaucuagugauugaaaagucaaaggaaaucugauaccaucuucuuuugauauugcagcauuuccugucacaacuccugauuuaguuuuguaaugcuagaacuauuccuauuuccuucuuggaaaauucccuccacguccuagaguacuuccucaggucuaaauagcuaauguuuacaaaggaaggauuaaguaagacgaagaugacacagcagaguuuuccauuaagacaugccauaucggccgggcgcaguggcucacgccuguaaucccagcacuuugggaggccgaggcgggcggaucacgaggucaggagaucgagaccauccuggguaacacagugaaaccccaucucuacaaaaauacaaaaaaauuagccaggcaugguggcgggcaccuauagucccagcuacucgggaggcugaggcaggagaauggcgugaaccugggagguggagcuugcagugagccaagauugugccacugcacuccggucugggcaacagagugagacuccaucucaaaaaaagccaugucaauaaucauauuuaauauuuuauaaauuguauauucauaaauauauacaaauauauuuauaaauuaucauguuuaauaauuuagaauuuaucuuuaggucuuaaauagauaaauuauguuaaaacuauaaagguaaggcacauugggcuauaacaaagaauaaaaguuuuccuuaacauuucuauauacaugaauagaauuuuauccuuuuccuuugcaguuuuuacacagauuuuaauuauauaugcauauuuguccaccaugcaugacuggaggcuccaugauaccagaaauacccuccugaacuuaaccuggagccugacucuagaagcuagucacuaguauuuguugaccucaaggaauuuaccgucugguuggagugcaagagaacuauaauacagauauuaaaaacagauacaaagggaaguagaauuacagaggaggaaauuagcaauuuaguaucaucagguaaauuuuuauuaaaauggcauuguggccagguauggugccucacccuguaaucccagcauuuugggaggccaaggcaggugcaucccuugaggccaggaguucgagaccagccuaaccaacguggcaaaaccccaucucuacaaaaaaauacaaaaauuagccaggcauaccggugcaugucucuaaucccagguacuuggggaggcugaggcaggagaauugcaugaacccaggagguggagguugcagugagccaaaaucgugccauugcacuccagccugggcaacagagugagacucugucucaaaauaaauaaagacaaaagugaauaaaauggcauugagcugggugugcugagugagcuugagagggcaaaauauaggaucauugcagcuauuggggggcuuuuguuaauagaaggcugcaagguagauuggaaaaaacaaacuagaauuccaugccaaggaauuuaguuuuuccucuggaccaguauuuuugaaaugugguccucaccagucuguaagaugccucguauaaaaccuaccccauugacagauagguuuguauaaugccacaugcuguaucuuggaauaccacagugcacauuaguaaaucuaaguuccuaaaguucuguaggaaauaaacuuuugagcuugguuuaaccaaauguaucccaauuauaugaccagcguuagauggccugcucauuuaucuucagcuauuaacaaucauugcucacuccuccugguuucuccagacacugaauagauacauguuucucaagguguauugcuggccagaugcauuaguaucacccaagaacugcaaauucucacacauuauaccagaucagcagaaucagaaauucuagggguagagcccagcaaucugucuuuaaauagccuaucaggugauuuuaacacacacugaauuucagccugaaucuugaaacucuagauuagguugggcacagagccuccagcuuuccucagcuaccacagcuuccuuuuauccauuuuaaaguaguuuccuguuuaucuguuuuaaaauucaccuucucacacuuacuuguuuuuaaauugaacauccaagauuuuacacagcucagcuccuugguuucuuagaauugaaggcacucuauauuugcaacaguagcagucgucugcugauuucauuucucauuuaaacugcagagauaauucuccagagaauguuagcguccaccucuucgaaaguuaucuuuuccuuucccuaguagcuuggcagacauuucuaaaaagaaaaaaauuaauaucauaauuagugcucagaagugugaaucucuauuuucagucgagagugaauacuuuucuuuuggaaaggaagagcuuuauccauuuuagcaguuaccuagcugugaguauuuccuggcuaaauuauaacuuuauaccuuaguucucuuguuauuuuccuuuguucagaaauauaaauuugaaacaaugggaugagccccucccuuuuuuagagguggaaagaaaguugaaacaaaugcaaaaccuuuuucucauauuuaguagucaucuaguuuaggagcauacaauauaaauugcuccuaaaaauguuggauauauuacauuuuaacuuuagaaauaauuauaaaauccuauuuauauuugauacggacacaaccucugauuccuguuaugucuugccugcuucagauuccuucuuuccuguagcauauuaaaaaaugguuuguauuuuuaaauccucacaauaaaucaugaaugaaacuuuagagcauguaaagauaaacuugacaagguaaaucaucuguuuucacaagucugugauaauuagaaaguaagaacuccaaagaaauugaaauucaaaggacaauaacucaaagugaaacugauuuagaaaguaguuucuccugacuuccaccucaccccaaucugugagguaaaagccccuuuaaagaugugaggguuucuaagggccguagaauuucaaguagugugaagcuacuaucaaagaaccaaguaccggugucucuugguauuugcagggggaaugguuccaggaccccacagacaccaaaaugagcagauacucaaguuccuuaaauaaagugguauaaaauuugcauguaaccuacacacauccucccauaaauuuugucaucucuagauuacuuauaauaccuaauacaguguaaacacuauguaaauacuugugcugcauuguuuuuuaauuuguauuuuuuuauuguuguguuauuuuuucuuuucaaauauuuuugaucccggauugauugaauccaccgauagagagagcugacuauacaguuuaugucuuauagucagaucuaccagaaaggcuagaggccgagcaaaucacaaacuuaagacauggaaugcuugcuuuaugcaaagauauccaguuuccaaagcacuaugauuuuauagcacagauuaaauuguuuaucuaacuccauuuccucauugacauauagaaagauugacucaguaaauuuugaacuucuaggaaaauguuuuaaauaagcccauuauaguauaaagcacagucaauaaggaaguaggaaagaagcagcuauacaaaugcaauuuuguuuauuaauaagauugguuuaccuuagaaaacaguuaaguuaaauuuacagugauuuuugugagccuuuuuucuaucuauaucuaguauguaguaugaauccauauaguguggauuuugagaggaaggauguucauuuaaaauaauaguuuuuauuauauucagcaagcagaaaaauaugguuucuuauuuuuaaaauacuauaaaaggucuauucauauaaguucugcuuauuuuucugagacacucaugugcgaauaucauguguccaaauacccacuuuucauguguucaaauaaaaaaaaauuaaaugucuuauaaauagaauggaaauuuaaacuccacuuuaagcaaagagguucuuagauaauuucaauucaaguuuuuaauuguaaaacuuacaauuaaaguuuuaauuaaaaacuuuaaguuuuuaauuguauucuggucuuuugugaucucugaaguauuucuugaucuguuagcuuaauuuaaauaguaugauuaauaacggcuugaacauuuuuauggcuguaaauucuuucaauuucuuuuuuuacugccugccccaauucuugucuuuagaauuauaugaucuauacagaggaaucaugacauuugcgcauagaggauuuuaauacagcucugugaagacaguuguuauuaacaaugauuaagauacuaauacaaauguaagccucuugaucuugaaucuuugaucuugaucuuaccuuugaagaaagguauuuaaacuuaucugugcuucuuggcucacucagaaaaguauuuccuucuguagcauccaauuaaucacuaagaucuguuucuaucucagguuaguuuacuguaaucuuuauuguuacacaaaauaaaauuauuuuagauauauaugcaaaaugauaaauaccagcuugguugaggcauuguuugugguagcaaaagauuugaaaccauuuagauugucagucugaauuuagauugacaaucuaauugucugucaauagggaacuaguuaaggaaauuuugcuguaccauauaauagcauaccauacaaccaccaaaaagguaaagcaucucuauauauauugauaugugaacaaaguaugaaagauaauguugaaggggggaaagcaagcugcauaacacuaugucagagaaaacucuaaagggauggauaggcacaaaaauaaaacagcuaucaccuuuugcaaggacagaggguaaaaauggauagcuggaggguagaaacuguuucauuuucuuuuugauuuuguacucgguguauguguuacuuauauuuuuaaauuacuuuuuaaaaaauguucuugaaagaaaagugcugauagcuaaaucugaaaacugaaaaaacaaauuauacuauaucuaauauucagguauaaaauuuauuuuuacucuuuaaaaagcaugauugaaacaaaaaguuugauauuacagcagaaaaccuuggcuaucuuguuggccucuggcugugaagaaauuauucuuucuauaauccuuugccuuuuacaguagauuugcccuggaaaauuauuuauaauucauauuuauuauuuauuuauuuauuuauuuauuuauuuauuuauuuauuuauuuauuuauuuauugaguuggaguuuugcucuuuugccuaggcuggagugaaguggugcgaucucagcucacugcagccucugccccuccagguucaagugauucucaugccucugccucacgaguagcugggauucuagguggccaccaccacgccuggcuaauuuuuguauuuuuaguagagacgggguuuggccguuuugaccaggcuggucucaaacuccugaccucaggugauccaccugccuuggccucccagaguguuaggauuacaggcaugagccaccgugcccagccuauaauucauauuuaauagaaacucuuuuuaaagcaaaguauucuucaaaguugugacacuuuaacuuaacuguuuuuuaaauucugauuuuuuauuacuuuggauucucuuaaagcauaacauuuagcuacuauucauucuuauuaaaguuaacaacauuugaccuccuaaaauuagagcaucuuuaguucuaauuaaaguuuuuacaaaaacagcaauuuggauuuucuuuuuauguucuaaaaauuguuuuaagaaacugaaauucaugucauuauaauacuagaaaagguauuauuuacugacuaaacugugcccauugcagauaguccuguuuaaaaucaccugguguucuaaauucuuuuucagacuuucaggcauucuuaaauuacuuauauuauaccaaaugcaaauuuguuuuaugaaguaggcugcaugcaguucaaauauaggaaauaacucuugcaaagaaaugcuugauacucagaauuuggaacaauugguuggcuagggaaauauuaaugaacaucacagacugacuugccuucauaggaaugaauuuaaaacgauuacuuuuccuuuguaaauggaaaaagaaccucuaauuguccuguauuuauagcaaccauaugucccagacuuuccaggauaguucccaauuucagauucuccaucuucuucugagacuaugcauauugacuuuuaguuuggaaaauuuuuucauuuuucaaauauuggaaauacagcuauuugggaucauuucauuuuauguagaagugaagaaacucauuucagaucauuggcuuuaaauaagacacuguugcaagaaauauuuaaaauguagguacuugagacaagaaaauucucaccaugugggauuuuuguucuuuuguucccaaagacaaccaaugaacaacaaauauagagcaauaaaaacaggugauuuuuuuagggagaugggaugggaugaguuuucuuucugucccucagugaccaggcacugccucuccaauggagaugaaagcuguagggaagauuguaagagauuuuaggaaauaagcacaauaagcacaugaaaagaugcucaaucucauuggcugccagggaaaugcaaaaagccacgaugguauacuacgucacacccacuaagaaggguauugucauaaagacaggucauuguugguaagaaaggggaggaauugaaaucuuacagugcugauagaaauguaaaaugaugcagcaacuuuggaaaacggucuggcagauuuuuagcaaauucuguuccugaguauauauccaagagaaaugaaaacauauguucguacaaaagcuuuuacucaaauguucauaguggcauuauuuauaauagccaaacaguugaaacaacccaaaugucaaucaacugaaaaauggauaaauaaaaugugguauauccauauaauguaacaacaauaaaaaaggaauguuacaguauggaugaaucuuggaaacauacuaaguaaaauaagucagucauaaaggaccacguauuauauaauuccacuuauaugaaauauccagaauaggcaaauccauaaagacagaaagugguuggugguugccuaggacugaaggagggguggggaaaugggcagugaaugcugauugguaaggguguucuuuuugggugaugaaaauguucuaaaauugauugucuaaugguugaacaacucugugaaaauacuaaaaaacauugaauuguacacucuaaguggguuaauuguaugugaauuacaucuuaauaaagcuuuuuuuauuuuuaauuuuuguggguacauaguagguauauauauuuaugagguacaugagauauuuugaaacaggcauacagugcauaauaauugcaucagaguaaaugggguauccauccccucaagcuuuauccuuucuguuacaaacaguagaauuaugcucuuuuaguuauuuuuaaauguacaauuagucuugguguggugguucaugccuguaauccuagcgcuuugggaggccgaugugggcagauugccugagcucaggaguuugagaccagccugggcaacacagugaaaccccaucucuacuaaaaaauacaagaaauuagcugggcgugguggcacaugccuguaauucuagcuacucaagaggcugaggcacaagaauugcuugaaccuggaagguggagguugcggugagcugagaucacaccacugcacuccagccugggugacagagcaagacucugucuccaaaaaaaacaaaacaaaacaaaacaaaacacuaaauuaaauuauuuuugacuaaaguuacccuauucugcuaucaaauacuagaucuuauuuauucuuuuuuguguagccauuacuuaucucuacuucucccuaccccacuacccuuguuagccucugguaaccaucauucuacucucuaucucaguucaauuguuuuaauuuuuagcucccacaaauaagugagaacaugugaaguuugucuuucugugccuugcuuauuucacuuaacauaaugaccuucaguuuuauccaguuguugcaaaugagcggaucucauuccuuuuauggcuggauaguacuccauuguguauauguaccguauuuucuuuauaugucuguugauggauacuuugguuguuuucaaaucuuggcuauugugaacagugcugaaauaucucuucagcacugaagugcacauauccuuucaauacgcugauuuccuuucuuuugggcauauaccuaguagugagauugcuggauuauauggucguucuauuuucuuccaaucuaugggcugucuccccacuuuguugauuguuuauugugggcugugcaaaagcuuuuuaccuugaugugaucccauuuguccauuuugauuugguugucugugcuuauggaguauuacugaagaaaucuuugccuucuccaaugucugcagaguuucuucaguuuucuuuuauuacuuugauaguucaaggucuuagauguaaguguuuaauccauuuuuauuugauuuuuguauaaggugagaaauaggagucuaguuuguuucuuuugcauguggauauccaguuuucucagcaccaguuauuaaagaaacuguccuuuccccaguguauguucucggcaccuuuacccaauaugaauucacuguagauguauggauuuguuucuggguucucuauucuguuccauuggucugucuguuuuuauaccaguaccaugccauuuugguuacaauagcuuuguaauguaauuugaugucagguaaugugauuucuccaguuuuguucuuuuugcuuaggaugccucuggcuauucuggguauuuugugguuccacauaaauuucaggauucuguuuucuauuucugugaaaaaugucauuggcauuuuuauagggauugcaucaaaucuguagauugcuuuggguaguaugggcauuuuaacaauauugauucuucugauccaugaacauaccuuuccauuuuuuguguccucuuugauuucuuucaucaguguuugauagagauauuucacgucuuugguuaauuccuagguaauuuauuuguaguuauuguaaauaggauugccuucuugauuuauuuuacaaauuguuuacucuuggcauugagaaaugcuacugauauuuguauguuaauuauguaucaugcaacuuuacugaauguaucaguucuaaugguuuuuuggugcagucuuuagguuuuuucaaauauaagaucauaucaucuacaaacaaggauaaugugacuucuuccuuuccaauuuggaugccccuuauuucuuuuucuugccugauugcuguagcuaggacuucccuuacuacauugaauaacaguggugaaaguggcauuccugucauguuccagauguuagaggaaaggcuuuuaguuuuucccuauucaguaugauauucacuaugggucugucauguaugacuuuuguuauguugagcuauauuucuucgauaccauuuuuuguaguguuuuaucaugaaaugauguugaaauuuaucaaauacuuuuucagcaucaauugaaaugaucauucuguuuauaaucaauacuucauucuguugauguguuguaucacauucauuaauuugcauaucuugaaccauccuugcaucccuguaaugaaucccccuuggucaugaugaaugaucuuuuuaauagguuguugaauucgguuugcuaguauuuuguugaggauuuuuguaucaaugcuugucagaaauuuggcccuguaguuuucuuuuuugguugugucuguuugguuuuggucucugaguaauacuggcuucauaugauaaguuuggaaguauucccuccuccucuguuuuucagaauuguuugaguaggauugguauuaguucuuuaaauauuugguaaaauucaucagugaagccauuggaugcugggcuuuuccuuggugauagacauuuuauuacagcuucaaucucauuacuuguuauuggucuguuccuguuuuggauuucuucauggcucaaucuuaauagguuguaugugucuaggaauuuauccacuucuagauuuuccaauuuauugcauauacuuggucauaaucucuaaugauccuuugauuucugugguaucaguuguaaugucuccauuuucaucucugauuuuauuuauuuggguuuucucucuuuuuuucuuagucuggcuaaagguuuguuaauuuuguuuaucuuuuuuuaaaaaccaacuucuuuuuguuggucuuuugugucauuuucuucauuucaauuucauuuauuuuugcucugaucauuauuaucucuuuuauucuacuaauuuuggguuugguuugcucuugcuuuucuaguucuuuaagaugcacuuuuuacgcuguuuauuugaaguuuuuuuuuucuuuuuugauguaggcacuguuagcuauaaacuuuccccugaguacugcuuuugcuguaucccagagguuuugguauguuauucuuccauuauuuguuucaagaaaauuuucaauauccuucuuaauuucuucauuaacccacuguucauucauucaggagcauacuauuuaauuucgauguuuuuguaucauuuccaaaauuccuuuuguuauuuauuucuaguuuuauuccuuuguggucagagaagauauuugauauuauuucaauuuuuuuuuuuuuuuuugagacggagucuugcucuguuguccaggcuggagugcaguggugugaccuuggcacacugcaaccucugucuccuggguucaagcaguucuccugccucagccucccgaguagcugggacuacagaccagcacgcucugcuaauuuuuuguauuuuuaguagagaugggguuucaccauguuggcaggauggucucgaucucugaccucgugauccacccaccucggccucccaaagugcugggauuagaggcgugagcaaccacgccuggcccauuucaauuuuuuaaaacguuuuaaggcuuauuuuguggccuaauaaauggucuguccuugagaaggauccaugcacugagaauaauguguaaucugaagcaguugaaugaaguguucucuaaacauuuauuagguccauuuggucuguagugcagauuaagucugauguuucuuuguugauuuucuguccggauaucuguccaaugcugaaagugugauguugaauucucaagcuauaauuguauuggggucugucucucucuuuaucgcuaauaauauuuucuuuuuauaucugagugcuccaguguugggugcauauagacuuauaauuguuauauccuauuauugaauugacccauuuguuauuauauaaugaccuucuuugucuuuuuuuauaguuuuugucuugaagucuauuuuaucugauacagcuacucaugcccuuuuuugauuuccguuuuaaugaaguaccuuuuuccaucccuuuguuuuuagucuuuaugucuuuauaggugaaauguguuucuuguagacaacagauuguugggucuugauuuuuuuuuuuuaaaucuauucagccacuguaugucuuuugauuggagcguuuagucuguuuauauucaguguuauuauuguucaguaaagacuuaccccugccauuuuguuauuuguuuucugguuguuuuauaguuuuuucuuccuucuuuucuuccuuccugucuuccuuuuagugaaggugauuuuaucuggugguauguuuuaauuucugucuuuuaauuuuuuguguaucuuuuguaugucuuuuuauuuaagguuaccaagaggcuugcaaauauuuuauaaguuauuguuuuaaacugaugacaacuuaacacugauugcauaaacaaaguaacaagccaagagaaaacuaauaaaaacucuaacuuuguccucuugcuuuuuuuuuauuucuauuuauaucuucuuguacuaugucuuaaaaaguuguuauagguacuauuuuugaucaguucaucuuuuagucuuucuacuuaacauaugaguaguuagcacaccacaauuacaguauuaucauauucugugcuuuucuguguucuuacuguuaccagugaaauuuguaccuucagauaauuuccuguugcucauuaauauccuuuucuuucagacugaagaacucccuuuagcauuucuuguaggacaggucugguauugaugaaaucccucagguuuuguuugucugugaaagucuuuauuucuccuucauguuugaaggacauuuucgccagauauacuauuguaggguaaaacuuuuuuuacuucagcacuucuaaaaugucaugccacuaucuccaagguaauaagguuuccacugaaaagucugcuuccugauguacuggaauuccauuguguguuauuuguuucuuuugcugcuuuuaggauccguucuuuaccccugaccugugggaguuuuguuaauaaauaucuugaggagucuuauuuaggucauaugugcuugguguucuauaaccuucuuguacuugaauauugaucucuuucucuagguuuggacaguucucuguuauuaucccuuugaguaaacuuucuacuucaaucucugucucuacuucuuuaaagacaauaccucuucgauuugcccauuugaggcuauuuucuagaucuuguaggugugcuucauuguuuuuuauucuuuuuauuuugucuccucuuacuguguuuuuuaaaauagccuuucuuaaaauucacuauucuuucuucugcuugauaaauucugauauuaacagacucugaugcauuacucaauauaucaguugcuuuuuucagcuccagaauuucugcuugauucuuuuuaauuauuuuaaucucuuuuguuaaauuuaucugacaggauucugaauucuuuuucuguguaucuugaauuucauugaguuuccucaaaacaacucuuuugaauucucugucugaaaggucacauauaucucuguuucugggauaggucccuggugcuuuauuuagcacauucugugaggucauauuuuccuggauggucuagaugcuuguggauguuugccaaugucuggacauugaaaaguuagguauuuauuauagucuucacagucuaugcuuauuuuuacccauccuucuuggggaggcuuuccagguauucaaagggaccugguuguugugaucugaguuuugguugcugcagccauauguguguuaggggacauuccaagcccaguaaugcuguggcucuugaacuuacagaaguaccaccuugggaccaggcaugguggcucaugccuguaaucccagcacuuugggaggccaagguggguggaucacuugaggucaggaguucaagaccagccuggccaacauggugaaacccaaucucugcuaaaaauacaaacauuagccagacaugguggcaggugccuguaaucccagcuacuugggaggcugaggcaggagaauugcuugaaccugggagguagagauugcagugagccaagaucaugccacuguacuccagccugggcaacagggugagacucugucucaaaaaaaaaaaaaaagaagugccacuuugguggucuuggaugacaucuggaagaauucuuuggauuaccaggcagagacucuuguucuucucccuuacuuucucccagacaaauagagugucucucucucucacacacaaauagagucucucucucucucuuucucuuucuguguguguguguguguguguguguguguguuuguguguguguguguguugagaugccuggaacuaggggagggaugacacaagcaucccuguggccaccaccacugggaaugcacugggucaaaccuaaagccagcacagcacugagucucgcccaaggccugcuguaaccacucgcuagcugccaccucuguuugcuccaaggcccuagggcucuacaaucagcagauaaagucagccaggcuugugaccuucucuucagggcagcaaguuaccuugggcccagagugcauucagagaugccgucuagaagucagggccuggagucagaaagcuuaggaaucuaccuuguacacuauucugcugcagcugaguggacacacaaaccauaagacaaaguucuucccacucuucccuucucuuuccacaggcagagucucuccguggccacuccugccacagggcuauggggaguacugccagacuaccaccaguguucacucaaggccccagggcucuucagucaccugguggugaaugcugccaggccuggaauucacucuacugagaagugggcuccccuguaucccagggaagguccagaaaugccauccaagaacugagccuuggcaucaaggaccccaagaggcuuggugcucuacccuacuguggccaagcugguaccuaaacuguaauacaaaguccucuuuacucuuccuucuacucuucccacgcaggagucucuauagccaacacagcugagaaugugcuggauuucaccugaaaccuguaugucucagagucucaccuaaggcccaugauguauacuaucugguuacugcugcugauuauucaggaccuaaggcucuucagucagcaaguguccuagccuacuauggcugagcugguauccagguuguaagacaaaguccucuuuacucuucuuaagcaaaaggaaggaguuucuuucagagcugcaugcugcacugccugggguugguguagggguggcacacgcacucccuugaccacuccaacuggugucucacuagaucaccugccccccaaguccacugguuccaauccaagcccaguacgaacuaggacuuaacuaggaauugcaguccuuguggccuaaacugccuuucaaguuuauuuagaaccccagagugcuuuagcccacaguggugaggcuugccagaacucaagcuccaaccacuaggauggacaauucuccaccggcucuggcugaucuaaaugccaccuucauggaccauggcugaguucugccugguguugcuuuccacugugacaaugcagcacugaguuccaaugcaaagucccacugucacugagcucucccaacccuaagugcacggauucuccaugccauacagccacugccaggggauggagggggugggugucagcaacugaagacugucuuuccuacccucuucagugccucuuucagugaugugaaguuaaaacuagauacugugauugcucaccugauuuuugguucuuaugaaggugcuuuuugugugauuuuuaaauuuuguguuucugcagguaggaugaucaguggaggcuucuauuugguuuucuugcuccacuuccugccuaaaagcuguuacuuuuaaaaaccaaaauuaggaagagacuucugcacguuuguuggaacauuuggucuuauaccuucuguagcagugguucuuaaugaggaaugaucuugccacccaggggauauuugacaaagccagaaaauguuuuugguuguuauaacuggagggcggguacuacugacacaaguggguagaggccaggaauguugguaaauauccuucaaugcacaagacagcccccacaacaaaaaaaaaauuaucuggcucgaauugucaguagugcccaagcugagaaacccuguucugugccuguauuacucuagugacaguugaucacagcuauguuuuuuaagcacugcagggucacaaaucaucaaacauacagauguucaguguauucuguuuacucaggacaaggcuauuuaauaagacuaaaccaaaaaaaaaguuguuuuuguuuuuguuuuuuuuaaucugauuaagccuaaaccuaaguuaacuagauaauucaguuacccaaaauauuuuauuccucagucauccugauugagauuuuacuauuuuuuguuauauuuuacuuauucauguagagcuucuuaaagaucagacuuaaugaagcauaacaucuacuugugauaaaaacaggaauaaagaaacauacuggcugggcacuguggcucaugccuguaaucccagcacuuuggaaggccgagguggguagauuacuggaggucaggaguucaagaccagccuggccaacauggugaaacccugucucuacuaaaaauacaaaauuaggcgggagugguggcgugugccuguaaucccagcuacucaggaggcugaggcaggagaauugccggaacccgggagguagagguugcagugagccgagaucacgccauugcacuccagccugggcaaaaagaguaaaacugcaucucaaaaaaaaaaaaaaagaaaagaaaagaaacuuacugcaauauagccuugaaaacaucauuaaaagcuaacuuacccauuucaaaaauuaucaucaacucauguucuagaauaggaauauggcguuaaacuaagcuaauuuguuaggccuuagacuccaaccguacuccuuuucuuggauauaccuguuugaaauguccacacacugguccagggaaaggggagcagggguuucauuauauacgccaguauuuuaaauauauauuagcuaacauguuuugaauacuuacugugugcuggguauuaugcagggcacuuuguauucucuuauuuaauuuucaccaaacccuacuagucgauaugauuaucccuacucuucuaggaaacaucucucucguagcugucuuccugcuccaguaugcacugguugcucucuagguguuacauaacuguuacucugagacuuccuuucccugucuuucugagauuccucuaugcucuccuaucuugaauccccugcaucuuccauaucacggcacacucccucauuuuggugaaguauauccuccauuaccucccugaaaauaccaguaucugaaaaugucuuuauucuaccaucauaauugaaaaagguaguuuuucugaauguagaauucuacauaagaaauaucuuucucucauuauuuugcaggaaguacucucuuauauuucagguuuguguauuagcuacuuuguuacucuccaagcuuuuagaauuucuuuaucucuggugcucugaaaugucacggugaugugccuugcagcaagucuuuuuccccuuucaugcacuuugccuaauauucagugggccuuuuuauucuuuuuuuuuggagacggggucucacuccgucacccagacuagcgugcaauggugcgaucucggcucacugcaaccuccacuuccuggguucaagcaauucuccugccucagccuccugaguagcugggauuaaaggcauguaccacuaugcccugcugauuuuuguauuuuuaguagagaugggguuucaccauguaggucaggcuggucucgaacuccugaccucaugauccgccauccuuggccucccaaagugcugggauugauuacaggcaugagacaccaugcccagccagcccuuuuauuuuuaauauucucuuccuugaguucaagcaaaguuacuuaaaaugcuuuuuugauaauguccucccuuuccucuuuucuuucuggaaugccuauuauuucgauguugacuuuugaauuuucuccuguaauuuccuuauuugaagaauccuauaguguauugucuuuuaguucuacuuucugagaauuuuuuuaacucuaucuucuaacucuaucuugaaguuuuugaguuauauuuuuuauuucuaagagauauuucuuguccucuaauugcuucuuuuuugcagccuccuaucuuguuugacaggugguucaucuccucuuaucucugggaauauuacgguuuuucugagguauuuuucuugcaauuugacuugauucuuauucaucagacucccgucuuucauuuaggucuguguguuucauguuauaaacuuuccccaaauauuuaguaguccauaacugcccauaauguauaauauuccaauauuuauuggaaggguuuuguucaugggcaucuacugacuaguggacuucacuuuggggugagcagagagaauuagucauuuuauuggaagacuuccuggauuuaauaucuauaagucugucucauuggguugcuuaguuguuccagagaggaauuuucuuuccugggaaguauauauuugucugccaguauucuagaagccaagugaaacaaaggaguuggagagguccuuauuguuugguauuaggacuuucacucauucucucacuuaucucucugcugucaucuacucuuccagucucccuuuuuucuuucuuuuacuguucauguaaauuaaaucggacagcauguacucuuuuguaucuucuuuuuauaauuaaacuuuucuggccaggcacuguggcucaugccuauaaucccagcacuuugggaguccaagucagguggaucaccuggggucaguaguuugagacuagccuggccaacaugguaaaaccugucuuuacuaauaacacaaaaaaauuagcugguugugguggcacaugccuguaaucucagcuacuugcgaggcugaggcagaagaaucgcuugaacgagggaggcggagguugcagugagucgagaucgcgccauugcaccccagccugggcgacaagagcgaaacuccgucucaaaaaaacaaaacaaacaaacaaaaaaaccacuuuucuuugagauuuauauauguuauuuuguauauccguucauuucauuucaucgcugaguaauucuacuaguuguauaucccacaguuuuauuuuucaaaggacauuuauuuccaguuuaggcuauuaugaaugaaauucugugaacauucuugaagaaguauuuuagaggauauuuguuuuuauucucuuaagaaaauacaaggagcagaauuucuuggucauauacugguauauguuuaacuuuauaagagaguuuugauugcaccacacccugaccaauauuuguuuuugucagacuuuuuuuauuuuagcuauuccaggggguuugaaguaguacugcauugugauuuuaauuugcauuucccugaugauuaauagugauaagcauauuuucauauaauauuuaccauuuauuuaucuucuuguuugaaauaucuguucaagucuuaugcccauuuuaaugggacaguuuuucuguuuauuauugauucauauuauugacuuauaguaauauuuuaugaauugaucucuuuauuauuaugaaauguuucuuuuuauuugugguaauacucaucaucaugaaaucuaauuugucugauauuauuauagccacuuauacuuacuguauaccugauuauuuuuuccauaccuuuaucuucaauuuaucuguauauuugaauucaaaguucaucucuugagccugaaaguaauaagcaccuugaacccggaucuuuauaucuaaauaugauucuccaguaaaauuuaucaggguucucuggacaaguggcugauugauuguagagcagggauaagaagaguauaugcugaaccugaaucauuuuuguggugccaaaaaguaaggaaguacacaaaaaaauugagaagauaucagaaaugcacaaaaacuaaccugaagugacucucaaugaccauaucugggacaauuugaguaaaaaaauaaguaacaauaauggauuauaucuuauaagauaauauaaaacaaauaucaaugagucuaugaugauauaaauuagaauguauaaaugggaggaaggggaaaauucuuugcuuaagcagaauaauaauuaauuaauauaaaaagaauaauggaaaugguagaaauagaaagucaacauuuggcaagcaccacaguaauaauuguugcaggcaagaaucaucaauggaugcuaaaguuugugagaaaaaguuugaugagaaaugggcuauuuacauaaccucaaaggcuuuucccacaagauacuguuaauuacaaaggggaaaauauugagaaacauggaagacagcaccuuaaccaaaugauugaaguuaauaccauuaguaaugcaacaaaucaguaucgugugccuccugauaugaugcacugagaagggcacaagcaucaccuuuaugguauucuugcaaaaaaugcauaaucuaaauucaaccaugaagaaauauuagaaggauguucuaugacuagucaguacugcucaaaaaugucaagauuaugaaagacaaagaaagacuaagguacuuuccagauuuaaagaaauuaaauagacaggacuacuaaaugcaauauaugagucugaauuggacccuggacuaaaauuaggcagacaguuggugaauuuugagucaagucuguagaguaguuaauaguauuucugguuuugaucaucauaauaugguuauuuaagauguuaacauuugguggaucugggugaaaaguauaugaggauucucucgcaguauuuuugcaauuuuuuuaaaucugaaauucuuuuaaaaugagaaguuggcugggcacaguggcucacaccuguaaucccagcacuuugaaacaccaaggcaggagacucgcuugagcccaggaguuugagaccauccugcguaagauggcaagacuccaucucuuuaaaaaaaaagaaaaaagaaaaaaaaagugaaaaaaaaagaaaaacauuuaauaaaauauuuuuaaacaauaaugauagaugucuuuuauaggcaacauaugguuagauuuugcauuuuuauucagcuugacaaucucugucuuuaauuggacuaguuugucauaauuuauauggcuggauuuagcucucagaaugugcaguuuauuucuguuccucucaucuguuucuuuguuucucuuuuccugccuuauuuuggguuagucagauauuuccaauauuccauuuuaacucuucucugugcuuuuuagcucugcagucaauuaaugauuaacuuaugucaaucauaccacuuuauauaaaauauaagucuugcaacaauauagauuugauuauuccaccuaucuugugcacaauguugucauuuuuauuacaucuacauauauuuuaaacccauaguauagcgauacaauuuuuuuuuuguauacaacaauuuguucuuuaaaagauugagaagguaccuuaaaaaaaaaaaacuuuacccacauauuuaccauuuucuggugcucuuuauuacucucuuuagaucugaauuucuaucuggugccacuuauccucagccugaagaacuuccuauagcauauucuguagugccaacaauuugucugcugaugacaaauuaucucuacuuuauccgaaaguaucuuuauuuuccuucccuuuuuuauggauaguuuuugcuagauacagaauucuugguacauuuuccauuucagcacuuauagauaucauucaguugucuucuggcuuccauuguuuuugacgagaagucaaccauuauuuguauucuuauucuccuguguguaauguauuuuaggcugcuuucaagauuuucuguuuaucuuuuguuuucagcguuuaauaauggugugccuacccauguuuucuuuauguuuauccugcuucaguucacugacuuuauugacugucucagcuuguguuuuucuaaaugugugaauauuuuggcuguuuuuuuccccaaauauuuuucugcccuauuaccuauccccuuuuauggaacuccaguuacacauacgucagacugcuugaaauuuuuccacaaguucccuuuauuuuucauauuagauaaauucugucucuauaucuucaaguucauacuuuucuccagucaucuucaauugucuuuuaaacccauuuauugaauuuuuuuauuucauguauuauauuuuucaguucuaaaauguacaucuggccggccgugguggcuaacaccuguaaucccagcacuuugggaggcugaggcaggcggaucaccugaggucaggaguuugagaccagacuggucaacauggugaaacccugucucuacuaaaaauacaaaaaucagccaggcaugguagugcauggugcaugccuguaaucccagcuaccuguguggcuaagacaagacaaaucacuugaacccaggaaguagagguugcaguuagcugugauugcaccacugcacuccagcuagggugacagagcaagacucugucucaaaaauaaaauuaaauaaaauaaaaugugcauuugauucauuuuuaguuuccccuucacugcugagguuccccaucuuuucauucauuaugaccuuauuuuucuuuuaaguccuuugaacaucuuuauaauagcugcuuuauuuuccuugucugcuuauuccaugaucugcgucaucuuguggcugguuucuguuaauuacuuuuucucuuccuacuggguuuuuuuuuuuauuucuuugcaugucuaguaauuuuuuuauugugggcuggacaaugaauauaguaacuaauagagacagugaauuuuauuauauuucccugaggagaguugauuuccuuuuuuuuuuucuuuuugagcggagucuuacucugucacccaagcuggagugcaguggcaugguccaggcucacugcaacgucugccuccuggauuuaagccacucuccugccucagccucccaaguagcugggauuacaggcaugugccaccacaccuggcuaauuuuuguauuuuucguagagaugagguuucaccguguuggucaggcuggucucuaacuccugaccucaggugauccgcccaccucggccucccaaagugcugggauuacagguguaagccuccaugcccaguguugauuuuuguucuagcaaguuaacauagcugaacuccaaauucugcuucccuuuuggugaacaucagcugaaaucagugcugagcccucucagucuuccaucuguugauuuucacuuguucaguucagaguaaaacuagggauuuagguaagaguuuauauauagauuuggaagaacucugguggcuucuuuuuuucugggacguuucuccucuuuuucuagauaugcugucaaccccaaacuaggccuucugacuccucaagccaguaauagugcagauuucagcuuaaguucuaggcucucugcauuauguggacuguagaauacuacuagaggaaaagccauauaaauacugaaucuuaccuaguguaguuccuucuuugaaggauugacaucccuccaguuucugcuuguuuggggucauucuguuguacuuucaaauagcucuuuuaguauuuugucacagaauauaauuguuaucugcagaaggauuaaucuaauauaugcuacucugccauuaccagaaguuguaccacauuacuuuuuauuuuccauugaugcugcauaugacugaauaaaaaaaaaacucuacauuuucugugaaugguggcacuaucucaucaaacucuucuaaaggaauugagcguauuacuaauuauauuuuuucuuccuucucuuauagacaagagaugauuuccuaggucaaguggauguuccacuuuauccauuaccgguugguauagguguccaugauuuuccuuuugggcuuauuuuuuuaauuuaauaaauacuuacauauauaauauagcuacuguaaauaauugauuuaucaaauguauacuacuuuuauuuauugagcauacuguuuucuaaaaacucauuucaauuuuccguuuccauuuucucuuuaagauuuccguucaugaaccccagugagaaauagagaauuucugauguuuguuggcauugugaaaacauuguguaaaaaagauuaguuugaaaauauucugcugaauaacuagaaugaggagugccuaagcucacagaagaaaacuaagauaguuuacgacaauggaaacauaaaacacuaagaaucaggacuaagaauauagcaaggagaaaaacagauucaggaaacauugcaaaauagaacauuauugaaucacaugucugacauggaggcuuaagaaaauaagcaagaaguaaagauaauacaaguugaacuuggaagauaagaguggcgucucuuguagaaaagugaggaagaaaagccauuuuguuuugaaaagcaaaaaauuuauuuuuggacaaacagaguuuugauaggaaacaaagaaaaugaaaguuuaaaguagacugcugacagagagauaaaaaucagcuagguagggaaaagggacuggaaggauugaguguuaucacuguccagauaacagcagaaucucugagaauaaugggcucuccugaugaaagagauaagaacggagggccagccauugacccucagucaacgugaguggaucagaaaagaaagagaagacagacaaggggaaacaggaaaagagccaaguaaaauaaugucaugagaauuuaagaaaggaguuucaaggcagacuggguaguuaacaaugcagaacaucagagaaggauaauaaaaacuaacaacugcugaauuuuaaagaaagagaaaaaauacuucuuuuucagucuugugaguuauauuaauuggcucuccacagucuuuccagagcauaaucuuuuuuuuuuuuuuuuaaacagggugcaggaccauaagcuuucaguaauauauuuaauccagucuuacuuuccaggcuguugacuuuuuugaucuccuagaauuaucucuaugcucuaaccaagccagccugcagacaugugcauaguccguguucuuuugggauguuaacauacuaaccacucuauacuguuuuucugcuuauucucuucugcccucccuuuggcuccacaacccaccugcucagcuaguuuucauuugaguugugaugucggcugcaauuccucuugggcaggaaagugaaagcacugucaaguuagcauuugauaaacuaaagcuacuuuuuuuucucacuuccaacuuaaauuaugccuuaggugauaguucaugaguauucuugaaaaguacaugcuuuugguguuauagauauauuuugaaaacccacuauuuuauucuagacagaaaauccaagauuggagagaccauauacauuuaaggauuuuguucuucauccaagaaggucaguaaauauaaaauaauaauagcauauuaaauuuuuuaucucuucauuacaccuuacaguagccuuauuagaaauucaggguuuaaaccucuguaaauaaguuacuucuaaauauuauuauuauuauuauuauuauuuuaaaagcuucauugcuauuucugauuaaaaguacuguaugcacauugcaaaacauucugaaaauacagaaagugaucacagccuuuugggaaagauucguucuccuaauacuuaucagacuagaaggcuauuuaugucauauugucauacuaugcuuuaaaaaaucacaaacaugaauucaucuaaaaccauuaccuaacucgacgugcacaaagccaauuucagaaaaaccuaacuauauuuugcauacuuaguauuucagaagacucaaauauuuagagaaaauaacauaagacuggaauuuaaaacccaaauagcaugcuuauaauuccauuuucccaaacaaaguuacuugauguuuaucaaaaaaauuuaaauuuaagcuguaacuaaaacuccuuuugaucuucuauaccucauugacaaguaaaaucuagugaaaacguguguggauuuacugucaaaaaggucaaacuaaagcagagaaaggacaucugugaaagcaacaguauuugucuuguuucuuaaacuauaaaaugcauuugaaaauguacuuuuggaacuuaguaaaauuuuucacuuaaaaaugauuuuuuaaauuacuguuuguaauguaaauauuaaaaaaaugaaaaggagugcucacugacuguuaauauuuacucucuauaaaggaagucacauuuaauuucuguagaugucuggaauguaaaucucuuuuagucuuuuaauuuuagacugauugugacaucugcauaucaagaauaacuaaauuguuuuuucuuauuugauuguccuagcagccugcuuuucaauuugucacaugcuuucuagcgucuuuaucuuuaaaaaauacaauuuguuucuucugucugcaaugaauauuauugcaaguguagaaagaacuuuauucagauagaaaauguacuacauuccuaaauuugugugagccccauuaagucaaaaccuugaggcuucuuuuccaauugaaaagacaugaaacauacaauuguagagaaacuuuucaacaaaacauugucugagcacauuuucuguauccaucuuuuauagccacaagucagaauguucacaucuccuucaguauggagacacaagccacauuagcggccuugggaauaagcaucaggauuucacugacuacucaugaaaggauacacuaaauuugccaaauccaugagaaccauacagagaagagcuaaaaagauuaggggaggcuugggaguggggguagguaaucucuugaagacagaauaaaaggauuaggacucuugucuagaaagacaaaggguaauugcuacauaucugauaucuguaaaaaaucauccccaaaaaaucuauauagagagcugagacaaguaaggauuucuuaaguaaaucauaggauacuagaauugaugaggacaauagaauuaagccuuaaauuagaaccuuaugaaagcauuguaauuguagcacuuugggaggcuuagguggguggauugcuugagcccaggaauuccagaccagccugggcaacauggcaaaacccugucucuacaaaaaaauacaaaaauuaaccgggcauggcagugugugccuguagucccaguuauuuaggaggcuaaggugugaagaucaccugagccugggaggucaaggcugcagugaaccguaauugagccacugugcuucauccugggcgacagagggagaugcugucucaaaacaaaaaaaaaaaaaaaaagaagaagaagaagaagaaaaaaaaagcagcagcagcuuaugaaagacagguuuucaaaagauuuaaaauauuacuacagcaggcagcagccuuuagcuuagacaacugauuauucaaaaaggugauacaauauaaaaauagauuagguaaauuaaugugugacagauucaaacagcugccaaagagauguagcagguuucagacacugaucaggccuugcccucuacucuucugucauccaaaaaaauauggccagauuagcaucccuaaagcacaucucugaggauaccuuucucuaucccccaaauucucagugauuuaccaaaauaugcaaaauaaagucugaaguugucugauuuugcaugaccucuggaccaucccaaucuccuguaguccccuuuacauguccuauaaucuagccaaacucaacuacugcaauuuccuuaauugcaccccaaauuucccaucuguuuccuggaucuugcccucuucuuuacucauaugccuuuuccucuacugccacagguaagaauccuccccagucuucuaaccccaacucaaaggccagcuucucuuugacauugucucugaucguucacuuaaacuuccuuagcaucuucuuugugucauaacaauuauuuauuuauuuauuuauuuauuuauuuauauauguuugccuuuucucuaccuucuauuccuuucccuagauaucuucugcccuggaacuugucuuugaaccucccuuuguagacccccugguaccuaguggguguucauuaaacucuuauuaauugaauacuuuucucccgguguuaaaguuuuaugaauauuuauuuucuuuucuacagucacaaaucaagaguuaaagguuaucugagacuaaaaaugacuuauuuaccuaaaaccaguggcucagaagaugauaaugcagaacaggcugaggaauuagaggugagauuuuauaaauauuugguuaaacuaaaaaaauuuuaauuucuuauuuuacuguacucugaagaacaauaacuauugaaugaaguuaacaugugcaaugaagauuauuuacuuggauguuuauuucacccaagcauuaauaguuuucccucuaaggauauuuccguagaaggaauggccauuauugauggccuucuuaaagguuaaggaguagagaauagaauauaaaucuaguuuuucaaaguuuucuaaaacuguauauucuccauuaaaguaagaacacaauuuaguauuuugaaguuaaauauauggacauuuugaggagacuccacugauuaggaacucuuuuaugaaauuuaaguccuguuaauauucuuauuauggugggagggcucauaggaaaggaggggaauuagggagcaaggaaaauuuaagugaucuaauaaagagccuucuguauguggggcaaguagaauuuaacaauuuucauggaugacaggaugagaggaaaguccaagucaagauuuguguagaguuacaugcaucuggaguaagcaaguaggaggcagaaaguauguauuuggaauagaauuggauaggguuuggagacuggaauccuaguugcacacucugucuagccagaccugugugagucauugaacuuuuccgaaccucaggaucuuguuugcagagugacaggauggcaucagaugaccucgaggguuucuuccagcaaaaaaauuuaugauuuggaaaggggucaaaaaaacaccugcucguugagguucccuuugaaagcacauuaucaucaaaaagaaguaucauuuauucaguagcuguguuaguccauuuucauacugcugugaagaaauaucagagacuggguaauuuauaaagcuuuaaaaacagguuuaauggacucaguuccacauggcuggggaggucucacaaucaugguggaaggugaaagaggagcaaaggcacagcuuauaugguggcaggcaagagagugugugccagggaacugcccuuuauaaaacuaucagaucucaugagacuuauucacuaucaugagaacagcaccggaaaaacucacucucaugauucaguuaccucucacugagugccuaccacgacacgaggggauuauagaagcuacaauucaagaugagauuugaguggggacacagccaaaccauauuaacagcaguuacugaaagcaaagcacacagcguauggcaccaaauugcucuggaggguucuuauuuguugccuugcuuaacacuuucuccucugacugagggccugcuuaggucuccauaagaacagugaagcugagggccuuccccaggggcuaggcucuaccucacaugcccauguaccuugagaaagaaaagcucuagaacagguagugaauuugcagcagagcuuucugggaaaauuuuaaaugcacuaaugagauuuugcuuugcaggagaaucuauaauaauagaaggaaagaccuuuuuuuuuuuuuuuuggagucagagucuugcucuguggcccaugcuggagugcaguggugcaaucucagcucgcugcagccucugccuccuggguucaaguaauucucaugccucagccucccaaguagcugagauuacaggcaugugcuaccaugccuggcuaauuuuuguauuuuuaguagagacagaguuuuacuauguuggccaggcuggucuugaacuccuggccucaagccguccauccgccucggcuucccaaagugcugggacuacaggcgugagccacggcacccagccaggaaagaaccuuuuuucuucaaaucacagaguauagauagccccugguuuggugaucaaagaacucucuucacuuauuugauuaacuuuuuguuagguauuuuucucugauuuucguauaauuguuuuuaaaguuuucaaguauucauucaguagaaguuucucuaccuggcuuuuugguguaccagaguaucucgaauaauggaauucuguuugaaaugaaggauaucugcuguaaagaaagaaaauuauuuauuuaguaacuugaaaaaauuuaacagcauuucauuauuuaguaaccugcuccaaguuuugcccacaugcacgcaucauaggacccuauucacaguugaguuucuguggagagaacugcuucacuucauuuugcggucucaugucucaguguuugaauucccucagaaugcaccuuauaauuucaggagauguaagcuuguaggaguuuauuuaugaaaggcccuaggaauucaaacacaugaaucugugcuuauuuaccuucuguguagcuaaugacuagaggagucuugccuaguccuuugacagcuaguuugugacuguauauauaaaauucuacuauuuaaggaaaacaauuguaauuuugaaaugaagcucacucuuagguaguuuguauucuguaguaaaguauggcuauaauagauaauuauguaacauuugauuuuuguaccauuugcaacuuuaggguuaguuguauguauuuuacaaaauuaacauaaaauguugguuguaccucugaaugcuuucuuucugacccucuuugacuugauuaaauugugagcaauuacauauuggcuuugcgguuagaaauuaaauaagguucauugauacuuagaaaguuauuuuauaaagaauagcagcugauacauauuuaauaggaaggccuucuauccaaaaaauugacuguauagaggcauuguauccagucuuucuaagccguguuugauuguacaacucuacuuccacaaauuugagacaggucuuuuuuaagcccuuaauuaaauuaauuuuuguucuuucucuuccugaauuuacucagauaauauaaauacauuaagcagacauuuaagagagaaaucucuaagaagcuuuaaaagaaauauucuuuugcuaccauuuuucuagcacuauuuuuauaauccuuuacagcaguagugagaacuauuuuauuaauaaauuguauuaaucuuaaaggaaaaguaaucaaugguuauauucaaccaaaaaauguuaaauuuauauuuucucaaaagaguaaaauauaaaaacuuaacguguuuugggauugaaaccagaaacauacagucugauucaauauaugcaagacuaaauuuuagguaugcuagauccuguauuaucauaauuuaagagaaaggaaaagaaagaaagaaggaagaucaacauggaugggcagacaaaguaagaggauauaaggaaagaagagaaugaaauuugggcaauaaaaagaaaaaauagagagaacaauucuuauaaaagagguaaaaauuuaaaaaaaaaaagaagaaagguugggcacaguggcucacgcugguaaucccagcacuuugggagaccaaggcaggaggauugcuugagcccaggaguuugagaccagccugggcaacauaacgagaccccaucucuacaaaaaaauuaaaaauuagcuugggaugguaguacacaccuaaagccugagguggaagauugcuugagcucaagaggucaaggcugcagugagcugugauggcaccacugcacuccaaccugggugucagaaugagacccuguugagagagagaagaaagagagaaauuccccuccagaccuuuucucccaaaauaauuuauucugucaucuuccuacuccacuacucgucaccuucuauacagagcuagccaaacuagaucagccuugcugcagaaaccccuauccauuucucccugcuaccaaaaaacauuccuuuccuucccaacucuuuucccugaggccucguuuucaggucuagccuuccaacguggaagaauucucuuccaucuuggaagccguccacugccugucacacagcagucauuuacugcugaucuccaggccuagaacagaagcucuguguaucuaaggaaauuauucugugucaguuaucaaagcaccaaaaauguuugccacuuugucauuuggucuuuuuuuuuuuaauguuauuuaguaguuuuggccauauacaaauguggguguuuuguuaucaaauuuauggaucuucucuuucaugccuucaagguuuggugucauacuuaacagugucccacuuuuaaaauauauuucuaaaauuuucaaaaguuuguuacuacuacuuuuugguuucacuuuuaaacauuuagauauuauucagucuguaacuuauccugauauaaggcaugagguaggaauucaagugaaguuuuuuccaaaugggugcccauuuucuaaguaaucugcguauuuugccacagauuucaaaugucuuuaucauauucuaaauuccuauaaaguuuuuuuuuuuuuuuuuuuuugagacagagucuugcucuaucgcccaggcugguaugcaguggugcgaucucagcucacugcaaccucugccuccugggcucaagcaauucuccugccccagccucucgaguagcugggauuacaggcgcccgccaccaugcccggcuaauuuuuguauuuuuaguagagaugggguuucaccauguuggccaggcuggucucaaacuccugaccucaagugacccccucaccucagcuucccaaagugcugagauugcaggcaugaaccacugugccuggccggaauuccuauaaaguugaguuucuuucugggcaaaucuauugagcugccugucgaugcaugcaccagaaccacacagcuuuaauuguugucauuuauaauguguuuuuaucugguaggguugaucuucacuucuugcuuuucuuuuuaaaaauugugcugcuuauuccugcuuguuuauguuucuguugaacuugagaguugccucguaucuuuuuuuuuuuuuuuucuuaugagacagaguuucacucuuguuguccaggcuggagugcaauggcgugauuucggcucaccaucaccuccgccucucggguucaagugauucuccugccucagccucccgaauaacugggauuuacaggcaugcgccaccacaccuggcuaauuuuguauuuuuaguagagaugggguuucuccauguuggucaggcuggucucaaacucccuacuucaagugaucugcccgccucggccucccaaagugcuggaauuauaggccugagccaccgcaccuggccuauuuuuuuuuuuaaucauaauacaguuuuguuggaaucuuggcaaauuuauagauuaacuugggaagaauugacaccuuugugagacugagucuucccagccaagaacagacuaugucuuucccuuauuuaggucuucuuuuguguccuuuugggagcauuuuaaaguuuucuucaccaguuuauuucaguuucuaaugcuuuccuaaccaaucaguauuuaauagaaucuuugaccuacugccuuuucuuuugugagguuucucauauaaaagcauuaacucuugcuacucuuuucuaucaauuccuuacuuuaacugcccuaaggcuuuauguuaauuuugccccuuguuaaucucugagaaaccaaacuucucagugcauuuuuuaaaaaucuuucuuuggcuguuuuaugacuugauaaaaugccuugccuugguccagaggagaaagagagaaaucagacaagggaaugagaaugacuuuuccaucacuagagaguucacuguagcaguuauuucuaaaucauuugccuuccccaucuugccccuuuguauauuugaccuuuaucaaaugauuuuuuccaugugucagauaguuauugauuucuaccguaagcaaggugcuuucucuguaggaaagacaaugaccaauaagaaauaauccuugcccuucauucaguugauaauuuagagaacagccuaagauuacacuaguaguuuaaacuauacuucucaauuucucaguacuuuccaacuuuccgugguuguuuauuuaaacgauuuuuuguccuuuuuuucuauuagauuuuuuaaaauuuuauuuuugauugacaauaauuguauauauuuauggaggacaaugugauguuuugauauauacuuacaaugcaaaaugauuaaaucaggcuaauuaaucucauuaaaucaccucacauacuuuuauuacuuuuuuguuaugaaaauuuuaaauagauuuguuuuaaaguucuguuuuauuguuguuuugagaugggaucugguucugucacccaggaagaaccugguggaaacuuuacaggcuugugccuuuaaaguuuuuuuugaaaaauuuuuagacaauuuuaaacaaaauuuaaaugguuaucauuuuugcaaaaagagucuucauuaucauaaaguauuuacauuauggucuuaaaaguugaggauuguuuauucugucuaugcauaauuucuaaaacuugauauaauaaaucucuuuuuaaauuuccuuuagcauauaauuuagaaaguuaaaaaaaucaugcguaaacuuaauugcugccauccuguuuuucagccuggcuggguuguuuuggaccaaccagaugcugcuugccauuugcagcaacaacaagaaccuucuccucuaccuccagggugggaagagaggcaggauauccuuggaaggaccuauuauguaaaccaugaaucuagaagaacacaguggaaaagaccaaccccucaguaugugcugauggcuuucacaauuuuaaucuggaaacacuuuaacuacgaauuuucauuuugaagucaugucucagauggauucauaacaguauagugauccauaaacuauaagaauacuaggauuuuuauugcccaggacuuuaaaaauccuaacucugcuguuucguuuuuuaaaugacuugauaauauucaaaauuacuugacucuagauacuacccuuuuaauugcgucuuaauuuuaauagguuuuuaauuuuauguagccacaaaugguagauuuuuauuuuuaggcugaauuagaagucuuggagaauucuuguaguuuguuauuaaaauguaauaaaauguuaauuucuauaguacucuauuuuuaaaauauaaauuauuuguaaaauauaaaggacucaauaauaaggguauuacguuaaacgcgcauuugacagucuggucaauguccacauaacuuccagcacgcacagaucaaggacggaaugacuuucaacauauucuaacuucugucuccucagugauuuuuuuuauuauuagacuguauauacauuuauaaaaucucccauuauucauauuuauucucaaauccccuuccauuuuuccuuccauauagucuuauaaagucuuccuuuagucuucuguuugaaacauacucguaauuuuuuaauguguucauuagccuccuaauuuuuggcuaugauauuuugugccugauauaugccaagcacuuuuacagauauuuucuguucucaaauccuuccaaaacaaaucagcaauucaaguacuucauggcacagaagcuucagucuucauagagugacguacagacugcaaagcugaagacacuauaaaauucuguagaauugcgcuguugcauaccucaguauuauggcaagccuuacaugagcaaaaucacaguucuuucacuguggcugaugucauuuucagguagccaaaaucauauauuuagggggaaaaaaacugaagcauucccuuagagccauguaucaaaauuauguuuucuuuagcuacgguacaguaagaacuggucuucugacuagccugagcucaugucgcauuaaauaaacaguaauuuuauuauuaaauauuugaacaaaauucuugaucugauagacugguuauauuaaaugcaaauaauuagaauaauauaaaugacugggguaaggguguucaaucugauuuuuuuuaauuuuaauuucugugggucccuaguagguauauauguuugugggguacaugagagguuuugauacaggcaugcaaggcauaauaaucacaucauguaaaaugggguauccauccucacaagccuuuauccuuuuuguuacaaacaauccaauuauagucuucugguuguuuuuaaauguacaauuaaauuauuauugacuguagucaccuguuaagcuauuaaauacuaggucuuauucauucuuucuguuuuuuuuaauacucauuaaccguccaaucugauuuauuguaccucuccuaagcucagacaaaucuuuacuauuaccuuuuucaggacaggcccaugacuguauauuacgaaaaacagauaccauuacuaauagauauguaauuccuaaaccauuaagcuuuucauuauaaaguucuuacaccaucuuucauucugcccuucacauucaugcauggaguacucuacuccuggcuuaagaccaauucuagaaaauguacuaucugauucacaaagauguauguauguguaacucuauuacucuuauaauaacauggcaaaauaauacaaugaaauaaucuaugaagcgcucugauauuuauucauucaacaaauauuuuugaguaccuauauguguuggacauuauccuagacauagugacaaacuaaaauaucaaaucagacauguuauaccuuuucacaaaaccuuaaacuccguaagguacucuaaauauaccagucugccuacccaugauugaaucuuugcauguugaaauagccuuuggucaaagacaauaaauuuuuuuauugauguaauguagauuuuuuucccaaugaucacagaaucuuugacaaucauuuuaacuacuuaagacauggaugauggcuuuuuauacuuccaauauagggacaaccuaacagaugcugagaauggcaacauucaacugcaagcacaacgugcauuuaccaccaggcggcagauauccgaggaaacagaaaguguugacaaccgagagucuuccgagguauaaguaguuuccuaguucuccuugaaagacacaugcuauagcaauaaaguauguguggcucaagcuuauucuguucauuuuagaacugggaaauuauaagagaagaugaagccaccauguauagcaaccaggccuucccaucaccuccaccgucaaguaacuuggauguuccaacucaucuugcagaagaauugaaugccagacucaccauuuuuggaaauucagccgugagccagccagcaucgagcucaguaagaugcucuuagauuuuguuacggcuucaguaguuuauauuaugcauauuauacuauucaacaacuaacuuuuauguaaaauuuugucuuaaaugcaauaauauguaauaauacauuagggaccuugggacuuuacaacauggucauuuuucaaauauccucauuaguaguauggaccagagucauggcauccaaauuuccauuaugucagugcccuccagucaaaaaucacuagggacacauuugucauugaacaaguuggguuuauuauucauuucagcaagggagaacacgcaccauugguguuuugguagcagaauguuagaaaagacuucagggauuugggcuccuguuaggugauuuugaagaggguuuuaggaagcaggacuuugcucuacaugagaugcuguugggaagcagggauaauucuaugauuuuguaucucaaaucuuaucuguagugaggcuaaagcuaugauuagcaaaguagaacagucacucacauuugccaggauggggaaauguuugguauuuuguggcuuggacaauguucauguuuugucuauauucagccacgauuacagaguggucuugauuuugucuugaucuuaccuaugagugccaggccagcucuuggauguuagggacugcuuuucucucucccaguuaugcugaaguugguuuuuuguuugcuuguuuguuuguuuguuuugagacaucucacucugucaccuagacuggagugcaguggugcuaucucggcuuacugcaaacuccgucuccagcuucaggcgauucucaugccucagccuccugaauagcugagauuacaggcgcacaccaccacgcccagcuaauuuuuguauuuuuaguagagauggaggaguuucacccuguuggccaggcuagucuugaacuccuggccucaagugauccaccugccucagacucccaaagugcugggauuacaggcaugagccacugcuucuggccugaaguuuuaacauuauaucacagaugucaccaacagguauauaugaauaagaacugauauacuuugacuaaacaaggagauagaugacauuuucacuucagccaccacuguaaaaacuguuguccauaggguucagaauaaaguaucccagcauaugcuuccacgaugagaacuucauagcuagcugucuaauauguaucaucaagggagauugaguagaagacaaagauuauucucugaggaugcuauuugucauuuccaguugagguuucccugccuuucauuuaguuaguaaauauuuaaugagagcugaucacauauaugcagaguacuauaugcuaguuacugaggauacaucagucaauaaaauuaacaauaucuccugccuucaugggacuuacauucuagugcagaggaaagcaaacuacaaccggugggccaaaucagcagcugccuguuaugaauaauuaccauuggaauacagccacaucauuuguuuugguauugcccaucucugcuuucacacgacaucaucugaauaaaguaguuacagcagcaaccauauggcccacagccaguauuuacugucuggaucuuaacaggaaaugugugcuaaccucugcucuagcaucuucuucaagaagcuucacaguagauaguuguacgugaauaugaauaucugccaguaaauccgccugccugccuccugcccuuccuuucuuccauuugucuguucugucuuccauucauuucauuuuuucacaggggagugggacaggucagucaaagaccuaaacuacauuaggccaggcgugguggcucacgccuguaaucccagcacuuugggaggcugggauuauagauggguugaagucaggaguucaagaccagccugggcaacauggcgaaaccuugucacuacuaaaaauacaaaaauuagcucggugugguggugcacaccuguaaucccagcuacuugggaggcugagauuggaagaauggcuugaacccaagaggcagagguugcagugagccgagauugcaccauugcacuucagcuugggugacagagugaaacuccgucucaagaaaaaaaaaagaauaaaccauauugauuugcugaugauaaaucacauacgaucccauuccccuucuuccugguauuuuuuuuacuuaaaguaauacauggcaaccauauaguguaauacuaugcagccauugaagagaacaaggugggcucgaguguauauguuggauggaacaaucccuaagagaugcugguaaaugaaaaacagcaagguacagaacaguguguuuguuacaccagaauuuauguaaauuauuuaaaugcagagcauaaauauguguauaauuuacucgaggacuaaacaggaaacuaauaacuuugcuugccucugaagagaggcaaagaaugagcaggauauauauuguuuguaccuuuuguuuuuuugagauagggucucacucugucgcccaggcuggagugcaguagcaugaucauagcccacugcaaccucaaauuucugggcucaagggauucucccaccucagccucuggaguagcugguacuacaggcacaugccauuguaccccugcuaauuuuuuuaaaaaauuuuuguaaagacuugguauaguauuguuucccaggcuccuuuugaauuuuauaacauguaugaguguuaccuauuuuaaaaaauauuuuuaaagcacuguaugguuaugguuacaaauugagauuguauuuagguauauaaaauaaaauuuaagacugggcaucuuggcucacaccuguaaucccagcacuuugagaggucaaggcaggcagaucacaugagguuaggaguucgagaccagccuggccaacauggcgaaaccccgucucuaauacaaaaauuagccgagugcaguggcgugugucuguaaucccagcuacucgguaggcugaggcaagagaauugcuugaaccugggagguggagguugcagugagacaagaucgcaccaccauacuccagccugggcaucagagcaagacucugucucaaaaaaauaaauaaauaauaaauaaaaauuaaaccuucuaucuuaccacuaauauaugcucccucaguuacuauuaguggucaaagaccuaaagaauaaaugauacugauuugcuggugauaaaucacaugcauacauauauagaaacuuuuucuguauauucauaaacaugcaugcauacacauauauuuguagaugauuuuuuaaccugagaucaucuuaaacauacuuuuugguaacuugcuuuuuucacuugcugucucuuagacauugaaccauuucaguacagauagauguacuccuuuaaaaaccaacuaaaacagucauuaaacucuggcauauuccauuguacaaguaacccuuaaggcauuucaccagucuccuauugaaagacuuuagauuguuuacaguacuauuauaaacaguacuacaguggauauucugauucaauuuguaugugcauuguaaauuuugaugucauuaaauaacaaaacuaagauauuucagauagugauaauagcauguauagaaaaacauaaggaaagaaagaacaugagauuuccaggaaacaaguagucuggaauguccaggggguagauugcgaagugggaaguggcugaagaagucaggaagaggcaggucgugguguucaggaagcauuguuuucuguguugucauugacuucagcuccagaaggacaggacuggcugugcauugcaggaugcucugagccugcagcgugcagcauggagaauggacuuaaggaaguaagacuugcaacggggaaaccucuuaggauauugcugccauuguaaucaaagugacaaaagaugaaacuugaaguuaaaacaacaauaaaacuaguaacuaaaguggagagggaguguauuugagaaugguuucugugaaacauucaagagaagguguccaggaggcaguccagcacggggggcaugggagcuggaugugugaagguguccacguagggggcugagagcgaccacaugacucagccugcacucucaacauuugcauccuagccagccuucucucuucugcccugucauauuuacccucacuaccuuagcugucacucaaaggcaaaucacaaauaucaagguauucuucuguugucuuguuuuuucacaagaaucauuccagcagaagaggcagcuuacaagccuauacuuuugaggaacaaccuacacuuccuguggugaguuuuacccucucccaucaaucaauaaaaauauaaaacucagcaucucuuuuuauuuuuuggaagauugagugugaacguuugccuuacagggagccaauacagcacagaauguaggcuccagguggugauguucagggaaggggcuuaaagacaaaacauggagaaccgucucucccauguuaaaagcaaagucucugcaugcuggugacugugggugguaucugggcuugucaguugaagugcugugcuggcuagaggugauccgcugcauacggcauacaauucaggaucacuguguccauuugcugauguucugcacaugcacauggcauccagcagccaugucugcccuguacaugaagaauagccaggguuucaucacucaggcgugcacuggcauucacaugcccggcagccaggcuggaguuuaucaguccuuggucuguuucuucccugcaauaucacauccaccagucuacuaaggccuucugcuuccugcucagugcugucccagccacagccuggauggcagcuuggaccuuaacccugccuccauccucuuccuaacacaagccucacuacugaguuugucucuguuuuccagaagcccuacuuguuuuugaaaccaaaguaaaacucccaggcucccagccucuucagccuacccuucuccuuaucccccaacagaagccuccugcugccuucauuccugucuaugcuuuuucuuccaagcagacuguucccauguccugauucucucccgcuucugagucugugugcauuccauuuccccacuuggaauggcuuucucauuuucuuccccaaccaucuggaacuuugaauggcagucuagauaucagcuuugaaaaguaggguauguucuagcacaggaaugcagagucuccaaaauccucaucccaugaguggguuaucugucuaaauaacacccugcacuaagaaagggacacagauccugugcugaggaaugagaggucgcccaccuaugcaucauugcucuggucaguacugaccaucaacaagaggacagaugccauugaaagacuaucaucgcuagccuuacucucacucacugucaucuguccagccuccuccauuagaucagagcccgcucaagcugaguuccaugguguuuuucccucugcacguuauaauguccucuauacaaugaauauguggaaguucucauugacugacagacauucacccaagacacaauuuuagauggaccggaugagcagcagaaucucgagaugauuuauauuuuaguaccagaaaaguuguuuccaugccuuuuuuuucccucaauacauugauugggguuuuuuuuaagagcuuucuuggaguauaauuuacauaccauaaaauccacccauguuugaucauacaauuaaagaguuuuuguaaauuuauacaguuauggagacaucaccacaaucaaguuuaagaaacuucugucacccccaaaaguucccucaaucccuaugccuacucucaguugcaagcaaccgcucaucugcucucuauugcuacaguuuuugccuuuucuagaaaucucguguaaagggacucguagggugugggcuuacgugucugaccuuuuucacuuagcaugcuguuuuucacauagacccauguuauugcaugccucuauuagugcacgguauuccacuguagagauauauccacuacauuuaucuauucaccagcugauggacacuuguagaacugggcagcauuuaaaugcaucauuuugugauguaucagcucaucacaacuguccccaaaguacguaggacucccguguauuuaguaaguggugucuucauuguagagacugguggugaugguuuuuauguuguaagccaccuuagggagccacaccaaaccagggcuuaucugguucaaaaugacaacaggaaggccagauuuaggacuuuuuuuuuucggaggggagggggauggagucuugcucuguuguccaggcuggagugcccaggcgaucucggcucacugcaaccucugccuccuggguucaagugauucuccugcuucagccucccgaguagcuggacuacagacgugcaccaccaugcccagcuaauuucuguuauuuugagucggaguuuugcucaguugcccaggcuagagugcaauggugcaaucucagcucacuguaaccucugccucccgguucaagcaguucuucugucucagccuccugaguagcugggauuacaggugcccaccaccaugccuagcuaauuuuuuuguacuuuuaguagagacaaguuuucaccauguuggccaggcuggccucgacuuccugaacucaggugauccgcccaccucagcccccaaaagugcugggauuacaggggugagccaucaugcccagccuggauuuaggacuauuuuaaguaagccuggaaauaaccagacuucucuuuauucauuuguaacaaacuaugauaaauagcauucuccuagcuuuuagagaaacaaggcaggaguaacuguugauucagcagauaagcaugauuucuguuguuagauuaccuggguucaaaucucagcuccauuccuuagaagccaugucgcuuaacaaguuacuuccauuacucucggccuuuuggcuaagaucaaguauaguaacaaguuacuuccauauuguaagcuucuguuuacucaccaguaaaaugagccaguauuaguaauuaucucauugaaauucaggugggaaguaaaugacguuaucuguguuaaacaggacacgugcuuguuauuguugguauguuuuauuaggguuguuaucacucucauuauuauuguucuaguguuuuuuuucccaagugaaguacuguacacuuuaucuugcacauuuuaagauauuuaaaaugugguuuauuucacuaaaauguauaauuuacccauuuuuauuauaauacaugguuuuaguucaaaauaaaauauaauuuguuuuaaagcaaacaaguagugaagaagggaugugguguuuuuuaaaggauucuuucuuauuaauauuuaauucuucuggccaggcacaguggcucaugccuguaaucccagcacuuuggggaggccaaggcagguggaucacuugagauuaggaguucgagaccagccuggccaauauggugaaacccuguugauacuaaaaauaaaaaaauuagcuggguguguuagcacaugccuguaaucccagcuacucaggaggcugaggcacaagaauagcuugaacccaggaagcagagguugcagugagccgagaucauaccacugcacuccagccugggcaacagagcaagacccugucucucucugucucucucucucucucucacucucucagaaaagguaaauauauauauauauauauauauauauauauauauuucuagaaaaggcaaaacuguaguaacagagcagaugagugguugcuuggggcugagaguagacauagggacagagggaacuuuugggggugauagaaggauucuuaaacuugauguauuuaauucuucuguuauucuucacuuuagcuuuugccuacuucaucuggauuaccaccagguugggaagaaaaacaagaugaaagaggaagaucauauuauguagaucacaauuccagaacgacuacuuggacaaagcccacuguacagguauccuguaaucuaucaacuugcuuucuuacaggauuuaaacugucacaucccuauguaaacuauuacaucacuuuguaggauacacuggauacuucuaccaccuucuuuuuuuuuuuuauuuuuuugagauggagucucaguauugucgcccaggcuggaguccaauggcgugaucguggcucacugcaccucugccuccuggguucaagcgauucuccugccucacccuccugaguagaugggauuacaggugcccgccaccacaccuggcuaauuuuuguauuuuuaguagagacaggguuucaccauguuggccaggcugaucugaaacuccugaccucaggugauccacccaccucggccuccuaaagugcugggauuauaggcaugagccaccgugccuggucauagcaucuucuaauuauuuauauucugacacugauguuaagugucuaccuuuuccuaugaaucucuaauauacacgaauuaccacuuguuauuauauaaaacaaguacaaaugagaauaagaggaaaaagcaaaugaucucgucuuuggguauuuuuguaauuugaauaguuaggaucauuauuuuaacuaacagauaaucuuggcgauugggaucuauuaaagaaguuuaugcugggccgggcaagguggcucaugccuauaaucccagcacuuugggaggccaaggugggaggaucaccugaggucgggaguucaagaucagccugaccaacauggagaaaccccaucucuaccaaaaauacaaaaauuagccaggcgugguggcgcaugccuguaaucccaucuacuuaggaggcugaggcaggagaaucgcuugaaccugggaggcggagguugcggugagccaagauuaugccauugcacuccagccugggcaacaagagcgaaacuccaucugaaaaaaaaaaacagaaaagaaaauguaaaauauuguuuauaugccuguguuucuaauuuugcaacgagagaacacucauuuuauuuuauagaaugaggugcugcuugauaaaaaaaaaacuuugcauugauguuguggcccuguaagucuacaccuuuuugcuuaacauuguuuuaaagcucuguccauguuguuauuuauagauccaguguauuucucuuaacuacuaauauuccaucaugaauauauugcauuucaauuauccauuucugugguagauauuugccauucauuuugucugcccaucauuugaaucuacuucuguguaugaggaauuccccauccugugaguuuugggaaaacaaagacgaccuccuccuauaggcacgagagcuccccuugcagcuagggcuugagcuugcagaccucgcuccuucagucagaugcacccacagcauacuguuaacuaacaucuuacugcuugagaauuaguugaaaaauuauaaauuacuguaaaaauaaaguuuuacaaaauaauuuauuggaaaaauguuauuaaauguaaugcauuauugaaauguugggaaaauauuaacaugccauaacuacauuugaaaaugagccucaaauauuuagagucucuuuaauggaggguguguauucuauuugcagguuaaguuaccuuuuuaacuacaucuauuugugaguucucucuauaaaauauuacaauaugauuucauuaaugugcuaggccacaguggagaccagucagcugaccucaagccagaguucugcaggcccucaaucacaagccuccaccagugauucaggccagcaggugacccagccaucugaaauugagcaaggauuccuuccuaaaggcugggaaguccggcaugcaccaaaugggaggccuuucuuuauugaccacaacacuaaaaccaccaccuggguaacuuugauacuuuuccauuuaaauuuauaacaacaauaaucaucucuuauguauaguuccuuaaaaucuuuaaguauguauuaguauaaccuauguuuccuaauauucauugaaagguauauugaauucuuaauaauauuauuuguauucaggagaaugcuuaugcgucuuuuuaauauuguuuuggauuaugauggagauauucauguuuacuuccuauuuccaguuuuuagcucacuagccauaaaugcuuaagaagauacauaggaauaauccuuugcuuuuauaugaggcuuuauagcuccaaagcacuuuugaauccauaucucauuuaauaucaaaaaaaccuugugaggcuagguagaacaaguauuuuuauuuuaagauaaggcuuaaaauuguuuagugcuuggcuuacuacuaauagaaaaauuaccuaaaggccgggugcaguggcucaugccuguaaucccagcacuuugggaggccgaggggggagaucacgaggucaggagauggagaucgagaccauccuggcuaacauggugaaaccccguuucuacuaaaaauacaaaauaauuagucaggcaugguggcgggugccuguagucccagcuguucaggaggcugaggcuagagaauggcaugaacccaggaggcggagguugcagugagccaagaucgcaccacugcacuccagccugggcaacagagcgagacuccaucucaaaaaaaaaaaaaaaaaaauuacuuaaaauuagcagcagaugaauauauuuuaauuaauuauuaaaagaccaacauagcuuaaauaauacuaaacuuauuuaauaaauuaauaauauuaaaauaauauauauaaauuaaaccaaauaaauuuaauuuuguucucuuuuuuaacauucugaauuggccuuugauaaccuuuuugggcuuaccuuccuguuauucaaaaauauuaaucgacccuugaacagauagcuggcaaaaugcauguucuggggcuuagaaauaucaugugguccagggccaggcacagugaucccagcacuuugggaggccaaggcggguggaucaccugaggucaggaguucgagacuagccuggccaacauggagaaaccccgucucuauuaaauauacaaaaauuagcuaggcaugguggugcaugccuguaaucccagcuacucaggaggcugaggcaggagaaucccuugaaccuaggaggaagagguugcauugagcugagauggugccauuguacuccagccugggcgacaagagcgacacuccaccucagaaaaaaagaaagaaauaucaugugguccaauuuaauguccuacucuuucaccaguuuuuacauagagaaaagcccuauauagugacacauuuccuaaagagcggggcaaaagaaaugaccaguuaguggugaucccugagaacugaucguuauuccuuuugauauuauagccugacagugauagauuuuagaaggagaaaauauugugucacauauuuaggaaauaaaguauaaauugacuuuuacaagagaauauuuuaaauauccauugauguuagaaaacaugguaacagacugacuuugauuauuuuaaaauuuguguguauuguucuuuauuuacucuaccaaaaaaggaagauccaagauugaaaauuccagcccaucugagaggaaagacaucacuugauacuuccaaugaucuagggccuuuaccuguaaguguauagaaaugcuaacccaucuaacuuggcuaucucaaauauuuugcauuuucggguauaguauuucuuuaucaucuauaauuaauguuauuauuaaaauguugauaccuucuaagaauggaauggaauaugcaaguuaaauuaaccauacaaccagugcuauuuuucuauccauucaucuacgccccucuccuaaaauaauugaaauacauuuuuaauuauagccaggaugggaagagagaacucacacagauggaagaaucuucuacauaaaucacaguaugugcagugcgauuuuucauuauguuauuuuuuguaauaaauuuuaugugugagaaaguacaucuuuuuucuuuuucuucccuucagauauaaaaagaacacaaugggaagauccucgguuggagaauguagcaauaacuggaccaguaagucucucugccagugugcucugaugggacuguccgcucaccugucucuucaagagcagauagucacgggcauaacccuacaggcauugagaggaaagcacauuggccguucucuccucucccccauuucccauacuccaagucucaguuauuugaaaagauucuauaacgucauuauccuuacccuacgcaauagcagugaggggacaagugagccagacagucagaaugcuaaggcagugugggcugcugagcucaggcuggugccucccacugucugaacaagaaugaugacaguccuccacaaaucagagaggagcagagaguguaugcggaugaggaagcagcagcacccuauccacuccagggucauucuuaaauuuuuuuauagaaaucaagccaggcucacaccuguaaucccagcacuuugggaggccaaggcagguggaucaccugaggucaggaguucgagaccggcccggccaacguggugaaacccugucucuacuaaaaaugcaaaaaaaauuaguugggcaugguggcagguaccuguagucccagcuacuugggaggcugaggcaggagaaucacuugaacccaggaggcggagguuguggugagcugagguuguaccaccacacuccagccuggacaacagagcgagacuccaucucaaaaaaaaaaaaaaaaaaggaaaaagaaaaagaaaucauuguaaaugcccaguauguaagacacauccacacuuaaguauaaauauuaccacguaugauaauuguacuacucuugagucagauugauaggaaaauuauccuuuuuuauagcugcuuuuuccauuuuauucagauuuuguuuucuaauucauaaaaauaaauaaaacugaagauaccguuuuuuauuacuauuuacugucucaacauguaguccuuuaauggcucaaaaaggcaacuccuuggaguucaaggaaaaaguacgcuuuucacauugucccuuuaauggagaaaucacuuugaaagucucuuuagaaauggaaauuuuuguuucuaauauuucucuaccuggaagaaauuuccuauuucuggcaugcugcauuuuaagaauauugcauaaugaaaauuacagccauaggaauugcugaauacaauuuuaucuuaaacagagaaauuaaauauuuuaaaguuuaaaguuuuguauuuguuuuucuucuaauuaaacuuuucuuuccaaauauuuuucuuuuaaugcccuuacguucauaaaauacaacaaauaaaaauuguuccagaauaaaaacaaccuaaacuucuuuauuuuuccaaaauuuccaacuaaaggcagugcccuacuccagggauuacaaaagaaaguaugaguucuuccgaagaaaguugaagaagcagguuagucauguuuauaauaaauacuuaagagucaucaauauauagauggaaaguaaugggaaauguuuuuuacaguaauaauuuguucuauauuuguaacaacuuugagugaacaguuuuuccuagagaaaggaugcucauuuuuugaguagcugugauauaucacuacagaccauaauuaguuuaugucuuuauuuuucaguauauuuuauaauauagaaaaauggcauuuaaaguuugcuuuccagagcucuaaccugguguaucccugugggguuuauggggcuugaucuuuguagaaucugagcaagagugggucaggaaauuaucuucuggccuagucuuugacuguguuggaggacggucuggauuuuuuuaugacuuuguuguuuuccagcgaaagucauucauucucuacggcuucaaauguaaugucucugcauaauuuaaaaauacaaucaugaguggaacugugcucuugugacuugucuccuuaugcuuaucaguuauguucacuacacuuuuucccaucgccacaaaugcaauauguuuggaacuaaacucaucaucuggccaucuguuucauuccugguuuuguuuacuaguuuuaacgccucucuuacuugcucauccuguccuccuuugccugcaguuuaggaauacuaccacuagguggccauauuggguuauacuuucuugcauucuaagccagaagcuggcuuucacaaauauucaagauggugggugggccaccucagaguuucacccaaauuuuuagcaaaaagaaaacaugauaguuuuuuuaguguaaacauuuuaugcccuaauaaaauccuuaaauaucauaaacuuucuaaacucauuuuuaaggauaauuuugugggccaggugcaguagcucaugccuguaaucccagcacuuugggaggucgagguggguggaucacuugaggucaggaguucacgaccagccuggccaacguggugaaacccccgucucuacuaaaaauacaaaaauuaguuaggugugauggcgcacaccuuuaaucccggcuacuccggaggcugaggcaggagaaccgcuugaacccaggaggcagagguugcagugagccaagaucgcgccacugcacuccagccugggcaacagagugucucaaaaaaaaaaaaagaaaaaagaaaaaaagaauaacuuugugucgaaauuucccuggaaauuuguuuucuacuucuagacuuugggauuuuaaauguuuacugauuuauuguucugcuaaauauuuucauuguuaaugagaauacgcuggaggaauagaagcacuagcuucuccauuugccacucugagugguugaaacauguuguaguaucuaauuauuaaugucuuccaggcagcaggagaugggagacaaugccauuacaggccucaaaauacaaaaaaaaaaccaugauaaaagcaauuauauuuguugaucucucauugcauaccaggcguucuucuuagaaguuuacauauguuauucauuuaaugucuacaauaacucuguaaggaagggacuacuauuaccuuucacagaugaggaaacugaggcacagagagaauagguaaugugaucaagucccaugguuauuaaguagaaaagcuaaguggucuagcuccagaucccauguuccuaagcaacaugacaugucauauuggugacuaagagaauuaagagagaaauuaauuaauuuguauggaaauuacccagaaugcaacaaagguauguaaggggauaaacauauaaaagaaagguuaaaagacaugaagucaccccagaaggaggggaccaagaucaugaagaggagaaggcuaagaauaugaauucucacauuaguaaaaaggcccaagcaguacuuuaaaaauaaaaucuguaucuagacacaucauagcaaaagagcagaacacuuagaauguaagaacauguaacaccaaaacagaaauaaagaauauuaaaaacaccaggugcagugguucaugccuguaaucccagcacuuugggaggcugaggcaggagaauuacuugagcucaggaguucaaagcugcacugggcuauaaucaugccacugcacuccagccugaaugacagagcaguacucugucucaaaaaaaaaaaaaaaaaauugaaaaccggugcuugaaagccgugcacugucuuuaaccuuuuccucuuccuuauccucaacaucuuguaguuaggaauaaugauggcuaauaauuaccauaugccagauacuguuuaagcauuuuuaaugcauggaguugaaacaacuccauguggguagcuaucauuauuauuaucccuauuuuauagaugaggaaacuaauccuuagaaaagacauguaaccugcccaaagugucacuccuagugaaugguggagucaauaacacaggaccagauuccagaaugcaugcacuugucuacuacucaguucaaacacugaaguucucuuguaccccccucuucuuccacuaccauugcuccuucacaggucccucugucuucucucacucagcuauuccaggggucuuuaacugaccagugugccucuuguuucuccucuuuaaaaccacccuuuacacccugucccgucagcuucugagaacccagcaaucugaccguguggcuccccaacccagaaacucucuucuuaacugcauucacacuguccacccucuggccccagacuacuuuuuugcauuuuuccccuauaaucccugccuucuuucccuuccucucccuucuucuccuucugugcccucuagguauuaaauauaucagaccucucauguaugcuguuccuccguccuucccucccuuucucugucuaaagacuuccucucaaagccuucuugauugccucauuugaagucaauagcucagucuuuuaugcccugcagaacauugcuuccaucucuaucaucagcaauuguccuccuauuuuaagucucagaauuagcaucauuuacacuuguuuuucacauauacgccagaugagaaacuccuugaggaagcaaggacaucuuacccuauguuuuuauucccuuuauuccccaucguuggcccuacuacaauaccaccuggcccagaguaggccuuugauaaaugcuuaccugcaccagcugccuaguauccagucuaaaguugcuguucugcaagcuuaccauuuuuuuaaugacauaagcaguauaggaaacugcucauaucaugcuuauauugcuuauaucaacugcuuacauuauuauguuucuauagggcuuuccauuuucccuaaauaaauugagaaugaaauugauuuuuuuuccuuagagcuaaccuucuuuuuuggaggugacagaauauugauggcauguuuucucuuacugguuuccccuggaaauuugcccaugaaguacugaggaauaaaauauuuagauauaucuuuuguaaaauuuacaauaaguucugccuaaagcauaguuguguacauuugucacauaagcaaagaacguacaaaagauuagugaggcaauguagcuccauuaauuaagagcacagacucaggagcuaagacuuucuuaagucgucuucuucaguuuuauguguaaaaugaagacaauaauaguagcuuucgcauaguguuguuaugagguuaaacacguuaaccugccauuccaggguacccaugccuggcuguuuuaguccguuuucaugcugcugauaaagacauaccugagaccaggcaauuuacaaaaggaagagguuuauuggaccuacaguucuacauggcuagggaggccucacaaucauggcagaaggcaaggaggagcaagucacaucuuacauggauggcagcaggcaaagagagagcuugugcauagaaaccauuagaugucgugagacccauucacuaucaugagaacagugcaggaaagauccgcccccauaauucaaucaccucccaccagguucuucccaugacacauggagauugugggaguuacaauucaagauuagauuuggguagggacacagccagaauauaucacuggcacagucuguaaaugucaccaucuguuaaugagugaagcaagauagacuccagggaggaaaguagagguagggaaaagccugaacagacaggcacaacagcuagcaggcaguggcuauccuacaggucacagaacgguguucauuggaacuuaauaugaaaaggacuguuaacgaaaugccuucaugggggcauuaccaucaccaucaauugcuucuuuaggccgggugccauggcuuaugccuguaaucucagcacuuugggaggccaaggcgggaggauugcuagagcuuaggaguuugagaccagccugggcaagauggcaagaccucaaaaacuuaaaaaauuagucaggcaugauggcaugcgccugugguccaguuacuuaggaaucggaagcaagaggaucacuugagcccaugaggucgaggcugcaguaagccauguucacgccacugcacuccagccuggacuacagagcugucuccaaaaacaaaagcuucuucagauguaaagaagucuauauuacuaagugauuaaagaaaaugcagaaacugucucauaccauagaggaaaccaagacaauauaccuaguuguguuuucccugaguauauuacguaaggaaaaagagacuuggacacaggguguagagggaauguuauaacuuuaugagagauggguuuguuauuauguugaacugauuuaaacaguacgucucuccucuggauuuucagaaugacauuccaaacaaauuugaaaugaaacuucgccgagcaacuguucuugaagacucuuaccggagaauuaugggugucaagagagcagacuuccugaaggcucgacuguggauugaguuugauggugaaaagggauuggauuauggaggaguugccagagaaugguucuuccugaucucaaaggaaauguuuaacccuuauuauggguuguuugaauauucugcuacguaaguaccuuuacaaugauuaucggcagaaaaagaaaaaucacuguuuuaaaaguaagagucggccgggugcaguggcucaugccuguaaucccagcacuuugggaggccgaggcgggcggaucacaaggucaggauaucgagaccauccuagcuaacacggugaaaccccgucucuacuaaaaauacaaaaacuuacccaggcgugguggcgggcgccuguagucccagcuacucaggaggcugaggcaggagaauggcgugaacccggaaggcggagccgagaucacgccacugcacuccagccugggcaacagagcaagacuccucuaaaaaaaaaaguuaccauuuuagccauuuuaaauauacaauuuagagucauuacauacauucacauuguugugcugccaucccacuauccaacucuagaacuuuuucaucuucccaaaaugaaacccuauacccaguaagcacucgcuccccauucccuggcagccaccauucugcuuucugucccuaugaauuugacuccucggguaccucacauaaguggaaucauucaauauuugucuuuuugugaccagcucauuucacuuaacaugaugucuucaggguucauccauguuguaguauguaucagaauguccuuccuuuuuaaggcagaauaauauuccauuauuuuugcauauaaugcuuuguuuaggcugggcgugguggcucaugccuguaaucccaccacuuugggaggccaaggcugguggaucacaaugccaggaguucaagaccagccugaccaacauagugaaacccugucucuacuaaaaauacaaaaauuaaccaggcaugguggcgggcgccuguaauuccagcuacuugggaggcugagacaggagaaucacuugaaccugggaggcggagguugcagugagcugugaccgugucauugcacuccagccugggcgagagcaagacuccaucucaaaaacaaacgaacaaacaaaacuuuguuuauacauucaucugccaaaggacauuuggguuauuuccacuuuuugacagaaauuacuauuuuuaaaaccauuaaauccaguggaggaaugugguucuaacagugguaaacaacucuuaaaggaggaagauuauuuguaauuauuugucauauuaaaguuuuucaaaugaaguauuuaaaugggguugucuuuacagggacaauuauacccuacagauaaauccaaacucuggauuguguaacgaagaucaccucucuuacuucaaguuuauuggucggguagcuggaauggcaguuuaucauggcaaacuguuggaugguuaguauuaaguauaaacuuuuuacaauauaauuaccuguuuucuuucacuugguaaucauccuaaauguauuugguuuuuugcaagguuuuuucauccgcccauuuuacaagaugaugcuucacaaaccaauaacccuucaugauauggaaucugugguaugucuuuuucacuuauaguauagacgaaguauaauuuaacaagcagcuugaacauuuugaagaauuugcuuuuaaugacauggaaauuaauauauuaucauguuucaaaauacaaaugaacuuuuuccucaacauuuuauuaugaaaauuuucuaacauauaauaaaguuggaagaauuuuacauuggacaguuguauaucaacuacucacaauugcuuuuuuucuagauuuacuuuaucacauaccuaucugucuauccaucagucugucuuaguuucuucaugcauuucagaguaaguuauagauaacauuaaacaucccacuaaauacuucaauagguuauaccaaguuauaugucuuuugaaucaguauuugcauuaugaucuuuuaugaugaauguuauauauauauauauauauauauauauauauauauauauauauuuuuuuuuuuuuuuuuuuuuuuuuuugagacagagugucacucuguugccaagcuggagugcaguggcgugaucuuggcucacugcaaccucugcuuuccaaguucaagcaauucucugccucagccuccuguguagcugggacuacaggcgcgcaccaccacacucagcuaauuuuuguauauuuaguagagacgggguuucaccguguucaccaggauggucucagucuuuugaccucguuauccgccugccucagcgucccaaagugcugggauuacaggcaugagccaccgcaccuggccaaaugguguauauuuuuuaaauggcagucgaaaggcaaagcguuaugguuagguuccuagaaaaaaacagaagcccaaggauuaaaccccggacuguagccguguuguuuccugugcugcugaauagccucacacaauguguguucacaugaauuccagggcaucuuccuuaguaccaaguucauuuuuuauucuuuucuuauuacauauuaacagcacaaacagugugauucuuuauaaaucauaagauugcacaguuacuugaguugguucauugagccucuauauuuauuaagagauuuuucuuuaacucgggcuggguauaaacaauggccuccucauagcuacuuaaacauuucacacuuagugccggacacaggggugugcaacuguaaucccagcacuuugggaagcugaggcagguggaucacuugaggucaggaguuugagaccagccuggccaacauggugauacucugucucuacaaaaaauacaaaaauuagccaggcgugguggugcgcgccuguagucccagcuacuugggaggcugagguaggaggaucacuugagucaaggaggucgaggcugcagugagccacagucgccccacugcacuccaaccuaagggacagagcgagacccugucucaaaaaaaaaaaaauuaaauuaaaaaauaaaaauaaaacauuuaacacgaagucacauaggcauaugaggaaugugcuaagugcuccuggauauccagagaaguuagguuuuaucugaaaacuucuguauucauuccuuuaacuggaugauaaaaucuguaccuccacugcuuccacauaaacauagauucuaaacuuuuaaguaggcaccaauugauuaauugauugaugcauuuuuacucuugcccuuaccugucauccaucucuuuuuguaauacacacacauacacacauacauuuuuguuuauauauguguguaaguaaaggauguccaucugaccucucaucuuuuacccaauuauucagacccucuacauacuguuuuuugcaauuucagguguguuauagauacaaauuuuaaauauguaauuuuucccaucuaggauagugaauauuacaauucccuaagauggauucuugaaaaugacccaacagaauuggaccucagguuuaucauagaugaagaacuuuuuggacagguuugugaauuuugaucaguuaaaauggcacauaaauugugagacaaauguuuagauguuaauacguacacuuaauacauuccuaggcucuguuuuuacauucauuucccaguaacaaaagcugucucugagcaagaauuuguacuuucuuuaacauuugacucguuccauauuuauuuuaguaaaacuaguauuuuaaguuuucuuaguuuuuaacuuuugacuggacuuaauuuaaaacaccaaguuucucguauaacuacaauauguauacuuuuuaaauuuuucucgcuaaaauaacauaucaaguuauuguguuuaauuuuagacacaucaacaugagcugaaaaaugguggaucagaaauaguugucaccaauaagaacaaaaaggaauauauuuaguaaguauuuuauuaguauguauuuuauuggauauaauuuuguacuuuauuccagaaagacucuucuuaccaucuuucucuguccccuuguccagaaucucaguguucuuuuucucuaucacaaugcaguagcaagcacucauauucagcuuuuaccuuggucucagcuagccuuuaguuuuuguuucuaacuagaauaauugugccucagaauuuugucuugguucacaugaaaaugaaauguuguuucuuuuuagucuuguaauacaauggcgauuuguaaaccgaauccagaagcaaauggcugcuuuuaaagagguauucauuuucuuuuauuugcucuuccauaaugucacaguauaaccuauaaguuucaaauauuaggccucaucacaucugagaaaaauaaguauauggcuuguuuugugaaaucauucuaaauuauauuuuuauauuaacuaaauauuccauucagucauucaagaagucuagacaauaaacauggacagguccccuuucccccaagccuuuucccuauuccauucucuucacuuuaggacagcaaaagaacaagagugcuuuagggauaguauaacauauuguuuguuuuucuaaauaggaucaccuuacacauuuuguuuugugacuuacuuucuucuuuuuuuuuuuuuuuugagcgcggagugagucacuuugucgcccaggcuggaaugcaguggcgugaucucggcucacugcaaccugcaccucccagguucaagcaauucuccugccucagccuccugaguagcugggauuacaggugcccgccaccacgccuggcuaauuuuuguauuuuuaguagagacaugguuucaccauguuggucgggcuggucucaaacuccagaccucaagugauccauccaccuuggccucccaaagugcugggguuaccagugugagccaccgugcucggccuacuuucuucuuuuaucagauauuuauuagggauauuuacaugugacgacauauagcugccuuucuuuguggcuauauuuuauucagaauauaaauuaaaaaguuacuuaaauuuuuccaauugguagacagauugucagagcacucauuucuuaagcuaacuuacaaucuucuguuaaauauguaucuggcugggcaugguggcugacgccuaaaaucccaacacuugaggaggcugaggcgggaggauugcuugagcccaggaguucgagaccaacguggacaacauagggagaccuuaucucuauaaaaaauuaaaaauuugggcgcgguggcucauuccugugaucccagcacuuugggaguccgaggugggcagauugccugaggucaggaguuugagacuagucuggcuaauguggugaaacccugucucuacuaaaaauacaaaaaaauuagccggacgugguggcgugcacgugcagucccagcuacucgggaggcugaggcaggggaauugcuugaaccugagaggcagagguugcagugagccaagauuacgccacugcacuccauccugggcaacagagcgagacuccgucucaaaaaaaaaauuagccuggugucauggcaugugcauauggucacagcuacuugggaggcugaggcuggaggaucacuugagccugggaagucgaggcuacagucagcuaugagcuaugauggcacuacugcacuccagucugggcuacagagugaaacuuugucucuaaagugugugugugugugugugugugugugugugugugugugugucacauacuuuuucauaaauucaguauugaguacuauguguauggugcuguaccaggccaaaagacauagguccuguuauuaagguauguaugauguaaagagugaaaugaacagaggcaagcauaaagugcuaggugagcacagaagagaaguacaaaccagggaggggcaaaggaagggacaaagaaggacuagagggauuggccaaccauggagaagagggaaaugcaguucuaagcaacaggagcagcgugugugaagucuggcaauaagguaggcuguacccacaggcaguugaguaugcugggugagagaaugcaagagggaaacaaucagccugcggagcuaacagaccagcuuauacagggccugugugugaagugguagaguucggaguuuucucugaauuucaaugagggagaaggaagguagcauuaaaggcuauuaaccaauaagacaccaagauucaauuuauguuuuagaucauucuggaagugcuauguagagcaaguuagaggagagccagacuagcagcagagacuucccagcagaguugggaaagugcuacaguaaucuuggugagaaauggugaggaauuaagggaauggugagggaguugagauaggauugguaagggaaugaagauaguggugguguucagagcugcaugugcauuugaauggcauucaaaaagggagacuuaaaggauagagauguauggauuuggggaucaucugcuuaaguguagugaagcugugaacucgauacaauggaaaaugugaaagggcugugaaagcggauggccucacauguggagagagaccugggaacaccagcaucuuaacuguuguuuugaauggaugguuuauaaauggacaguuuagggcaugggaaaaaaaaaaaaaaaaaaacagaacaggagacugcaaaggaaauaaggaaauuaacagaggcagacaaaaagguaucaagaguagacagaguuucaauagaaaagaugguuuuaaucauaucauacugcaaauaagucaaauaugauaaggaauuaaauauguuuauuagauauagcugcaaagccaucuuugacuuuuuccagaacaauuucaaggaagcuguaguguagaaguccgauugcaguggguugagggguuagaugggaggugagugaauggauuugguaagugcauaacacugucaagaacuuggcugugaagggaaaaagagagucauuaguuuuuguuuguuuguuuguuuguuuugcuuuguuuuaaagguagguauggguugagcacauuuaaaugcguacagagugagccaauaaagagaaagagaucuagugagaugaccucccugaggagcaggugaagcacaggugcaggccuagccugaaagaagaggcggcacugcggugggaaggaggccaugauggguguuggugaugguugggacgcagggauggagaagcuugagggaguuccauugugcauaauugccucuuuucccucaaauagaacuuacacuuaccuacuguaaagaaggggugauguggaggcuugagaaggaugggaaauuuguuuuuuguuguuguucuuguuguuuugagacaggaucucacuuuuugccgaggcuggaauaccucagccuccccaguagcugggaccacagguucacaccaccaugccuggcuaauuuuuguauuuuuuuguagagaugguguuucaccauguuucccaggcuagucucaaauuccuuggcucaagcagucugcccacccagccucccaaagugcugggauuacagaaugagccacugcgucuggccacaggaaguuuuaaaaauagccacuuugaggaauaaaugagagagaacagacugugcacauguacauuuucuggccaauauugagaucucagugaagagcccgugauuguguagugguagaaacuuguguggaugugggauuccuccaguagcauccagaagcugaggcauaggaaaggccauuggcccugcccaucaaguuuuuaaauacaucuuuuuucuagggauucuuugaacuaauaccacaggaucucaucaaaauuuuugaugaaaaugaacuagagguaagacauaacauuuuauguugaaacagaaauugugaacccauuauuuuccuuguuuauaauuugacauuucuuauguagcuucuuauguguggacugggagauguugaugugaaugacuggagggaacauacaaaguauaaaaauggcuacagugcaaaucaucagguuauacagugguuuuggaagguaauuugaaacuucuauuuucauaacuuacuuuuugauagauugaaucauauuuaagucaacucuugauuaacuauacugguggauuacauuuaacugauacagaaaaauauacagaccagaaaaaauuaucuuugauuuuauacuguauacaugcaccuucugggucuguaacuauuacuagguaaguaaaauguucagaagguaguaaguggaaugacaggcugagacaggcacuuaguuuucuacuaaaguagggacugaaagaacuuguaauaaccugcaggguauuccuagggacuccuggguggcucuuuuaaaauuucucauagagaaauauguaugccauucaaucauauuaauauaauguguuuuuugagauggagucucgcucugucucccaggcuggagugcaauggugccaucucagcucacugccaccuccaccucccauguucaagcaauucucuugccucagcuucccgaguagcugggauuacaagcaugcaccaccaugccuaguuauuuuuuuuuguauuuuuaguagagacgggguuucaccuuguuggccaggcuggucucaaacuccugaccucaagugauccacccaccucagccucccagagugcugggauuauaggcaugagccacugcacccagcauauaauuuuuaaaagucaugagucacaucucaagagaaauuuuguuacuucacuagguuauaaucccauucuaaaaaguugacauguagccuuagaaauaaaguuuucaagaacuuuauaaaccaucuauaaacaaaaauuuaacugaaagaaacauccacaucuaguaagggauuauuaauauucuaaauuccgauagcuuauguuucaggauaauuuguuuaccucuuucccagugcuguucccuaaaugauguuuuuaucuuauucaggcuguuuuaaugauggauucagaaaaaagaauaagauuacuucaguuugucacuggcacaucucgggugccuaugaauggauuugcugaacuauacgguaaggauuuuccauagaucauuaaaaaaauggaauaaugcguauugucuuuuucauggcugacgaauccgcaagcuuccaucauuuacuaacacuuagcuuaauuuuaaaaagaauuaagauuuugaaagugauaccauuagggacacuggaguaggcuaaaauauauuuacaccuucuaaucagauaauaaaggggaaaacuggaaacaucaaaugacuugagucacuuuccguucuuuaacuucaaauucuaugcccaguaugcauccguuacagaaaaagcauuaccuuggccgggagggguggcucacaccuguaauccugcacuucaggaggccgaggcaggcagaucacuugaggucaggaguucaagaugagccuagccaacacagugaaaccccgucucuacccaaaaauacaaauauuagcugggcuugguggugcacaccuguagucccagcuacuugggaggcugaggcaggagaauugcuugaacccaggaggcggacguugcagugagccaagaucgcaccacuguaguucagccugggugacagacugagacccugucucaaaaaaaagaaaaagcauuacuucuaaugugauaguucaggauagcauuugaaguuucacagaauguuacuaaguguauuuuuaaaaaaauaaaaacagagucaugguugaauaccuuuaaggaaaugcuggacuaaacaaaguuaaauggauuucuucaggacuucuguagaaccuuuacuguuagaagaaaacaaaagcauuguuucccaaacuuauuugaucaugaaaucuuuuuuuuuuuuuuuuuucaagauagggguggagaaucucauuaggcuacuauuuuucauuucuugugggaggcagcaggacugggaagacuacauaucucuugauuuucagaauaguuaaugcaguuuucgguaaaguaagauucuauguauucuaucaaauuauuuuccaguugauguauaaaacuggaaguguguuuuguuuaaaagugccauuucugauguagauuacagcaacuuuucucauauugauucauauucuguuuauuggaaugauauuuacuugcuuuuaaggaaaccaagaauccaagaauaaaucuuuuacaaaggauguaccuaaaguaggaggccuacucagaacaaugaguaagauuaggauugaccuggggacuacaagucgggacugcugccuaggaaauugcuaagcugaauuuuuugugcaaauagaagcugaccauaugaugggauagcuaaaccuuucuucuccauggcaaaucuggucagcuugccaagccucauuaauaugaguuugcagaacugaucaagcagcugcuaccucucuaccuagaguaaccacucaaagugguuagcuuugccaguaaccaauucagucauucuuugccuaauuggacuugauagccucuuucuuuuucaugguuucaccugacuccccuuccuccaucuucucuacuuuaacaaguuaguagcgaaaaaugaaggcagggcaaacaaaugccccuuuccgucucuggccucucuucucucuucuauguaacccagccccauagccauccacugauuucaugcacuguuugaaauuuggggcaaauaucccacacauagagccagaguuguuuguguuagaauacaaagucaaauucuuagaauacaaagucaaauucuuauguauuuauaggaagaaguuauuucaaaauguuaaaauuacaauauuagauagccaauaaaaaguauguuaaggcggcugggugcgguagcucaugccuguaaucucaacauuuugggagacugaggcaggcagaucaccugaggucagggguuugagaccagccuggccaacauggugaaaccccaugucuaguaaaaauacaaaaauuagcugggugugguggcacacuccuggaaucucagcuucuugggagggcugaggcaugagaaucauuugaacccaggagccagagguugcauugagccgagaucaugccauuuuacuucagccugggugacagagugaauggcuuguggccaggaguucaagaccagccugggcaacauagugagacccccaucucuacaaaaugaauuuuuuuaacaguuagccaggcgugguggugcacaccuguaguccuggcuacucaggagacuaaagcaagaggaucacuugagcccaggagcuugaggcuacagugagcuugaaucguaccacugcacuccagucugggugacagagggauaccccaucucuaaaauauaaauaaauaaaccagauuaguucccuguguguguguaggaacuaguguacacuagaaaaaguuuugauaugccuggagauccuuguagagaguaaaugaaaccaaauaaauucuuccuuauagguucaaauggaccacagucauuuacaguugaacagugggguacuccugaaaagcugccaagagcucauaccugguaagcaguuguuuggaccuugauagaacaaagccucagagagugagauuccucuguuagucuagccacagcagggcuagucuccucuguguuaugucgguggcagguauggauuauggguaagaaggaguuggugacacccaacgaacagguguuuuguuaccaaguuggcccaagcuugaaguccagguagcugaagaucagagagacccaccuaaacugagugaugagugaugggcugucccaagacaggcuagaacauuccaucuuggaggcugaaguggcagagaacucagacauuuggaagauguggugggggcagcacuccacaaggaguugugcagaguauccaugcccagaacccaguccuacgucuuacuucuaccccuggugaaaagacauauuuuggugguguuggaacauucucaucaagaauagcagcauugcucuguuugcuguggugguacuugcuuugucagugucuuucauaaccacuuccucucuguucuuucaguuuuaaucgccuggacuugccaccuuaugaaucauuugaagaauuaugggauaaacuucagauggcaauugaaaacacccagggcuuugauggaguugauuagauuacaaauaacaaucuguaguguuuuuacugccauaguuuuauaaccaaaaucuugacuuaaaauuuuccggggaacuacuaaaauguggccacugagucuucccagaucuugaagaaaaucauauaaaaagcauuugaagaaauaguacgacaacuuauuuuuaaucacuuuuaaauaauguguugcauuuacacaguuguuucaugcugucuuuagaguuaggugccugccuaaagccaggcaccaccacaccuggcuuuagaguucacacaauaggauauaaguccuguaugacuuaaauagugaauuuuguccuuaacauuuaccucuuguauaguaucugccaggcaguuuuuucuuaaacuacugagaugauaacugugaaauauuugugauacgugucaugugugaaaaguuugaugcauuuugagauggaaaacugaaauuuggaaaaagaaauacuuuacuauugaguaaacuacaauauauuuagugcuacucgcagcuauuuauuauuuuguagaccugccuuaugcaccuuacugccuagauuuuugggaaaaaacuuuggaaaguguguuaccuauauuucuagccaacuaacucacagaaaaacuguuuacuucuucacuuucgaaguauuuggcuuuuguuaauaugcaguuuuacuaaacagaugguucauaagacaugugaagcaaauucauauuugcaauggguaaaaaguauuaaagccuuucucuugccugcauauccuauugaccauugguauagucaucacuuuuucauauuuuaguguaguuagaagaauuccuucuucaaacauuaaagauccacaaagcaguauuucuaaauaugccuugaagaacuaaaugaaguguauagcacuugccuuuacuagauauucuuuacacuuguacaauuauguaguaaauguauguuuacaggguuuaucauguuuacagauuaagcuaauuucuguagucgcauuuuuauauuuuuaguaucacucuaguaaaaaaaccaaauaauuuguuuaaaauaaccaaagaguuguuauaaugcauaauuuguauuaaauuuauuacuauuucuuaugccuuuuaaaauacuguuuacuaugaagacaauguuuuuaauuacaaauccagaauucuguaggcaaaaugcuacaguucauaucuuccuuuaaccaaacugaaguacauaaagaccauguacauguauucaucaaacguuuauugaaugcugcgugccuagcgcugugcuaugcucugggguaagaguugucagcuucagagaagcugaguccugauccucaaggaacuugcaaaugugucuaugaauuuguaaaacaaucaaaaguaggcguaagcagaauaaggcaaaagggaaaguguucuagguuccagcacaccugcaaagauaaagugugccaagacuguauuuauauuucauacuuauauuguuucauccuuauauuggaaugauuauauagaaaaugcucuuaaaaagauuaaaccuauuucucaguaugguaucuuggugauuuaggaauaauuguaaauauauguuacgaaucuucuuaaauauauauauauacacacccugugagaacuguaaaaaguaccucugguucuugguuuaaguuuguugggguauaacaugaugaguacucauuagcaccugauagaaaucugaaaugugacaguagcaaaaccacuuucuacuuuccaaacaccacagcaucagcaugguuuaggggaagcaauucacagauuaauguacccugcguuuugucuucaccauugucaaccagcagucaaggaugagcaccagguauaguccugguuugauaucucaccagccaugugaacugaagcagcuuacuuaaccucucuggauucauauuucuucaucugucaaaugagaguaaucaugcccacccucauugucaugccagauugucagaaguuccagacagaugagaaagcaaaaaguacuuuguaaaguguuauacaaucagaaggugcuuugugcugaccgucagauugugucaagucaggugugcaaauugaccacacucccaaagaaucauuuaaaaguaaagugacuucuaagagacaaggaaguaggaacauuucugauauuaaauauauaaauaauauggauacacauguguauaucuguauauggaucuuaccaucauaauucauuuucuucauaucagcaaaguaauaguaaugugggccaaugcauuuuggaaauguccucauuauguagaauggaaugugaaaauuauuuuuguuaaaacaggauuuugccacaauuauuuaaauauuauguuugugaacuaucuaagcaugagaaaauacaaagcuuucuuuguaucuggcugauacucauuuggaugauucugugacucauagaacaugauguuaaaugagaccagacucaacugccaccaguccccagcugcagaccuucauccccuucaucucccacuaggggcucguggucuggaagaaacaucuaucaagcaacacagccccuuaucccagauagaaaagugucucaaaugcauucuacugcgggacagucaguaggaucauuuucauaaagcaaggacaucauauguuucuagaaauuacaagcauauaacuuuagccuacaaucucuuauuaaaaauuuuuaacaaaauuguauuacaaaugcauuucaucagaacucaaauuuaaaugguguuuguuuuggguuuuuauuuauaaugcugaaguuauuccauauaaguaucaaguuaaacacaauucauuuugauuauaaacuauuugacuuuuuaaaaucuucugacacaguaaauauauauaucaagauugauguaucaaaauuuauugcacacuuuaaaguguaaaaucauuuuuuaaaaucuugaauccacaaauaaaguucuauucugauuuuaaaaaacaa

SEQ ID NO: 192071 - RNA, 42830 nt, Homo sapiens
augcccgccgagaacucuccagcucccgcuuacaaaguuuccucgcaugguacguucaucuuuccgaucccuagcugcgaggccgagacgccugcugcuguggccuccgacgaaguucggagaugcccuuuccuugcgaaagcugggcccgguagcgucggccgcggggucgggcguucucgggccuggcggucggcgagggagcgccgggcgcggggcggggcggccccuaggcgcgcgcugcccacccgggcugcaagagccgcgggcccgcgagccccggcuuggagcaagaggcgcgcgcgggccgugggggcugggccgaggcggagcgcgaggcggcggcgguggcgggaggcgccgcgggacgaggcagcggcccccgccccccgaagcccguccccgcgcggggcuggggagcucagggcggggaagccgcggggccgcgccacgucccucgcccgccccagagcggguuuuacaggcggcuccagucugggggcuuuugugucugcgacucgggagcggcgagagagcagaccuccuccucagagggcgcugugagugugccgccagggccgggccgcgagccuccugcuuccccugucagcggcuccugaggcggcggcgaagaagaaggagugggaggaggcggcggcggcggcggcgcacucgcccucagcacaugccggccccggguggggggccgcccccaggccgcgcucccggccaccgccgcugagccccgccggugcccgcacgccgccccgccgccccgccgccccgaggccucguccuccucccaaacuuugcaaagucggcccgcguccccaccgcccucggccgugccucggcuccgaggcuugccucgcagccgcagcggccccgcgaggaggaggagccgccgccgcagcaucaaagagaccgaauucccgcggccugggggggagucaugcuuugcggucuguaaugucagcagaacaggagaaggaucccauuucgcugaagagaguucgagguaaccgagaagggugccggauugggggaaccggggugagugaggugcgcggggccccgugcccggccgccgggaggccauggggcucuguccgggccuaaguccgcgcagcccgcgucccgccggcaccccggggccgaggcugcgauccgagcgcgcggcccgggcgcccgcuggcccccgagacauccgcgcggaucccucgccucccgacuuuguguucggaggcaguuggagccgcaagcagcauccuuucuuacccccuccucacccaccucuccucguucucaagacagcacaauaggcaccucaaagggugaaaaacagacacccccuggcagagaccucgaacggugcccacccccucaaaaaaaguaaguuggaguacacaagaguugaugcuguugaagaagggcuccugggcuuucacgucucuccuggcccccuucucgcccccccaccccggcaaaggcaacaaauauucaguuuauuuuccguagguuuaagaggagaagcuacaaauucagaaggcauuuucucuguugguuuauggauaagauauuaucuaaaaucaguguuaugcaugguugauuuucuucuuucuugcgcacugguuaggaauuuuccuuucguguuacuaucaucuaagaaaaaucagagggaaccaugugucaaacaaaagauacugcauauaaguucacaaaagucaaaugccacccggaaauugggggaugccuuuuagcucuuaauaagguuaagacugaaaguucuagaguuggaguaguacucacuguucauuaagcaaauauuuauugaacaucuacuaugugcuagacacuguucuuguuacugggauacagcagugaacaaagcagauagacaaucuucauccaguaggaguucacccucuugugggauaaacaaaugauaaacaguagauacagaaugucaaaucguaggugguaugguggacaacaaaacaggaauagaggagaggaaauauguguggggaugggaaguauggauuguauguaaggugaucaugaaagggcucaccugguagauaauguuugagcaaagaccuaaaggaaaugauagagccagggccauaugaauucacgugggaagagcagucucugaaaagcaacagcaaaugcaaagccccugugucuggaauaugcccagugugugcaaucaacagcaaagaagcuauuguaacugcagcaaagugagcaaggaaagaguccugugacaggggcuaaggaguaggaucaagaauuauuugauucuugaaaagugagcaaaggugauagauaucauuaagaguacauuuuuaaauuauagcauuuuaauaguaaaauuacagucguucaguagucuuaaugcugccggcuauaggaugauuguguauuagagggccuggugugccauuuaaaagacuuuggcuuuuacucugagaaaaggucugcagaguuuugagcauaagagugagugaucugacauuuuaaacagggcaucuuaagcugcugugcggagaauagacuguagagaaaaggcugaagcaggggagacuaguagggaggugauugcaauagucauccaaacaggguaaacaggguaaaaugcuuuauaaaucaguaaguaggaagguaaauuuccggcugacuuaagugauguagagaugaaggaccacagucauucauuuuuguuuuuguucaaugugacuagaaauuaaacauguauagaacuagcuugugacacacaauccaaaagacauccacucaagaguauuuugguagaaaaugauuuucuuagccauuuaagagaaaacauaauuuagagaauauuguuuuuaaaggcuuaauaucagcacaaccuuuaauuuggugaaauauuuuaauugucuuuuucuguuugugguugugaguugccaaagccuuuaaggaauagaccuuccugagauacaauuauuccccugauauuugugcuguauaauuuugccuacuauuauaaauuguuuugggguuaaaggaaaagaaagagcuaucaaguuuauaccuuugaacugaauuaucaguccuaaucaaauuuaauucuaaauaaaauggaugaguguuuuauugugggucaagaacacagauauaucuucauuuuguuccaacugcuguuaaguucuauggcguagcuauugggguuggcuccggugucagcucaagaauauucugagaguuaaguaccagaauaaaagacaaaacacuuuuuaaaauaaaaagucaguauuuuuauguuauggggagaauuuucuuaaugucauuuuguaauaauuagaacauucauuaaaaaauuuuuuggaauauuuuaugauuagcucuucugaagcaccauucugcugaacuucauugcccuggagcuuuuuguuauuuaauguaauuuauaucaucagacugcaugcaggaugugguguuugcagggcauaaacucuggagcagugcuuuucaaacuguuucccaucugcugaugugauagagacagaccuuuuuaaugguuguguauuuauuuuauauguauuaaaagagucaccaaauaccuugcuuaggauaaggcuaagauacauauguguauaaauacacacauauagcaauuuaaaugaauuauuaacacacauauagcaauuacaugaauuauuaagaaaguaauauuauagguagaacucagauauggcaaaacuaaaacaugaaugacugaggacuuuacaguagcaugcucugcagaccaaaagcaucauaaucacuugugaugcuuauuaaaauauagauucguggaucuacggaaucaggacuucugggauccacagaguugggacuucugcaucuuuaacaagauccccaggugcuccuuaugcauacugaaguuugagaaaugccacuaauagaccuagauuauaaaggugugaguagaccagaagcagcuggcuguggucuuccaaacuguccuuauauuuuaacaauagauuuagaauuacucuuuagugacacaguaucuuacuccuauuuucuaccaguucuuaacacuccacccccaaaccuucaccuuuugauuauaagacagaucuaugaggacagguacuaugucuugauuaucuuauuugccuugcccauaguaaaugucaaaugaaugaaugagugaauacaugaauuaugcugcuuucugauaguccauuuccccucauacuacuuuuacuugcccuuuucccuuagaaugucaacugccaucguuauuuuaaccaauacucccauucuccaguauuccuagaacucuuuuaggcauugaucugauggcaauauucauucauuuauucaacaaauauuuauagagcaaucacagugccauauagugggaaugcacuaauuaagauaugacaccuggcugggcgcaguggcucacgcuuguaaucccagcaccuuggaaggcugaggcagguggauuacuugacuccaggaguuuaagaacagccuggacgacaaccugucucuacuaaaaguacgaaaaauuagcugggcgugguggcaugugccuguggucuuagcuacgugggaggcugaggugggagaaucaccugagcccagggagguugaggcugcagugagcugagaucgcaccauuccacucccgccugggcaauuggagugagacccuaucugcccccaccaaaaaaaaaaaaaaaaaaagguaugacaccugucuucaagaaauuguuaagucuaguacaggacagugacaaauaaauagcuacaaauagcaugauaagggcugugauuauuuauaggaaauaaaggaacacaucuuuuggggaaucaaggaaggagaagaauucuaagaaguagugaguguucuuuugucuuaagugauguacagaaagcaucagaggagauaaaaaugugagaaagggucuaggaggucucuugugauuuugagaaggcaguuuuuaggaggaaaccacauuucaaaguguugaacauuaacgugggaccaggugugguggcuuaugccuguaaucccagcacuuugggaggcucaggcaagagcaucacuucagcgcaggaguuugacaccagccugggcaacauauggagaacccaucucuacaaaguuuaaaaauuagugguggugugcacccguagucccagcuacucaggaggcugagguaggaggaucccuugagcccaggaggucgaggcugcaaugggccauguucacaccaagacacuccagccuaggugacagagcaagacccugucucaaaacaaaagaaaacaaaaacaaacaaaaaaaugugguaaaagauuaaaugaugaagauguggcuuaaaacuuaaaagaagcuugaugguagacagaaagacauagcaaauaucuuaaaaagauagucaagagaaaauaugagucuuuuuuuuuuuucauuggaaaaagacuuaaacguauuuguagauuuacagaagaacccauuguagaaggacaggggaaaaacuggaaaggcaccagaaagaggauaauucauuaauuaauacagcauucaauacauguuuaaaaaauauagaccaugugcuauacaaucauuccaguagcuggagaugagacagacaagguuucuauugucauaaaucaggucuuugcagcuaagggaacaagguuagcaucagguauacacauggaaguuuagucuuggagaaaaagagaauggagaaagaaagaaauuuagagaugaagaaggaagucaagggcauuuauuucagugcuuuuaaccagaguuagaaauaacauagaagggauaaggauguauuuuagaauggaguaguacagaaaugucauaaaaguuacuaaaaauggacuuuacaagaaaauauagacugucucgaugggaugaauauagaggauuuggauuaagauuggagaaggagcauaauuuaugcagucacaaauuggggguuggggaagagccugugagagaaagucugaaggaaaggauuuuuuguuuuuguuuuuaaaauugguccauguaagagcuaggcagauuaucaggaaagugaguuugguuuuagacacauugaaugaguauccuccugggauauuccaguguauacaguggauguauaugguuuggaacuggguugaguucacccagaaguagagcucuggaagucaucaguaaacagauaaauacuaauuaaugccuugggaguguaugagcucaugcaagagagagugagaaguaaaaagagaaaagcauugaaaacaccaacuuuggaaacacuaacauuugggagacaaggggggaaaaagacgcugaaaagcagaaugugaaggaguagucagagagguaggagaaaaaccgugagagagugguguuacagcuaaugaaggaagaauggacuaaugagggguagauaaaugaauuuuguuuuuaauguguggaauaaaauguuucuauccaugagauguccaugauucuuuuucuaccauauucccucucuuggggaacauggccaucuuuauccauccccuacucccacgcaacacugucccaaaguccuagaauuucugucuccuuaauuuuuuuuuuuuuuuuuuugagauggagccuugcucugucucccaggcuggagugcaguggcaugaucuugguucacugcaaccucugccucccagguucaagcgauucuccugccucagccuccagaguagcugggauuauaggcacgugccaccacgcccggcuaauuuuuguauguuuaguagagggcugauuucaucauguuggccaggcuggucucaaacuccugaccucaggugauccgcccaccucagccucccaaagugcugggauuguaggcaugagccacugcgcccggccucuccuuaauguuuugaacccauugacuucuugaccuuuccauagcugcugcuuuauuuuagguuuugcuuaucccuuugauuauuucaguaacccucuauugguuucauggccucccccuuagucccucuuaauccauuuccacauugcuacugauagugaugaauagcuuaccaaguacuuugcugaguguuuuaaauggaucuuccugcuuaauccucucaguaaauaugugaauuagauauuauuguugguuuacagucgaggaauugauguucagagagguuaaguaguaugugcuuaaguaacauauauaaguuuacccagugaggaagcagcaaagccggaacucaaaaucuagggcccaagaucuuagcuacuaugcugcauugccauagugguccccaaacacaacugagucacguuucucucuuuuguaaaauuauucagugguuuccuauuaccuuuagaguaaaaaucaaacuuucuuauguuggcucuuuuuuauuuggcccaggucuaccacuuaguccucuauucuucacacuccaugaagugcuuucccuauuucuuaugcuccaguucugcaguauucacacuuccucucuaaauguuguccuggucucuccugccuuuaaaacuuccuuugcauauucuaucccuucugcuaaacaugcccucuuuuucucccaccuuugggugauacucauccucaaaguuucaguucaguugaaaucucccaggauguuuuccugagcuccccacucagccaagauuaggugggaguuccuuauguucucucaguauccugugcuuaucucuaucauaguguuuaucacauuaaacuuaagaguuucaaaagaaaaauauuguuuccuauagguuauaagauccuuacagggaggaauuauuacuuuuauuuauuuuauacuuccacaagcucaacaaauguuucugaaauccaauuugaugaacauuaaugaagagguuucaguaacuucaagucauuagucuuccugguuugcuuuucccagguguguagagaaguuaccuccugggaagaugauacaguucugucuucugacauucuuguuuuaggcaacccgauaggucuaagucaucuuuaacaucaaaauuagccuuaaaguauggucaagaaugauuucagaucugcuuuuuuaucccuaaucucuguagaugugcuaacugcaauaaugagaaacaguacagcauuguaacugugagccugacugccaagguuuuuaucccagcucugccauuuauuagcuguaugguccuuggcaaguuacuuaacaucucugcaucaguuuccucagcugcaaagugagaauaauaaugguacuuaucucauggaguuguuggaaggauuaaauugguuaauauguaugaaccacuuagaacauugucuucugccuucuaaguuaucuguuugcuauuaacaucagaaacaggucuaaaauacacauucuguguaaguaaugugaucaacauucucuuuuagguauauuuaaucaaucaauaaauguacauaaccuacagcagauucuuauuuuguuuaggagugggugugaagagaacagaaaugguuuucuucuuacagaaagaaaacaaugaacaaaaaaaaauuuuuuaagcagaaaacucugagguuucaccguuuuguuggaaaagacaaauagaagcuguuuauugaauaauauuuaugaauaucugcaacuuuguuccccaugauuucugaguuuuuuuggcuaaaaguuugccugacuucguucaugaaagaaguucauuaucagagguauuauuguauaguuaucuucacaugugaauaccauccaccuacucuccuaagcuuuaccuuucuaagcaaccuuaaaccccauggaccucaguaacacaaagagguaagugggagaccagugggaaugugaagauuuguuuuacagagggaaauguuagauucuuaaauauaaaauuaauaccauaaaacucaauguucaaaaaagaauuuuaggugguuuugcucacagauugcuugaaaaugaaaaaguuauuucaaugauuucaagcgucagaauuuugcuguauaguaaguauaagcaauuauuugauucuugaaaaguaagcaagaugauagauaccauuaagaguauauuuuguccauuuauaaauuacagcauuuuaauuguaauauuaugucuguucaguagucuuaagaaugcugugggcuggauguggugguuuaugccuguaaucucagcacuuugagaggcugaaguaguaagauugcuugaacccaggaauucaagguugcagugaguugugauggugccacugcacuccagccugggugacagagcaagacccagucgcuuauaaaauaaaaaagaauuuuaugaguaauaauuuagauguccuagauuagagauuggagauuaauuuauuaauaauuguuuuauuuuuaagaauuaccuuuuucuauuuauacuuuuguuaaaaugaaauacucaugacauguuagggaagauaggacuuugagguuuggcgccuucguuuguuuauauaaccacuuuauuauuugacuucuaagaccauugcuaauucuuuuuccauaucagacucaucaccaucucaagguauucagauucaaggauaucacauuucucuguucaauauguggguauaugguguuauagaaaaacugcaugcaaauuauuaaucugcaaucaucauuuuauacggacuacugaauaauuauaaauugguaauagguuuauuuaaaccaucaaauuugaaaaaaaaugaccuugaggagagcacuggcucuuacugucaauucuuuauuuaccaucuucccaagugggauuauaacaucaaauuaaaauuaaaauauagaaguucuuuuaauuugaaccagaaguuucuaauuuugccuucugugagucacugaggaagacuuaguguauggaucagauuuuagggaggcaacuaguaucuuagagguagauaagcuuaguuuuacucaauuaaccaaagaagaaauagauaaauuggacuucaucaaaauuuuaaaauugugagugucaagggauacugucaguaaaaauagacaacccgcacgauggaagaaaauguuugcaaaucuuguagcuaagaguuuaguacccagaauauauaaagaauuuuuguaauucacaacaaaauacaaccuaagaaaugaauggccaaaggauugaauagacauuucuccaaagaaaagauauauaugguccauaaguacauaaaaagaugcuuggcaucauuagucauuauggaaaugcaaaucaaaaccacagugagauaucacuuuauauucauucacuaggaggcuauauuaaaacaaaaacagaaaaauguuggugaggauguggauuguaacccucauaccuugcagaugaaaauauaaaaugauguagccacuguggaaaacaguuuggcaguuucucagaguuaaacauaaaauugcuaugugacccagugauuccaccucuagauagauacucaagaggauugaaaacaugcuuauacaaaaacuuguacaaaaaaaaaacuuguacaagaauauuuauagaaguauuauucauaauagccccaaaaguggaaauaaccgaaauguccaucagcuagugaaugaauaaacaaaaugugguauauuuauauauuggaauguuaaucagccauaaaauggagugaaauacugauacauacuacaacauggaugaaccuugaaaauguuaugcuaaacgaaagaagcuauguacaaaaagcuacauauuguaugauuccauuuaugugaaaugucuggaauaggcauauuauaaauagaagguagauuaagguugaagcagguagaucacuugaggucagguguucgagaccagccuggccaacauggugaaaccaggucucuacuacaaauaaaaaaauucaccaagcaugguggcagccaccuguaaucccagcugcucgggaggcugaggcagggaaauugcuugaaccucaaccugggaggcagaggagguugcagugagccaagauugugccacugcacuccugccugggugauagagcgagacucugucucaaaaaaaaaaaaaaaaaaguagauuaguaauugucagggggugggggaaugaggagugacuguugaugggauaggguuucuuuuggggaugaugauaauguucaggaauuagaugguaaugaugguuauauaaccaggugaauaaaaaucaccgacuauacacuuaaaacaaaaaccuaguuuuaaaaacaaaaaccuaguuuuagauuucauugcuucuuuugaccaauggugugacugcuuuacauuuauuuuucuuaacuuuuuaaaaauugggaaugacuugcuuugugaacucaaaaguaucugagacagauuucaaucaauuuagaaaguuuauuuugccaagguuaagcauguacccaugacauagccucagggguuccugagcccaaggugguggggauacagcuugcuuuuauacauuuuagguagacgugagacaucaacuaauauugauacauuggcuagcggcggggugagggguaggcaggcguccaggucauaggcagauaagagacaaaaguuugcauucuuuugaauccuugaucagccuuucacugaauacauaauuuagucuggcucagugaaucuccauuuuuacauaaacaacagggcagagaaaccgaucagauaugcauuugucucagaugagcagagaugacuuucugucccacaucuuugaagauaagcuaucaguuuacauuggcagggugaaauucaacagaacucuuccuugugagcaaaucgugagggagguauguaguuuuuuuuuuuaucuuuguugcuaucuuauuuaggaauagaaugggaggcagguuugccuagcuacguaguucucagcuugaccuuucccuuggcuuagugauuuugggguucuaagguuuauuuuacuuucacaccuaccucauagguuuaugaagaugaaggaaaagaacauggauguuguauccaacagacuucuaaguuaagaugauggaacaagacugcuuuacagaaucuuuucccccacuucuuuuuuuugaucugucgcccaggcuggagugcaguggcacaaucucggcggcucacugcaaccuccaccucccggguucaagcgauucuucugucucagccucccgaguagcugggauuacaggcacccaccaccacgcccggcuaauuuuuguacuuuuaguagagacaggguuucaccauguuggccaggcuggucugaaacuccugaccucaggugaucugccugccuuggccucccaaagugcugggauuacaggcaugagccaccaugcccggccucucucuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacagacgugagccaccgcgcccggccucucuuuuuuaaauuaacaagcuuuaacagcuuuauugauguuaauaguaaugauaguuucuggcugaugggacuugaaauguaaaucaacuaggauuuggucaggaaacagaaaccacaccaguuauuuuuaacaaauaauauaaaguauugcuaacagagauuuaaguagcaaaaauaagaugcuaaaguuuucacagagauagcaacugugagaacuagcugccauuccuaaggcuguggaacaaaggauuguggcugaaauuauuaaauuguacaaacucagaggaggggcccuguggaguauaaacucagaucucugagaaaggaauacuguuuaagcugguauuaauaccucugggcuuggaagagcagcccuguaggccugggacccagacaccuggugcaggugucucugaggagugcagaagucuguuucugcaaguguuggaaauacuacaaacuagauuuaccgcaacugcuaugacugaaacaaacugccaaugcaggauaguagacaucaggccaggguugccauggagaagaacagaagcaucauauucauuuuuguccuccagccuuccagucucccucuagcacaccuuguuggcauagccuaauagagaucaagcagagaguauagaaugaugugaacagggugauugauuuuuuucuuuguauuuguaugcauugcuuauacuucuuuauaaugagcaugucuauuuccuacaaaaacacagugauuuuuuuaaaaguacugacuacaguauuugucauaaagcuuaaaaagcaaaguaguguagccuaggggagagaauuguacauugcuacucagugugugguugauggaccaccaguaucuguauuaccugagggggauuguuagaaauccaaguucaugggcuuuaucccagaacuacucaaucagaaucuuugggaguaggacucaggaaucuacauuuuaacacacuuuugugguaaucuuuaugcauacugaaguuugagaaccacugauacauaguuuaaaacuucauauauaggcuuucgagucagaaagacacaacucugugaccuugggcaaguuaguuaaaucugagccucuguuuucucaucuauaaaauggguauagccauagaauucuuugaggaucagaugaaauaauguauauaaagugcuuaucccaguaucugacacaguaaacauucacugaauuaauguuauuaaaugguaauccucuucccuucaguuuuguaacaaucugguauuguggaaauuuucuuaguuuuugucuuuuaauuguuaauuaacuguugaaauauacuauagcaaaugaaggaacgaacaaaaacaaagauacuuggacucaauuuaauucaacaaacauuuauugccuguggauaaggccauauauuguagguagauaaaaaauaaaugacauuagcuguccuuauaaagauaucuuuauauaucauauaucuuugaagauauguuuacguaucauacacacacacacacacacacacacauauacaguauaccuuugaacaacauggguuugaaccugaaauuuuuugaagaauugcaacaaauugaaaaaacucaacagaugaacccuauagccuagaaauaccaacaaauuaagaaaaaguuaagucugucaugacugcauaaaauauauguagacacuagucuacuuuauuauuuacuaccguaaaacuuacacaaaucuauuacaaaaaguuaaaauuuaucaaaacuuacacaagcauuugcagacccuacguggcaccauuugcaguagagaggaagguaaacaaugaugcaguauuaaaucauaacugcauaaaauuaacugugcuuacuguacuacuguaauuucauagccaccuccuauugcuauuguggugaggucaaauguugcaaguaucugcuuaaaauaccacauggugcuaaucaucucuaugaaagcaguucauuucuccaauaaauugcacaucacaguaaaaaauaguaucuuuugguucucacauauuuuucaucaucuuuagugcuguaccauaaaccuuaaauaacaccaugggacccauauaaagugccacuagugaugcuggaagugcucccaagaaacagaaaagccaugacguuaccagaaaaagcugaauugcuugauauauaccguagauugaggucuucaaccuugguugcccgccauuucagacagaugauucaucuuguaaauagacaaugaaaacauauaguaugauaaauauaguacuauaaauguauuuucucuuucuuaugauuucucaauuauaucuuuucucuagccuacuuuauuguaagaacacaguauguaauacaacauauaacauauauuuguuaaucaguucuucauguuaucuguuaaggcuuccagucaacaguagccuauuuuaguaguuaaguuuuaggguaaucaaaaguuauacauggacuuuugacugcacagaguaucagagcuucuaacauccgcauuguucaagaaucaacuauaucacaauguauauaguucaaggaucaacuauaugcacccauuguugacagaugcuuauguuguuuccaugucuuggcucuugugaauaauguaacaaacaugggagugcacauaacucucugagauacugauuucauuuccuuuggguguauauccagaaguuggauuacuggaucauaaaguaguucuauuuuuaauuucuugaggaacuuccaggcuucucuuuaauggcuguaccaacuuacauucccaccagcaguggaugaggcuucccuuuccuccacauccucaccaacacuugcuaucucuugucucucuuuuuuuuuuuccuuuuuugagauggagucuugcucuguugcccaggcuagagugcaguggcacagucuuggcucacugcaaccucugccucccaggcuuaagcgauucuccugccccagccuccuaaguagcugggauugcaggugccugcuaccacgcccggcuaauuuuuuguauuuuuaguagagacaggguuucaccauguuggccaggcuggucucgaacuccugaccucgugauccgcccaccucagccucccaaagugcugggauuacagacaugagccacugugcccagcuuuuuuuuuuuuuuuuuaaagacagagucucacuguguugaccuuggcugaucuugaacuccugaccucaagugauccuccuaccuuggccucccaaugugcugggauuacagacauuagcuaccacaccuggcuuuauuuauuuauuuuuuuugucuuuuugauaauacauccuaagaaauguaagguuauuucucauugugguuuugauuugauuucccuguugacuagugauguugagcaccuuuucagguaccuguuggccauuuuuauguauucuuuggaaaaauguguaccuagguccuuucuccauugauuaagcauuguuuuugcuuuuggaugagcaccuauauauuuuggguauuaacuccuuaagagauauaugauuugcaaauauuuucucccauuuuuguaggcugccuuuucauuuuguuuccuuuucugugcagaagacuuuuaguuugagguauucccacuugcuuauuucugcuuuuguugcuugugcuuuuggucauaucccaaaaaucauuggcaagaccaaugucaaggaaguuuuuuccucucuuuucuuccaggaguuuuacaauuucaggucuuacauuuaaaucuuuaguccauuuccaguuaaucuuugugaguaguuauaagauagguguccaguuucauucaucugcaugugguuauucaguuuuuccagcaccauuuguuggagggacuagacuauccuuucuccauuuuguacucuugguaccuuugccaaauauuaaucauguauuuguugguuuauuucugggcucuugauuguguuccauggugaauguguguguuuuuaugcccguauuacuguagcuuugucauauaguaugaaaucaggaagugauuuuuuguucacuuguuugucaagauugcuuaggcuauucagaaucuuuagugguuccauaugaauuuuaggauuuuuuuucuuuuucuguggaagaugcccuuggaauuuugauggagauuauauugaaucuguagauaaaaacucccuaaaaacccuauugagggacacagaggaagacuucuaauaaauggaauaguauucccuguuguggcuagccaucuggaacaaaauaacauuguuuuuuaccucacauuaucccaaaauaaauuccaaauggaguaaagauaugacauaaaaauauggccauauuacgaaaaaauagcuugaugguuccucaaaaaauugaaaauaggauguauuagucuagucacagaaagacgaauacuggaugauuuucacgcugcugauaaagacauacccaagacuggaugauuuauagauaaaaagagguuuaauggacuuacaguuccauguggcuggagaggccccacaaucacgguggaaagcaagguggagcaagucacaucucacguggaugguggcaggcaaagagagagcgugugcagggaaaccccuguuuguaaaaccgucagaucucgugagacuuauucacuaucauaaaaccagcauaggaaagaccugcccccaugauucaguuaccuccuaccagaucccucccacaacacaugggaauucaagaugagauuuggguagggacacagccauaccauaucauaggauaaacucuccaacaauuucacuucuguguauauauccgaaauaguugagaauagagucucaaagagguauuauaacauguauguucuuagcagcauuagucacaguagcuaaaagguagaaacaaccgagguaugcaucuacagauaaauggauaaacagaauguaguauguguauacuauacauggaauauuauucagccacaaaaaggaaggaaauucugacacaugcuauagaaccuugaggacauuaugcuuaaugaaauaagucagucacagaaagacaaguacuggaugauucuacuuguguaaaauaucuagaguagucaaauucauaaaagcuaaaaguagaugaggaucauaggggauggagaaggggaaaauggggaguuguugcuugauggauauaguuucaguuuuacaagaugaaaacauucuggagguugguuaugcaguaaugugaauauacuuaauaccacugaacuguauacuuuaagaugguaaauuauauauguguuuuacuacaauuaaaaguuaaaauuaaaaaauuaagccauaaaaauauuaggaaaaaaaccugagagaauuauguuuuauucucuaaaaauggggauugcucuuuuaagcauaagacaaagcccagaauuaaaaaauaaaauauugaugcauuuuauuacauaaaauuauuuuuuaaaauucuggauagcauuauagaggaaacuggguacaggguaugugcaaauucucuuuacuaucuucacauuuuuauaaauguaaaaaucuaaaauuuaaaauguauuuaaaauuuuauaacaagaaaucaaaacauaauaaccugaugaaaguauuuacaguuuaaauauguucaguuuuuuuuuuuaguauaugaaaagcuuccauaaaucacuaagaaaaggaugaaacacucaguagaaaaauggcaaggaauauuagcucccaagugauuccaacaugcagccaagauugaaaaugacuaguuuagauauuuuugauaaaucagaguaaaauuugaaaaaauuuuucuuaaaaacaaaagcaggcuucuuuuuccccaagauggcagauuagaggcuuuuggcaugccucagccaccuggaaauagcaagauaguacauaaagaucaacucugugagcuuuaauucaaaaaggaaaaugaguauccaauggaauugugaaggacacccucaaucccagagaggagaacacuggcaaacagcccccaugauggcauccaguugauaaaagugagugaggccuaaguaugugaaagagguagagagccccucucucugacugaccuuuccacuggggaucugagcaacucagguagagggaaagcccuuuguuucucccaagcccuggagcuaacauggggaaaaucuuggagacacugugagggaaagacacugggaaaagcugcagguauuuuccaagacccugagagcaggaugccauuuuaaaucugguuguguacaaaaucaggaauuccuuggugaccuggcagugcagcuauauaggcauuuuagucucaggcuagagauuggagugccugcuguggagugguagauaugucuauaggaccccaauggcaggcacagccaccauccaucaaccacagaauauacauucuucucaucugcacaugaacauacucuaagauugaccacaugcuuggcuguaaagcaagucucaauaaauucaaaaaaauugaaauccuaccaacaguacuuuuggaccacgguggaauaaacauagaaguaccaagaagaucucucaaaaucacacaauugcauggaaguuaaacaacuugcucuugaaugacuuuuggguaaugaaaugacaucuggguaaugaaaucaaggcagaaauuuaaaaaauucuuugaaauaaaugaaaacagaggcacaacauaccaaaauaucugggaugcaguggcaacaguauuaaaaggagcauauguagcacugaacaucaccucaaaaaguuagaaagaucucaaauuaaugaucuaacaucacaccuagaagaacuagaaaaacaagaacaaacuaaucucaaggcuagcagaagaaaugaaauaacuaaaucagagcugaauauaacaaauugagacaccaaaauccauacaaaguaucaaugaaacaaacaaacacccuaggaucaaaugaauuuauagcugaauucuacuagaaauucaaaaagagaagagcugguaccaauucuacuauucuaaaaaauugaggaggaacuccuuccuuacucauucuauaaaguagaaugagucccaucaucccaauaccaaaaccuggcaaggacacaaugaaaaaaaaaagaaagcuauaggccaguaucccugaugaacauagauguaaacauacuuaacaaaauacuagcaaaccaaauucaauagcacaucaaaaaguuaauucaccaugauuaaguagguuucaguccuggggugcaagguugguucaacauaagcaaaucaauaagugugauucaccacauaaacagaauuaaacauaaaaaucauauaaucaucuuaauagacaugaaaaaagcuuuugauaaaaucuaacauccuaucacgauaaaaacccucagcaaacuaggcaucgaacgaacauacuuccaaauaauaagagcccucuaugacaaacccagagccagcaucauacuguauaggcagaaacuggaugcaguacccugagaacuggaacaagacaagcauacccacucucaugacuccuauucaguacaguacuggaaguguuagagcacucaggcaagagaaagaaaaggcauccaaauaggaaaagaagacaaacuauuucucuuugcugacaauaugauucuauacuuacaacacccuaaggacuccaccaaaaggcuauuagaauuuauaaacaauuuuagcaagguuucaagauacaaaaucaacguucaaaaacugguaccauuucaauauaccaguaauauacaagcugagagccacaucaagaaagcaaucccauuuacagacacacacacacacacacacacacacacacacacacacacacaguaccuaggaaauacgucuuaaccauugaggugaaacaucucuacaaggagaacuaaaaaacacugauaaaauaaaucauagaugacacaaacaaauggaaaaacauucuaugcucaugaauugaaggaaucaaucucauuaaaauagccacacugcucaaagcagucuacacauugaacacuauuucuaucaaacuacaauggaauuuuucacagaauuggaaaaaacuguguuaaaauucauacggaaccaaaaaagagcccaaauagccaaaucaauccuaagcaaaaagaacaaaguuggaggcaucacauuacuuuacuucaaauauaaggcagcaguaucaaaaacagcaugguacugguacgaaaacaauuuagaccaauagaauggagaaccuagaaauaaagccacauacuuguagccaucugauauuugacaaaauugagaaaaacaagcaauggugaaaggcccaguaaauggcgcugggauagcuggcuauccauauguagaagaaugaaaauggacccauaccuaucaccauguacaaaaauuaagauggauuauagauuuaaaucuaaggccucaaacuauaagaauccaagaauacccaggaaacaccauucuggacaacagucuugcaaaagaauauaugacuaagucuugaaagcaauugcaacaaaaacaaaaauugacaaguaggaucuaauuaaacuagagaguuucugcauagcaaaagaaacaacagaguaaacagacaaccuacagaagggagaauauauucacaaacugugcaucugacaaaggucuaauauccagaauuuauaaggaauuuaaaccauugaacaagccaaaaacaaacaaccccauuaaaaaugggcaaaaggaguuugagaccagcuugggcaacaaagggagacccugucucuacaaaaaauaaagaaauuagccagguaugguggcacaugcuuguggucccagacacgugggcagcugagguaggagaaucucuugagcccaggaguuugaggcugcaguuagcugucuucacaccacugcacccagccugagugauagagccagacccugucucaaaaaaaaaaaaaaaaaaaaaaaaaaaaaggugggcaaaagacaggaacagauauuucucaaaagaagccgugcaaguggccaagaaacaugaagcaauguuuaucaucacuaaucagagaaaugcaaaucaaaaccacaauaagauaccaucucacaucagucagaauggcuauuuuuaaaaagucaaaaaauggcugggcauggguggcucaugccuguaagcccagcacuuugggaggcugagguagguggauugcuugagcccaggaguucgagaucagucuggacagcauggcaaaaccccuucucuacucaaaauacaaaauauuagcuggacauggcagcccacaccuguagucucagcuaccugguaggcugaagugggaggaucaccuuaccccaggagggcaaggcuguagucagcugugaucacgccacugcacuccagccugggcaauagagugagaccuugucucaaaaccaucaaaaccagguguugauaaggccuguggagaaaagggaaugcacauagacuguuggugagaauauaaauuagucacuguggaaagcaguuuggagauuucucaaauaaauuaaaacagaacuacuguucaacccagcuauccccuuacuggauauauaccccaaagaaaacaaauuguucuacuaaaaagacacauaaucacauguacauggcaccacuauucacaaucacaacaacauggaaucaaccuaggugcccaucagugguggauuggauaaagacuaugugguacauacacaccauggaauauaaacaaccauaaaaaaaaaagaaugaaaucuuuuuuuuuuuuguagcaauaugaaugcaacuggaggccguuauccuaagcaaauuaacauaggaagagaaaaucaaauacugcauguucucacuuguaagugggagcuaaacauugguuacucauggacauaaagauggcagcaauagacccuggggacuacugaggggcagugcaauuaggggcaggguuugaaaaccuaugcucagcaccugggugacaggaucauuucacaccucaaaccucagcaucauacaauauacccagguaacauaccugcccauguacuccccaaaucuaaaauaaaaguugaaaauaaaagccagacacgguggcucacgccuguaaucccagcacuuugggaggccgaggcaggcugaugacaaggucaggaguucgagaccaacuuggccaacaugguagaaccgcugucucuacuaaaaauacaaaaauuagcugagugugguggcgugugccuauaaucucagcuacuugguagacugaggcaggagaaucucuugaaccaaggaguuggagguugcagugaaccaacaugugccacugcacuccagccugguggcagagugagacugucucaagaaaagaaaagaaaaaauggcaaaggacauacauggaaaaggaaauaaauauguuucuuuuuguuuuuguuuuuguuuuuuuuugggggagacggagucucacucugucaccaggcuggggcgcaguggugcgaucuuggcucacugcaagcaccgccucccggguucaagcgauucucaugccucacccuccugaguagcugggacuacaggugcccgcuaccagccuggcuaauuuuuuuuuuuuaauuuuuauuuuuaguagagaugggguuucaccauguuggucaggcuggucucgaacuccugaccucagguagucugcccgccucugccuuccaaagugcuaggauuacaggcaugagccaccgcgcuuggccaaaauacauaugauuuuuaaauauacauuauagagaaaugaaaguuuauacauggugagauaaaugaaaacagaugaaaauaugaccauuuugcauccucuggugaaucagugggccuaggcuuugauuaucaguggugguuuauguaggggcagaauucuaagaugaccaccaagaugucccauccugcuaguguaccucccuguguaaugcucaguacugugaauuucaugaauguuaaucccucgauugggcuguaucauauggcacaguucaccuggagauagggagauuaacugggcggaccugaacuaauuacaugaaccuucuaagagcaaaggcuucuuuauggcuaguucaagaagaagaaaucagagacuugaagcacaaggaguugauacacauugaaagcagaaagagucaugaaucaaggaauguggguggucucuaggagauaagagcugacagccagcaaggaaaguaggauguuaauccuacaaccacagggaauugaauuuggcuacagacaagaaugaugagauuggaggcagauuucccucagagccucaagacaagaacucacccuacugauaccuugauauccugagcagagaacgcagcccaauuucugauuuuugaacuacagacugagagauuaucaaugguuuuaaaauuuauuuuuaauucagauaaaauucacaugauguaaaauucaccauuuaaacuaucuuagaguauacauuucagugguuuuuaguacugugcuaaaaagucacuacuuucuuuguuucucucuuuugugacaccugugccuugcauggcccugggacaggcauggccaccagaaccccugggcugcagaucugcuccaccucucuguucuggccacuaggagcagaggagcucugagcaggcaaagcuuuagaggacuuuacccucuacuuucuaauucuauauuacuuuccauugccucaaaaagauaccauguaacucccaauuuccucccuuuccuaguggucugucaacuacuaaucuguuuuuugucucuaaagauuuucccauucuggacacuuccuauaaauggaaucaugcaacauguggcuuuuugugucuggcuucuuuuacuuacaacauuuucaagguucauccauguuguagcauguaucaguacuucauuccuuuuuauggcugaguaauguuucauuguauagauauaccauuuuguauauccauucacucguugauggacauuuggguuguuucuacuuuuuuggcuauuacaaauaauacugcuaaaaacguuguacaaguuuuugugcaaagaaauuuucaguugucuugucuuggauaaauaccuaggagaggaauugcuggaucauaugauaacuuuauguuuuacuuuuugaggaacugccaaacuguuuuccacguguuuuccacgguggcuguaccauuuuacauucccaccugcaaaguaugaggguuccaguuucuccauaucuuugccaaugcuuguuauuauuugucuuuuugauuacagccaucccaguguuaucucauugcgguuuuaauuugcauuuuuuauaacgacuacuggugcugagcaucuuuucauguguuucuuggccauuuguguauuuuauuuggagaaaugucuguucaaaaccuuuggcugggugagggauaaaagacuacacgucggguacaguguacacugcucgggugauagaugcaccaaaaucucagaaaucuccacuaaagaauuuauuuguggcuggacgugguggcucacgccuguaaucccaacacuuugggaggccgaggcaggcggaucacgaggucaggagcucgagaccagccugacccaugugguaaaaccccaucucuacuaaaaauauaaaaauuagcugggcaugguggcgcacuauucacgaggcuaaggcaggagaaucacgugaacccaggaugcagagguugaagugagccaagauugugccacugcacuccagccugggcgacagagcaagacuucgucucaaaaaaaaaaaaaaaaaagaauuuauucauguaaccaaccaccaccuccucccuaaaaacauauugaaauaaaagauacauuuggaggggggaaaaagacaaaccuuuggccguuuuucaguuagguuguuuucuuugaguuguaagaauuauucauauauucuggauacuagacucucaucagagucuuauuauuugcaaauauuuucccccauuguguggguugucuuuucacuuuagugauaguguucuuugaugaaaaacuuucaucaaaaguuuuuaauuuugaugaagugcaauuuauguuuuuuuucuuuuguuucuugugcuuuggcauuauaauuaagaaacuuggcuaaucaaggucacgaugcucucccucccgcuccccccgacaggccccaguguguguuguuccccgcaauguguccauguguucucauuguucagcucccacuuguaagugagaacaugugguguuuuguuuuugguuuucuuuucuugcauuaguuugcugaggguaacagcuucuagcuccauccaugucucugccaaggacuuguucucauuccuuuuuuuggcuguauaguauuccaugguguauauguaccacauuuucuuuaucauugaugagcauuuggauugauuccaugucuuuguuguugugaauagugcugcacugaacauauguguggauuuuucuuuuuuuuuuuugaguuggagucuugcucugucacccaggcuggaguguaauggcgugaucucagcuuacuguaaccucugccucccagguucaagugauucuuccgccucagccucccgaguagcugggauuacaggcacccgccaaaaugcccaguuaauuuuuguauuuuuguaaagacaggguuucaccauguuggccagguuggucuugaacuccugacaucaggugaucugcccaccucagccucccaaagugcugggauuacaggcaugagccaccacgcucagccagugugcauguauuuuuauagcagaaugauuuauauaccuuugggucuauauccaggaaagggauugcuggguccaaugguauuucugccucuagaucuuugaggaaucaccacacuuucuuccacagugguugaacuaauuuauucucccaccaacaguguaaaaguguuccuuuuucuccgcaaccuugccagcaucuguuguuucuugacuuuuaucaucgccauucugacugaugugagaugguaucucguugugguuuugauuugcauuucucuaaugaucagugauguugagcuuuuuuucauguuuguuggcugcauaaaugucuuuuuuugagaagugucuguucauguccuuugcccacuuuuuaaugggguugguugguuguuucuuguaaauuuaaguuccuuguagacucuggauauuagaccuuugucagaaggcaaacauuuucucuuauucuguagguugucuguucacucugaugauaguuucuuuugcugugcagaagcucuuuaguuuagaucccauuugucaauuuuugcauuuguugcaauugcuuuuggaguuuucaccgugaaaucuuuccccaugccuaaauccugaaugguauugccuagauauucuuuuaguguuuuuaucauuuuagguuuuacauuuaagucuuaauccauccugaguuaauuuuugugcaagguguaaggaaggugauaugguuuagcuuugugucccugugcaaaucucaucuugaauuguaaaccccagguauuaagggaggaaucuggugggaagcgauuggcuuaugggggugguuucccccaugcuauucuugugauacgagugaguucucaggagauuugaugguuuuauaaguguuuggcaaguuccuccuuugcucacucuucuuucuccugccacuuugugaagaaggugccugcuuccccuucugccauaauuguaaguuuccugaggccucccgggccauguggaaaugugagucaauuaaaccuguuuccuuuauaaauuaccaucucagggaaauucuuuauagcaaugugagaagggacuaauacagaagggguccaguuucaguuuucugcauauggcuagccaguucuaccaucaccauuuauuaaauagagaaucuauuccccauugcagauuuuugucagauuuaucaaagaucagaugguuguagguguguggucuuauuucugaguucucucuucuguuucguuguucuguaugucuguuuuuguauaaguaccaugcuguuuugguuacuguagccuuguaguauaguuugaagcuagguagugugaugccuccaccuuuguucuuuuugcuugggauugucuuggcuauuugggcucuuuucugguuccauaugaacuuuaaaguagugggguuuguuuguuuguuuguuuguuuuugagauagagucuugcucugucgcccaggcuggagugcaguggcaugaucucggcucacugcaacacagguucaagcaauucugcugccucagccucccgaguagcugagacugcagguguguaccaccaugccuggcuaauuuuuguauuuuuuaguagagacaggguuucaccauguuggccaggcugaucucaaacuccugaccuugugaucugcccaccucagccucccaaagugcugggauuauaggugugggccacugugcccagcuaguaguguuuucuaauucugugaagaaugucaaugguaguuugaugagaauagcaucaagucuauaaauuacuuugggcaguauggccauuuucacaauacugauucuuccuauccaugaggauggaauguuuuuccauuuguuuguguccucucuuauuuccuugagcaguaguuuguaguucuccuugaagagguccuuuacgucucuuguuagcuguauuccuagguaguauauucucucuagcaauugugaaugggaguucauucaugauuuuguucucugcuugguuguuguugguguauaguaaugcuugcaauuuuuuuacacugauuuuauauccugagauuuugcugaaguugcuuaucagcuuaagaagcuuuugagcugagacgaugggguuuucuagauauaucaugucaucuacaaacaaagauaauuugacuuauuaucauccuauuugaauacacuuuauuucuuucucuugccugauugcccugaccagaacuuugaguacuauauuuaauaggaguggugagagagagcauccuugucuuuugccaguuuucaaggggaaugcuuccagcuuuugcccauucaguaugauaaucagcuguggguuugucauauauaugguuauuauuauuuuuaaguauguuuguucaauaccuaguuuauugaguuuucaacgcgaaggguguuaaauuuuauugaaggccuguucugcaucuacugagauaaucauguguuuuuugucuuaguucuguuuaugaauuauauuuauugauuuucaucuguugaaucaagcuugcauucucagagauuaagccaaauugaucauggugcguaaacuuuuugaugugcugcuggauuugguuugccaguauuuuauugaggguuuuuacaucaauguucaucaggaauauuagccugaaguuuucucuuuuuguuuuaucucugccagguuuuguuaucaggaugaugcuagccucauaaaaugaguuagggaggagucccuccuuuucauuucuggcugcauaguauuccauuguguauaugugccacauuuucuuaauccagucuaucauugauggacauuuggguugguuccaagucuuugcuauugugaauagugcugcaguaaacauacgugugcaugugucuuuauagcagcaugauuuauaauccuuuggguauauacccaguaaugggauggcugggucaaaugguauuucuaggucuagauccuugaggaaucgccgcacugucuuccacaaugguugaacuaguuuacagucccaccaacaguguaaaaguauuccuauuucuccacauccucuccagcaccuguuguuuccugacuuuuuaaugaucgccauucuaacuggugugagaugguaucucauugugguuuugauuugcauuucucugauggccagugaugaugagcauuuuuucauguaucuguuggcugcauagugucuucuuuugagaagugucuguucauauccuucacccgcguuucgaugggguuguuuuuuucuuguaaguuuguuugaguucuuuguagauucuggauauuagcccuuugucagaugaguagauugcaaaaauuuucucccauucuguagguugccuguucacucugaugggaguuucuuuugcugugcagaagcucuucaguuuaauuagaucccauuugucaauuuuggcuuuuguugccauugcuuuugguguuuuagacaugaaguccuugcccaugccuauguccugaaugguauugccuagguuuucuucuagggauuuuaugguuuuaggucuaauauuuaagucuuuaauccaucuugaguuaauuuuuguauaagguguaaggaagggauccaguuucagcuuucuacauauggcuggccaguuuucccagcaccauuuauuaaauagggaauccuuuccccauuucuuguuuuugucagguuugucaaagaucagaugguuguacaugcguuggcucuguucuguuccauuggucuauaucucuguuuugguaccaguaccaugcuguuuugcuuacuguagccuuguaguguaguuugaagccagguagcaugauuccuccagcuuuguucuuuuggcuuaagauugucuuggcaaugugggcucuuuuuugguuccauaugaacuuuaaaguauuuuuuuuccaauucugugaagaaagucauugguagcuugauggggauagcauugaaucuauaaauuaccuugggcaguauggccauuuucacgauauugauucuuccuauccaugagcauggaauguucuuccauuuguuuguauccucuuuuauuuuguugagcagugguuuguaguucuugaagagguccuucacaucccuuguaaguuggauuccuagguauuuuauucucuuugaagcaauuuugagugagaguucacucaugauuuggcucucuguuugucuguuauugguguauaagaaugcuugugauuuuugcacauugauuuuguauccugagacuuugcugaaguugcuuaucuguuuaaggagauuuugggcugaggcuaaugggguguucuaacuauacaaucaugucaucugcaaacagggacaauuugacuuccucuuuuccuaauugaauacccuuuauuucuuucuacugccugauugcccuggccagaacuuccaacacuaugcuguguugaauaggagugguaagagagggcaucccugucuugugccaguuuucaaagggaaugcuuccaguauuugcccauucaguaugauauuggcuguggguaugucauaaauagcuccuauuauuuugagagacgucccaucaauaccuaauuuauugagaguuuuuagcaugaagggcuguugaauuuugugaaggucuuugcggcaucuauugagauaaucaugugguuuuugucuuugguucuguuuauaugcuggauuacauuuauugauuugcauauguugaaccagcuuugcaucccaaggaugaagcccacuugaucaugguggauaagcuuuuugaugugcugcuggauucgguuugccaguauuuuauugaggauuucugcaucaguguucaucagggagauuggucuaaaauucucuuuuuuuguugugucucugccaggcuuugguaucaagaugaugcuggcccgguaaaaugaguuggggaggauucccucuuuuucuauugauuggaauaguuucagaaggaauaguaccagcuccuccuuguaccucugguagaauucagcugugaauccgucugguccuggacuuuuuuugguugguaggcuauuaauuauugccucaauuucagagccuguuauuggucuauucagggauucaacuucuuccugguuuagucuugggaggguguaugugucgaggaauuuaugcauuucuucuagauuuucuaguuuauuugcguagacguguuuauaguauucucucaugguaguuuguauuucugugggaucgguggugauauccccuuuaucauuuuuuauugcgccuauuugauuuuucucucuuuucuucuuuauuagucguccuccuuuucauuucuuuggaacaguuucaguuguaccucugguagaauuuggcuguaaaucugucugguccugggcuucuuuggguugguaggcuauuuauuacugccucaauuucagaacuuguuacuauucuuuaauucaguuucuuccugguucagucuugggaggauguaugugccuaggaauuuauuuguuccaguuuuuuuuuuaguauaugugcauagaggugcuuauaauauucucuggugauuguauuucuguauuguauuucuguggggucaguggugauaucccccuuucauuucugauugugucuauuugauucuuuuuucuuuauuagucuagcuagcagucucuuuuauuaauuuuuucgaaauaccaaccuggcuuuauugauuuuuuuuuuugaaggguuuuuugugucucugucuccuucaguucugcucugauuuugcuuauuucuuuucuucugcuaccuuuggaguuuguuugcccuugguucuccaguucuuuuaguugugauguuagcuugguaauuugagaucuuucgagcuuuuugaugugggcauuuagugcuauaaaugucccucuuaacacugcauuagcugcaucccagagauucugguacauugucucuuuguucucauuaguuucgaagaacuugauuucuguguuaauuucaguauuuacccgggagucauucaggagcagguuguucaguuuucauguaguuguaugguuuucagugaauuucuuaguuuugaguucucauuugauugcgcuguggugugagagacuguuaugauuucuguucuuuugcauuugcuaaggaguguuuuacuuccgauugugaucaauuuuagaguaagugccaugugucgaugaaaagaauguaaauucuguuguuuuuggguggaaaauucuguauauaucuaucagguccucuugacccagagcugagugcagguccugaauaucuuuguuaauuuugugucucgauaaucugucugauauugucagugggguguuaaagucucccaguauuauuuugugggagucugagucucuuuguaggucucuaaaaacuugcuguaugaaucugggugcuccuguguugggugcaaauauauuuaggauaguuagcuauucuuguugaauugaacuuuuuaccguuacguaaugcccuuuuuugaucucuguuuugucacaaacuaguauugcaaccccugcuuuuuucuguuuuucauuuucuugauaaauuuuccucccuccuuuuauuuugagccuaugugugucuuugccugugaggugugucuuucggagacagcauaacgaugagacuuaacucuuuauccagcuugccauucugugccuuuuaauugggccauuuacuccauuuacauuuuuuaaaaaauuuuauuauuauacuuuaaguuuuaggguacaugugcacaacgugcagguuuguuacauauguauacaugugccauguugguaugcugcacccauuaacucgucauuuagcauuagguauaucuccuaaugcuaucccuccccccuccccccaccccacuccauuuacauuuaagguuaauauuguuauaugugaauuugauccugucaucaugauguuagcugguuaauuugcaggcuuguuuaugugguugcuucauuggucauguaccucagugcuuuuguacuggcuggcaacaguuuuuccuuuccauauuuagugcuuccuucaggagcucuugcaaggcaggcucaguggugacgaauucccucaggguuugcuuaucugaaaacgaucuuauuccuccuuugcuuauaaagcuuaguuuggucggauaugaaauucuugguuggaaauuuuuucuuuaagaauguugaacauugguccucaaucccuuguggcauguaggguuucugcugagaggucuacuguuagucugauugguuucccuuuguaggcgaccuggccuuucucucuggcagcccauaacauuuuuuuuuucaucuugaccucagagaaucugaugauuauguaucuugggguugaucucuugugcauuauuuuacugggguucucuggauuuccugaauuuugaauguuggccugucuugcuagguuggggauguucuccuggaugauauccugaaguauguuuuccgacuugguuccauucucccccuuuuucagggaaaccaaugaguuguagauuuauucucuacauaauuccauauuccuuggagguuuaguucuuuccuuuuucucuauucuugucugccuuucuuauuucagaaugauuaucuucaagcucugagauucuuuccuuugcuuggucuguucugcuguugacacuuguaauuacaucaugagguucucauguuguguuuuucagcuccaucaugucaccuauauuccucuuuaaacuggcucuucugguuaucagcaccuguauuguuuuaucaugauucuuagcuucuuugcauuggguuacagcaugcuccuuuaacucagugaaauugauuauuacugaccuucuggcgccuaccucugucaguucagccaaucucagccucagcccaguucuuucuuucuuuuuuuuuuuuuuuuuuuuuuuuugagacagagucuugcucugucacccagacuggagugcagugguucaauaucagcucacugcaagcuccaccucccauguucacgccauucucccaccucagccucccaaguagcugggacugcaggugcccaccaccacacccugauaauuuuuuuaaauauauuuuuaguagagaugggguuucaccauguuagccaggauggucucgaucuccugaccucaugauccacccaccuuggccucccaaagugcugggauuacaggcaugagccacugugcccaucugccucagcccaguucagugcccuugcuggagaagugcugugaucauuaggaggagaagaggcacucuguuuuuuugaguuuuaagcguuuuuguguugauucuuucucaucuuuuugggcuuaucuaccuuugcucuuugagguugcugaccuuuggaugggguuuuuguggggucuuuuuuguugauauuguuguugacauugcuucuguuuguuuguuuuucuuuuaacauucaggccauacuucuguagggcugcugcaguuugcugggggucugcuccugacccuaguugccucaguuuuuccuguaccuggagauacuaccagugaaggcugcguaacagcaaagguggcagccugcuccuuccucugggagcuccuucccagggcaguccugaccuauugcuggcuugagugcuucuauaggagguaucuggagaccccgguucagagguuucaccacugucuagaggcugggcgcguuggcucacaccuguaaucccagcacuuugggaggcugagguggguagaucacuugaggucaggaguuugagaccagccuggccaacauggcgaaaccccaucuguacuaaaaauacaaaaaaaguuaguggugguggcaagugguggugguggcaagugccuguaauuccagccaaucaagaggcugaggcaggaggaucgcuugagcccaggaggcagagguugcagugagccaaggcuacgccacugcacuccagccuggcaacagagcgaaacuccuucuuaaaaaaaaaaaaaaaggaagcagucuggcugcuuuuugauagagcaguuguacugcacuggggggaauccuucuuuguccagacugccuagauucuucagagccagcaggcaggaaagacugucuacugaacugcagagacagcagcugccccuuuccccaggggcuccaucauggggagaguucagaguucugcuuguauaacccugcuuggaaauucccacagggaggccuugcucugugagaagugauggaucagggucccacuuaaggaaguagucuggccaugaucuggcacagcagcugugcugcauuguagagcacuccccuucguccagacugccuggacuccccagugccagcaggcuagaacagcugagucaacugcagagauggcggccaccccucccccaggaacuugcucugucucagccagucuccagucuguugaugcugguggcuggaauuccaagucaguggaucuuaacuugggaggugccauggaaguggggcccgcagaacaaugcugcuuggcucccugaauucagcacccuuccuagggaauguauggguggaucuuuugccuugcaggauucuuuuucaucuuugcagggacuucuggggccggaguauguaaaacuccugggucucugugugugccugaguggcugcucuacugagacucugcauacacagcucuguauaucggacccaaggcccugguggcaugggcucacgaggagauccccugaucuguggguugcaaagaucugugggagaagugugguuuccuggauggggucacacaaucacucacugcuucccuuggcuggagguggggcuuuuuuuuuggcuccaugcugcuccugggcgggcgauugcccuaccccauuuuucuucauucucugugggucaaguuguucacuuggucagucccauugugagaaccuggauauuucaguugaaggugcuuaauucacacaccauuuucauucuucucccugagagccauggaccacagcucccccuaccuuuuuuuuuuuuuuuuuuuuuuggagacagagucucgcucuuuugcccaggcuggagugcagugcaguggugcgaucucaacucaguggaaccucugcgucccagacucaagcaauucucccugccuuagccucccaaguagcugggauuacaggugccugccauuauaccuggcuaauuuuuguauuuuuaguagagacgggguuucgccauguuugccaggcuggucucgaacuccugaccucaagugaucugccugccucggccucccaaaguguugggauuaccggugugagccacugugccuggcccacagcugcuucuaaucagccaccuugaccccuccuugguauuagauuuuugucaaaugcuuuuaugcaucuauugaaaugaucauguauauuucucuuuauucuauuaauauggcauauuaaauugauuuauuuuaauaugcugaaucaaccuucuauugcugggaaaaaucccgcuuugucaugauguauuauccuuugaauauucugcugcauuuguuuugcuaguauuuuguugagaauuuuugcaucuguguucuuuuuuuuaguuggggucuugcucuguugcccaggcuagagugcaguggcaucuucacagcucacugcagccuccaaccccugagaucaagagauccucccaccucagccuccugaguagcugggaccacaggcaugugccaccauaccuggcuaauuuuuuuuuuaauuuuaauuuuaauguagaggugggaucucacuguguuuuccaggcuggucucagacucuugggcuggagcaaucccccgccucagccucuuaaaguguugagauuaucgacaugagccaccacacucggccacaucuguauucuuaggagguguuagucugugguuuuuugguuuuuuccccuugugauaucauugucuggcuuugguaucaagguaauauuggcccaauagaaugaguuaggaaguguucccucugcuucuauuuaaguggacauuguuuuaaguggcaaagcaaguaugugguaauuuguuauacagcaauagaaaauuaauacaacuguuaaagaaaaucaaccagaaauuagguuccuucuaguggaagaacagaccaucacuuauggagcagccuugcaaaaaaacagaaaucugaaucugaucaagccuauagucuugaccagggauccccaaccccugggccacggacugguacuaguccaugcccuguuaggaaccaggccacacagcaggaggugacuggcgggugagcgagcauuacugccugagcuccgccuccugacagaucagcagcagcagcauuagauucucauaggagggugaacccuauugugaacugugcaugcgagggaucuagguugugcauuucuuaugggaaucuaaugcuugaugaucugagguggaacaguuucauuccacaaccaucgccaccucccaucccccaccacuggucccuggugucaaaaagguuggggaucacuggucuagacccaauaucaauuuauaggaaauaaggaacauguuaaacaugucaaucagcaaauauaaucagcaaaaucaagauauaucaaacauuccagacuagaaaauauaaaucacaccugcaauuuaauguaauauaauuuguaauauaauuuuauguaaggaauuaaacagguguugaaaaaccaaaaaagcaaaaagugagguagcauggacagugacugcaggaaggaacuuccacaucugggacuuagugaacaaagaaaagaaguugggguuaugagaaccuagaggauuggaagagagaugccauagagcuuggacucagacuuggagauugaggugcugcccagcugguauuaauaaccucugagaaaacauguugaagcugguuuggggagugugauggacuaccagugccagagagaaggccuguugggaugauagagauaagaagaguaagcagacaggaggggcagaaauuuccuaucacuuccccuggccuucaaguaucccucuagagcucccguuggaagacccuagcaaaagaaaaauguaguuugcaaagucccaguuccagugucacuaagagggguuggagcuaaaagaugguagcuuaauaauuggaacaauaaucagccugguucaguuaauacuuugcaaggaaaaaacaggauggagggaaguauaucaauuaaaagacaugucaaaccaguuguaaucuauggaacauauuuggaucccaaucuaaacaaaccauacagauauuaugagauaauuggauuggguaugaaauuauaugaaggauuauuguuaauuucuguaguggcuagaauggcauuguauuuuuuuuaaguuccuaguuuuuagaaauacauucugaaauauuuaccaauaaaaugaugucugaaauuuucuucaaaguaguacuggauggagagaggugaagaugguguugaaaacacaagaugagaugugaugguuauuagggcugggugauaggcauaugggguuaauuucauucuucucuguauguuguauauguucagaauucuccauaauaaaauguuucuuaaagcuggaaaaauuccuuucauaaacucuuuuuaaccucuuagauugauagucaagcuuuugcuuuccuugaucauguacuguugagaaagcaauauuuggaaacauuguugcauuuuuaacauuaucuuuaagaauuaaaaggcacauaccuuugaugccauaauucugguucuaggagcuacuuguaaaucucucuaaaggcauuuauacauggauuuuuauugcagcaacagcagaggcuuggaaacaacuuaaacauugaucaauauggaggggacuaguuuaaugaaucaugguguagucacacuguagaauacuacucagcuauuacaaaauaaagaaguucuaaauagagugauauggaaugaucuccaaguaagaaagcaagguacacuguguguacuguguguacuuugucucauuuguguccuccccgccaaaaaaauaauaauaauauacuuuaauauaucuagauuaucuuuggaaagguaggccagaaacuaguaauagugguggccucugagacagggaaccaguuacuaaagauuuuagagugagagagagagacuugcuuuuucacugaaagaauaauaaauaugggagcagggaugaauggcuauuucuggcucaaacuaugggaaagacuuuuuugaaacagauaaugauaauaaaaguauugcucuugucuaacgaaaauagaaaacauuaacagguaaauauaauagauauuacuaugagauauaaaguaacuucacuuacaagugggaaauauuaccugaauuuuuuuuuuuuuagguggugauaguggacuggauggguuaggaggaccagguguacaacuaggaagcccagauaagaaaaagcgcaaggcaaauacacagguaaacugacauuuucuuuaauaaaaguuuuucuuugcuaguauggucaggcugaugagguaaauuugaacuuggucauaaguuuuguuuucuauucaagugauuguacuuuuaaucauucauuguacuuucaaucaaucauuccagugaugguacuuucuuuuuuuuuuuuuuuuuuuuuuuuuuuuuuuuuuuuuuuuuuagguggauucuugcucuguugccagacuggagugagugcaguggggugaucucagcucacugcaaccuccaccucccagguugaagcgauucuccugccucagccucccaaguagcuggaauuacaggcacgcgccaccaugcccagcuaauuuuuguauuuuuaguagagacgggcuuucaccauguugaucaggauggucucaaucucuugaccucgugauccacccgccucggccucccaaagugcuaggauuacaggugugagccaccacgccucgcuguauuuuuuuuuguuuaagucuguaacuaguggcuauugucagacuauaggcauagacuagauacugcaaaaaggaagugugggcaaauuaaaaugcuuguucuuaggcugggcaugguggcucaugccuauaaucccagcccuuugggaggccaagguggguggauuacuugaggccaggaguucgagaccagacuggccaacauggggaaagcccuucucuacuaaaaauauaaaaauuagccgggugugguggcacacuccuguaaucccagcuauugcggaggcugaggcaugagaauugcuugaaccuggaagguagagguugcaaugagcugagaucacgccacugcacuccagccuuggugacagcgugagacucugucucaaaaaaaaauuaaaauuaaaaugcuuguucuuaaaucuaauuuaaagguuuuuaaagggcaugaaugccugcaguucuauuaaaagauuucaaaauauauaguaacaauuuuaaccugaaauaauuguucaacuauaauagugauuuaguauuaugugcauaucacgaagcaaucaugauggaggccuuuuuuuguuauaacuugugguuguaacaagcaauuauauauacaggcucucacuguuuuauucuuuauaaauuugaagcacucuuucuaugauaaaggcuacuaguaaguauguguguacagauuacugaucuuuuuaucauuuugaccaccaucuguuaaacuugcagugugacuaaaacuggcaguuuauuuuuucagucugaggcccagaacuuaauguuuuggaaauauuuuaauuguaucucccugaaguuaagcuaggggaaaaacuuagauucugauuguuguuauuuaacuuuaugacuguuugguguaugagagguauuuuagguuagacugcuuuaguauuuaagugaaaguuucuagaguuauagguaagcauauuaaaugaaaauuaggauaaugaagcuucuuuugaaaguuaacuacuuuugguuuuugaaguuacaauggauuugagcucagaaaaucauacuuuauuuucuuuuggaaaugaaauaaaacuaaauauuuuuaucagcaaguauaauuaaauauaaacauuagucaaaauugaaaggucaagugaagauaauaaauguuuguuaacacugcaagagaaauuugacuaauacuagguucacagguauuaagguaacaggacaauuuuaauaauguauuugaucgaaaacauguauuuuacuuuacauucucauuucagggaccuucuuucccuccauugucugaguaugcuccaccaccgaauccaaacucugaccaucuaguggcugcuaauccauuugaugacaacuauaauacuauuuccuauaaaccacuaccuucgucaaauccauaucuuggcccugguuauccuggcuuuggaggcuauaguacauucagaaugccaccucacguucccccaagaaugucuuccccauacugugguccuuacucacucaggaaccagccacacccauuuccucagaauccucugggcauggguuuuaaucgaccucaugcuuuuaacuuugggccacaugauaauucaaguuucgguaauccaucuuauaauaaugcacuaagucagaaugucaacaugccuaaucaacauuuuagacaaaauccugcugaaaauuucagucaaauuccuccacagaaugcuagccaaguuucuaaccccgauuuggcaucuaauuuuguuccuggaaauaauucaaauuuuacuucuccguuagaaucuaaucauucuuuuauuccucccccaaacacuuuuggucaagcaaaagcaccacccccaaaacaagacuuuacucaaggagcaaccaaaaacacuaaucaaaauuccucugcucauccaccucacuugaauauggaugacacagugaaucagaguaauauugaauuaaaaaauguuaaucgaaacaaugcaguaaaucaggagaacagccguucaaguagcacugaagccacaaacaauaacccugcaaaugggacgcagaauaagccacgacaaccaagaggugcagcagaugccugcaccacagaaaaaagcaauaaauccucucuucacccaaaccgucauggccauucgucuucugacccaguguauccuuguggaauuuguacaaacgaggugaacgaugaucaggaugccaucuuaugugaggccucuugucagaaaugguuucaucggaucuguacuggaaugacugaaacagcuuauggccucuuaacugcagaagcaucugcaguauggggcugugauaccuguauggcugacaaagauguccaguuaaugcguacuagagaaacuuuugguccaucugcagugggcagugaugcuuaa

SEQ ID NO: 192072 - RNA, 53288 nt, Homo sapiens
ggauguuguggggaucugcggccgccuggcccagcuucccgcagccgcccggcggcggccugcgcuccacuucgggagugguaguucuucucuucaccgcugccgggcaggaggcgcaggcgggacuacgcgucacggcaugcacugcggcgcccagccggucaccgccugccggcugcagacgccugcgagcagguuguuuuuauaagaggcgucauuggcgcccgagcugugaccgccgccacuggggcagccagcacaaucgggcggagguggcgcugccccuucagguacuguacuaggcgggcuuagaccccgggaggggguuugugccgacugucugagucccuggccgacacgcucggcucaguagaggagcaguggcgggguccgccuccuaggcuggggcugcucgggcggggacuugacgccuggugucagcggccgcacgggcgaccuccucgggccgugcgcgagugcacagcuccggaggcccgagccgacccuggggcguccgguccgguggucuugcagccuccaaaccccgagugcuauaccgaacugcgcgccaagggugggagagcugacggccugggccacccuucuuccuucacugggcaggcuuugaggugcuugucggucuggacugaugaaaauccauaugguaagauguuaugugcgucacccugccggguuuaaugccagccugucuuuugaugacauuugagcccccgugaugucaggaauagaaagauuaaauauuaaauaaugcccggagacuuccgcuagcacgccagccugaugaugaucaaauaccucuccauauccuucuccaguuccaguggccuccuuuagcuuuggucucccuaaucgauuuguccucauuagcagcugucccaugcagugccuuguacgcguuguuuauguuuagcacuauugggagcgccaaguaagguauuuuauugaguggugaaguuugcacuguucugcucuacuuuuauugaaaaacacaguugggcauucuuguaguuagaauagcuaacuauauaguacuaugaauuuuagauuugucuccuccaaucuacaggauagugcuugaaauaucgcuauuacugcaucguaucuuuuaagauuagaaucauauugggucccacacgucucaggggauauuuaucacacacauccagugugaaugguuuacuuuuauuuucugaguucaggucauauagcagaagauggagauggugaggguauuauuuuaauucauauuuuuuuuuuuuuugagagaggguuucgcucuuguugcccaggcuggagugcaguggcgcgaucucggcucacugcaaccucugccuuccaguuucaaacgauucuccugccucagccucccgaguaucugggauuacaggcgcccgccaccacgcccagcuaaauuuuguauuuuuaguagagacggcggggcgggggggggggucucaacgugucggccaggcuggucuuggacuccugaccucgugauccgcccacuucggccucccagagugcugggauuacaggcgugacccaccgcgcgggcguuaauucauaauuuuuaaccuuuuacgcugagggcggaauuucagucaaaaaagcugauuaaaaaucagcccaaauacaauuuaaaggugugggaaauacuccuucuuagaugaaaacaguuuagaaaauaguguaauugcaauuuuguaaaccauggaacaaaaagugaacauaacuucuuuuagaaaugacuuaaaggguccagagcgguggcucaggcuuguaaucccagcacuuugggaggcccaugcagguggaucaccugaggucaggaguucgagaccagccuggccgacacggugaaaccccgucucuacuaaaaauacaaaaauuagccuguaaacccagcuacuugggaggcugaagcaggagaauuacuugaacccgggaggcggagguugcagugagccacaagaucuggccaccgcacuccaaccugggugacagagugagauuaucucaaaaaaacaaaaaaaaaaaaacaaaaaaaaaaaaagagaaaaagaaagaaaagaaauaaaggauauucacaguuauaaaaguguagauagugaaacuagaaaugauuuuucuuguacuuuccuguauuuuucaaguuuucuguagaaaaaacuuuuaaaaaaggaugcaaguauuaacagcacuuugagaguuucuauaucauuuuuuucacuuucuaguggaaagccccacccuuaugcaaaaaaaaaaaaaaagcagcaauuccaguuauggacucuaugaacauuacuuuaaaaagaaaauaaaggccuagagcaguggcucaugccuguaaucccaggacuuugggaagccaaggcaggcggaucacuugaggucaggacuucaaggccagccuggccaacguggcaaaaccccgucucuacuaaaaauacaaaaauuagcugggcaugguggcggaugccuguuaucucagcuauucaggaggcugaggcaggagaaucgcuugaacccgggaggcagaaguugcagugagccgagaucaugccacuguacucuagccugggugacagagugagacugucucaaaaacaccaaauaagcaacaacaguaaaaaacacaggcaaagucccuguugcugcaucuguagacuauaugaauuuaaguguaaauuauuuggagaguagggacaauaaaugaaauaguuggacucgaagaaaauaacagauccgacaauuuguagcauuuguagaucucauuuuauuuuuuggagaugaugucuugcucugucaccuagucuggagugcaguggccuggacacgacuuacugcagccuccugggcucaagugaucccaacacagccucccacauagcuggggcuacaggcacaugucaccaggccuaggccuggcuauuacuuuuuuugagacagagucuugcucuauuguauggugguucagucucggcucacugcaaccucugcuuccuaguagcugggauuacagugugauucaagcugaguucaagugugauucuccugccucagccucccaguagcugucacaugucacagacaugugacaccaugccccacuaaauuuuuuuuugagacggaguuucgcucuuguugccuagacuggagugcuauggcaagaucucagcucaccacaaccuccgccuccugguuucaagugguucucccgccucacccucccgaguagcugggauuacaggcaugugccaccaugcccggcuaauuuugcauuuuuuaguagagacagaguuuuuuccauguuggucaggcuggucucaaacucccgaccucaggugguccgccugccucagccuucuaaagugcugggauuacagacgugacccacugccccugaccuaauuuuuguauuuuuaguagagacuggguuuugccauguuagccgggcuggucaugaacuccuggccucaagugaucuguccgccuuggccucccaaagugcugggauuacaggcacguagcugggauuacaggcacacaccaccaugcccggcuaauuuuuguauuuuuaguagagaugggguuucaccauaauggccaggauggucucgaucuccugaaugcgugauccgguugccugggccucccgaagugcuggcauuacaggcgugagccaccgcaccuggcccuaauuuuaaaauuuuauguagaggcagggucucgcuauguuucccaggcuggucucuuugaacuccuggguucaagcgauuuuccugccuuagccucccagagugcuggauacaggcaugagagcuccaugucuggccuguacaucccaucuuuugaucugguuucuuuucacuuuguacaguuaaaucagaggugaaaguacuuagcuuuucuucacuuaagccuggaaaaucuuaaacuugucaacauugaaucacguucagaaccauguuuuauaugucugauauuuuggcuuaugucuauuuuuguuuuuauuuuuuguuaugguuauguuggauauggacugguaaguaguauaaucaaucauuagcccacauuuugcuuucuguuguaaagggcuacauuguucuuccacaguaauauacaguacauuuuucuuuuuuuuggcuacuaucagcccuuaaaaauuaaggggguuuaccuuaacaccaaguguccauuaacacuggauaaaauaucuauucuaaaguguuuuacaaaaaacacugguaacacguuguuuuucagguugugguguucauacuuuauuuucuuagguugucuucuuuggagcuugccuacuccaaaugucaauuucuuuucaauauuuuuuaccuuauaauuuuguauauucuguguacugaguuggcucaauauguuauuaggcuuugggucuauucacagggcauaagaaaaauucauaauugauuaacaugucugauuuacuaacucauuccacaguauuauuguauggguuguauaauuauauucuuaugcaaguuaaagaaagacuuuuaaaaauuaggugcauaugaacugcuaaaaucauggaaguaguaguuuuugaacauguuaagaacaugaacacagcagcaaggccuguuaaguccaagguacuuuaaacaaaaaaugcagacucaucuaacagugcagaacugcuggaggcugaauuauguuuguguuucuuuguggugaagaugaggaaguugcaguauuguaagugauaaaggauuacauuuucacaaauuuccuuccugacaguuccauaauuguaacuagacuaaaacacuugguuucaaaggucauuugcaauguauugcaucagauaaacuuggccauauuuucucucaauuugaguucuaagaugaaauucagcccuaugauaugggaaggauuguaauuaagugauaaauaaagggauuuuuucccccaaaggguauuuaauguguggaaaccucuuuaagggucuauagaauuaccugaggaaguauuagaaaauaagaagugggaguuaaguauuuuuuucugucaucacaggaagccugaaaucuuuuuuuuuuuuuaaguacuuauccaaaucacuauucuuuuaaaaucuuacaaaaucuuacuucugguucauauugccagcauguugaaauguaaaaagagcauuagguuggaaaucagaggauuuuuaaugauguugaggaaguuauuauuuauaauuuucuguucguuuucauuuggaauuuguaaauaauagcaagcugccuuuauggggguauuugugaagauuaaaucagauaugaaaaugaaauugcuuuguaagugguggaguuaucuacucauaugaaguauuauuguacuaagugcauuuacauaaagcacuuauauguuugaagugugaugccuugaugugauaaauacuuuuugacugggaaguuugaugaagaaaaaaagucaaauggguuauucauuugauuucuugguagagauugguggcuuuuuccagacugaaggaaaccuggcuccucuccugacugugacuuugcacucuguugcaucaaauguccugaaacugcaguguacuucugugguugagcuuuuaauuuugguuuugauuuguuuuaaucucacuucuauaaguguaagaauggucaucagucuaguuugacaauaggaaguagcuauuguuuuuaauauucucaaauggaucuuuaaguuauuucaugaacaaugagacuacauugaaugugaaaucucagguccucugagaaauacauuucauguuuaaagcauuagucuuugagccaaagaaauaauggaguuuagauuuuuccuucuggggaaguuaucucuggcuaugagaggaucugacccuugagauuaacuucaaguuagguugauauauagaauauuuacgauaaagaaaaaguauuuuagaaacaaguacauauuggcugggugugguggcucaugccuguaaucccagcacuuuggaaggucgaggagaguggaucaccugaggucaggaguuugagaccagucuggcccaacauggugaaaccccgucucuacuaaaaauacaaaaauuagccugacuuggugguguguaccuguagucccaauuacucaggaggcugaggugggaggaucgcuugagccaaggaguuugagguuacagugagcugugauggugccacuguacucccgccugggugagugacagagcgagauccugucucuaaaaauaaagcuauaauaaagacauuaacaaauaaaauuggagcuauuuaucaaaacuuugaacuuaauacuaauuaauaaaguagcucaaggaaaaaaguaaguaguguaagcuaccauuaggcaaauuaugcugagaaguauaguaagugcuauagauucaggggaaaaugaaaucuguaugucagaaacagugaucuaggaaaauuucaugggagaagacagcuuuaaauacagaaaucagaaugaaggaagaaaagcauuucaggaagugaagacauggaguuaggguuguccauuuuguguucagaagacagcaauuaaauuacuucagccauaugacgaggaaagcuaaucagauuaguugcaaauuaggugagaaccagauagugggaguuuuucagugucacacuaaggagugugucuuuauuguacagaauacuuacucuuaaaguugggcagacucugagugggaagaaaaauauuuuagcacuggguauaaguguauguaaccugcagucucuuucaucuuugccucuauguuuauaggguaguagugguuuuuuuuuuuuuuugagacggaguuucauucuuacgcccaggcuggagugaaauggcguggucucggcucacugcaaccuccaccuccugguucaagugauucuccugccucagccucccgaauagcugggauuacaggcaugggccaccaugccuggcuaauuuuuguauuuuuaguagagacggaguuucgccauauuggccaggcuagucuugaacuccugaccucaggugauucacccgccucggccucccaaaaugcugggauuauaggcaugagccacugcgcccagcaguaguguguuuuuagggagggacagggaagguugaaaaauggcacuguagaaagccaucaguaccauagcaauuaaaccagcguuguagugguucaggaauagaaaauagaucaguggaacagaauagagaacacagaaauggauuaauaaaugugugggacuuuauaugacaaaagguggcauuucaaauuauagaaaaaguguggaauauucaauauuugguuuaauuuccacuucacaccaaaagaaaaaaaauccaaaugcaugaauuaaacagcuaaauguaaaagccaaaaacuguggaaguauuaguagaaaauacaggagaauaauuuuauagucuugggagcaggaaaaacuuucuaaaacaagauacaaaaucuagauacuauaaaggacacccuguuuuccagccucuacauugacuguauaaaauuugaaacauaauaaagauacuuuaaaaauguuugaggcaugcuagaacauuaauucaugacccaacuuauaaggaacuacaaaucaguaaugacaaucuaauaggaaagugaacauaugaauauagaugcuucacagaaaaggagaugaggauagccaguaaacacaagaugcacagccccacugaagucuuccuggaagugcagauuaaggaauuuauuauuuugcucaugagaugagcggaaauuaaagaugguuguuacucuguuggugggauuguggagaaauagguacuuucauauguuguuggcagcaacuuuguacuaccuuugggagagcaauuuagcaauaucuauaauuuuuuuuguuuguuuuguuuuguuuuuguuuuuuugagauggaguuucacuggagugugccuggccuuuuuaauuuauuuuugagauggagucuggcucuguaacccaggccuuagugcaguggugugaucucggcucacugcaacccccaccuccugggcucaagcgauucuucugccucagccucccaaguagcugggauuacaggcacgcaccaucaugccuggcuaauuuuucuauuuuaguacaggugggguuucaccauguugaccaggcuggucucgaacucaugaccucgugauccgcccacuucggccucccaaagugcugggauuacaggugugacucaccaccccuggccuuuuuuuuuuuuuuuuuuuuuuuuugagguagaguaucuuguccaggcuggagugcagugguauuaucucggcucagugcaaccuccacuuccuggguucaagcagcaauucuugugccucagccucccgaguagcugggauuaaaggcuccugccacuaugugggccuagcuaauuuuuuuguauuuuuaguagagaugggguuuugccacgggccaggcuggucucaagugauccucccaaagugcugggauuauaggugugagccaccacgcccuacuaauuuguuguauuuuuaguagagaugggucuucaccauguugcccaggcuggucucaaacucgugaguucaagcgauuugccugccuuggccucccaaaguauuggaauuacagacgugagccaacgggcccggccuguggcuuuucguggaguucuuagaacguaaguuuucugugcuguugugccuucuacuuucucuaccuuuuggaaugucuucacuuuccagucccuuuuaccuagauaauuugaauuacucucugaaggcucaaccuacuuuucaugaguuacagauauuugcuucuuaaggaucuuuuuuuaucaguuucauuuugauauuuuagaugugaauucaauuugguugacagagucuugcucugucacccaggcuggagugcaguggcacaaucuuggcucacuuuaaucucugccuccuggauucaagccauucuucugccucagccucccaaguagcugggacuacaggugcccaccaccaugcccggcuaguuuuuuuuuuuuuuuuuuuuuuguauuuuuaguggagaugagguuugcaccauguuggccaggcuaaucuggaacuguacccgaccugacaguugaucuuuuuaauauuuagcuuagcuuaucucuagguguuucauccauagaacuaaaucucaguuguguucagguacaaaaaagauggaaaacuacucauucauucuucagaacuguuuucaggacuucaaggaggccuucccuaaccacccuauuuaacauuccaguucuugcaccauccccaccccuacucugcccucacuuuuuucuccauggcacugggcaccagcuggcuaacucugucuucaaaaaguacuuuucuuugggggagguuuuucuuuuguuuuuguuuucuuucuuucaguccuguaucuucagcacuuagaagaguucauggcacacaguagguacucaauaagcauauguugaaagaaugaaugcaguuucauguuccggaugaggauaggcucauuuaaaauauuuucauauguuuauuagacaaaaaguagccuucaaaaaaguuuucaugcugggcgcaguggcucacaccuguaaucccagcacuuugggaggccaaggcaggcggaucaugaggucaagagaucgagaccauccuggccaacauggugaaaccgcaucucuacuaaaaauacaaaaauuagcucggcaugguggugcgcaccuguaaucccaguuacuugggaggcugaggcaggagaaucucuugaacccggaaagcagagguugcagugagccgagaucgcgccacugcucuccagccuggagacagagugagacucugucucaaaaaaaaaaaaguuuucauuaguugggaucuuguauccucuucccuuucucaagugauguguuuuaaagcagacauuuucauauccuuuggcggaggugaaagacccagaccuuuugaaaaguauuuuacaaauacguucuugaaagcacuccagacugacucgcuuaucuuuggucacaugacaguacagcugcacuuugaggccuuugccuauagccuauugguugccuuacuucggaauuguagacgugugggagaauaaugcucccauucuucuccaucuuaucuaguucuagaagauauaaugguaauggaaaccucaccuuuuucauaguaaaauguagcuacccaggaaugaugaggggcaccaucauaucagguaauauucauuccaguuauauuuuaugagguaaaauugauacuguuguuguguuguucuuacagauuuugacaggcuccaccaaaguguuuuuaaaugacuuauuuagccucuaacucuccccugaauucagucuccagacgccuacuuuauguuuccucuuggaugugauaauaacuaucucagauuuaaaaugccccaaaccaauuugcugguuuccuuuucuucuucuuuuuuuuucuugagauggagucuuguucugucucccaggcuggagugccguggcauagucucggcucacugcaaccuccaccucccgaguucaggcgauucuccugccucagccucccgaguagcugggacuacaggcauccaccagaccaccuggccaauuuuuguauuuuuaauagagacaggguuucaccauguuggucaggcuggucaugaacuccuuacgucaagugaucugcccaccucggccucccaaagugcugggauuacaggugugagccaccaugcccggcccaauuuacugauuuucuucucauaaccugcucuuuuugaagucuuucugccucaguagcuauuccauucuaguacucggugaggccaggagucauccuuuauaccccauauucaauacaucaggaaguccuguuggcugcuguaccuuugaaauccguguauaaucuguccauuucucacugucuucacugccaccauucuaguccaaaccaccaucaugucucaccuggauuaucauaguagccaugcaaaugaacuucuugcuucugccuuugcucccccacaaugcugucccaguagguagccagagugaucuuuuauuccuuuucucaaaacgcuucugugacuuuuaguucucagaguguaaagcuaaaacgcuuuuuaaaaggagucuuaggaucuguaagcccuacucagucuguccccuugccaccacucuguuuauuaucuuguggguuuuuuuuuuuguuuguuuuuuuuugagacggagucucgcucugucgcccaggcuggagugcaguggcgccaucucggcucacugcaagcuccgccucccggguucacgccauucuacugccucagcguccgaaguagcuggaacuacaggcgcccgcuaccacgcccggcuaaucgcccggcuaauuuuuuguguuuuuuuguagagacagaguuucacuguguuagccaggauggucucgaucuccugaccucgugauccgcccaccucggccuggagugcugggauuacaggcgugagccaccgcgcccggcuuaucuuguguuuaaucuuuuccuccucucuccugcuaggcgauccacacaggccuccuugcuguuucucagagguagagcucugaucucagcuuuauagcuacuauuucuuaaaugcucuuccuccaguuaacuguauauaauggugccucacucauucaaaucuuugcucacauauacuucagcaaugaagcuugcccugaccaucguuuuuagaguuaagcuucucuaucccagcauaaaucuaucccagaauaaaucuccucaaauauuuuacaggguuugacuguuuuugucgacauaagucuaagguuuuugaccugaauguguggugacucuugcuuguaauggcuguauuguuuuuggcuacugcaauucugugaguuagcagaaauaggagcagcaggaagaugauuucaguauuguagcuguuguguguuaaacacuugagaaaccugcaaggggacaucaaaagcaauuggaaauauaugacuagagaucgaguuaaagaaacuacucugaggaauaaaaggaagccugagccuaaacagagcuucaaguuuauugucuucacaaaguauucuucuuuuuauaaccguaugauuucuuagccuuuguaacuguccuguaaauucugcuuauuucuaaauuacuauuaguaaagcucuuaaaauggggaggguuuauacauuuaccaauggucagauuaaugggagaggaagcucauggauuucuccagaauuuugaguucuuuuuuuuuuuuuuuuuuggagguggagucuugcucuguugcccaggcuggagugcaguggugcgaucuuggcucacugcaaccuccaccuccugguuucaagcaauucuccugacucaggcuccugaguagcugagacuacaggcgcacgccagcaugcccgacuaauuuuuguauuuuuaguagagaugggguuucacuauguuggccagguuggucuuuaacuccugaccuccugaucugccugccuuggccucccaaagugcugggauuacaggugugagccaccgcacccagccuaauuuugaguucuguaaagaacaauuaacugcacuaucacccagacgugguuaccuuucuuguuuauugauugcuuaauauguauuuagcauucauucaauauguguugggaauacauuauaggcugguaaacaagcaauuacagcacaauauucuauauuaagugccagaugcagaaaauaauaagagucuuagggauggggucaagggaugguucucaaaggaaaugaaccguuagcugagacaagcagaggaguuucgguggagguaaaggggaugggcaacugaucagaauauguaaagcccuggaguaaagacaaagccaagcauuuugaggggaacugagaagguugggcaaagcgggaaugaauuaaaagagaugagagcuagagauaaaauacuugauauucaaggcuuuggggcauuaucuugaagaaaaucuuaacauuuuaaaggaauuacauaaugagauuaucauuugaagaucucuagcuauaauggggagguucaaacugccagggggcuuucauauucacugugucuaggauagggcuuaaaaaguuacuuuuuuuuuuuuccuuugauuguaguacacgcccaacauuuugagaacaguugaauuaauaggguucuuuaguaagccuguuaguuuugcuuauccaaauugucauggugguguuagggccagcgggaaaucuuuuucucuuuugggcuggaugguguuaccaaaacaccagggguuuggucuagguccugcugcuugccgcacagaaagccaaucacagagacggguauugccagggaagaaggcuuuaauugggugcugcagccaaggacaugggagaucagucucaaauccaucucagucucaaauccaucucugacugacuaaaauuagaggucuauauagcagagaagaaauguaaccaugugugggcaaacaggaauuagagaggggugaggaagagaaguuggucaacaggcagcagguggucaguuaagcaaucaugcaggcucuggcuucucauuguccaguugcagugaucuguuaaguaaguuucagcuucuuaauacuaucuaggaggccugaugguuuguuuccuaagaaaggagcuuagauaacacaaauagaacuuucucaaguuuuaagacugugaggaucaauuucuguauuuauucagagaaaccauaaagaucaguucugugggauaauuggcugguuucaauguuaucuuuccuugaaggaaguaaacaaagcauuaaacuggggccugauuaaagugggcuuauugauuugagaaauucaaguaugguaaguugucccaagucaguaauguauuuuacuuuuuuuuguaaucuguuagaagaugggagcaggcaaagggaaggagggaagcuuucacacaguggagaaagaaugcuuuuuaggcuucagccaguuuuucuuaucacaaagcccucaccuacuucuuguuucauauagaauucuuccaguuacccagucacuuaaaccagaaaccugugagcuauccuacacuuucucccuuauauaguugguuauucaguccuuuaauaaaauaaucuuuaggcuguguacaguggcucacaccuguaaucccagcacuuugggaggccgagguggguggaucacuugagcccagaaguuugagaccagccuaccaaacuagcaagaccccgacucuuaaaaagaaauuagcugggcaggguggcacauaccuguauaguccuagcuacuugggaggcugagaugggagcaucuacuugaaccugggaguuugaggcuguguuacugguggaggguguccagguucuuggcaucuugaacaaagaacuggacaaaacacacagacaaagcaaggaagggaugaagucagagauuuauugaaaaugaaaguacacuccacagugugguggcgggcccuagcguaggggcucaagggcaccguuauagaauuuguggggguuucaauacccucuagaggcuuccauugguuacuugguguauacccuaugugaauggagaggugaaguaaaguuacaaagucauuuacuugguguaugcccuauggagaggauauuuccugucauagcugaagugugaaucggccuaauguucccugccuccagacccuauuuucccaucucagcaagccguguucauacuacuguacuccagccugagugacagagugagaccuugcauccaaauaaugauaaaaauaauaaaauaaccuuucaugucuucucagaucucuucaaaacccuucccgcuaucuucuaaacccuuucccucaucaacacugguuaaguucagaugcucauauuuuucauggaauauuauguugcuuccuugcaucccacaggucuaggguuguugaguugcuucccuaucuugaaaaaaaacauuuuuuugagacagggucuugcucuguuacccaggcuggagugcagucaugcagucauagcucacugcaacuuugaacuccugagcucaaaugauccuccugccucggcuucccaaguagcuaggacaacaggugugggccaccauguccugcugauuaaaaaauuuuuuuugguagagauggggagucucacuauguugcccagccuggucuugaacgccuggccucaagugauccucccaccucagccuccgaaagugcuguuacaggugcaagccgccacucuuggcccugccaucuuaauauaugcuauuuaauuuaauuaauuaauuuauuuauuuugagacggaguuucccucuuguugcccaggcuggagugcaauggcgccaucuuggcucaccgcaacauccgccuccuggguucaagcaauucuccugccucagccucucgaguagcugggauuacaggugcuugccaccaugcccggcuaauuuuuuguauuuuuaguagagacaggguuucaucaucuuugccaggcugguguugaacuccugcccuuaugaucuacccgccuuggccucccaaagugcugggauuauaggcgugagccacugcaccuggccaaaucugaccagauacaaccgcuuaugccugucauccuaguacuuugagaggccaagaaagguggaucacuugagcucaggagugugaaaccaaccugggcaacauggcaaaacccugucuuuacaaaaaauacaaauauuaggcaugguggcgcacaccuguaguuccagcuacucaggaggcugaggugggaggguagcuugagccugggaggucaaggcugcaaugaacuguguucaugucacugcccuccagccugggugacaaagcgaaauccugucucaaaaauuaaaaaaaaaaucauggccaggugcgguggcuucaugcuuguaaucccagcacuuugggaggcugaguuggguggaucaugaugucaggagauggagaaucuccuggccuuuaguagagauggugaaaccccgucucuacuaaaaguacaaaaauuagcugggcaugguggcgcgugccuguaauccccgcuacucgggaggcugaggcaggagaaucgcuugaaccagggagucagagguuguggugagccgagaugacgccacugcacuccagccuggugacagagugagacuccgucucaaaaaaaaaaaaaaaaaaaaucaaaucugaucuuuuaaacuauauuuguacuagauugucuuuuuuauuuuuuauuuuuuuaaagaacuuucauauucuuuuacauuuuucugccuuuguuuuuccugugugaugcuuuuuccuuuuucacugggacaucuuuccuugucaucagaucuuuugauuuuuuuuuuuuuuuuuuaggaaucagaaaucguuuuguuuguuuuuugcaauguugcccaggcugaucuugaacucuuggacuugagcgguccuuccgucuuggccucuccguguugggguuacagacgugagcuaccacaccuagccccccccccccuuuuuuuuuuuuuuuaaagagucaagguuucacuguauuacccagucuggagugcaauggcaguucacaggcaugaucauuauggcucuuaacagccuugaacuccuggccucaagggaucuuccuuccucagucucccagguagcugggauuaauaggcacucuccacugcuuccggcuccagaaaucuucauuuuaauguaguaucucaauuuuuaaauuuugacaacuguuaauuuacuuuaaaaaaugcuaucaaauuugcagccucauuuauagagauuuccuugaucauucuccuuucccccugcaaauuuaauugcucagucuuuguguauuucugucauugcauaauuuucaagcuauuauaaacaugauucucauacaaauagacauugauacauaucauaaacuuuuuugaaaguccugaaaaauaguggaaugagaaauugggauuuauauagucaguuuaggccaggugcaguggcucacgccuguaaucccagcgcuuugggaagcugaggagggcggauugcuugaggccaggccuuccagaccagccuggccaacauggccaaacguugucucuacaaaaaauacaaaaaauuagcugggcauaguggcacaugcccaucuacuuauggggcugaggcaggaggaucgauugagcuugggaggucaggguuguggugagccaugauuacgccauugcacucaagccuguaugacagaacgggacccugucacacucaaaauaaagaaaagaaauauagucaguuuaauaaagaaugcugaaauaaaauugcuaagauauaaacgugguuaauauccuacaggguauuuaaacuguagcuuuuuggauaaccucuacugacuggacagaaaaaauuuauuuuaccguaguaguuuucuguaaguuuacuuuuaaauuuguagaguuauaaacugccugggccuuaauugaaauuagaaauaaaacaauuagaugaccucaggugagccuauuacaaaaugcucuugucauaacauuaaaagucauacaauugauaccuuauuucagguuuugaauaauucauuugaaacauguuaauuuuuauacuauuagcgaccaaccuuuuuguauccucucuuuuugaaauauuaauguacaggaguuuucagaauaauuaacagauuauauagaucugacuugaggcuaggaguuugagaccagccuggccaacauucgcaacgagugaaaccucgucucuacuaaaaauaccaaaaaacaaaacaaaacccccaaaaacagauuauauagaucuguauuuuugcccuguucucauuugagcacuaguuccauauugucuucaguagaguucuauuagaacuuggaucuaauguguucacaguauauguccaauaacagaagcauaagacacauguagaauaaaucaguaggaguacuauuugcuuuacuaaguuggguuuugaaguuuaaaggaguuucagauacaaaaagaaaaaaccagguggagugaccauuguaugcuggcuuagggcuugaguccagguuguugccagugaccagauguuuguaaccaaccucuggugucuuccccccugccccaacuuuaacacaacugaaguauugcugacacaguuauuuucauaaaaacaguuugauugccgggcgcagugguucacgccuguaaucccagcacuuugggaggcugaggcaggcggaucacgaggucaggaguucgcgaccagccuggccaacauagugaaaccccgucucuacuaaaaauacaaaaauuaguggggcgugguggcacgcgccuguagucccagcuacucgggaggcugaggcaggagaaucacuugaacccgggaggcggagguugcagcaagucgagaucgugccaccgcacuccaaccggucgacagcucgagacuccgucucaaaacaguuucaucauguuucuucuauguuugaaaauguaaauuacuucauguugccaacauacagacuucauuuucuuggcauaggagcuuuucaguuucccugugcuucucaguuucugcagucauguuuuucacaccuuacuguucauugaaaauagaguccuuuacuguugcugccugcuccccauucacgauuauccuuuuccuucaccucugucuggccaaaugcuacauuuucuuuuagacauaacuuucuccuucauuccaacaauauaacuguugagacuguucuaguccaggagggucuccuuaucuuagaaguuugcuucuaucuguucauacagguaugcaguccugucauguucuguaugguaaaucuauggguggcuugucucuguuucaccuggaagacaguaaaccacuuuucaaacuuagugucacauauagugcuuccuauagaauuaaaaaaaaugugucucaugagucaauauguuuuuguauuuguagaccugaaagaugucugaaaauuccagugacagugauucaucuugugguuggacugucaucagucaugagguaugauauuuaauacuuuuuauaagguaauuuguaauauuaauguuaccagugauguaaacuguguucuuugaagaucagucuuuuucuaccuuuaagcaaaaaguuccaauggacauuuucccucucauauuaaacuucacugcugaaaacgcuucaugagccagcaucuucuacauuauuguacauagcuuugagacauuaggcaaauauuuauugaagguuuguuauuguucaggcccugugcuuuacuuucauuuucauauaauuuugucuuuuuuuuuuuuuuuuuuuuugagacagagucucacucuguugcccaggcuggagugcaguggcgugaucucagcucacugcaaccuccgccccacuggacugaaaugauucuccugccucagccuccugaguagcuggaauuacaggugccugcuaccaugcccagcuaauuuuuguauuuucaguagagacgaguuucaccaucuuggccaggcugaucguaaacuccugaccucgugauccaucugccucggcuucccaacaugcugggcuuacagaugugagccacugugccuggccaauuuugucuuuuuuuuuuuuuaaagggacaggaucuugcucuguugcccaggcuagagugcaguggcuguucacaugugcaaucauaguaccauguaaccuuuaacuccuugggcucaagugauccucccaaguagcugggacuauaggcauaugccaccauacccuguucuuaaauaauuuugaauauuucacugugauacauacuguuuucauucuuauuuuauaguugagaaaacuaaagcuuagagagguuaaguaauuuggucaagauuaugcagcuagaaaauagauccuggauuugaacagaucagaaaggagaauggagaacauguguuccauuuacguuauagcagaacuucacagggaaaaggccagaacccuaucacaaaaugaauuuuauaauagaagauugauauacauacaacaaguauacauaacuuguacauuuuguuuauuuuuucauaccaguaauauauguucacuguagaaaaauggcaguauauugauaaacagaaauauacuuacuccagguuuuacuccagguuuuaauggacaucuauaauuuucccauuuguuuuuaggguauuguaagccucacuuguuuucuuuuuuucuuuuuugagauggaguuuugcucuuguuguccaggcugucgcucuuguugucuuguacagugacgcaaucucggcucacagcaaccuucgccuccuggguucaagccauucuccugccucagccucuggaguagcugggauuacaggcaugugccaccacgcccgacuaauuuuguauuuuuaguagagacgggguuucuccauguuggucaggcuggucucgaacucccgacgccaggugauccgcccgccucggccucccaaaguacugggauuacaggcgugagccaccgugcccggccacuuguuuuuuuaauaaaaauuauaggccgggcguggugcucacgccuguaauuccagcacuuugggaggccgaggucggggcagaucacugaggucgggaguucgacaccagccugaccaacauggaagaaacccggucucuacuaaaaauacaaaauuagccaggcguggucgcacaugccuguaaucccagcuauuugggagguugaggcaggacaaucgcuugaaccugggaggcggagguugcggugagcagaguucgugccauugcacuccagccugggcaacaagagugaaacugucucaaaaaaagaaaaaaaaaauuaaaaaauuuuuguuuuuuaaacuauuaguuaagguucagguaguuauguuuagaaaacauuaacagaaaaaaacaagauugccuuuucugcauuaaaauuucaaaauuuaaaagcaucuaucauuugagauugagaugauucuucuuuuuaaaaucuucagugacuuuucuauuuuuagcuuguuuucuucaaaggauuagaucaacucccauagcaacuucuccuucaaggauaauuaacaauauaggagcaaggcagcuaugggagucuuaccuguuagucugcaggguggaguaugacagcagaccucugucuggcacucagucaagugugucauuaggguguucuguacuggauguuaugucccagauugaaucauauuuguacuuuuaucucucuucuucuauaucugcuuuccagguucuacucuuucuugcuaauuucucuuacaugugucuccuuuuccucucccauuacugccauucucauuugggccagaauugguuuccccagcaauuccuaauacauaaccuugcuuuagccucuaccauucuccugccacuauagacaaccucggagucuugcauuccgaauucucauuagggcucaacuuaaacgcuacuuuuuucuuuacuuuuuuuuuuuugagauggagucuugcucugucgcccaggcuggagugcaguggcaggaucucugcucacugcaagcuccgccccaucgguucacgccauucuccugccucagccucuggaguagcugggacuacaggcgcccgccaccacgcucggcuauuuuuuuuuuguauuuuuaguagagaugggguuucaccguguuagccaggauggucucgaucuccugaccucgugauccgcccgccucaggcucccaaggugcugggauuacaggcgugagccacugccccggcccuacuuuuuucaugaauucuuuuaauuuuugcugucuugaguuauguauacgcaagagaaugcagaccuuucgauuccaugugucagcagacuauaguggggacauagggaaagacggaaucaccuuagugguuaacuuuguuuuacaauuaagacacaaagaaaaauuguaugauccgcuauuauuaaugaaaagacagucugacaucaaaguaggaaagauaaccucagaauaaaaagauagucuaaaauugugugaggagaguauucauuaacccuauagguuuauuuaauccaugucauuaaagcuuuagccauuuuuaguuuauagugccauaauaaguaguuauuugcauauggguguuucucugaauauguuguaaaauugaauuuuggauuucauuuuuuuuuuuuuuuuuugagacggaauuuugcuuuuuuugugauccaccggccucagccucccaaagugcugggauuacaggcgugagccaccgugcccagccagauuugaauuuuuuauaucccacagcaucuagcgaagugccuugucuagaguaguuccauaaauguuaaguagaaacaaauuauuauagaaauaaccaaauuuagacccuuauucucuggaauucaaauuuauugcuugagcucauaaaauagagcauuccacuuuugggcugaccugacuuagaauuuaaaccugagacuccauugugccauuuuccugccauaggccuuuguggacuaaauugaacaaaagcuugucuaauuagauacuguuccuuuggaguauggcagcaucugagacuuuuaauaauggaagaagcauuuacauguagucaaaucuagcuuugaggagcuaauaggcaaauaacugaaagauuaucacuuuuccuuaggggucagauauagaaauguugaauucugugacccccacugacagcugugagcccgccccagaauguucaucuuuagagcaagaggagcuucaagcauugcagauagagcaaggagguaaguuguucacaaauucuaauuuuuuuuuuaauaugauauaugagugauauuaugagucuugccuucuuuccagguggguggccuuucuggcuaaucuaaggggucguuggaggauuagaacuucaguguagguugggcacaguagcucacaccuguaaucccagcauucugggaggcugaggugggcggaucauuugaggucaggaguucaagagcagucuggccaacauggugaaacccugucucuacuaaaaauacaaaaaauuagccggguguauuggcaggugccuguaaucccagcuacucagaaggcugaggcaggagaaucgcuugaaccugggaggcggaguuugcagugagccgagauugugccauugcacuccagccugggcaacagagugagacuccauuuaaaacaaacaaacaaagaaaaacuucaguguggauuuggugaaggcccacagaacccagagucaucagccugccccagggguuuauuugcagcuguaguauauuuuuggguuuucagauacacuuuguugcuacagagguaaccagugacaaaaaaaguguuucaugguuuaaucugaauuuguuugguaguuucuauuuccuugucauuuguuugguaguuuguauuuacuugucauuauuaaaguuaagaaaaaaauuauucauugaucacaagagauuuacuaaccuguuuuccaguuauuaucauguugauggaguuacagacaugccucucauuuuauucugcuuugcuuuauuguacuucgcagauacuacauuuuuuacaaauugaaaguuuguggcaacccuguguugagcaagucuauuaaugccauuuuuccgauagcauaugcccacuucaugucucugugucucauuuuuauaauuauaauauuucauuuauuuuuauuuuauuuuauugaauugaauuggcggaguuucgcucuuguuucccaugcuggagugcaaugguaugaucuuggcucacugcagccucugccucuuggguucaaguuauccuccugccucagccucucagcugggauuacaggcaugcgccaccgugcccagcuaauuuuguguuuuuaauagagacggaguaucaucauguugguuagccuggucucgaacuccugaccucaggugauccaccugugucaaccucccaaagugcugggauuacaggcgugagccacugcgccuggccuguaauugucauauuucaaacuuuuucauuauuauuacaucaguuauggugaucugugaucagagaucuuugauuuuacuauuguaauuccuuugggacaccaugaaccgugccuaugaaagacagugaacuuaauaaauguguguguucugacugcucuacugacuugccauucccccaucucucucccucuccuuuggccucccuguuccuggagacaacaacaauauugaaaucaggccaauuaauaacccuacaguggccuccagguguucaggugaaaggaagaguugugugucucucacuucaaaucaaaagcuaaaaaugauuaagcuuauuugaggaaggcaugucaaaagcuaagucucuugggccagauaguuagccaaguugugaaugcaaaggaaaaguucuugaaggaaauuaaaaguccuucuuagugaacacaugaaugauaaggaagccauauagccuuauugcugacauggagaaaauuuuaguggucuugguagaagauugaaccagccacaaaauucccuuaagccauagccuaauccagaacaaguccuuccuaacuugcuucaagucuaugaaggcuaagagugguuaagaagcuguagaaagaaaggcggaagcuagcugagguugguucaugagguuuaaggaaagaagcuauguccguaacauaaaagugcaaggugaaguagcaagugcugauguagaaggcgcaccaaguuauccaggagaucuaacugagauaauggaugaagguggcuaccccaaccagcagauuuucaguauagaugacacaacuuucuauuggaagaagaugccaucuaggacuuuccuaacuacagagaagucaauaucugcuucuaggcuucaaagaacaagcucacuuucuuguuagaggcaaauguagcuggugacuuuaaguugaagccaguguuuacuuaccaugccuugagaaauccuaggacccuuaaaaaauaugcuacaucuacucugccugugcucuguaaauggaacaacaaagccuaggugacagccauguguuuacaacaugguuuacugaauauuuuaagcucaguguugagaccugcugcucagaacaaaaagauuccuuucaaaauacuagacauuguauagcaauaccuggucaaucaccgaagggcucugauggagauguacaaggagauucauguuacuuuguuuccugcuaacacaacauccagucuguaguccauggaucaaagaguaguuuugacuuucagguuguauuauuuaauaaauacauuuuguaaggcuguagcugcuauagauagugauuguucugauggaucugggcaaugugugugaauugaaaaucuucaggaaaggauucaccauucuagaugccuuuaagaacaauugugauuugugggaaaaggucaaaauaucaacauuaacaggaguuuggaagaaguugauuucaaccuucaugacuuugagugguucaagacuuuaauggaggaaggaacugcagaugugguagaaguagcaagagaauuagaauuagaaguggauccuggucgggugugguggcucaugccuauaaucccagcacuuugggaggcugaggugggcggaucaugaggucaggagaucgagaccauccuggcucacacggugaaaucccaucucuacuaaaaauacaaacaauuagcugggcgugguggcaggcgccuguagucccagcuacucgggaggcugaggcaggagaauggcgugaaccugggaggcggagcuugcagugagccaagaucgcgccacugcacucuagccugggcaacagagcgagacucugucucaaaaaaaaaaaaaaaagaaguggauccugaaaaugugauccaauuguuguaaucucaugauaaacuugaacagauaaggaguugcuucuuauggaugagcaaagaaaguaguuucuugagaugcaaucuacucuuggugaagaugcugugaauauuauugaaaugacaacagaggauuuagaauauuacacaaacuuaguuaauaaagcaguggcaggguuugagaagauugacuccaauuuugaaaguuguucuacugugggcaaagugcuaucaaacagcauugcaugcuacagagaaaucuuucaugaaaggagagucaauccaugugggaaacuucaguguugucauacuucaagaaauugccccagcuacuccacccuucagcagcuaccacaguggucagucagcagccaucaucuuugaaguaagacucuccaccagcaaaaauauuacaauucacugaaggcucagaugaucacuagcacuuuuuagcaauaauguauuuuuaaauuaagauauguacaguuuuuuagacaugauguuauugcacacuuaauagauuacagcauaguguaaaccuaacuuuuacauggacagggaaaccaaaaaauucaugugacuugcuuuauuacauugguuuggaacugaacuugcagauaucugagauaugccuguacucugguuccaaucugguaaaauggaaucuguauuauguauacuucacaugggauuugaugcacacauuauuuauauagagaaauaggacuccugaacaauuacugcauacacuuauguucauauuuaaauuacuucauuaacuuuuuaaaaaaauuacaguaaaaugcauacagaacauuuccccucaggagaaaaaaguggaugugucaaggccagaaauagaagagauuauagcuguuaauuuuuuuaagccuacacguugauuauuacuacucucauuugaaaagugauucucaucuuuuuugugucagagauccuuuugagaaucugaaagcuauggacaguuucuuccaagaaaugcauuuacuugcauauguuaaagaaaauuuucuuuuuuuucuuuuucuuuaugagacagagucucgcacuguugcccaggcuggagugcaguggcgcaaugaucucagcucacuguaaccuccgccuccccgguucaagucucagccuccuguguagcuuggauuacaggugccugccacuaugcccagcuauuuuuuuuuuauuuuuuauuuuuaguagagacggggguuucaccauguuggccacucuggucucgaacuccugaccuccugaucagucugccucggccucccaaagugcugugauuacaagcaugagccacugugcccggccuaauuuuuuuguuuuuugagauggugucuugcucuguugcccaggcuggagugcaguggcgggaucucggcucgcugcaagcuccgccucccggguucacgccauucuccugccucagccucccaaguagcugggacuacaggugcccaccaccacgcucggcuaauuuuuuguauuuuuaguagagacgggguuucacuguguuagccaggauggucuugaucuccugaccucguggucuguccgccuuggccucccaaagugcugagauuacaggcgugagccgccgcgcccggccauuuuaauagcgacgggauuucacuauguuggucaggcuggucuugaacuccugaccucguggucugccugccucagccgcucaaagugcugggauuacaggcaugagucaccgcgccuggccccagcaccccggccgaguacuguggcggaaucucaccucuaaauuaauuaauuuucuguuagaggguauauaaugcugaaaaauauuuuuuuuucccuguucuuugcaggacuuaaauuacauaagaaaugcaugaucgaccgggcgcgguagcucaugccuauaaucccagcacuuuggguggccgaggcgggcggcuuacggggucaggagaucaagaccauccuggcuaacacggugaaaccccgucuguacuaaaaauacaaaaaauuagccgggcgugguggugggcgccuguagucccagcuacuugggagccugaggcaggaggauggcgugaacccgggaggcggagcuugcagugagccgagacggcgccacugcacuccagccugggcgacagagggggacuccgucucaaaacaaaacaaaacaaaaaaaaaacaaaaagaaaugcauguucaugauagggaaaaaaaaauaguaagcaaaagaaauuuaaaauggucuauaauucuuuuaucuagaaauaauuacuguugauauuugguguacuuugcucauaaauuuauauguuauauuauuuuuaacuuuucuuaauauuuuaugcucuuuucuuuuuuuuuuuuuuuaagacagaguuucacucuuguugcccaagcuguagugcaauggcaugaucucggcucacugcaaccuucgccuccuggguucaagcaauucuccugccucagccucuggaguagcugggauuacaggcgcgcaccaccacaccuggcuaauuuuuuguauuuuuaguagaaacgggguuucaccguguuagccaggcuggucucaaacuccugaccucaggugauucaccugcauuggccucccaaacugcugggauuacagguuugagccacugugcccggccuuuaugcucuuuuucauuaaaaauauauugugaagucaucauucuguuuguacacauuuucuuugaggagguucuuauaaaauauaucuucuguagugacauuuaguuuuucuguguuuugaguucuuucuuuuuuaaaaaaaauuauugguagaacuggucucgcuauguugccuaggcugguuuugaacuccuggcuuuaagugauucucacacauuggccuaccaaaguccugggauuacaagcaugagccacugugccuggacugcccucucucugacuuuuuuuugagacauagucacacucucuuguccaggcuggagugcaguggcaugaucauggcucacugcagccucaacuccuaggcucaaguaauccuccugccucagcuuucugaguagcuaguacuauaggcacauaccaccaugcccaaauaauuuuuuaauuuuuauuuuuguagagacagggucuugcuguguugcccaggcuggucuugaacuuguagcgucaagcaguccuccagccuuggccucccaaaagugcuagggugacagguaugagucacugcaccccgccugaguccuuguuuuuuauaguuuauguuuucuuauaaggcauuuagacacacacacacacacacacacacacacacacguacauauacauacauacuuucauaaaucauaguuugaagccacgguuuuuauucuuacgguaccaggcauugacagccauuagaauggucuuuagaaacuucgaauaaacuuuuaagaauucaggaaauguaucacuagguaucuaaugauagauuuuuucauauuagguauuaaugaacauacuggaucaaguaauuugguaauguaagguagagguuuuauuuacuuagucaagguagcuuugaguucuuaauaaaucuuguggcugggcacgauggcucauaccuguaaucccagcacuuugggaggccaaggugggcggaucgcuugaagucaggaguucgagaccagccugggcaacaugguaaaacccuaucucuaguagaaauacaaaaauuagccguggcguaugucuguaaucccaguugcuuaggaggcugaggcaggagaaucacuugaacccaggaggcagagguugcagcgagccaagauagugccacugcacuccagccugggcaacagagcaagacuccaucuccaaaaaaaaaaaaaaucuuaaaugauugcauuuucuuauccaaaauuaucaccugacaguuucaaauaaaugaaguucauuagcaacaguggagugacuucuauaauuguaugugacauuucauuaaaucuauccuaacauauuaggaagagauuuuuaucuacccagauuauauguuggcugcagaaagucaacagagaguuuuaaauuaagaaauaauuauauugaucuuugcuuuauaucagaaagcagccaaaauggcacagugcuuauggaagaaacugcuuauccagcuuuggaggaaaccagcucaacaauugagguaaacuuguauuuuacacuguggauauauguuaaauaguauccuuagaauacuauuuaaagccucuaauucuauuuaugcauucuauuccuauuuugaauuauaagcaauuuugacuucuaaguuagaugucuuagaggacaucuaagcaaaguauuuuauugguauuguguuaaagaucuaucuuuucaccucuaauauaauucuuuuuggaaguagauugcauucuugaauuauauugaaaaauuaaacuguuagguuucaugucuaaaauggugguucauuuuaaaauuugguaacaaccugagacuuaugcuuugggguuuuacuugacuucuguauaaaacuagauagcuagaugaucauuuuacaugguguuuuagucuguacugaucugacaaaauaccugauacugggugauuuauaacaaacagaaauuuauuucucacaauuauagaggcugggaaguuuaagaucaaaguguggacaaguucaguguuugcugaugacaugcugucuuguuuccaaauggcauuuuguugcuacaucuuuaagaggagaugggcaaaaaaaggcuggaugcugcaugaagccuguuuuauaaagaccuuaaucauauuccuaggggaggaucccuuauaacucagucaccuccuaaaggucccacuucuuaguacuaucacauuggcgauuacauuccagcguagaaauuuguggggacaccuucagauacauucaguacaagauacagcuguugaaguuuauuacguacauaaccuaaaaaguucagugagucuuuuuugggcuuccacacuacagaguugugcucgaauagaaccauggaacucgugagagaagugagcucuuuuuucugugguuauugagggggcaaagaugggcuucucagcuucugcagcccacuaggagaaugcaguggucugaucuaauucugagaguugucaagggaucugaugguguucucaagcuauaugaugagccugcuauugcauaauucuuuacuaauaguaggaaucauaucuuuuauuuuaacucagaugacuauaauacuuacuacuguuguauucuaagaaaauguaagacccuuaaaugauuguugaacuuaccaucucuaaaauuaugauucuucaggcagaggaacaaaagauacccgaagacaguaucuauauuggaacugccagugaugauucugauauuguuacccuugagccaccuaaguuagaagaaauuggaaaucaagaaguugucauuguugaagaagcacagaguucagaagacuuuaacaugggcucuuccucuagcagccaguauacuuucugucagccagaaacugguaagaauacacugauaagagacuuaaagacauguacgaccacauuuuauauaaaggcuuguuuucuaccccuaauaauuuagucucuaguuuugaauauguuuggguaaaacucaagacaagacuauuuuugugugugaaaucuauuaauaccuaguguuucgcuagacuguucuggagcauagcaaucuuuuacuguaacaguaaccaucuuuugccauuaaauagaagacaaaauugcuucagugagauuuguuaaaaucacaaaugcuccaaaauucuuuuggugcuuuuuagaucuuuaagagugggagauuggggauguuaauauuuuugcuugcaguaguguacauuuuguaauauagaaauagugaaaaaaauuguuauuaaagucucuucagauauauucaauuauuaaucaugcaacaaacauuuauugaguaccuaccauaugugaaacagaguucaaggugcuaucaauacagcuagucuuccaaagcucgugaccuucagaucuuuuguuuuagauucuguuaugaaaaugucacuaguguaagccacauuuuuaaugcaaucaaugcccguuguacagacagacucauucagagauuaaagugugaguugcuugauuucuuucugcuaugcuucagcucaguuuuagcaguauguauaacaucuuuuaaugugauguaaguauguagguauaaaguuccuggauauaucaguuauuaagccacaauuauaacuaagcgugaguuauggcagagacaacuugaaacacugcuagugauucuaaaaauuuccuaauuugacgaagaaacaggaaacagguaguaucuauuuuagauaauuuuuuuagauuuuaccauucuuuaauauuuacauuugccaaccagaaucagacaauagaauuucugucauuccaguuuaagcuaauaaaaugucaaguagagguucuuggcugggcauaguggcucaugccaguaauuccagcacuuuguaaagcugaggcagguggauuaccugaacccaggauuucgagaccagccugggcaacauagcgagaccucaucucuacaaauaauaaaaagccaggcaugauggcgugcgcauguggucccagccacuugggaggcugaggugggaggauugcuugagccugggagguugaggcuguagugagcugagauugcgccacugcacccagauugccaaccugggugacagagcaggauccugucucaaaaaaaaaaaaaaaaaguagagauucuuggcuaucucauuuaaugagaaguuauuuucaguuaguauaucagugguuugccuauaaacaugaacgugaaaacacuuuuuccagcuauuugaauauucaugugacauucuugauguucagaggaaaacuucaggcuuuguuagaauagcauucauaguaucuuuauuuauggagggguauuguaauugauuuuagaauccuuguuagucaucaaauuuuauuauuauuuuuuuaaacuccaggauuuguguuguauucagguaguuuccccacccccgcuuccuuuccugccucugguuuaauuagagaauauucauggcccagaaaagucaaauugaagccagaguauuauagaauggucagauauauaagaaacugacauagacguaaaaggaacuacauacuguugcugggcgugguggcucacgccuguaaucccagcaccaucucaaaaaaagaaagaaauuacauauuaacuuuuuucaggaaguuguauaguucuaagaccauucuucuaauauuuaucuucuuucugaauucugacuucuugagauuuuuguggacuaagaggaauauuugauuaacuguauuuuuacccauuguuauuccuccuaaagauauuguuucaauaaaccaaauguuuaaagacgaaauuuuggacuauacugaaaacacugcauauaaaccaguugccaaaaguuuuuguuuuggggccgggcacuuuggcucaugccuguaaucccugcacuuugggagacugaggcaggcagauuaccugagguaaggaguuugagaccagccugaccaacacggcaaaaacccuucucuacugaaaauacaaaauuuagccaggugccuguaaucccagcuacuugggauuagcugccugugguagcgcaggccuguaaucccagcuacucuggaggcugaggcaggagaaucucuugaacccaggaggcggagguugcagugagccaagauugcgccacugcacuccagccugggcaauagagggagaccccgucucaaaaaaauaaaaaagaugguuuuuguuuuucccuuuuaguuuguuaauuuugugcuagccauugcuuaauuuuguuuuuuccuuucccuuucuucauccuuaaggauuucaacuucaauuuuuucuucuccugacuuauauucuuguggcaguguacguuuuguuggguuaagaacacugccugcuuccucuuuaugaacucucuucccugacaaaaagcaaaguugguaguguagagaaguuuguauuguguguuuuuaagaaggcaugguuauuacguuuuaauuuuguacggauaacaauguuaagugauaauuaaguauuuuuaauucuuuuuuuucuuuuuagucuuuauaauauagcuuuaugccucuuuuuuuccuguuuauucacaaaagaaagguggugggagaagcuguggaagauuccugagugcauauggggaugggaugaucagcugaaacaccauguuccuagccaacucgcuuuccaagguggugugacuaaaucugaccagcuucucuagagcugagugugccuagucacauuuacuauuuaccgagugcuuuaaagauaccuguugucauccgcaauacucuaaacagguguucagaaucucuuguaaaggagcuggccaagcuuauugcaugccuuugcauugcuugcaucuaugggccaaauuaagcuuuuuuaaaagaaguuaaaaaucaaaauauuucagcuauuauauguauggguuaaaaaaguuggaagcauuagauaaggacaugaauauauuaauguggguuaggcuguuuuguuagaauauauaaugaagguaauguuaauguagaauugaacaauuauuuaaauaaguuuuacaaaugguuuguuuuuacauuuaccuaucuuaauuuuaugucagaaagccugacuuaaauacucuaaccaugaucaugaaugccuuuguauuauguaaugcuuuguuuaagucuuccuuucuuucucuuuguccaagaaauauaaucucacaccugaggcgacggcaucuuugaaaaacuagugaucaagaauaaccagauaaacaugaugggcauaagggucaugaccaaaaagaucucucaguggcaucuguaucacuaaauauuaggaauauucauucauuucaguagugccuucugucuuuguguuuauuguuguaagugugaaagugaacugaauacuccaugauccaucucugaaaaauauugccuaaccuaaaucaccagcuuuccuguggcauggauauccugucuucugaagaacuguuuuugcuuuucuggagcaugaauguuuguuguuuuagagcucuuuguauucgaguucauauuuuauccuuauuuuuagugcuuuuccucuaaguagcuuguggaaauuauuucugaguaauugaagcuucugugucaacauaauaguuuguugacauaagaaacaguguuaagaaauuaugcauuuggaaaaaacugaaggugauuuuuuccagggaauuuguuuccuggacuugggauuucuugugcaaauuuuccccacuaguuuguuuuucucuacuauuauuuucauaaaggagcagcaccagaauaguccuuaauaucggagauagcuguugugucacuuccucaugcugacauauuuacuagaggguaaaauuaauaaccuucuaguaagaguggcagucgaagggaagggcucaucugacuucuggaaaccuauguuaaaauacagugcuuugaaccuugaucaugggcuaauuagguuggaaaugaaacuagagaccagauacacccaaggaaacuuuugguaguuauuuuacuuuauaagucacaggaaaugcuuguguacuuuccuguguuccuuaaauaguugcacuuaaauuaccucuuugaaacugaaugaagagacagagaguauuuuuuuucuuuccagaaauaauacuuguuuauaccuguaauagcaaugaaauuuuguuucuuuugagacagaguuuugcucugucucccagucuggaguauaguggcaggaucucagcucacugcaaccuccaccucccagguucaagugauucuccugccucagccucccaaguagcugggacuauaggugcacuaccaugcccggcuaauuuuuguauuuuuaguagagaagggguuucgccauguuggccaggcugaucucgaacuccugaccucaggugaucugcccgccucggccucccaaagugcugggauuacaggcgugagccacugcuccuggccagcaaugaaacuugaggcuaugcgaaugaaggauuguucuaagaguguaaacuauaaggcgaggaggauuaaauaaaaaaacagagauaggcucucaaagcaccaaauaguaugauuaacagauucuuguguaucacauuugaaaugcuuuauguuuuggcuuuauguugaugaguugaaaacccguguuuuuguuuauguuguuugguuuuuguuuuuggcuaucuuauguagaaaggcauguaagggauggcauugauuauucuaaauaauuuuuacugggaaagcuuuuccaagauuuugaauagcuaaaugucaacuuuuuucuuaauaguauuuucaucucagccuagugacgaugaaucaaguagugaugaaaccaguaaucagcccaguccugccuuuagacgacgccgugcuaggaagaagaccguuucugcuucagaaucugaagaccggcuaguugcugaacaagaaacugaaccuucuaaggaguugaguaaacgucaguucaguaguggucucaauaaguguguuauacuugcuuuggugauugcaaucagcaugggauuuggccauuucuaugguaaguacucaaaaauguguuauacauaaccugaugggauaguguagaggaacuuaagagugaggacucuugggaucuguuuucagugccauuauuaaauguguggccuugaaaacuugaagccuguuugagccucaguuuucucauucgggaagugggugcugccuaucucacaaagcuuuuuauuuaaauaagguaguaguuauuaagaaauguaaggauaauaaccauauauguuugugacucuuuuaaaguuaaaagauuggaagauuaaaaaucugaaaugcucaccaugaggcaaaucauuuacauuuagaaucacacuuaaacuaaguugaagugugacuuuauuaggaagauuauuuaaaucccaguugaaauaguuacauuugaaauguguaaauaauaaguguucauuauuucuacuuugagguuucauguaaguaucauacuuuguaacuuucauuguugcuucugugauucacaugaauugagaguuugucaucuuuguucuuauacuuugcucuuuauuaugauugauacuguuuauauauguugauuaucuuaucaauucaaagcuuuuaaaugccuuuugggugagaagaggaagguauucuauugguguuacuuuacuuuuucauuuaggagccucacccauugacucucuccuuuguuuuuuggagacggagucccacucugucgcccaggcuggagugcaguggcacaaucucagcucaaugcaaacuccacucccaggguucuagcaauucuccuaccucagccuccggaguaacugggauaacaggcgcccgccaccaugccuggcuaauuuuuuuauauuuguaguagagacgggguuuugccauguuggccaggcuggucucgaagucuuuuuuuuuuuuuuuuucuuuuuuuuugagacggagucucacucugucgcccaggcuggaguccaguggugcgaccuuggcucaaugcagccucugccucuggguucaagugauucuccugccucagccuccugaguagcugggacuacaggcgccugccaccacgcccagcuaauuuuuuuguauuuuuaguagagacgggguuucaccaucuuggccaggcuggucucaaucuccugaccuugugauccacccgccucggccucccaaaguguugggauuacaggcgugagccaccgcacccagccagucuugaacucuugaccuaaggugauccaccccacucagccucccagagugcugggauuauaggcaugagccaccgugccuggccugagucucuuauuuaagguauguguuuguacaaugacuggaguauuugaaaccugaacuuugacucucuuugcuauauuggaauuugggguagagacacuuuaaaaggaaaugucuuagaucuugucaacuucccaaauuuuagcuugcuuuacauuaacuacuuuuagauuuuuuugccugcauaauccacagucuuaacuuuucguuuugcuaguucauucgaaaaauguauuucuuaugcaaagauugaagaauuacauguacccuauguggauuuguggaaaagguauauuauucaacauagcguaauguuagaauaaacuuaaugaagacaauaccuguuuaaagucagagcuugcaagauguuucuuguauuuauauuaauaaaaauauguauuuagauuucugauggauaccugcuugaauuuaauacugagauacuauuauuuguauccuuucuugaaauuuguuguaauaagauuugauuugaaauauauauuuaccuuuauagacuaucuagcugaaacaaucaauaaguauuugaguaugauuuucccuccacaaguaaacaugaggguaacaauggagaagaucuuaucuuaaucuuuuuuucuuacuucaaaaaaaauuggauagugauuuaaaguguuaauccaaauugcauuaaaacuucaccauuuacaugaccuuugaauauuuuguagaaaaauaauuuuacagaagugcuuucaaaaugagaaguuacuucucuguuauguaggauuuugguuauuaguaaaauuuaccuuaauaguuaauuaauaaaacauuguccuuuacuugauauuagccuuuucaggcuaugaaaagccuggauaacauauuaugaaguaggccuacauaguaaugagauuaguugaauuaacauacaagaccugaccuaaaugacuuuuccaagucacuacuuaaaagacaucacuuuuuuuuuuuuuugagacagaguuuugcucuuguugcccaggcuggagugcagugcgugaucucggcucaccgcaaccuucgccucccggguucaagcaauucuccugccucagccucccgaguaucuaggauuacaggcaugcaccaccauguccagcuaauuuuguauuuuuaguagagaugggguuucuccauguuggucaggcuggucucgaacuccugaccucaggugaucuguccaccucggccucccaaagugcugggauuacaggcgugagccaccgcaccuggcaagacaucacauuuuuuaauuucagcacugaucucaacauucuuuggaguugauuucagagccguuuugaauuuucuauucaccguaaagucggucauugcaucccauagucauucauucacuuuauaauuuuauuuuuuuuugagacagagucuugcucuguuccccaggcuggagugcagugguaugaucuuggcucacugccaccuccgucucccagguucaagcgauccuucugucucacccuccugaguagcuaggauuacaggcauccgccagcacgccuggcuacuuuuuguauuuuuagaagagaugagguuucgcccuguuggccagguuggucucgaacuccugaccuuaagugauccgccugccucggccucccaaagugcugggauuauaggcgugagccaccgugccuggcccgcuuuauaauaauuuaacaauaccauauuacuaauugaaucauucugcguuugccagcccuggugccauacagauuugaauuggcagaucuauacugcagggaagagaaagcuagcaugacuaaggauagugaggcaguguacuccagguauuugguucugaaaaugcuuccagaaguuuuauuaaaaaguuucaugagaaagcagucuuucuuauucuuacauuugcuugugacuaucaacauuccaaaucaucaauggaguucaauugauuugguuuucuccucgaguugcuuuaaguauugauagacuacccggcucuucggcagacuauuauauaacaagauaucuagaugcuaaguuauagagcacagaaugaauuacagcucaaaggguacacuuacugaauuauccuggaggugguaagauuuaaguugugucuaaucauaguaaguuuaugauagacucaagggaagguggaacauuccagcgacagagaaucugauaaccugaggaagacguaaucuuggguuugggagcagugaaaagacugcuuggacuacagcagaguguagguauuuagaaauaauggaauagguggggugcuauuauagucaucccuugauauacaugagggauggguuccaggaugcacccccauaccaaaauccauacguacuaaagucccuugacugcggaccucacauauaugaaaagucaccucuccauauaccuggauuuugcauccugccauguaguucaaacucauguugcucaagggucaacuguguauuguaaaacgucuuggaaucuagauaggaaaguuugauuuauugaguaaccugcuaucagguuagagaaaaaagugccggaacuuuuugcugguguggaaaaggugguauggaaaaauguagaauagucagucaguuaagaguucuguaaucuggauauuuggugaggaggaccuugacaauuggaauaacagugggaauggaauaagggacauugaaggaauaauggaaaauaauggcaauuuauuaaauuguagaaaaugugcuagcugcuucacuuuuggaguugggguuacuggggaaguuuugccagaugauaaauagaugguaagcacaguuugguuugguuuuacccaaauuuguucuagacaaauuugguuuggggcagguguugagguuugauuuuuuuuuuuuuuccacccuacaaacaggcccccuacacagcuggauguguuggcuagaagcucugaugagaaguuaggacaagaucuguagcuuggaauucuuaauaggagugauagcaaaaucugacagcgcugcaacaugguaaaauaggcagcauuuguagacaugacuaggccaaagauuguaucuugaggauaagacuuuagguagcugaaggugcaggaaaaacccccaagugauuagucaguaauauuguaaaaggccacauuaagacaguaaucaagcauaugcuauauuauacuaucuugaauucagaccucaacacaguuuuagauuauuuuccagugggcaaaggaauuaaucucagcaguuugaaauagaaauugcagaaguuuucuguuacucugggaacuauagauaaauuucaacauuugaaaaaaaucugggauucugcugaguaauuuugaaacaagcuugccgugcuucuauaaauugagaaaucuaaagagaggaaaugaauucuaacacagaauaucauagcuagacuauguaacaguuaccuguaaauuggcaaaaguuguuuuugguguuuuucaagauguauugaagacauuuaaaauaauuuuuauagcaguaagggaagaaauagugaucacugcauccuuucuuuguaaaauucuauaguaucuauacucaguagauguaauguuaagguugcuaacugcauuuugccuuauuuuugauuucgugguuuuuuccccccauacaugacgcaugugaauagcaugucugaguaaaguaacauuuugauuuuuaggaugaaaauaugaagaauccuaguugguuuaagauucuuuuuuugagacggaguuucgcucuuguugcccaggcuggagugcaguggcgcgaucuuggcucaccacaaccuccaccucccggguuuaagcgauucuccugccgcagccucccgaguagcugggauuacaggcacaugccaccacucccuggcuaauauuguauuuuuaguagagacaggguuucuccauguuggucaggcuggucucgaacuccugaccucaggugauccaucugcuuuggccucccaaagugcugggauuacaggcgugagcuacugugccuguccaauucuuuuaucacuguugggauaaggacagugcuacuccaguacagauuuaaccauugcagaauucuuaacaaauuuggccuugagaauggugcacaaucaccauuagccaauuauuuucugugcuguacuuuuugggcuuuguuguauccuuaaggcaaaauauuaaaaaaaaaaaaaauuuucauuuuuccuuauugacuuacgaccugugaaaaaauaccaggguuuguucauuucucuguauaagggaggcugaaacacuuuuuguacuuaaaagauaaccccaaaacaacaaagcugagugccuucaauauaguaagauaagaacauuacauaaauuguucucuugguuagagccauaugggcuggccuguguguuuuaauacaaaagauagugaacugcuuaaauguuccuggguguauguaaauaaauguuuuuaagaacuagccuacuuggccuuacuuauauuacguuaacguucaccaccauuugaugaaugauugaucaugggcuuucauuuacuuuucuuuuuuuauuuuauuuuauuuuuauuuuuaguagagacaggguuucaccauguuggccaggcuggucuugaacuccugaccucaaaugaucuaccugccuuggccucccaaugugcugggauuacaggcgugagccacugugcccagccucaguuacuuauucucuauuuauguaaucagaauuuuuaaagaacggugaaaugcugauacucugaaugaaaugauugucaagauuacauagguuauggccaggcacaguggcucacacauguaaucccagcacucugagaagccaagguggguggaucacuugaggccgggaguuugagaccagccuggccaacauggcaaaacccugucucuauaaaaaauuaguugggccugguggcgcuucccuguagucccagacacucgggaagcugagucacgagaauugcuugaaccagggaggcagagguugcagugagcugagaucauaccagccugggcaauggagcaagacucuucucaaaaaacaaaaaaaaaacaaaaaaaaaaaacaaaaaaaagacuacauagcuuauaugcagauuaccaauauuaaaaaauacauaaaacauuuaaugauaauauuuuuguuacauaccuuuaauaaaaauauuuauuuuaggcacaauucagauucagaagcgucaacaguuagucagaaagauacaugaagaugaauugaaugauaugaaggauuaucuuucccagugucaacaggaacaagaaucuuuuauagauuauaagguauguaccacuaacaguauuuaaaauaauuguuaguaauuauuuugcuuauuaguuagagcuuauugugcuuauuagugcagauuaguaaaucaguaauaaugcugaucauuguugaauugaguacggguauuuaguguguccuagucauugucaugaguguaccauauagaguauuucucuuauucucacaauaugugaauuaagcaauuacuaacuuuuauagguggaaaagagguuuagaaaaguuaagugacuuucucaagguagcaacuggcagagcuaguuuguuuuuguuuguuuguuuauuuauuugagauggagucucgcucuguugcccaggcuggagugcaguggugcaaccucagguugcugcaacuuccaccuccuggguucaagcgauucuugugccucagccucccaaguagcugggauuacaggugugcaccucuaugcccggcaaauuuuuuuguauuuuuaguagagacgggguuucacuauguuggccacgcuggucuugaacuccugaccuccgucuacccaccucagucuccuaaagugcugggauuacaggugucagccaccaugcucggccauggccuuuuuuuguuuuguuuuguuuuguuugggagagcuaauuaauugauucuaaggauuugacuuaagaacucuuaucccuagcugcuauuuuauaguuaacaucuuuuauaagugacauuuuauauguguauauagacauuuuuauuaacauuauuuucacagagcgaagcaaacauuuucaguuggcaggagggaaagaggagaguuuugguuuuauagccucucuaagaucuucucuugaucaggggacauagcuauuccuuuccauuguuuuuuuuuauucugauggaagggagagcauguuaucuuuuucugccuauaacucaccuagaucucgucucacaggacuguacuguccauucugucauuaccuaacaccucuguggguuuaugaggaucagcaaaauagcuggucucuuaucuaguuuuuuccuaagaagguuguagagagaaaugcaggguagaaaaauaagcuaugucugggugugguggcaaccucccaaauucccaaaguugguaaccuugggaagccaagguagguggauugcuugagcccaggaguucaagaccagccuggccaauauggugaaaccuugucucuacuaaaaauacaaaaaucagccuggugugguggcacauaccuguaaucccagcuuuuugggaggcuuaggcacaagaauugcuucaaucuaggaggcagagguuauaguaagcugagaucacacuauugcacuccggccugggccacagaggaagacugucucaaaaaaaaaaaaaaaaaaaaaaaaggaaaaggaaagaaaaguaagcuauuguuuuuuccuucauuuuuccacccccaauucucacacuuaauuuauguaugcuucccuuacagguuauauuucuugaaaagacaaaaauacuacuuuguaacuaaauuguaucuuucagggagguacuucucccauccaaguacuaaccaggccagacccugccuagcuucugccaucagaggagacuggcggcauuuaggguguuauggcuguagacacagggagguacuucugaaguuaauuauaaauaguucaguuuuuccuaccuguauuagaagaugccauuuucuucuucaccacaguguuuucugguuccauaggauaacauuggcuuuuggaaaacucaccacgcauuaaccucuagagagaguuuguaguuugguuuggguuuggguuuuuuuuuuguuuuguuuguuuuuuuucugagauggagccucgcucuguugcccaggcuggagugcaguggcaugaucucagcucacuggaaccucugccuccuggguucaagugauucuccugccucagucucccaaguagcugggauuacaggcucccuccaccaugcccgguucauuuuuugcauuuucaguagagaugggguuucacuauguuggccaggguggucuugaacuccugaccucagguaaucugccugccucggccucccaaagugcugggauuacaggcgugagucacugcgccuggccuguuuuuuuuguuuuuguuuuuuaagagacaggguuucauucuuauugcccaggcuggagugcaguggugugaucauggcucacugcugccuuaacuucugggcucaagcaauccuccuggcuuagccucucaaguagcugcgaccacaagcacacgccaccauguccaacuugguuuuuaaauuuuucauagagauggggucucacuauguugcccaggcuauucuggaacuucuggguucaagugauccucccaccuuggccucaaaauacugggauuaaaggauugagccacugugcccagcuagagagucaguuuuuacagaucucuuauuucuggcuguuaaguguggaucagauagauuuugaagcucuuuggaagaccuggucaggaucugcuuaucaaucacuuaugucaacaucauauuuacugcacgaggaaugcuguacucuucuuucauccuguggcuuccugggcuugugcauuucaagauuaugccacaccagugcaucagucucuucuacuccacaguccacugcuguuggguagaagaaauuucuuuucucucauacagguagagcagaugaaaugacugugauuaaauuuuaaaucuuuauuuguucucugaagauuaaugagccagaacgugaagcagucauuucagauaguuauuuuucaaguguauauuagugucauucucuuaaaggacuuguauuuuuuuuuccuuuuuuuuuuuucuuauuucugaauccagguaauugacugcucugacucaaaugggguaaccauaacguuugugauaaauuaagccaaauuuaaguaucauuuugcagauuuauacauaggauauuuuuaacucgauguauaaugcuuuaagaaccuguugaaccauauuguuuaaguuuugacuguuuuugguuagauuuuguuacuaaugcauauguguaaaagaaaauucaaaucagucaaggauacccuuauugaagcaguaaaauucuauaagccgaauugaccaugauuucuaccacgggugcugacuuucaguuauaguaaucuauagauuaaucuucagaguuauauuaaucuguacagauuacagaacuucaaaaauuuaccauaaaauuggauaaguuaguuauaaauguucaagauucagucugucuucuaacaugguuauagaauuuauggcuuaucuguacuuacuuagaaauguuaauugcauaggacuaaaauguuucaaauaggacuaagauuguuagaauuucauccuuugaaggguacacugaguacaaacaauuuuugaagccguaagucagcucucgauguaauuuuacuuuuauuuuuuauuuguuuuuuuuuugagacagagucucgcucugucgccaggcuggagugcaguggugcgaucucggcucacugcaacauucgccucccggguucaagcgauuccccugccucauccucccaaguagcugggacuacaggugcaugccaccaugcccagcuaauuuuuguauuuuuaguagagaugggguuucaccacguaggccaggauggucuugaucucuugaucucgugauccacccaccucagccucccaaagugcugggauuacaggcaugagccaccgcgcccagcuaauaauuuuaccuuuuauaaaagguaaucucuuuuccugauucagaaaagccuuuaguccugcaagcucuagcuaacuuucugucuuuuaaauucuuccagccaggcgcggugguucaugccuauaaugccagcacuuugggaggcuggagagucgcuugaacucaagaggcagagguuauagugagccgagauugcgccacugcacucuagucuggacgacagagugagacuccaucucaaaaaaaaaaaaauucuuacaccaugcuguaguucucaauuugauguagcucucugcucugcguuuucuugcauaugaaccuuguauuucccaauguuuauacuauugaaaauacuacccgggggguuguaucuguagaaguaaagacacaaaagcuuaugggguauuauaucuugaagauuuaaauucagcuuuuaaagcauuugacauuuuauuucuucucuuucaaaaaaaaauguagucauugaaagaaaaucuugcaagguguuggacacuuacugaagcagagaagauguccuuugaaacucagaaaacgaaccuugcuacagaaaaucaguauuuaagaguauccuuggagaaggaagaaaaagccuuauccucauuacaggaagaguuaaacaaacuaagagaacagauuagaauauuggaagauaaagggacaaguacugaauuaguuaaagaaaaucagaaacuuaagcagcauuuggaagaggaaaagcagaaaaaacacagcuuucuuagucaaagggagacucuguugacagaagcaaagaugcuaaagagagaacuggagagagaacgacuaguaacuacggcuuuaaggggggaacuccagcaguuaagugguagucaguuacauggcaagucagauucucccaauguauauacugaaaaaaaggaaauagcaaucuuacgggaaagacucacugagcuggaacggaagcuaaccuucgaacagcagcguucugauuugugggaaagauuguauguugaggcaaaagaucaaaauggaaaacaaggaacagauggaaaaaagaaagggggcagaggaagccacagggcuaaaaauaagucaaaggaaacauuuuuggguucaguuaaggaaacauuugaugccaugaagaauucuaccaaggaguuuguaaggcaucauaaagagaaaauuaagcaggcuaaagaagcugugaaggaaaaucugaaaaaauucucagauucaguuaaauccacuuucagacacuuuaaagauaccaccaagaauaucuuugaugaaaaggguaauaaaagauuuggugcuacaaaagaagcagcugaaaaaccaagaacaguuuuuagugacuauuuacauccacaguauaaggcaccuacagaaaaccaucauaauagaggcccuacuaugcaaaaugauggaaggaaagaaaagccaguucacuuuaaagaauucagaaaaaauacaaauucaaagaaaugcaguccugggcaugauuguagagaaaauucucauucuuucagaaaggcuuguucugguguauuugauugugcucaacaagaguccaugagccuuuuuaacacaguggugaauccuauaaggauggaugaauuuagacagauaauucaaagguacauguuaaaagaacuggauacuuuuugucacuggaacgaacuugaucaguucaucaauaaguuuuuccuaaacggugucuuuauacaugaucagaagcucuucacugacuuuguuaaugauguuaaagauuaucuuagaaacaugaaggaauaugaaguagauaaugauggaguauuugagaaguuggaugaauauauauauagacacuucuuuggucacacuuuuuccccuccauauggacccaggucgguuuacauaaaaccgugucauuacaguaguuuguaacauuuguagauuggauagcauuuuuaugauuugaugaguuucuuguaagguuaccguuucuaagaguugugcuuuauggccacugagagaauucagaauaaauugaaagauggagucuaaaaauuauuagcuguuacaaauggaacauuucauuauaacgugaucacuuugacuugagcaaaugguuuaauuuuuaucuuaaaaaucaguuaagaauauauaaaauccuacuuuggccaaguuuguuucuuuucauuauaguuuauaugaaaagaucaccuuaagugaaauuauuuuccuuuaaucuuuuauguauuuauucacuuuuggaagcuaggaaugagcaacacaaauuuuacucugaagucagaagagcucauauauaauaauucuaaugucccaccuauuuucacuuguccauuccauguaccagcuuaguuaugauacuuagucacauaauuaucuuugauaaagguagaggcacaaagaggcaaacuaagcaagucaaauucuaauguguguacuucauaauaauuuuuuauccauuuucaucuuuauauucuguaacaugaaacuuaccuaaucuucaaauguuagcuucauuuuuuaccuuugaaauacuuaaucuuucugaauaaauauaaugugucuauaaaauaaugagacugauucuggugucuuuagucauuaagcugguaucuaguccuauaaugaacaaaggugaagcugccuugaggagacaagugaaaaauuuuugcuucaaaggagcucacaagcuaaguaaauaaaugaaauuaagguauggggcaugguggccucaggcugucuggagguguuuggaaaggcuucuugagugagguggccuuugaacugaacuuaguuuuuaaaguagcuuuuggaagagaaaugaggauuugcuaugcagacagggaagggaauuucacuuaaaaggaaggucauuuggagaugugaagauacacugcuuuaaggaagcaggguagagcuggaggauaagagaugcagaccaugaagggccccauuuuaugcuaaagguuuuguccuguaggacauggagaacuucugaagaauuuucaaggcgggugggauaagauuauauuguauuuuagauuacaguaguccccccuuaucuucaggauauauguuccaagacccccaguggaugcuggaaaccagggauagaacauaauucuauauauacuaugcaugaauuucuuuuuccuucuuuacaaucucacacauagguuuguucuuacuauagaucuuaccaaucucagcauacuuuuauuucucuugagaaccuucacccuuucacuuaaaggaggcgcuuuauagcuucucuuuggcauauccaaaugccagcaucacuguuguauuuuggggucauuauuaaguuacuuaaucauccuuaauccuuaucuuagggauacuugaacacaaacacugugguaggauaacaguauaucugauuaacagacugcuacuaggugauuaauggguggguaguguaaauacacaagaaaaggaugauucacaucccaugugggauggagcagaacugcauuauuucauuacauuacucagaacaggcauauaauugaaaacuuaugaauuauuuuuuuuuaauuauuugagauggaaucuugcuuugucagccaggcuggagugcagugacacgaucucagcucacugcaaccucugucuccuggguucaggugauucuccucccuagucucccaaguagcugggacuauaggcacgugccaccacacccggcuaauuuucauauuuuuaguagagaugggguuucaccauguuggccaggcuguucuugaaauccugaccucaagugauccacacaugucuaccucccaaagugcugggauuacagucgugagccacuguaccccgccuaaaacugaugaauuauuucugaaauuuucuauuuaacauuuucagaccacaguugaccacagguaacggaaaccucaaucacagaaaguaaagccguggauacggugggacuaauguauugguagcagccuagaggauugaugggaaagguaugaagcuagaagguggucaauauaauacagacaugagcugaugaacaucuaaacugggacuauacuaguaggagaggaaaggaaaaaacauuuggaaaauaguaacauugauauuucuugugaaggagaaguagaaaguaacagugacuucuagauuucuggguugggucaucuuguuggauaguaguaccacugagauagggaauucaagguuuggggcaaggguaauuggagaugagaauuguguuuggagguaacuacugacauucaaguggagaggguuaguuggcaguuaguucuauggucaucucuuuugccgagacuguauauuuaucagacuccugggagaacaccaacauccaugggguuguagggaaggcuaaggacaggaguggggagugguaccuugaaaauccaaaagccaucucaaguaaaaggaauaaaugugucaugcuuuuuaaaaaguugaugugcggaaaauguuuucuuggcuuggaaacugggcggccaggggaugacaguauggacuuccagugaaguagugacggaagccugaucauagacauuaaggaaagcgguguagguguugugagcuuuugcuguaagaaaaaguugagacuuuuguuuugcuuuguuugugagagauguguauguauuucugcugagugauaaagccagcggggagggacugauuuuuauaggaaaggaggaaaaauaauggaaacacaucucauuauuuuauugucacauuucuuuucuuuguuaucuuuugaguguuucccuuuuuugccaguagaguuauugucuauuuuuucuuucuauaggacaaaaaaacuaauacagacuccuuuauuuuuauauggauauacuaggauuguaauucagauauuuaauaucuuuuaucaguguucagaucauagauuaauggagaaaacauuuaaaauuguuuuaaauuuaaauacauugaacucuaacauagaugaaaaauguguuuacugcuuucagucgaccugauaaaaagcaacguaugguaaauauugaaaacuccaggcaucgaaaacaagagcagaagcaccuucagccacagccuuauaaaagggaagguaaauggcauaaauauggucgcacuaauggaagacaaauggcaaaucuugaaauagaauuggggcaauuaccuuuugauccucaauacugauucacaauugaguuaaauuagacaacuguaagagaaaaauuuaugcuuuguauaauguuugguauugaaacuaaugaaauuaccaagaugacaaugucuuuucuuuuguuucuaaguaucaguuugauaacuuuauauuauuccucagaagcauuaguuaaaagucuacuaaccugcauuuuccuguaguuuagcuucguugaauuuuuuuugacacuggaaauguucaacuguaguuuuauuaaggaagccaggcaugcaacagauuuugugcaugaaaugagacuuccuuucaguguaagagcuuaaagcaagcucagucauacaugacaaaguguaauuaacacugauguuuguguuaaauuugcagcagagcuugagaaaaguacauuguucuggaauuucaucauuaacauuuuauaaucuuacacucacuucuugucuuuuuguggguucaagagcccucugacuugugaagaauuugcugcccucuuaagagcuugcugacuuguuuucuugugaaauuuuuugcacaucugaauaucguggaagaaacaauaaaacuacaccaugaggaaaacuaaaggucuuuauuuaaaaucuggcauuguauuaacauguaauuuuauacuaugugguauuuuauacauuuccucaguagugauauuugguaaagcaguucauacagcuuuuuucuaaguuccaugaaucuuacccaguguuuaccgaaguauuuaagcagcaucugaauauuuccacccagcaauguuaauuuaucuaggaaaguucagaauuucaucuucauguugaauuucccuuuuaacuuccguucauagacauauaugugacuuccaauucgacccucuggcaagugaguguggaagaaaacagcaguucuuuuauaauugcuugaaauuaggaaagcgcuuauuuccuagaagcaaauaaauguuuaaguaaauaaaggcuacauuuugcugaguacuguuucagucaa

SEQ ID NO: 192073 - RNA, 53288 nt, Homo sapiens
uugacugaaacaguacucagcaaaauguagccuuuauuuacuuaaacauuuauuugcuucuaggaaauaagcgcuuuccuaauuucaagcaauuauaaaagaacugcuguuuucuuccacacucacuugccagagggucgaauuggaagucacauauaugucuaugaacggaaguuaaaagggaaauucaacaugaagaugaaauucugaacuuuccuagauaaauuaacauugcuggguggaaauauucagaugcugcuuaaauacuucgguaaacacuggguaagauucauggaacuuagaaaaaagcuguaugaacugcuuuaccaaauaucacuacugaggaaauguauaaaauaccacauaguauaaaauuacauguuaauacaaugccagauuuuaaauaaagaccuuuaguuuuccucaugguguaguuuuauuguuucuuccacgauauucagaugugcaaaaaauuucacaagaaaacaagucagcaagcucuuaagagggcagcaaauucuucacaagucagagggcucuugaacccacaaaaagacaagaagugaguguaagauuauaaaauguuaaugaugaaauuccagaacaauguacuuuucucaagcucugcugcaaauuuaacacaaacaucaguguuaauuacacuuugucauguaugacugagcuugcuuuaagcucuuacacugaaaggaagucucauuucaugcacaaaaucuguugcaugccuggcuuccuuaauaaaacuacaguugaacauuuccagugucaaaaaaaauucaacgaagcuaaacuacaggaaaaugcagguuaguagacuuuuaacuaaugcuucugaggaauaauauaaaguuaucaaacugauacuuagaaacaaaagaaaagacauugucaucuugguaauuucauuaguuucaauaccaaacauuauacaaagcauaaauuuuucucuuacaguugucuaauuuaacucaauugugaaucaguauugaggaucaaaagguaauugccccaauucuauuucaagauuugccauuugucuuccauuagugcgaccauauuuaugccauuuaccuucccuuuuauaaggcuguggcugaaggugcuucugcucuuguuuucgaugccuggaguuuucaauauuuaccauacguugcuuuuuaucaggucgacugaaagcaguaaacacauuuuucaucuauguuagaguucaauguauuuaaauuuaaaacaauuuuaaauguuuucuccauuaaucuaugaucugaacacugauaaaagauauuaaauaucugaauuacaauccuaguauauccauauaaaaauaaaggagucuguauuaguuuuuuuguccuauagaaagaaaaaauagacaauaacucuacuggcaaaaaagggaaacacucaaaagauaacaaagaaaagaaaugugacaauaaaauaaugagauguguuuccauuauuuuuccuccuuuccuauaaaaaucagucccuccccgcuggcuuuaucacucagcagaaauacauacacaucucucacaaacaaagcaaaacaaaagucucaacuuuuucuuacagcaaaagcucacaacaccuacaccgcuuuccuuaaugucuaugaucaggcuuccgucacuacuucacuggaaguccauacugucauccccuggccgcccaguuuccaagccaagaaaacauuuuccgcacaucaacuuuuuaaaaagcaugacacauuuauuccuuuuacuugagauggcuuuuggauuuucaagguaccacuccccacuccuguccuuagccuucccuacaaccccauggauguugguguucucccaggagucugauaaauauacagucucggcaaaagagaugaccauagaacuaacugccaacuaacccucuccacuugaaugucaguaguuaccuccaaacacaauucucaucuccaauuacccuugccccaaaccuugaauucccuaucucagugguacuacuauccaacaagaugacccaacccagaaaucuagaagucacuguuacuuucuacuucuccuucacaagaaauaucaauguuacuauuuuccaaauguuuuuuccuuuccucuccuacuaguauagucccaguuuagauguucaucagcucaugucuguauuauauugaccaccuucuagcuucauaccuuucccaucaauccucuaggcugcuaccaauacauuagucccaccguauccacggcuuuacuuucugugauugagguuuccguuaccuguggucaacuguggucugaaaauguuaaauagaaaauuucagaaauaauucaucaguuuuaggcgggguacaguggcucacgacuguaaucccagcacuuugggagguagacauguguggaucacuugaggucaggauuucaagaacagccuggccaacauggugaaaccccaucucuacuaaaaauaugaaaauuagccgggugugguggcacgugccuauagucccagcuacuugggagacuagggaggagaaucaccugaacccaggagacagagguugcagugagcugagaucgugucacugcacuccagccuggcugacaaagcaagauuccaucucaaauaauuaaaaaaaaauaauucauaaguuuucaauuauaugccuguucugaguaauguaaugaaauaaugcaguucugcuccaucccacaugggaugugaaucauccuuuucuuguguauuuacacuacccacccauuaaucaccuaguagcagucuguuaaucagauauacuguuauccuaccacaguguuuguguucaaguaucccuaagauaaggauuaaggaugauuaaguaacuuaauaaugaccccaaaauacaacagugaugcuggcauuuggauaugccaaagagaagcuauaaagcgccuccuuuaagugaaagggugaagguucucaagagaaauaaaaguaugcugagauugguaagaucuauaguaagaacaaaccuaugugugagauuguaaagaaggaaaaagaaauucaugcauaguauauauagaauuauguucuaucccugguuuccagcauccacugggggucuuggaacauauauccugaagauaaggggggacuacuguaaucuaaaauacaauauaaucuuaucccacccgccuugaaaauucuucagaaguucuccauguccuacaggacaaaaccuuuagcauaaaauggggcccuucauggucugcaucucuuauccuccagcucuacccugcuuccuuaaagcaguguaucuucacaucuccaaaugaccuuccuuuuaagugaaauucccuucccugucugcauagcaaauccucauuucucuuccaaaagcuacuuuaaaaacuaaguucaguucaaaggccaccucacucaagaagccuuuccaaacaccuccagacagccugaggccaccaugccccauaccuuaauuucauuuauuuacuuagcuugugagcuccuuugaagcaaaaauuuuucacuugucuccucaaggcagcuucaccuuuguucauuauaggacuagauaccagcuuaaugacuaaagacaccagaaucagucucauuauuuuauagacacauuauauuuauucagaaagauuaaguauuucaaagguaaaaaaugaagcuaacauuugaagauuagguaaguuucauguuacagaauauaaagaugaaaauggauaaaaaauuauuaugaaguacacacauuagaauuugacuugcuuaguuugccucuuugugccucuaccuuuaucaaagauaauuaugugacuaaguaucauaacuaagcugguacauggaauggacaagugaaaauaggugggacauuagaauuauuauauaugagcucuucugacuucagaguaaaauuuguguugcucauuccuagcuuccaaaagugaauaaauacauaaaagauuaaaggaaaauaauuucacuuaaggugaucuuuucauauaaacuauaaugaaaagaaacaaacuuggccaaaguaggauuuuauauauucuuaacugauuuuuaagauaaaaauuaaaccauuugcucaagucaaagugaucacguuauaaugaaauguuccauuuguaacagcuaauaauuuuuagacuccaucuuucaauuuauucugaauucucucaguggccauaaagcacaacucuuagaaacgguaaccuuacaagaaacucaucaaaucauaaaaaugcuauccaaucuacaaauguuacaaacuacuguaaugacacgguuuuauguaaaccgaccuggguccauauggaggggaaaaagugugaccaaagaagugucuauauauauauucauccaacuucucaaauacuccaucauuaucuacuucauauuccuucauguuucuaagauaaucuuuaacaucauuaacaaagucagugaagagcuucugaucauguauaaagacaccguuuaggaaaaacuuauugaugaacugaucaaguucguuccagugacaaaaaguauccaguucuuuuaacauguaccuuugaauuaucugucuaaauucauccauccuuauaggauucaccacuguguuaaaaaggcucauggacucuuguugagcacaaucaaauacaccagaacaagccuuucugaaagaaugagaauuuucucuacaaucaugcccaggacugcauuucuuugaauuuguauuuuuucugaauucuuuaaagugaacuggcuuuucuuuccuuccaucauuuugcauaguagggccucuauuaugaugguuuucuguaggugccuuauacuguggauguaaauagucacuaaaaacuguucuugguuuuucagcugcuucuuuuguagcaccaaaucuuuuauuacccuuuucaucaaagauauucuuggugguaucuuuaaagugucugaaaguggauuuaacugaaucugagaauuuuuucagauuuuccuucacagcuucuuuagccugcuuaauuuucucuuuaugaugccuuacaaacuccuugguagaauucuucauggcaucaaauguuuccuuaacugaacccaaaaauguuuccuuugacuuauuuuuagcccuguggcuuccucugcccccuuucuuuuuuccaucuguuccuuguuuuccauuuugaucuuuugccucaacauacaaucuuucccacaaaucagaacgcugcuguucgaagguuagcuuccguuccagcucagugagucuuucccguaagauugcuauuuccuuuuuuucaguauauacauugggagaaucugacuugccauguaacugacuaccacuuaacugcuggaguuccccccuuaaagccguaguuacuagucguucucucuccaguucucucuuuagcaucuuugcuucugucaacagagucucccuuugacuaagaaagcuguguuuuuucugcuuuuccucuuccaaaugcugcuuaaguuucugauuuucuuuaacuaauucaguacuugucccuuuaucuuccaauauucuaaucuguucucuuaguuuguuuaacucuuccuguaaugaggauaaggcuuuuucuuccuucuccaaggauacucuuaaauacugauuuucuguagcaagguucguuuucugaguuucaaaggacaucuucucugcuucaguaaguguccaacaccuugcaagauuuucuuucaaugacuacauuuuuuuuugaaagagaagaaauaaaaugucaaaugcuuuaaaagcugaauuuaaaucuucaagauauaauaccccauaagcuuuugugucuuuacuucuacagauacaaccccccggguaguauuuucaauaguauaaacauugggaaauacaagguucauaugcaagaaaacgcagagcagagagcuacaucaaauugagaacuacagcaugguguaagaauuuuuuuuuuuuugagauggagucucacucugucguccagacuagagugcaguggcgcaaucucggcucacuauaaccucugccucuugaguucaagcgacucuccagccucccaaagugcuggcauuauaggcaugaaccaccgcgccuggcuggaagaauuuaaaagacagaaaguuagcuagagcuugcaggacuaaaggcuuuucugaaucaggaaaagagauuaccuuuuauaaaagguaaaauuauuagcugggcgcgguggcucaugccuguaaucccagcacuuugggaggcugagguggguggaucacgagaucaagagaucaagaccauccuggccuacguggugaaaccccaucucuacuaaaaauacaaaaauuagcugggcaugguggcaugcaccuguagucccagcuacuugggaggaugaggcaggggaaucgcuugaacccgggaggcgaauguugcagugagccgagaucgcaccacugcacuccagccuggcgacagagcgagacucugucucaaaaaaaaaacaaauaaaaaauaaaaguaaaauuacaucgagagcugacuuacggcuucaaaaauuguuuguacucaguguacccuucaaaggaugaaauucuaacaaucuuaguccuauuugaaacauuuuaguccuaugcaauuaacauuucuaaguaaguacagauaagccauaaauucuauaaccauguuagaagacagacugaaucuugaacauuuauaacuaacuuauccaauuuuaugguaaauuuuugaaguucuguaaucuguacagauuaauauaacucugaagauuaaucuauagauuacuauaacugaaagucagcacccgugguagaaaucauggucaauucggcuuauagaauuuuacugcuucaauaaggguauccuugacugauuugaauuuucuuuuacacauaugcauuaguaacaaaaucuaaccaaaaacagucaaaacuuaaacaauaugguucaacagguucuuaaagcauuauacaucgaguuaaaaauauccuauguauaaaucugcaaaaugauacuuaaauuuggcuuaauuuaucacaaacguuaugguuaccccauuugagucagagcagucaauuaccuggauucagaaauaagaaaaaaaaaaaaggaaaaaaaaauacaaguccuuuaagagaaugacacuaauauacacuugaaaaauaacuaucugaaaugacugcuucacguucuggcucauuaaucuucagagaacaaauaaagauuuaaaauuuaaucacagucauuucaucugcucuaccuguaugagagaaaagaaauuucuucuacccaacagcaguggacuguggaguagaagagacugaugcacugguguggcauaaucuugaaaugcacaagcccaggaagccacaggaugaaagaagaguacagcauuccucgugcaguaaauaugauguugacauaagugauugauaagcagauccugaccaggucuuccaaagagcuucaaaaucuaucugauccacacuuaacagccagaaauaagagaucuguaaaaacugacucucuagcugggcacaguggcucaauccuuuaaucccaguauuuugaggccaaggugggaggaucacuugaacccagaaguuccagaauagccugggcaacauagugagaccccaucucuaugaaaaauuuaaaaaccaaguuggacaugguggcgugugcuuguggucgcagcuacuugagaggcuaagccaggaggauugcuugagcccagaaguuaaggcagcagugagccaugaucacaccacugcacuccagccugggcaauaagaaugaaacccugucucuuaaaaaacaaaaacaaaaaaaacaggccaggcgcagugacucacgccuguaaucccagcacuuugggaggccgaggcaggcagauuaccugaggucaggaguucaagaccacccuggccaacauagugaaaccccaucucuacugaaaaugcaaaaaaugaaccgggcaugguggagggagccuguaaucccagcuacuugggagacugaggcaggagaaucacuugaacccaggaggcagagguuccagugagcugagaucaugccacugcacuccagccugggcaacagagcgaggcuccaucucagaaaaaaaacaaacaaaacaaaaaaaaaacccaaacccaaaccaaacuacaaacucucucuagagguuaaugcguggugaguuuuccaaaagccaauguuauccuauggaaccagaaaacacuguggugaagaagaaaauggcaucuucuaauacagguaggaaaaacugaacuauuuauaauuaacuucagaaguaccucccugugucuacagccauaacacccuaaaugccgccagucuccucugauggcagaagcuaggcagggucuggccugguuaguacuuggaugggagaaguaccucccugaaagauacaauuuaguuacaaaguaguauuuuugucuuuucaagaaauauaaccuguaagggaagcauacauaaauuaagugugagaauuggggguggaaaaaugaaggaaaaaacaauagcuuacuuuucuuuccuuuuccuuuuuuuuuuuuuuuuuuuuuuuugagacagucuuccucuguggcccaggccggagugcaauagugugaucucagcuuacuauaaccucugccuccuagauugaagcaauucuugugccuaagccucccaaaaagcugggauuacagguaugugccaccacaccaggcugauuuuuguauuuuuaguagagacaagguuucaccauauuggccaggcuggucuugaacuccugggcucaagcaauccaccuaccuuggcuucccaagguuaccaacuuugggaauuugggagguugccaccacacccagacauagcuuauuuuucuacccugcauuucucucuacaaccuucuuaggaaaaaacuagauaagagaccagcuauuuugcugauccucauaaacccacagagguguuagguaaugacagaauggacaguacaguccugugagacgagaucuaggugaguuauaggcagaaaaagauaacaugcucucccuuccaucagaauaaaaaaaaacaauggaaaggaauagcuauguccccugaucaagagaagaucuuagagaggcuauaaaaccaaaacucuccucuuucccuccugccaacugaaaauguuugcuucgcucugugaaaauaauguuaauaaaaaugucuauauacacauauaaaaugucacuuauaaaagauguuaacuauaaaauagcagcuagggauaagaguucuuaagucaaauccuuagaaucaauuaauuagcucucccaaacaaaacaaaacaaaacaaaaaaaggccauggccgagcaugguggcugacaccuguaaucccagcacuuuaggagacugagguggguagacggaggucaggaguucaagaccagcguggccaacauagugaaaccccgucucuacuaaaaauacaaaaaaauuugccgggcauagaggugcacaccuguaaucccagcuacuugggaggcugaggcacaagaaucgcuugaacccaggagguggaaguugcagcaaccugagguugcaccacugcacuccagccugggcaacagagcgagacuccaucucaaauaaauaaacaaacaaacaaaaacaaacuagcucugccaguugcuaccuugagaaagucacuuaacuuuucuaaaccucuuuuccaccuauaaaaguuaguaauugcuuaauucacauauugugagaauaagagaaauacucuauaugguacacucaugacaaugacuaggacacacuaaauacccguacucaauucaacaaugaucagcauuauuacugauuuacuaaucugcacuaauaagcacaauaagcucuaacuaauaagcaaaauaauuacuaacaauuauuuuaaauacuguuagugguacauaccuuauaaucuauaaaagauucuuguuccuguugacacugggaaagauaauccuucauaucauucaauucaucuucauguaucuuucugacuaacuguugacgcuucugaaucugaauugugccuaaaauaaauauuuuuauuaaagguauguaacaaaaauauuaucauuaaauguuuuauguauuuuuuaauauugguaaucugcauauaagcuauguagucuuuuuuuuguuuuuuuuuuuuguuuuuuuuuuguuuuuugagaagagucuugcuccauugcccaggcugguaugaucucagcucacugcaaccucugccucccugguucaagcaauucucgugacucagcuucccgagugucugggacuacagggaagcgccaccaggcccaacuaauuuuuuauagagacaggguuuugccauguuggccaggcuggucucaaacucccggccucaagugauccacccaccuuggcuucucagagugcugggauuacaugugugagccacugugccuggccauaaccuauguaaucuugacaaucauuucauucagaguaucagcauuucaccguucuuuaaaaauucugauuacauaaauagagaauaaguaacugaggcugggcacaguggcucacgccuguaaucccagcacauugggaggccaaggcagguagaucauuugaggucaggaguucaagaccagccuggccaacauggugaaacccugucucuacuaaaaauaaaaauaaaauaaaauaaaaaaagaaaaguaaaugaaagcccaugaucaaucauucaucaaaugguggugaacguuaacguaauauaaguaaggccaaguaggcuaguucuuaaaaacauuuauuuacauacacccaggaacauuuaagcaguucacuaucuuuuguauuaaaacacacaggccagcccauauggcucuaaccaagagaacaauuuauguaauguucuuaucuuacuauauugaaggcacucagcuuuguuguuuugggguuaucuuuuaaguacaaaaaguguuucagccucccuuauacagagaaaugaacaaacccugguauuuuuucacaggucguaagucaauaaggaaaaaugaaaauuuuuuuuuuuuuuaauauuuugccuuaaggauacaacaaagcccaaaaaguacagcacagaaaauaauuggcuaauggugauugugcaccauucucaaggccaaauuuguuaagaauucugcaaugguuaaaucuguacuggaguagcacuguccuuaucccaacagugauaaaagaauuggacaggcacaguagcucacgccuguaaucccagcacuuugggaggccaaagcagauggaucaccugaggucaggaguucgagaccagccugaccaacauggagaaacccugucucuacuaaaaauacaauauuagccagggagugguggcaugugccuguaaucccagcuacucgggaggcugcggcaggagaaucgcuuaaacccgggagguggagguuguggugagccaagaucgcgccacugcacuccagccugggcaacaagagcgaaacuccgucucaaaaaaagaaucuuaaaccaacuaggauucuucauauuuucauccuaaaaaucaaaauguuacuuuacucagacaugcuauucacaugcgucauguauggggggaaaaaaccacgaaaucaaaaauaaggcaaaaugcaguuagcaaccuuaacauuacaucuacugaguauagauacuauagaauuuuacaaagaaaggaugcagugaucacuauuucuucccuuacugcuauaaaaauuauuuuaaaugucuucaauacaucuugaaaaacaccaaaaacaacuuuugccaauuuacagguaacuguuacauagucuagcuaugauauucuguguuagaauucauuuccucucuuuagauuucucaauuuauagaagcacggcaagcuuguuucaaaauuacucagcagaaucccagauuuuuuucaaauguugaaauuuaucuauaguucccagaguaacagaaaacuucugcaauuucuauuucaaacugcugagauuaauuccuuugcccacuggaaaauaaucuaaaacuguguugaggucugaauucaagauaguauaauauagcauaugcuugauuacugucuuaauguggccuuuuacaauauuacugacuaaucacuuggggguuuuuccugcaccuucagcuaccuaaagucuuauccucaagauacaaucuuuggccuagucaugucuacaaaugcugccuauuuuaccauguugcagcgcugucagauuuugcuaucacuccuauuaagaauuccaagcuacagaucuuguccuaacuucucaucagagcuucuagccaacacauccagcuguguagggggccuguuuguaggguggaaaaaaaaaaaaaaucaaaccucaacaccugccccaaaccaaauuugucuagaacaaauuuggguaaaaccaaaccaaacugugcuuaccaucuauuuaucaucuggcaaaacuuccccaguaaccccaacuccaaaagugaagcagcuagcacauuuucuacaauuuaauaaauugccauuauuuuccauuauuccuucaaugucccuuauuccauucccacuguuauuccaauugucaagguccuccucaccaaauauccagauuacagaacucuuaacugacugacuauucuacauuuuuccauaccaccuuuuccacaccagcaaaaaguuccggcacuuuuuucucuaaccugauagcagguuacucaauaaaucaaacuuuccuaucuagauuccaagacguuuuacaauacacaguugacccuugagcaacaugaguuugaacuacauggcaggaugcaaaauccagguauauggagaggugacuuuucauauaugugagguccgcagucaagggacuuuaguacguauggauuuugguaugggggugcauccuggaacccaucccucauguauaucaagggaugacuauaauagcaccccaccuauuccauuauuucuaaauaccuacacucugcuguaguccaagcagucuuuucacugcucccaaacccaagauuacgucuuccucagguuaucagauucucugucgcuggaauguuccaccuucccuugagucuaucauaaacuuacuaugauuagacacaacuuaaaucuuaccaccuccaggauaauucaguaaguguacccuuugagcuguaauucauucugugcucuauaacuuagcaucuagauaucuuguuauauaauagucugccgaagagccggguagucuaucaauacuuaaagcaacucgaggagaaaaccaaaucaauugaacuccauugaugauuuggaauguugauagucacaagcaaauguaagaauaagaaagacugcuuucucaugaaacuuuuuaauaaaacuucuggaagcauuuucagaaccaaauaccuggaguacacugccucacuauccuuagucaugcuagcuuucucuucccugcaguauagaucugccaauucaaaucuguauggcaccagggcuggcaaacgcagaaugauucaauuaguaauaugguauuguuaaauuauuauaaagcgggccaggcacgguggcucacgccuauaaucccagcacuuugggaggccgaggcaggcggaucacuuaaggucaggaguucgagaccaaccuggccaacagggcgaaaccucaucucuucuaaaaauacaaaaaguagccaggcgugcuggcggaugccuguaauccuagcuacucaggagggugagacagaaggaucgcuugaaccugggagacggagguggcagugagccaagaucauaccacugcacuccagccuggggaacagagcaagacucugucucaaaaaaaaauaaaauuauaaagugaaugaaugacuaugggaugcaaugaccgacuuuacggugaauagaaaauucaaaacggcucugaaaucaacuccaaagaauguugagaucagugcugaaauuaaaaaaugugaugucuugccaggugcgguggcucacgccuguaaucccagcacuuugggaggccgagguggacagaucaccugaggucaggaguucgagaccagccugaccaacauggagaaaccccaucucuacuaaaaauacaaaauuagcuggacaugguggugcaugccuguaauccuagauacucgggaggcugaggcaggagaauugcuugaacccgggaggcgaagguugcggugagccgagaucacgcacugcacuccagccugggcaacaagagcaaaacucugucucaaaaaaaaaaaaaagugaugucuuuuaaguagugacuuggaaaagucauuuaggucaggucuuguauguuaauucaacuaaucucauuacuauguaggccuacuucauaauauguuauccaggcuuuucauagccugaaaaggcuaauaucaaguaaaggacaauguuuuauuaauuaacuauuaagguaaauuuuacuaauaaccaaaauccuacauaacagagaaguaacuucucauuuugaaagcacuucuguaaaauuauuuuucuacaaaauauucaaaggucauguaaauggugaaguuuuaaugcaauuuggauuaacacuuuaaaucacuauccaauuuuuuuugaaguaagaaaaaaagauuaagauaagaucuucuccauuguuacccucauguuuacuuguggagggaaaaucauacucaaauacuuauugauuguuucagcuagauagucuauaaagguaaauauauauuucaaaucaaaucuuauuacaacaaauuucaagaaaggauacaaauaauaguaucucaguauuaaauucaagcagguauccaucagaaaucuaaauacauauuuuuauuaauauaaauacaagaaacaucuugcaagcucugacuuuaaacagguauugucuucauuaaguuuauucuaacauuacgcuauguugaauaauauaccuuuuccacaaauccacauaggguacauguaauucuucaaucuuugcauaagaaauacauuuuucgaaugaacuagcaaaacgaaaaguuaagacuguggauuaugcaggcaaaaaaaucuaaaaguaguuaauguaaagcaagcuaaaauuugggaaguugacaagaucuaagacauuuccuuuuaaagugucucuaccccaaauuccaauauagcaaagagagucaaaguucagguuucaaauacuccagucauuguacaaacacauaccuuaaauaagagacucaggccaggcacgguggcucaugccuauaaucccagcacucugggaggcugagugggguggaucaccuuaggucaagaguucaagacuggcugggugcgguggcucacgccuguaaucccaacacuuugggaggccgaggcggguggaucacaaggucaggagauugagaccagccuggccaagauggugaaaccccgucucuacuaaaaauacaaaaaaauuagcugggcgugguggcaggcgccuguagucccagcuacucaggaggcugaggcaggagaaucacuugaacccagaggcagaggcugcauugagccaaggucgcaccacuggacuccagccugggcgacagagugagacuccgucucaaaaaaaaagaaaaaaaaaaaaaaaaagacuucgagaccagccuggccaacauggcaaaaccccgucucuacuacaaauauaaaaaaauuagccaggcaugguggcgggcgccuguuaucccaguuacuccggaggcugagguaggagaauugcuagaacccugggaguggaguuugcauugagcugagauugugccacugcacuccagccugggcgacagagugggacuccgucuccaaaaaacaaaggagagagucaaugggugaggcuccuaaaugaaaaaguaaaguaacaccaauagaauaccuuccucuucucacccaaaaggcauuuaaaagcuuugaauugauaagauaaucaacauauauaaacaguaucaaucauaauaaagagcaaaguauaagaacaaagaugacaaacucucaauucaugugaaucacagaagcaacaaugaaaguuacaaaguaugauacuuacaugaaaccucaaaguagaaauaaugaacacuuauuauuuacacauuucaaauguaacuauuucaacugggauuuaaauaaucuuccuaauaaagucacacuucaacuuaguuuaagugugauucuaaauguaaaugauuugccucauggugagcauuucagauuuuuaaucuuccaaucuuuuaacuuuaaaagagucacaaacauauaugguuauuauccuuacauuucuuaauaacuacuaccuuauuuaaauaaaaagcuuugugagauaggcagcacccacuucccgaaugagaaaacugaggcucaaacaggcuucaaguuuucaaggccacacauuuaauaauggcacugaaaacagaucccaagaguccucacucuuaaguuccucuacacuaucccaucagguuauguauaacacauuuuugaguacuuaccauagaaauggccaaaucccaugcugauugcaaucaccaaagcaaguauaacacacuuauugagaccacuacugaacugacguuuacucaacuccuuagaagguucaguuucuuguucagcaacuagccggucuucagauucugaagcagaaacggucuucuuccuagcacggcgucgucuaaaggcaggacugggcugauuacugguuucaucacuacuugauucaucgucacuaggcugagaugaaaauacuauuaagaaaaaaguugacauuuagcuauucaaaaucuuggaaaagcuuucccaguaaaaauuauuuagaauaaucaaugccaucccuuacaugccuuucuacauaagauagccaaaaacaaaaaccaaacaacauaaacaaaaacacggguuuucaacucaucaacauaaagccaaaacauaaagcauuucaaaugugauacacaagaaucuguuaaucauacuauuuggugcuuugagagccuaucucuguuuuuuuauuuaauccuccucgccuuauaguuuacacucuuagaacaauccuucauucgcauagccucaaguuucauugcuggccaggagcaguggcucacgccuguaaucccagcacuuugggaggccgaggcgggcagaucaccugaggucaggaguucgagaucagccuggccaacauggcgaaaccccuucucuacuaaaaauacaaaaauuagccgggcaugguagugcaccuauagucccagcuacuugggaggcugaggcaggagaaucacuugaaccugggagguggagguugcagugagcugagauccugccacuauacuccagacugggagacagagcaaaacucugucucaaaagaaacaaaauuucauugcuauuacagguauaaacaaguauuauuucuggaaagaaaaaaaauacucucugucucuucauucaguuucaaagagguaauuuaagugcaacuauuuaaggaacacaggaaaguacacaagcauuuccugugacuuauaaaguaaaauaacuaccaaaaguuuccuuggguguaucuggucucuaguuucauuuccaaccuaauuagcccaugaucaagguucaaagcacuguauuuuaacauagguuuccagaagucagaugagcccuucccuucgacugccacucuuacuagaagguuauuaauuuuacccucuaguaaauaugucagcaugaggaagugacacaacagcuaucuccgauauuaaggacuauucuggugcugcuccuuuaugaaaauaauaguagagaaaaacaaacuaguggggaaaauuugcacaagaaaucccaaguccaggaaacaaauucccuggaaaaaaucaccuucaguuuuuuccaaaugcauaauuucuuaacacuguuucuuaugucaacaaacuauuauguugacacagaagcuucaauuacucagaaauaauuuccacaagcuacuuagaggaaaagcacuaaaaauaaggauaaaauaugaacucgaauacaaagagcucuaaaacaacaaacauucaugcuccagaaaagcaaaaacaguucuucagaagacaggauauccaugccacaggaaagcuggugauuuagguuaggcaauauuuuucagagauggaucauggaguauucaguucacuuucacacuuacaacaauaaacacaaagacagaaggcacuacugaaaugaaugaauauuccuaauauuuagugauacagaugccacugagagaucuuuuuggucaugacccuuaugcccaucauguuuaucugguuauucuugaucacuaguuuuucaaagaugccgucgccucaggugugagauuauauuucuuggacaaagagaaagaaaggaagacuuaaacaaagcauuacauaauacaaaggcauucaugaucaugguuagaguauuuaagucaggcuuucugacauaaaauuaagauagguaaauguaaaaacaaaccauuuguaaaacuuauuuaaauaauuguucaauucuacauuaacauuaccuucauuauauauucuaacaaaacagccuaacccacauuaauauauucauguccuuaucuaaugcuuccaacuuuuuuaacccauacauauaauagcugaaauauuuugauuuuuaacuucuuuuaaaaaagcuuaauuuggcccauagaugcaagcaaugcaaaggcaugcaauaagcuuggccagcuccuuuacaagagauucugaacaccuguuuagaguauugcggaugacaacagguaucuuuaaagcacucgguaaauaguaaaugugacuaggcacacucagcucuagagaagcuggucagauuuagucacaccaccuuggaaagcgaguuggcuaggaacaugguguuucagcugaucaucccauccccauaugcacucaggaaucuuccacagcuucucccaccaccuuucuuuugugaauaaacaggaaaaaaagaggcauaaagcuauauuauaaagacuaaaaagaaaaaaaagaauuaaaaauacuuaauuaucacuuaacauuguuauccguacaaaauuaaaacguaauaaccaugccuucuuaaaaacacacaauacaaacuucucuacacuaccaacuuugcuuuuugucagggaagagaguucauaaagaggaagcaggcaguguucuuaacccaacaaaacguacacugccacaagaauauaagucaggagaagaaaaaauugaaguugaaauccuuaaggaugaagaaagggaaaggaaaaaacaaaauuaagcaauggcuagcacaaaauuaacaaacuaaaagggaaaaacaaaaaccaucuuuuuuauuuuuuugagacggggucucccucuauugcccaggcuggagugcaguggcgcaaucuuggcucacugcaaccuccgccuccuggguucaagagauucuccugccucagccuccagaguagcugggauuacaggccugcgcuaccacaggcagcuaaucccaaguagcugggauuacaggcaccuggcuaaauuuuguauuuucaguagagaaggguuuuugccguguuggucaggcuggucucaaacuccuuaccucagguaaucugccugccucagucucccaaagugcagggauuacaggcaugagccaaagugcccggccccaaaacaaaaacuuuuggcaacugguuuauaugcaguguuuucaguauaguccaaaauuucgucuuuaaacauuugguuuauugaaacaauaucuuuaggaggaauaacaauggguaaaaauacaguuaaucaaauauuccucuuaguccacaaaaaucucaagaagucagaauucagaaagaagauaaauauuagaagaauggucuuagaacuauacaacuuccugaaaaaaguuaauauguaauuucuuucuuuuuuugagauggugcugggauuacaggcgugagccaccacgcccagcaacaguauguaguuccuuuuacgucuaugucaguuucuuauauaucugaccauucuauaauacucuggcuucaauuugacuuuucugggccaugaauauucucuaauuaaaccagaggcaggaaaggaagcggggguggggaaacuaccugaauacaacacaaauccuggaguuuaaaaaaauaauaauaaaauuugaugacuaacaaggauucuaaaaucaauuacaauaccccuccauaaauaaagauacuaugaaugcuauucuaacaaagccugaaguuuuccucugaacaucaagaaugucacaugaauauucaaauagcuggaaaaaguguuuucacguucauguuuauaggcaaaccacugauauacuaacugaaaauaacuucucauuaaaugagauagccaagaaucucuacuuuuuuuuuuuuuuuuugagacaggauccugcucugucacccagguuggcaaucugggugcaguggcgcaaucucagcucacuacagccucaaccucccaggcucaagcaauccucccaccucagccucccaaguggcugggaccacaugcgcacgccaucaugccuggcuuuuuauuauuuguagagaugaggucucgcuauguugcccaggcuggucucgaaauccuggguucagguaauccaccugccucagcuuuacaaagugcuggaauuacuggcaugagccacuaugcccagccaagaaccucuacuugacauuuuauuagcuuaaacuggaaugacagaaauucuauugucugauucugguuggcaaauguaaauauuaaagaaugguaaaaucuaaaaaaauuaucuaaaauagauacuaccuguuuccuguuucuucgucaaauuaggaaauuuuuagaaucacuagcaguguuucaaguugucucugccauaacucacgcuuaguuauaauuguggcuuaauaacugauauauccaggaacuuuauaccuacauacuuacaucacauuaaaagauguuauacauacugcuaaaacugagcugaagcauagcagaaagaaaucaagcaacucacacuuuaaucucugaaugagucugucuguacaacgggcauugauugcauuaaaaauguggcuuacacuagugacauuuucauaacagaaucuaaaacaaaagaucugaaggucacgagcuuuggaagacuagcuguauugauagcaccuugaacucuguuucacauaugguagguacucaauaaauguuuguugcaugauuaauaauugaauauaucugaagagacuuuaauaacaauuuuuuucacuauuucuauauuacaaaauguacacuacugcaagcaaaaauauuaacauccccaaucucccacucuuaaagaucuaaaaagcaccaaaagaauuuuggagcauuugugauuuuaacaaaucucacugaagcaauuuugucuucuauuuaauggcaaaagaugguuacuguuacaguaaaagauugcuaugcuccagaacagucuagcgaaacacuagguauuaauagauuucacacacaaaaauagucuugucuugaguuuuacccaaacauauucaaaacuagagacuaaauuauuagggguagaaaacaagccuuuauauaaaauguggucguacaugucuuuaagucucuuaucaguguauucuuaccaguuucuggcugacagaaaguauacuggcugcuagaggaagagcccauguuaaagucuucugaacucugugcuucuucaacaaugacaacuucuugauuuccaauuucuucuaacuuagguggcucaaggguaacaauaucagaaucaucacuggcaguuccaauauagauacugucuucggguaucuuuuguuccucugccugaagaaucauaauuuuagagaugguaaguucaacaaucauuuaagggucuuacauuuucuuagaauacaacaguaguaaguauuauagucaucugaguuaaaauaaaagauaugauuccuacuauuaguaaagaauuaugcaauagcaggcucaucauauagcuugagaacaccaucagaucccuugacaacucucagaauuagaucagaccacugcauucuccuagugggcugcagaagcugagaagcccaucuuugcccccucaauaaccacagaaaaaagagcucacuucucucacgaguuccaugguucuauucgagcacaacucuguaguguggaagcccaaaaaagacucacugaacuuuuuagguuauguacguaauaaacuucaacagcuguaucuuguacugaauguaucugaagguguccccacaaauuucuacgcuggaauguaaucgccaaugugauaguacuaagaagugggaccuuuaggaggugacugaguuauaagggauccuccccuaggaauaugauuaaggucuuuauaaaacaggcuucaugcagcauccagccuuuuuuugcccaucuccucuuaaagauguagcaacaaaaugccauuuggaaacaagacagcaugucaucagcaaacacugaacuuguccacacuuugaucuuaaacuucccagccucuauaauugugagaaauaaauuucuguuuguuauaaaucacccaguaucagguauuuugucagaucaguacagacuaaaacaccauguaaaaugaucaucuagcuaucuaguuuuauacagaagucaaguaaaaccccaaagcauaagucucagguuguuaccaaauuuuaaaaugaaccaccauuuuagacaugaaaccuaacaguuuaauuuuucaauauaauucaagaaugcaaucuacuuccaaaaagaauuauauuagaggugaaaagauagaucuuuaacacaauaccaauaaaauacuuugcuuagauguccucuaagacaucuaacuuagaagucaaaauugcuuauaauucaaaauaggaauagaaugcauaaauagaauuagaggcuuuaaauaguauucuaaggauacuauuuaacauauauccacaguguaaaauacaaguuuaccucaauuguugagcugguuuccuccaaagcuggauaagcaguuucuuccauaagcacugugccauuuuggcugcuuucugauauaaagcaaagaucaauauaauuauuucuuaauuuaaaacucucuguugacuuucugcagccaacauauaaucuggguagauaaaaaucucuuccuaauauguuaggauagauuuaaugaaaugucacauacaauuauagaagucacuccacuguugcuaaugaacuucauuuauuugaaacugucaggugauaauuuuggauaagaaaaugcaaucauuuaagauuuuuuuuuuuuuuggagauggagucuugcucuguugcccaggcuggagugcaguggcacuaucuuggcucgcugcaaccucugccuccuggguucaagugauucuccugccucagccuccuaagcaacugggauuacagacauacgccacggcuaauuuuuguauuucuacuagagauaggguuuuaccauguugcccaggcuggucucgaacuccugacuucaagcgauccgcccaccuuggccucccaaagugcugggauuacagguaugagccaucgugcccagccacaagauuuauuaagaacucaaagcuaccuugacuaaguaaauaaaaccucuaccuuacauuaccaaauuacuugauccaguauguucauuaauaccuaauaugaaaaaaucuaucauuagauaccuagugauacauuuccugaauucuuaaaaguuuauucgaaguuucuaaagaccauucuaauggcugucaaugccugguaccguaagaauaaaaaccguggcuucaaacuaugauuuaugaaaguauguauguauauguacgugugugugugugugugugugugugugugugucuaaaugccuuauaagaaaacauaaacuauaaaaaacaaggacucaggcggggugcagugacucauaccugucacccuagcacuuuugggaggccaaggcuggaggacugcuugacgcuacaaguucaagaccagccugggcaacacagcaagacccugucucuacaaaaauaaaaauuaaaaaauuauuugggcauggugguaugugccuauaguacuagcuacucagaaagcugaggcaggaggauuacuugagccuaggaguugaggcugcagugagccaugaucaugccacugcacuccagccuggacaagagagugugacuaugucucaaaaaaaagucagagagagggcaguccaggcacaguggcucaugcuuguaaucccaggacuuugguaggccaaugugugagaaucacuuaaagccaggaguucaaaaccagccuaggcaacauagcgagaccaguucuaccaauaauuuuuuuuaaaaaagaaagaacucaaaacacagaaaaacuaaaugucacuacagaagauauauuuuauaagaaccuccucaaagaaaauguguacaaacagaaugaugacuucacaauauauuuuuaaugaaaaagagcauaaaggccgggcacaguggcucaaaccuguaaucccagcaguuugggaggccaaugcaggugaaucaccugaggucaggaguuugagaccagccuggcuaacacggugaaaccccguuucuacuaaaaauacaaaaaauuagccaggugugguggugcgcgccuguaaucccagcuacuccagaggcugaggcaggagaauugcuugaacccaggaggcgaagguugcagugagccgagaucaugccauugcacuacagcuugggcaacaagagugaaacucugucuuaaaaaaaaaaaaaaagaaaagagcauaaaauauuaagaaaaguuaaaaauaauauaacauauaaauuuaugagcaaaguacaccaaauaucaacaguaauuauuucuagauaaaagaauuauagaccauuuuaaauuucuuuugcuuacuauuuuuuuuucccuaucaugaacaugcauuucuuuuuguuuuuuuuuuguuuuguuuuguuuugagacggagucccccucugucgcccaggcuggagugcaguggcgccgucucggcucacugcaagcuccgccucccggguucacgccauccuccugccucaggcucccaaguagcugggacuacaggcgcccaccaccacgcccggcuaauuuuuuguauuuuuaguacagacgggguuucaccguguuagccaggauggucuugaucuccugaccccguaagccgcccgccucggccacccaaagugcugggauuauaggcaugagcuaccgcgcccggucgaucaugcauuucuuauguaauuuaaguccugcaaagaacagggaaaaaaaaauauuuuucagcauuauauacccucuaacagaaaauuaauuaauuuagaggugagauuccgccacaguacucggccggggugcuggggccaggcgcggugacucaugccuguaaucccagcacuuugagcggcugaggcaggcagaccacgaggucaggaguucaagaccagccugaccaacauagugaaaucccgucgcuauuaaaauggccgggcgcggcggcucacgccuguaaucucagcacuuugggaggccaaggcggacagaccacgaggucaggagaucaagaccauccuggcuaacacagugaaaccccgucucuacuaaaaauacaaaaaauuagccgagcgugguggugggcaccuguagucccagcuacuugggaggcugaggcaggagaauggcgugaacccgggaggcggagcuugcagcgagccgagaucccgccacugcacuccagccugggcaacagagcaagacaccaucucaaaaaacaaaaaaauuaggccgggcacaguggcucaugcuuguaaucacagcacuuugggaggccgaggcagacugaucaggaggucaggaguucgagaccagaguggccaacauggugaaacccccgucucuacuaaaaauaaaaaauaaaaaaaaaauagcugggcauaguggcaggcaccuguaauccaagcuacacaggaggcugagacuugaaccggggaggcggagguuacagugagcugagaucauugcgccacugcacuccagccugggcaacagugcgagacucugucucauaaagaaaaagaaaaaaaagaaaauuuucuuuaacauaugcaaguaaaugcauuucuuggaagaaacuguccauagcuuucagauucucaaaaggaucucugacacaaaaaagaugagaaucacuuuucaaaugagaguaguaauaaucaacguguaggcuuaaaaaaauuaacagcuauaaucucuucuauuucuggccuugacacauccacuuuuuucuccugaggggaaauguucuguaugcauuuuacuguaauuuuuuuaaaaaguuaaugaaguaauuuaaauaugaacauaaguguaugcaguaauuguucaggaguccuauuucucuauauaaauaaugugugcaucaaaucccaugugaaguauacauaauacagauuccauuuuaccagauuggaaccagaguacaggcauaucucagauaucugcaaguucaguuccaaaccaauguaauaaagcaagucacaugaauuuuuugguuucccuguccauguaaaaguuagguuuacacuaugcuguaaucuauuaagugugcaauaacaucaugucuaaaaaacuguacauaucuuaauuuaaaaauacauuauugcuaaaaagugcuagugaucaucugagccuucagugaauuguaauauuuuugcugguggagagucuuacuucaaagaugauggcugcugacugaccacugugguagcugcugaaggguggaguagcuggggcaauuucuugaaguaugacaacacugaaguuucccacauggauugacucuccuuucaugaaagauuucucuguagcaugcaaugcuguuugauagcacuuugcccacaguagaacaacuuucaaaauuggagucaaucuucucaaacccugccacugcuuuauuaacuaaguuuguguaauauucuaaauccucuguugucauuucaauaauauucacagcaucuucaccaagaguagauugcaucucaagaaacuacuuucuuugcucauccauaagaagcaacuccuuaucuguucaaguuuaucaugagauuacaacaauuggaucacauuuucaggauccacuucuuuuuuuuuuuuuuuugagacagagucucgcucuguugcccaggcuagagugcaguggcgcgaucuuggcucacugcaagcuccgccucccagguucacgccauucuccugccucagccucccgaguagcugggacuacaggcgccugccaccacgcccagcuaauuguuuguauuuuuaguagagaugggauuucaccgugugagccaggauggucucgaucuccugaccucaugauccgcccaccucagccucccaaagugcugggauuauaggcaugagccaccacacccgaccaggauccacuucuaauucuaauucucuugcuacuucuaccacaucugcaguuccuuccuccauuaaagucuugaaccacucaaagucaugaagguugaaaucaacuucuuccaaacuccuguuaauguugauauuuugaccuuuucccacaaaucacaauuguucuuaaaggcaucuagaauggugaauccuuuccugaagauuuucaauucacacacauugcccagauccaucagaacaaucacuaucuauagcagcuacagccuuacaaaauguauuuauuaaauaauacaaccugaaagucaaaacuacucuuugauccauggacuacagacuggauguuguguuagcaggaaacaaaguaacaugaaucuccuuguacaucuccaucagagcccuucggugauugaccagguauugcuauacaaugucuaguauuuugaaaggaaucuuuuuguucugagcagcaggucucaacacugagcuuaaaauauucaguaaaccauguuguaaacacauggcugucaccuaggcuuuguuguuccauuuacagagcacaggcagaguagauguagcauauuuuuuaaggguccuaggauuucucaaggcaugguaaguaaacacuggcuucaacuuaaagucaccagcuacauuugccucuaacaagaaagugagcuuguucuuugaagccuagaagcagauauugacuucucuguaguuaggaaaguccuagauggcaucuucuuccaauagaaaguugugucaucuauacugaaaaucugcugguugggguagccaccuucauccauuaucucaguuagaucuccuggauaacuuggugcgccuucuacaucagcacuugcuacuucaccuugcacuuuuauguuacggacauagcuucuuuccuuaaaccucaugaaccaaccucagcuagcuuccgccuuucuuucuacagcuucuuaaccacucuuagccuucauagacuugaagcaaguuaggaaggacuuguucuggauuaggcuauggcuuaagggaauuuuguggcugguucaaucuucuaccaagaccacuaaaauuuucuccaugucagcaauaaggcuauauggcuuccuuaucauucauguguucacuaagaaggacuuuuaauuuccuucaagaacuuuuccuuugcauucacaacuuggcuaacuaucuggcccaagagacuuagcuuuugacaugccuuccucaaauaagcuuaaucauuuuuagcuuuugauuugaagugagagacacacaacucuuccuuucaccugaacaccuggaggccacuguaggguuauuaauuggccugauuucaauauuguuguugucuccaggaacagggaggccaaaggagagggagagagaugggggaauggcaagucaguagagcagucagaacacacacauuuauuaaguucacugucuuucauaggcacgguucauggugucccaaaggaauuacaauaguaaaaucaaagaucucugaucacagaucaccauaacugauguaauaauaaugaaaaaguuugaaauaugacaauuacaggccaggcgcaguggcucacgccuguaaucccagcacuuugggagguugacacagguggaucaccugaggucaggaguucgagaccaggcuaaccaacaugaugauacuccgucucuauuaaaaacacaaaauuagcugggcacgguggcgcaugccuguaaucccagcugagaggcugaggcaggaggauaacuugaacccaagaggcagaggcugcagugagccaagaucauaccauugcacuccagcaugggaaacaagagcgaaacuccgccaauucaauucaauaaaauaaaauaaaaauaaaugaaauauuauaauuauaaaaaugagacacagagacaugaagugggcauaugcuaucggaaaaauggcauuaauagacuugcucaacacaggguugccacaaacuuucaauuuguaaaaaauguaguaucugcgaaguacaauaaagcaaagcagaauaaaaugagaggcaugucuguaacuccaucaacaugauaauaacuggaaaacagguuaguaaaucucuugugaucaaugaauaauuuuuuucuuaacuuuaauaaugacaaguaaauacaaacuaccaaacaaaugacaaggaaauagaaacuaccaaacaaauucagauuaaaccaugaaacacuuuuuuugucacugguuaccucuguagcaacaaaguguaucugaaaacccaaaaauauacuacagcugcaaauaaaccccuggggcaggcugaugacucuggguucugugggccuucaccaaauccacacugaaguuuuucuuuguuuguuuguuuuaaauggagucucacucuguugcccaggcuggagugcaauggcacaaucucggcucacugcaaacuccgccucccagguucaagcgauucuccugccucagccuucugaguagcugggauuacaggcaccugccaauacacccggcuaauuuuuuguauuuuuaguagagacaggguuucaccauguuggccagacugcucuugaacuccugaccucaaaugauccgcccaccucagccucccagaaugcugggauuacaggugugagcuacugugcccaaccuacacugaaguucuaauccuccaacgaccccuuagauuagccagaaaggccacccaccuggaaagaaggcaagacucauaauaucacucauauaucauauuaaaaaaaaaauuagaauuugugaacaacuuaccuccuugcucuaucugcaaugcuugaagcuccucuugcucuaaagaugaacauucuggggcgggcucacagcugucagugggggucacagaauucaacauuucuauaucugaccccuaaggaaaagugauaaucuuucaguuauuugccuauuagcuccucaaagcuagauuugacuacauguaaaugcuucuuccauuauuaaaagucucagaugcugccauacuccaaaggaacaguaucuaauuagacaagcuuuuguucaauuuaguccacaaaggccuauggcaggaaaauggcacaauggagucucagguuuaaauucuaagucaggucagcccaaaaguggaaugcucuauuuuaugagcucaagcaauaaauuugaauuccagagaauaagggucuaaauuugguuauuucuauaauaauuuguuucuacuuaacauuuauggaacuacucuagacaaggcacuucgcuagaugcugugggauauaaaaaauucaaaucuggcugggcacgguggcucacgccuguaaucccagcacuuugggaggcugaggccgguggaucacaaaaaaagcaaaauuccgucucaaaaaaaaaaaaaaaaaaugaaauccaaaauucaauuuuacaacauauucagagaaacacccauaugcaaauaacuacuuauuauggcacuauaaacuaaaaauggcuaaagcuuuaaugacauggauuaaauaaaccuauaggguuaaugaauacucuccucacacaauuuuagacuaucuuuuuauucugagguuaucuuuccuacuuugaugucagacugucuuuucauuaauaauagcggaucauacaauuuuucuuugugucuuaauuguaaaacaaaguuaaccacuaaggugauuccgucuuucccuauguccccacuauagucugcugacacauggaaucgaaaggucugcauucucuugcguauacauaacucaagacagcaaaaauuaaaagaauucaugaaaaaaguagggccggggcaguggcucacgccuguaaucccagcaccuugggagccugaggcgggcggaucacgaggucaggagaucgagaccauccuggcuaacacggugaaaccccaucucuacuaaaaauacaaaaaaaaaauagccgagcgugguggcgggcgccuguagucccagcuacuccagaggcugaggcaggagaauggcgugaaccgauggggcggagcuugcagugagcagagauccugccacugcacuccagccugggcgacagagcaagacuccaucucaaaaaaaaaaaaguaaagaaaaaaguagcguuuaaguugagcccuaaugagaauucggaaugcaagacuccgagguugucuauaguggcaggagaaugguagaggcuaaagcaagguuauguauuaggaauugcuggggaaaccaauucuggcccaaaugagaauggcaguaaugggagaggaaaaggagacacauguaagagaaauuagcaagaaagaguagaaccuggaaagcagauauagaagaagagagauaaaaguacaaauaugauucaaucugggacauaacauccaguacagaacacccuaaugacacacuugacugagugccagacagaggucugcugucauacuccacccugcagacuaacagguaagacucccauagcugccuugcuccuauauuguuaauuauccuugaaggagaaguugcuaugggaguugaucuaauccuuugaagaaaacaagcuaaaaauagaaaagucacugaagauuuuaaaaagaagaaucaucucaaucucaaaugauagaugcuuuuaaauuuugaaauuuuaaugcagaaaaggcaaucuuguuuuuuucuguuaauguuuucuaaacauaacuaccugaaccuuaacuaauaguuuaaaaaacaaaaauuuuuuaauuuuuuuuuucuuuuuuugagacaguuucacucuuguugcccaggcuggagugcaauggcacgaacucugcucaccgcaaccuccgccucccagguucaagcgauuguccugccucaaccucccaaauagcugggauuacaggcaugugcgaccacgccuggcuaauuuuguauuuuuaguagagaccggguuucuuccauguuggucaggcuggugucgaacucccgaccucagugaucugccccgaccucggccucccaaagugcuggaauuacaggcgugagcaccacgcccggccuauaauuuuuauuaaaaaaacaaguggccgggcacgguggcucacgccuguaaucccaguacuuugggaggccgaggcgggcggaucaccuggcgucgggaguucgagaccagccugaccaacauggagaaaccccgucucuacuaaaaauacaaaauuagucgggcgugguggcacaugccuguaaucccagcuacuccagaggcugaggcaggagaauggcuugaacccaggaggcgaagguugcugugagccgagauugcgucacuguacaagacaacaagagcgacagccuggacaacaagagcaaaacuccaucucaaaaaagaaaaaaagaaaacaagugaggcuuacaauacccuaaaaacaaaugggaaaauuauagauguccauuaaaaccuggaguaaaaccuggaguaaguauauuucuguuuaucaauauacugccauuuuucuacagugaacauauauuacugguaugaaaaaauaaacaaaauguacaaguuauguauacuuguuguauguauaucaaucuucuauuauaaaauucauuuugugauaggguucuggccuuuucccugugaaguucugcuauaacguaaauggaacacauguucuccauucuccuuucugaucuguucaaauccaggaucuauuuucuagcugcauaaucuugaccaaauuacuuaaccucucuaagcuuuaguuuucucaacuauaaaauaagaaugaaaacaguauguaucacagugaaauauucaaaauuauuuaagaacaggguaugguggcauaugccuauagucccagcuacuugggaggaucacuugagcccaaggaguuaaagguuacaugguacuaugauugcacaugugaacagccacugcacucuagccugggcaacagagcaagauccugucccuuuaaaaaaaaaaaaagacaaaauuggccaggcacaguggcucacaucuguaagcccagcauguugggaagccgaggcagauggaucacgaggucaggaguuuacgaucagccuggccaagauggugaaacucgucucuacugaaaauacaaaaauuagcugggcaugguagcaggcaccuguaauuccagcuacucaggaggcugaggcaggagaaucauuucaguccaguggggcggagguugcagugagcugagaucacgccacugcacuccagccugggcaacagagugagacucugucucaaaaaaaaaaaaaaaaaaaaagacaaaauuauaugaaaaugaaaguaaagcacagggccugaacaauaacaaaccuucaauaaauauuugccuaaugucucaaagcuauguacaauaauguagaagaugcuggcucaugaagcguuuucagcagugaaguuuaauaugagagggaaaauguccauuggaacuuuuugcuuaaagguagaaaaagacugaucuucaaagaacacaguuuacaucacugguaacauuaauauuacaaauuaccuuauaaaaaguauuaaauaucauaccucaugacugaugacaguccaaccacaagaugaaucacugucacuggaauuuucagacaucuuucaggucuacaaauacaaaaacauauugacucaugagacacauuuuuuuuaauucuauaggaagcacuauaugugacacuaaguuugaaaagugguuuacugucuuccaggugaaacagagacaagccacccauagauuuaccauacagaacaugacaggacugcauaccuguaugaacagauagaagcaaacuucuaagauaaggagacccuccuggacuagaacagucucaacaguuauauuguuggaaugaaggagaaaguuaugucuaaaagaaaauguagcauuuggccagacagaggugaaggaaaaggauaaucgugaauggggagcaggcagcaacaguaaaggacucuauuuucaaugaacaguaaggugugaaaaacaugacugcagaaacugagaagcacagggaaacugaaaagcuccuaugccaagaaaaugaagucuguauguuggcaacaugaaguaauuuacauuuucaaacauagaagaaacaugaugaaacuguuuugagacggagucucgagcugucgaccgguuggagugcgguggcacgaucucgacuugcugcaaccuccgccucccggguucaagugauucuccugccucagccucccgaguagcugggacuacaggcgcgugccaccacgccccacuaauuuuuguauuuuuaguagagacgggguuucacuauguuggccaggcuggucgcgaacuccugaccucgugauccgccugccucagccucccaaagugcugggauuacaggcgugaaccacugcgcccggcaaucaaacuguuuuuaugaaaauaacugugucagcaauacuucaguuguguuaaaguuggggcaggggggaagacaccagagguugguuacaaacaucuggucacuggcaacaaccuggacucaagcccuaagccagcauacaauggucacuccaccugguuuuuucuuuuuguaucugaaacuccuuuaaacuucaaaacccaacuuaguaaagcaaauaguacuccuacugauuuauucuacaugugucuuaugcuucuguuauuggacauauacugugaacacauuagauccaaguucuaauagaacucuacugaagacaauauggaacuagugcucaaaugagaacagggcaaaaauacagaucuauauaaucuguuuuuggggguuuuguuuuguuuuuugguauuuuuaguagagacgagguuucacucguugcgaauguuggccaggcuggucucaaacuccuagccucaagucagaucuauauaaucuguuaauuauucugaaaacuccuguacauuaauauuucaaaaagagaggauacaaaaagguuggucgcuaauaguauaaaaauuaacauguuucaaaugaauuauucaaaaccugaaauaagguaucaauuguaugacuuuuaauguuaugacaagagcauuuuguaauaggcucaccugaggucaucuaauuguuuuauuucuaauuucaauuaaggcccaggcaguuuauaacucuacaaauuuaaaaguaaacuuacagaaaacuacuacgguaaaauaaauuuuuucuguccagucaguagagguuauccaaaaagcuacaguuuaaauacccuguaggauauuaaccacguuuauaucuuagcaauuuuauuucagcauucuuuauuaaacugacuauauuucuuuucuuuauuuugagugugacagggucccguucugucauacaggcuugagugcaauggcguaaucauggcucaccacaacccugaccucccaagcucaaucgauccuccugccucagccccauaaguagaugggcaugugccacuaugcccagcuaauuuuuuguauuuuuuguagagacaacguuuggccauguuggccaggcuggucuggaaggccuggccucaagcaauccgcccuccucagcuucccaaagcgcugggauuacaggcgugagccacugcaccuggccuaaacugacuauauaaaucccaauuucucauuccacuauuuuucaggacuuucaaaaaaguuuaugauauguaucaaugucuauuuguaugagaaucauguuuauaauagcuugaaaauuaugcaaugacagaaauacacaaagacugagcaauuaaauuugcagggggaaaggagaaugaucaaggaaaucucuauaaaugaggcugcaaauuugauagcauuuuuuaaaguaaauuaacaguugucaaaauuuaaaaauugagauacuacauuaaaaugaagauuucuggagccggaagcaguggagagugccuauuaaucccagcuaccugggagacugaggaaggaagaucccuugaggccaggaguucaaggcuguuaagagccauaaugaucaugccugugaacugccauugcacuccagacuggguaauacagugaaaccuugacucuuuaaaaaaaaaaaaaaaggggggggggggcuaggugugguagcucacgucuguaaccccaacacggagaggccaagacggaaggaccgcucaaguccaagaguucaagaucagccugggcaacauugcaaaaaacaaacaaaacgauuucugauuccuaaaaaaaaaaaaaaaaaaucaaaagaucugaugacaaggaaagaugucccagugaaaaaggaaaaagcaucacacaggaaaaacaaaggcagaaaaauguaaaagaauaugaaaguucuuuaaaaaaauaaaaaauaaaaaagacaaucuaguacaaauauaguuuaaaagaucagauuugauuuuuuuuuuuuuuuuuuuugagacggagucucacucugucaccaggcuggagugcaguggcgucaucucggcucaccacaaccucugacucccugguucaagcgauucuccugccucagccucccgaguagcggggauuacaggcacgcgccaccaugcccagcuaauuuuuguacuuuuaguagagacgggguuucaccaucucuacuaaaggccaggagauucuccaucuccugacaucaugauccacccaacucagccucccaaagugcugggauuacaagcaugaagccaccgcaccuggccaugauuuuuuuuuuaauuuuugagacaggauuucgcuuugucacccaggcuggagggcagugacaugaacacaguucauugcagccuugaccucccaggcucaagcuacccucccaccucagccuccugaguagcuggaacuacaggugugcgccaccaugccuaauauuuguauuuuuuguaaagacaggguuuugccauguugcccagguugguuucacacuccugagcucaagugauccaccuuucuuggccucucaaaguacuaggaugacaggcauaagcgguuguaucuggucagauuuggccaggugcaguggcucacgccuauaaucccagcacuuugggaggccaaggcggguagaucauaagggcaggaguucaacaccagccuggcaaagaugaugaaacccugucucuacuaaaaauacaaaaaauuagccgggcaugguggcaagcaccuguaaucccagcuacucgagaggcugaggcaggagaauugcuugaacccaggaggcggauguugcggugagccaagauggcgccauugcacuccagccugggcaacaagagggaaacuccgucucaaaauaaauaaauuaauuaauuaaauuaaauagcauauauuaagauggcagggccaagaguggcggcuugcaccuguaacagcacuuucggaggcugaggugggaggaucacuugaggccaggcguucaagaccaggcugggcaacauagugagacuccccaucucuaccaaaaaaaauuuuuuaaucagcaggacaugguggcccacaccuguuguccuagcuacuugggaagccgaggcaggaggaucauuugagcucaggaguucaaaguugcagugagcuaugacugcaugacugcacuccagccuggguaacagagcaagacccugucucaaaaaaauguuuuuuuucaagauagggaagcaacucaacaacccuagaccugugggaugcaaggaagcaacauaauauuccaugaaaaauaugagcaucugaacuuaaccaguguugaugagggaaaggguuuagaagauagcgggaaggguuuugaagagaucugagaagacaugaaagguuauuuuauuauuuuuaucauuauuuggaugcaaggucucacucugucacucaggcuggaguacaguaguaugaacacggcuugcugagaugggaaaauagggucuggaggcagggaacauuaggccgauucacacuucagcuaugacaggaaauauccucuccauagggcauacaccaaguaaaugacuuuguaacuuuacuucaccucuccauucacauaggguauacaccaaguaaccaauggaagccucuagaggguauugaaacccccacaaauucuauaacggugcccuugagccccuacgcuagggcccgccaccacacuguggaguguacuuucauuuucaauaaaucucugacuucaucccuuccuugcuuugucuguguguuuuguccaguucuuuguucaagaugccaagaaccuggacacccuccaccaguaacacagccucaaacucccagguucaaguagaugcucccaucucagccucccaaguagcuaggacuauacagguaugugccacccugcccagcuaauuucuuuuuaagagucggggucuugcuaguuugguaggcuggucucaaacuucugggcucaagugauccacccaccucggccucccaaagugcugggauuacaggugugagccacuguacacagccuaaagauuauuuuauuaaaggacugaauaaccaacuauauaagggagaaaguguaggauagcucacagguuucugguuuaagugacuggguaacuggaagaauucuauaugaaacaagaaguaggugagggcuuugugauaagaaaaacuggcugaagccuaaaaagcauucuuucuccacugugugaaagcuucccuccuucccuuugccugcucccaucuucuaacagauuacaaaaaaaaguaaaauacauuacugacuugggacaacuuaccauacuugaauuucucaaaucaauaagcccacuuuaaucaggccccaguuuaaugcuuuguuuacuuccuucaaggaaagauaacauugaaaccagccaauuaucccacagaacugaucuuuaugguuucucugaauaaauacagaaauugauccucacagucuuaaaacuugagaaaguucuauuuguguuaucuaagcuccuuucuuaggaaacaaaccaucaggccuccuagauaguauuaagaagcugaaacuuacuuaacagaucacugcaacuggacaaugagaagccagagccugcaugauugcuuaacugaccaccugcugccuguugaccaacuucucuuccucaccccucucuaauuccuguuugcccacacaugguuacauuucuucucugcuauauagaccucuaauuuuagucagucagagauggauuugagacugagauggauuugagacugaucucccauguccuuggcugcagcacccaauuaaagccuucuucccuggcaauacccgucucugugauuggcuuucugugcggcaagcagcaggaccuagaccaaaccccugguguuuugguaacaccauccagcccaaaagagaaaaagauuucccgcuggcccuaacaccaccaugacaauuuggauaagcaaaacuaacaggcuuacuaaagaacccuauuaauucaacuguucucaaaauguugggcguguacuacaaucaaaggaaaaaaaaaaaaguaacuuuuuaagcccuauccuagacacagugaauaugaaagcccccuggcaguuugaaccuccccauuauagcuagagaucuucaaaugauaaucucauuauguaauuccuuuaaaauguuaagauuuucuucaagauaaugccccaaagccuugaauaucaaguauuuuaucucuagcucucaucucuuuuaauucauucccgcuuugcccaaccuucucaguuccccucaaaaugcuuggcuuugucuuuacuccagggcuuuacauauucugaucaguugcccauccccuuuaccuccaccgaaacuccucugcuugucucagcuaacgguucauuuccuuugagaaccaucccuugaccccaucccuaagacucuuauuauuuucugcaucuggcacuuaauauagaauauugugcuguaauugcuuguuuaccagccuauaauguauucccaacacauauugaaugaaugcuaaauacauauuaagcaaucaauaaacaagaaagguaaccacgucugggugauagugcaguuaauuguucuuuacagaacucaaaauuaggcugggugcgguggcucacaccuguaaucccagcacuuugggaggccaaggcaggcagaucaggaggucaggaguuaaagaccaaccuggccaacauagugaaaccccaucucuacuaaaaauacaaaaauuagucgggcaugcuggcgugcgccuguagucucagcuacucaggagccugagucaggagaauugcuugaaaccaggagguggagguugcagugagccaagaucgcaccacugcacuccagccugggcaacagagcaagacuccaccuccaaaaaaaaaaaaaaaaaagaacucaaaauucuggagaaauccaugagcuuccucucccauuaaucugaccauugguaaauguauaaacccuccccauuuuaagagcuuuacuaauaguaauuuagaaauaagcagaauuuacaggacaguuacaaaggcuaagaaaucauacgguuauaaaaagaagaauacuuugugaagacaauaaacuugaagcucuguuuaggcucaggcuuccuuuuauuccucagaguaguuucuuuaacucgaucucuagucauauauuuccaauugcuuuugauguccccuugcagguuucucaaguguuuaacacacaacagcuacaauacugaaaucaucuuccugcugcuccuauuucugcuaacucacagaauugcaguagccaaaaacaauacagccauuacaagcaagagucaccacacauucaggucaaaaaccuuagacuuaugucgacaaaaacagucaaacccuguaaaauauuugaggagauuuauucugggauagauuuaugcugggauagagaagcuuaacucuaaaaacgauggucagggcaagcuucauugcugaaguauaugugagcaaagauuugaaugagugaggcaccauuauauacaguuaacuggaggaagagcauuuaagaaauaguagcuauaaagcugagaucagagcucuaccucugagaaacagcaaggaggccuguguggaucgccuagcaggagagaggaggaaaagauuaaacacaagauaagccgggcgcgguggcucacgccuguaaucccagcacuccaggccgaggugggcggaucacgaggucaggagaucgagaccauccuggcuaacacagugaaacucugucucuacaaaaaaacacaaaaaauuagccgggcgauuagccgggcgugguagcgggcgccuguaguuccagcuacuucggacgcugaggcaguagaauggcgugaacccgggaggcggagcuugcagugagccgagauggcgccacugcacuccagccugggcgacagagcgagacuccgucucaaaaaaaaacaaacaaaaaaaaaaacccacaagauaauaaacagagugguggcaaggggacagacugaguagggcuuacagauccuaagacuccuuuuaaaaagcguuuuagcuuuacacucugagaacuaaaagucacagaagcguuuugagaaaaggaauaaaagaucacucuggcuaccuacugggacagcauugugggggagcaaaggcagaagcaagaaguucauuugcauggcuacuaugauaauccaggugagacaugauggugguuuggacuagaaugguggcagugaagacagugagaaauggacagauuauacacggauuucaaagguacagcagccaacaggacuuccugauguauugaauaugggguauaaaggaugacuccuggccucaccgaguacuagaauggaauagcuacugaggcagaaagacuucaaaaagagcagguuaugagaagaaaaucaguaaauugggccgggcaugguggcucacaccuguaaucccagcacuuugggaggccgaggugggcagaucacuugacguaaggaguucaugaccagccugaccaacauggugaaacccugucucuauuaaaaauacaaaaauuggccagguggucugguggaugccuguagucccagcuacucgggaggcugaggcaggagaaucgccugaacucgggagguggagguugcagugagccgagacuaugccacggcacuccagccugggagacagaacaagacuccaucucaagaaaaaaaaagaagaagaaaaggaaaccagcaaauugguuuggggcauuuuaaaucugagauaguuauuaucacauccaagaggaaacauaaaguaggcgucuggagacugaauucaggggagaguuagaggcuaaauaagucauuuaaaaacacuuugguggagccugucaaaaucuguaagaacaacacaacaacaguaucaauuuuaccucauaaaauauaacuggaaugaauauuaccugauaugauggugccccucaucauuccuggguagcuacauuuuacuaugaaaaaggugagguuuccauuaccauuauaucuucuagaacuagauaagauggagaagaaugggagcauuauucucccacacgucuacaauuccgaaguaaggcaaccaauaggcuauaggcaaaggccucaaagugcagcuguacugucaugugaccaaagauaagcgagucagucuggagugcuuucaagaacguauuuguaaaauacuuuucaaaaggucugggucuuucaccuccgccaaaggauaugaaaaugucugcuuuaaaacacaucacuugagaaagggaagaggauacaagaucccaacuaaugaaaacuuuuuuuuuuuugagacagagucucacucugucuccaggcuggagagcaguggcgcgaucucggcucacugcaaccucugcuuuccggguucaagagauucuccugccucagccucccaaguaacugggauuacaggugcgcaccaccaugccgagcuaauuuuuguauuuuuaguagagaugcgguuucaccauguuggccaggauggucucgaucucuugaccucaugauccgccugccuuggccucccaaagugcugggauuacaggugugagccacugcgcccagcaugaaaacuuuuuugaaggcuacuuuuugucuaauaaacauaugaaaauauuuuaaaugagccuauccucauccggaacaugaaacugcauucauucuuucaacauaugcuuauugaguaccuacugugugccaugaacucuucuaagugcugaagauacaggacugaaagaaagaaaacaaaaacaaaagaaaaaccucccccaaagaaaaguacuuuuugaagacagaguuagccagcuggugcccagugccauggagaaaaaagugagggcagaguagggguggggauggugcaagaacuggaauguuaaauagggugguuagggaaggccuccuugaaguccugaaaacaguucugaagaaugaaugaguaguuuuccaucuuuuuuguaccugaacacaacugagauuuaguucuauggaugaaacaccuagagauaagcuaagcuaaauauuaaaaagaucaacugucaggucggguacaguuccagauuagccuggccaacauggugcaaaccucaucuccacuaaaaauacaaaaaaaaaaaaaaaaaaaaaacuagccgggcaugguggugggcaccuguagucccagcuacuugggaggcugaggcagaagaauggcuugaauccaggaggcagagauuaaagugagccaagauugugccacugcacuccagccugggugacagagcaagacucugucaaccaaauugaauucacaucuaaaauaucaaaaugaaacugauaaaaaaagauccuuaagaagcaaauaucuguaacucaugaaaaguagguugagccuucagagaguaauucaaauuaucuagguaaaagggacuggaaagugaagacauuccaaaagguagagaaaguagaaggcacaacagcacagaaaacuuacguucuaagaacuccacgaaaagccacaggccgggcccguuggcucacgucuguaauuccaauacuuugggaggccaaggcaggcaaaucgcuugaacucacgaguuugagaccagccugggcaacauggugaagacccaucucuacuaaaaauacaacaaauuaguagggcgugguggcucacaccuauaaucccagcacuuugggaggaucacuugagaccagccuggcccguggcaaaaccccaucucuacuaaaaauacaaaaaaauuagcuaggcccacauaguggcaggagccuuuaaucccagcuacucgggaggcugaggcacaagaauugcugcuugaacccaggaaguggagguugcacugagccgagauaauaccacugcacuccagccuggacaagauacucuaccucaaaaaaaaaaaaaaaaaaaaaaaaaggccagggguggugagucacaccuguaaucccagcacuuugggaggccgaagugggcggaucacgaggucaugaguucgagaccagccuggucaacauggugaaaccccaccuguacuaaaauagaaaaauuagccaggcaugauggugcgugccuguaaucccagcuacuugggaggcugaggcagaagaaucgcuugagcccaggagguggggguugcagugagccgagaucacaccacugcacuaaggccuggguuacagagccagacuccaucucaaaaauaaauuaaaaaggccaggcacacuccagugaaacuccaucucaaaaaaacaaaaacaaaacaaaacaaacaaaaaaaauuauagauauugcuaaauugcucucccaaagguaguacaaaguugcugccaacaacauaugaaaguaccuauuucuccacaaucccaccaacagaguaacaaccaucuuuaauuuccgcucaucucaugagcaaaauaauaaauuccuuaaucugcacuuccaggaagacuucaguggggcugugcaucuuguguuuacuggcuauccucaucuccuuuucugugaagcaucuauauucauauguucacuuuccuauuagauugucauuacugauuuguaguuccuuauaaguugggucaugaauuaauguucuagcaugccucaaacauuuuuaaaguaucuuuauuauguuucaaauuuuauacagucaauguagaggcuggaaaacaggguguccuuuauaguaucuagauuuuguaucuuguuuuagaaaguuuuuccugcucccaagacuauaaaauuauucuccuguauuuucuacuaauacuuccacaguuuuuggcuuuuacauuuagcuguuuaauucaugcauuuggauuuuuuuucuuuuggugugaaguggaaauuaaaccaaauauugaauauuccacacuuuuucuauaauuugaaaugccaccuuuugucauauaaagucccacacauuuauuaauccauuucuguguucucuauucuguuccacugaucuauuuucuauuccugaaccacuacaacgcugguuuaauugcuaugguacugauggcuuucuacagugccauuuuucaaccuucccugucccucccuaaaaacacacuacugcugggcgcaguggcucaugccuauaaucccagcauuuugggaggccgaggcgggugaaucaccugaggucaggaguucaagacuagccuggccaauauggcgaaacuccgucucuacuaaaaauacaaaaauuagccaggcaugguggcccaugccuguaaucccagcuauucgggaggcugaggcaggagaaucacuugaaccaggagguggagguugcagugagccgagaccacgccauuucacuccagccugggcguaagaaugaaacuccgucucaaaaaaaaaaaaaaaccacuacuacccuauaaacauagaggcaaagaugaaagagacugcagguuacauacacuuauacccagugcuaaaauauuuuucuucccacucagagucugcccaacuuuaagaguaaguauucuguacaauaaagacacacuccuuagugugacacugaaaaacucccacuaucugguucucaccuaauuugcaacuaaucugauuagcuuuccucgucauauggcugaaguaauuuaauugcugucuucugaacacaaaauggacaacccuaacuccaugucuucacuuccugaaaugcuuuucuuccuucauucugauuucuguauuuaaagcugucuucucccaugaaauuuuccuagaucacuguuucugacauacagauuucauuuuccccugaaucuauagcacuuacuauacuucucagcauaauuugccuaaugguagcuuacacuacuuacuuuuuuccuugagcuacuuuauuaauuaguauuaaguucaaaguuuugauaaauagcuccaauuuuauuuguuaaugucuuuauuauagcuuuauuuuuagagacaggaucucgcucugucacucacccaggcgggaguacaguggcaccaucacagcucacuguaaccucaaacuccuuggcucaagcgauccucccaccucagccuccugaguaauugggacuacagguacacaccaccaagucaggcuaauuuuuguauuuuuaguagagacgggguuucaccauguugggccagacuggucucaaacuccugaccucaggugauccacucuccucgaccuuccaaagugcugggauuacaggcaugagccaccacacccagccaauauguacuuguuucuaaaauacuuuuucuuuaucguaaauauucuauauaucaaccuaacuugaaguuaaucucaagggucagauccucucauagccagagauaacuuccccagaaggaaaaaucuaaacuccauuauuucuuuggcucaaagacuaaugcuuuaaacaugaaauguauuucucagaggaccugagauuucacauucaauguagucucauuguucaugaaauaacuuaaagauccauuugagaauauuaaaaacaauagcuacuuccuauugucaaacuagacugaugaccauucuuacacuuauagaagugagauuaaaacaaaucaaaaccaaaauuaaaagcucaaccacagaaguacacugcaguuucaggacauuugaugcaacagagugcaaagucacagucaggagaggagccagguuuccuucagucuggaaaaagccaccaaucucuaccaagaaaucaaaugaauaacccauuugacuuuuuuucuucaucaaacuucccagucaaaaaguauuuaucacaucaaggcaucacacuucaaacauauaagugcuuuauguaaaugcacuuaguacaauaauacuucauaugaguagauaacuccaccacuuacaaagcaauuucauuuucauaucugauuuaaucuucacaaauacccccauaaaggcagcuugcuauuauuuacaaauuccaaaugaaaacgaacagaaaauuauaaauaauaacuuccucaacaucauuaaaaauccucugauuuccaaccuaaugcucuuuuuacauuucaacaugcuggcaauaugaaccagaaguaagauuuuguaagauuuuaaaagaauagugauuuggauaaguacuuaaaaaaaaaaaaagauuucaggcuuccugugaugacagaaaaaaauacuuaacucccacuucuuauuuucuaauacuuccucagguaauucuauagacccuuaaagagguuuccacacauuaaauacccuuugggggaaaaaaucccuuuauuuaucacuuaauuacaauccuucccauaucauagggcugaauuucaucuuagaacucaaauugagagaaaauauggccaaguuuaucugaugcaauacauugcaaaugaccuuugaaaccaaguguuuuagucuaguuacaauuauggaacugucaggaaggaaauuugugaaaauguaauccuuuaucacuuacaauacugcaacuuccucaucuucaccacaaagaaacacaaacauaauucagccuccagcaguucugcacuguuagaugagucugcauuuuuuguuuaaaguaccuuggacuuaacaggccuugcugcuguguucauguucuuaacauguucaaaaacuacuacuuccaugauuuuagcaguucauaugcaccuaauuuuuaaaagucuuucuuuaacuugcauaagaauauaauuauacaacccauacaauaauacuguggaaugaguuaguaaaucagacauguuaaucaauuaugaauuuuucuuaugcccugugaauagacccaaagccuaauaacauauugagccaacucaguacacagaauauacaaaauuauaagguaaaaaauauugaaaagaaauugacauuuggaguaggcaagcuccaaagaagacaaccuaagaaaauaaaguaugaacaccacaaccugaaaaacaacguguuaccaguguuuuuuguaaaacacuuuagaauagauauuuuauccaguguuaauggacacuugguguuaagguaaacccccuuaauuuuuaagggcugauaguagccaaaaaaaagaaaaauguacuguauauuacuguggaagaacaauguagcccuuuacaacagaaagcaaaaugugggcuaaugauugauuauacuacuuaccaguccauauccaacauaaccauaacaaaaaauaaaaacaaaaauagacauaagccaaaauaucagacauauaaaacaugguucugaacgugauucaauguugacaaguuuaagauuuuccaggcuuaagugaagaaaagcuaaguacuuucaccucugauuuaacuguacaaagugaaaagaaaccagaucaaaagaugggauguacaggccagacauggagcucucaugccuguauccagcacucugggaggcuaaggcaggaaaaucgcuugaacccaggaguucaaagagaccagccugggaaacauagcgagacccugccucuacauaaaauuuuaaaauuagggccaggugcgguggcucacgccuguaaugccagcacuucgggaggcccaggcaaccggaucacgcauucaggagaucgagaccauccuggccauuauggugaaaccccaucucuacuaaaaauacaaaaauuagccgggcaugguggugugugccuguaaucccagcuacgugccuguaaucccagcacuuugggaggccaaggcggacagaucacuugaggccaggaguucaugaccagcccggcuaacauggcaaaacccagucucuacuaaaaauacaaaaauuaggucaggggcagugggucacgucuguaaucccagcacuuuagaaggcugaggcaggcggaccaccugaggucgggaguuugagaccagccugaccaacauggaaaaaacucugucucuacuaaaaaaugcaaaauuagccgggcaugguggcacaugccuguaaucccagcuacucgggagggugaggcgggagaaccacuugaaaccaggaggcggagguuguggugagcugagaucuugccauagcacuccagucuaggcaacaagagcgaaacuccgucucaaaaaaaaauuuaguggggcauggugucacaugucugugacaugugacagcuacugggaggcugaggcaggagaaucacacuugaacucagcuugaaucacacuguaaucccagcuacuaggaagcagagguugcagugagccgagacugaaccaccauacaauagagcaagacucugucucaaaaaaaguaauagccaggccuaggccuggugacaugugccuguagccccagcuaugugggaggcuguguugggaucacuugagcccaggaggcugcaguaagucguguccaggccacugcacuccagacuaggugacagagcaagacaucaucuccaaaaaauaaaaugagaucuacaaaugcuacaaauugucggaucuguuauuuucuucgaguccaacuauuucauuuauugucccuacucuccaaauaauuuacacuuaaauucauauagucuacagaugcagcaacagggacuuugccuguguuuuuuacuguuguugcuuauuugguguuuuugagacagucucacucugucacccaggcuagaguacaguggcaugaucucggcucacugcaacuucugccucccggguucaagcgauucuccugccucagccuccugaauagcugagauaacaggcauccgccaccaugcccagcuaauuuuuguauuuuuaguagagacgggguuuugccacguuggccaggcuggccuugaaguccugaccucaagugauccgccugccuuggcuucccaaaguccugggauuacaggcaugagccacugcucuaggccuuuauuuucuuuuuaaaguaauguucauagaguccauaacuggaauugcugcuuuuuuuuuuuuuuugcauaaggguggggcuuuccacuagaaagugaaaaaaaugauauagaaacucucaaagugcuguuaauacuugcauccuuuuuuaaaaguuuuuucuacagaaaacuugaaaaauacaggaaaguacaagaaaaaucauuucuaguuucacuaucuacacuuuuauaacugugaauauccuuuauuucuuuucuuucuuuuucucuuuuuuuuuuuuuguuuuuuuuuuuuuguuuuuuugagauaaucucacucugucacccagguuggagugcgguggccagaucuuguggcucacugcaaccuccgccucccggguucaaguaauucuccugcuucagccucccaaguagcuggguuuacaggcuaauuuuuguauuuuuaguagagacgggguuucaccgugucggccaggcuggucucgaacuccugaccucaggugauccaccugcaugggccucccaaagugcugggauuacaagccugagccaccgcucuggacccuuuaagucauuucuaaaagaaguuauguucacuuuuuguuccaugguuuacaaaauugcaauuacacuauuuucuaaacuguuuucaucuaagaaggaguauuucccacaccuuuaaauuguauuugggcugauuuuuaaucagcuuuuuugacugaaauuccgcccucagcguaaaagguuaaaaauuaugaauuaacgcccgcgcggugggucacgccuguaaucccagcacucugggaggccgaagugggcggaucacgaggucaggaguccaagaccagccuggccgacacguugagacccccccccccgccccgccgucucuacuaaaaauacaaaauuuagcugggcgugguggcgggcgccuguaaucccagauacucgggaggcugaggcaggagaaucguuugaaacuggaaggcagagguugcagugagccgagaucgcgccacugcacuccagccugggcaacaagagcgaaacccucucucaaaaaaaaaaaaaauaugaauuaaaauaauacccucaccaucuccaucuucugcuauaugaccugaacucagaaaauaaaaguaaaccauucacacuggaugugugugauaaauauccccugagacgugugggacccaauaugauucuaaucuuaaaagauacgaugcaguaauagcgauauuucaagcacuauccuguagauuggaggagacaaaucuaaaauucauaguacuauauaguuagcuauucuaacuacaagaaugcccaacuguguuuuucaauaaaaguagagcagaacagugcaaacuucaccacucaauaaaauaccuuacuuggcgcucccaauagugcuaaacauaaacaacgcguacaaggcacugcaugggacagcugcuaaugaggacaaaucgauuagggagaccaaagcuaaaggaggccacuggaacuggagaaggauauggagagguauuugaucaucaucaggcuggcgugcuagcggaagucuccgggcauuauuuaauauuuaaucuuucuauuccugacaucacgggggcucaaaugucaucaaaagacaggcuggcauuaaacccggcagggugacgcacauaacaucuuaccauauggauuuucaucaguccagaccgacaagcaccucaaagccugcccagugaaggaagaaggguggcccaggccgucagcucucccacccuuggcgcgcaguucgguauagcacucgggguuuggaggcugcaagaccaccggaccggacgccccagggucggcucgggccuccggagcugugcacucgcgcacggcccgaggaggucgcccgugcggccgcugacaccaggcgucaaguccccgcccgagcagccccagccuaggaggcggaccccgccacugcuccucuacugagccgagcgugucggccagggacucagacagucggcacaaacccccucccggggucuaagcccgccuaguacaguaccugaaggggcagcgccaccuccgcccgauugugcuggcugccccaguggcggcggucacagcucgggcgccaaugacgccucuuauaaaaacaaccugcucgcaggcgucugcagccggcaggcggugaccggcugggcgccgcagugcaugccgugacgcguagucccgccugcgccuccugcccggcagcggugaagagaagaacuaccacucccgaaguggagcgcaggccgccgccgggcggcugcgggaagcugggccaggcggccgcagauccccacaacaucc

SEQ ID NO: 192074 - RNA, 36714 nt, Homo sapiens
ugaggaaaacuaaaggucuuuauuuaaaaucuggcauuguauuaacauguaauuuuauacuaugugguauuuuauacauuuccucaguagugauauuugguaaagcaguucauacagcuuuuuucuaaguuccaugaaucuuacccaguguuuaccgaaguauuuaagcagcaucugaauauuuccacccagcaauguuaauuuaucuaggaaaguucagaauuucaucuucauguugaauuucccuuuuaacuuccguucauagacauauaugugacuuccaauucgacccucuggcaagugaguguggaagaaaacagcaguucuuuuauaauugcuugaaauuaggaaagcgcuuauuuccuagaagcaaauaaauguuuaaguaaauaaaggcuacauuuugcugaguacuguuucagucaauuuuagaauugccuauucuaauugcugucuacaacuuuuugcuuaauaaaagaauuaacuuauaggaaguaaaauacuuugauaguuacagaacuggggcuaauuuugacuggagaaaagacuaauuaugaaauguggguugaaacagaccauaaaaagguuauauuaucuauuuaccugaggguuuccuaaaccugggguaaaauuaaaauacugaguuuuccucuuuuucauguuuacuuaccucuuccaaaaugcugaaggugaucaagugaguaggcaaugaugcaucaucaugaaacucucuauguaaccaguuuaagggauuuagguaaaauacaucugcuucaucaagauaaugacuuuuuccagucaggucuggcgggcacuggagaaaucucaugggaagugggcagugaacauggcuaugaaaagaaaaguuaccauaauaaauacaaguaaaacaugaaaguuuucauuagucuuaagauaugucauuuauacuuagcaaaaugugaaaucugaaucuguaaacuguguugcaguuaagugaagaagcaagccuuuaacucauuuucucaaagauaaaaaaaacaugauucuuauaccauguaccuaugcagcagcagcaguauaaccuauaagcccaaacuagugcauagaaguccauuucaaggagggaaguaggucaguagggggacucaacauucuguagcauugguauucuguuccggaaacauaaaugguccucaggaccagguaaguuaacuuguuaauaggagaguaauucuccauagguguauuugauaaaguaggaaacugugaucauaaucagaaaggauucuuucucucuucccuuucugcucugauaggggauggaucacauacuuauauggcaaguuuuuuuuuuuugaagacaagaguuucgcucucgucacccaggcuggagugcaauggcgcaaucucagcucacugcaaccuccaccucccagcaauucuccugucucagccucccaaguagcugggauuacaggcgcccgccaaccacgccuggcugauuuuuguauuuuuuuaguagagaugggguuucaccauguuggccaggcugguccugaacuccuaaccucaggugauccacccgccucagccuuccaaagugcugggauuacaggugugagccaccacgcccagccacauggcaaguuugaaguguuuuuuuuuuuuauuuaagaugauugagaaguagagagcaacauauguccacugauuaacauccaaauaaguaaugguuuuauuguggcauagaaagacuagaguaggccgggugcaguggcuuaugccuguaaucccagaacuuugggaggccaaggcauguggaucacuggaggucaggaguucaagaccagccuggccaacauggugaaacccuguaucuacuaaaaguacaaaaauuagccgggcauggugguaugugccuguaguuccagcuacucaagaggcugaggcaggacaauuucuugaacccagaagacggagguugcagugagcugagaucauacgccacugcacuccagccugggcgacagagcaagagucugucucaaaacaaaaaaaagauuagaguauaaaaaagauggauucauuucuaauaccaguuaugacaauuuaagccaguuacuuaggucaugcaaaaagccauguuuauaauugccuuaggaaaaauuaaaccucacugauacaaacauuuaaaauuuccaguuagaaauggaguuaguaauuaugcaggagguuuauuuaugaaaugcauaaaaauuaaauguacacaagaccuaauagugauuuauuuauuggaaaugaaggucuuguuucaaagggaagcagaaauuccucagaaaaagcugccggccuacucuagucuuucuaugccacaguaaagccauuacuuauuuggauguuaaucaagggacagauguugcucucuacuuccaagucugaugcaaaauaggcaucagacuuuccucucuugugugcuuugaaaagguguggagaacuuggugaacuauucaaagccuaagacaucaacugacuacaguuaaguauaaagaacaucuugguacaucuaggauuccuguucuccucaguauuaucccuaaugugagcacggagagugaaugucccuuuuucagccacauauacauauaguagggaauccucaaguugaaaggauacuugaugucuuccuuuuagccugugguuuuugcuaggaucuccauuuuucuaaacuguauauuaauuacuggcauuaaugauuaguuaaauaggaguauuccaaguguuaaauuccccuaaaaugauaaccacuguaauuaaauuaauugaacgugcauaggagacauuaacuccagauuguuuaaagccagacugaguuaaauaguuauagauuuuauguauuuauuuauuuauuuuuagguugagucucgcucugucgcccagguuggagugcaaugguaugaccucagcucacugcaaccuccgccucccgaguagcuaggacuacaggcaugcgccacaacaccuggccaauuuuuuuuguauuuuaguagagucagggguucaccauguggcccaggcuagucucaaacuccugagcucaggcagucugcccgccucggccucacaaagugcuaggauuacaggcgugagccacaacgcccagccugguauauaauuuucuguaggaaaucuggcuccuuugccccuauaccauuacuggguaauuaguaacuaauacagcuuccugaaauaaagcacaggaacaaauggaugucuuuuuaaaggccauacauaguugaggcaauuuuaguauauuucccagaaacacuuaauucaagcauuagaauaucaucuagucgcauucccuaauuuuuuacaggugagacaacugauguccaaagagauuaaaaaucuaguuuaaggccgggugcgguggcucacgccuguaaucccagcgcuuuggggaggcugaggugggcggaucaccugaggucgggaguucgagaucagccugaccaacauggagaaacccugucuccaauaaaaauacaaaauuagccgggcaugguggcacauuccuguaaucuuagcuacucaggaggcugaggcaggagaaucgcuugaacccgggaggcagagguuguagugagccaagaucacgccauugcacuccagccugggcaacaagagcaaaacuccaucuaaaaaaaaaaaaaaagaagucuaguuuaagaugagggcaauaauccaguaguaaaucuggacuaaaauccauguuuuuuuuuuuuuuuuuuuuggagacagagucuugcucuguugcccaggcuggagugcaccuggugcaaucucggcucacugcaaacuccgccuccuggguucaugccauucuccugccucagccucccgaguagcuggaacuacaggcaccugccaccacgcccggcuaauucuuuguauuuuuaguagagacgggguuucacccagcuuagccaggauggucucgaucuucugaccuugugauccacccgccucggccucccaaaguacugggauuacaggcgugagccacggcgcccggccuaaaauccauguuuuaagauuaauucaaauuguguaaagauguaucacagagauuuguaguaagguaaguaauacaugaguuucuuuacuaagaagacuaucagauaccuacaaauuguuuuauacugauuuaaaucagaauuagguguaaguaaauuguuuuuaaagaauaauaaaguuuacggccgagcacgguggcucacaccuguaauccccgcacuuugggaggccagggcaggcagaucacgaggucaggagaucgagacuacccuggcuaacacggugaaaccccaucucuacuaaaaauagaaaaaauuagccgggcaugguggcaggcaccuguggucccagcuacucgggaggcugaggcaggagaauggcgugaaccugggaggcggagcuugcagugagccgagaucgcgccacugcacuccagccugggcaauagaacagacuccgucucaaaaaaaaaaaaaaaagaaaaaaaguuuauuuaaaacauuuucuuugacacaguucaagugguuuuuaaaauccaucagugaauaaauaugugggaguuuaaaauuuaucauuugaucagugaccaauuaauucaaauccaggaaucugaaagggaauuuuaaaguagucaguuucaguuucuuaacagcauauaguggaacaucuuuuauuaccuguaauaaggaguagaguggcaaggcaucauuauaaauauugaagcugaagauuuauugggauuguuguaacaaacuuuuugaauaugacucaugacaucaagaguaccucguugaugaacuaaaccaguauaaagggcgaggaacaaauuugauaaaaacaggaaacuuagagcugguuucuuccauguuuucagguggguuaaugaguauccuauaugaagauagacauauugaaccuuaacacugacaaucuuuuguuauguuaacugcaaauacaucuguaauuuuuaauggaaauagcaaaaacuguaauacuguuauagacaaauaagaaauaagcaauaagucauaucucugaccauucaccauucacuacugucaucuaggucuugacuuuuucuaguaaaagguauugagguauaguggaaagaugaugguuauggaguccaacagguccagauuugaauuccaguucuagcacaagucguuuuacuuugcuggucauugggauaauaguaccuuauucaaguguuagaaaaaauguccagugacugcccugguacauaguaguugcuaaauaaauaggacuuuuaauuauuccauuuaccuaccucuuuaaucucccaagcacuaauaauugguauuuuaguguguaauacgaguuucaauaauguguccucuuaggaaaauaagccauugggcaccugggagauuuuccguaaguauaugaguggaagaaaaggugcuaugucuuacauuuuuuuucccacaacagugggaaauuuuguuuucccacuacagucaggcaauuuggagaugcugaacaauuuuucuuuuuugauuuaugaaagggauuauucuguggggcaaaacaaaacaaaaaaccaaaggaaaaaaccaaguagaaugaauagacggguauaaaaggauaaguaaaagucucucuccccucugauaguccuuuucuucagcaacagccacuauuaauggacauauuaggaucuacugagaauacaaagaacaggccuuuccacuggaaaagauuaagcuuauuaguaagcaugacauuuuguucauaauuuacauacacucuuuuuauagaacuagauaauaguucuuuuugaacuuggguauucuucauccaaaccuugguuugcccaaaauguuaguacaauacugaaugggaccaaggcaguguuuuuuauuuuguuccuccuaugaauauguuaauaucauccacaguucauaccucaugaguuggaauaucacauguccaugucaccuaguauuuuuuaaucuacuugaaauaguucugauuaaagaauaaucugaaaagugguguggugaaaaauguagcaagauuaagaaaacuaagccuaucacuuaaaucuacauuuauaagauguuugaaaugguaaaaugaggaaccuacuaaaaggaaugauaauuagaacuagcuuuauuugaaauaaaauagcugagaugagaggauugcuugaggccaggaguucaagaccagccugggcaacauagugagacuccauuuaaaauaaaaaaaaauuagccaggcgugauagugcgcaccuguagauccagcuacugggaaggcugaggcaggagguucaccugugcucaugaguuugaggggacagugagcuaugaccacgccacugcacuccagccugggugacacccugucucuacgaaaauaaaaaugaauaaaauagggccaggugcgguagcucacaccuguaaucccaguacuuugggaggacaaggcaggcggaucacuugaggucaggaguucaagaccagccuggccaacagaggugaaaccccaucucuacuaaaauauaaaaauuagccgggcguggugucagagguugcagugagccgagaucacgccacugcacuccagccugggcaacagagugaaacugucucaaaauaaauuaaaaaauaggauucuaaaaguucaaccaucuguaauaaccccaaucacagacacagcagauccccaaauauaaguugaagcacuuaacuuagguugguaggcuaaaacaacaucuauuuuaguaggcucaaauacaaaaagcuacauuaaagccuugucuuuguuuguacugcuauacuggaauaccugagacuggcuaauuuauauuuacuuggcucaugguccugcagguuguacaagaagcauccacuggugagggcuucaggcugcuuccacucauggcagaaggugaaggggagucaguuugugcagagaucacauggugagagagcagaagcaagaaaguggaaggugccaggcucuuuuguacagccagcacucgggggaacucucauggaaccuaauauaaggagaacucacuuacuacuccaggauggugccaagccauucaugaaggcuccacccccaugaucgaagcaucucccauuaggccccaccuccaacaguggggaucaaauuucaacuaagguuuaggggacaaacguccaaacuacagcaagcccauccuacagcaaggcccgagaagauacaguuuguucucaauuauuugaagauacuuacaaggugagcauguguaaagugauucacuuauuaauaauuuguucauucaaggccgggggcuguggcucacgccuguaaucccaggacuuugggaggccaaggcgggcagaucgcgaggugaagagaucgagaccauccuggccaacaucgugaaaacccaucucuacuaaaaauacaaaaauuagcuagguguggaggcgcaugccuguagucccagcugaggcaggcugaggcaggagaaucacuugaacccggcaggcauagguugcagugagcugagaucgugccacugcacuccagccuggugacagagcgagaugucgucucaaaaaaaaaaaaaaaaaaaaaaaagaaacuauggcacuaggaauacaauaguauaggugggugacacaaaaugggaauacuuggugaucaagacugugaaaauagcacucuggguagaaugcuggaagauaacaugcuuguguuuccagcaucuucaguacuggugagacagagcgucucuuaaguuagguaaugcuugccuuacaugauggugauuuuaacucucugagcuuagcucauuuuaggauggaucauuuuagugagaacugaaucuccauauuacuuagagaaguaauauaaagaaaaugcugggaagagaaggaacagcugaacaaugccagggagagucaggugauagcuuaguuuucuuggggacaguggauacugaaacaguugccauucaaaauugucuucaacaguauuauggauccgaugagcuuuuguguaauauucugggagccuuacuacaugucacaguauuauuucuaagaaaaaaauauuucagguuccaacuuaaaaaugaaguuuggggauaaaaccuuauuuaaaauagaacugucuuuaugauuauuauuuuuuugagauggacucucgcucuuucgcccaggcgggagugcaaguggcaugauaccggcucacugcaaccuccaccuccuggguuacaagcgauucuccugccuuagccuccuggguagcugggauuacaggugccugccgccaugcccggcuaauuuuuguauuuuaaguagagaugggguuucaccauguuggccaggcuggucucaaacucaggugaucugcccgccacagccucccaaagugcugggauuacaggcgugagccacagcgcccagccagaacugccuuuauuuacauguuuagcauccuauaagcauuacuaugcauuugacauauaaagaaaauaucuuuauaauuucaguuaucaucaaaugacuugugcacauguuagaaaagaacccaacuuuagaguauaagucaagaguccugaauuuaaggccucugagggguuuuuaaaccuucuggcacugaaagcuuccaaaggggauuucagaaaugaguugcuaaaggaaggguuggaaagauuuuccaguuccaaugcuagacugagugaaccacaagagaagccuaagguccaugguuuucuuauagaccaguaguauuguuucaucaauauuuaaaacaaaugaacaagauuccaguaggugacauccaguaagucuacuuaauggcacgcacaaauuuggagauggaguucucacugaaauaauccacccucaaaugaccuagcuucagaaagugaucauccccaccacguaaaugauguguaucccaaucacugaagauuuaagacuguguguguaccccagugacuaaaguauagguuccuuccuuucacauaguaacaacccauugcuaacuggaugcuaaacaucaccccuaaauacuuaauuugcuccuguuaucugggccuacaaaaagauacuugaaagucgguauacagaaaauuucuggaagaacugcuuaagaaagugauaacaauaguuaccucuggggaaugggacuagaugacuugaggaugacacacuauuuuuguaccaucggcauuuauuuuuauaauaaaaaaauacacugggcuccuaucagaucauguucaucagacuacuguuacagaaauguuuaaaauccauuacaucucaguugacuacucuucaggauaaaaucuaaaaaccugagcauauaagaagauacuucaugaggugguuccuuuauaaagccauaucucuuaaucaucauguauuauuuagcuugauauacacacuuuaaaaauuuuggauaucuagcguggcauucuguauuuuccagcaaucacuaauacguuccuucuuaccaagguaagguucacgguaauagagaggaugggaguaucugagacuguacauugcugauuccauccugguuuugacaagaauuaucaggaaaccuaauguuaagaaaaaaaaucccuaccacauuuuaccaauuagagagauaucugaguuacuguuucuauuuuuaaauacucuuugagaaagcuuaguuucaguguuuagauaagaacaacaaaaggugguucaauucuggaaugggacauacaguagaauggggcugggaaagagagacuuugaacuacuaaccauaaugaggguacugggcacagaugaagguaucaagaagaauuuuuuuuuuuuagacagaaucucgcucugucacccaggcuggagugcaguggugccgaucucggcucaaugcaaccuccaccuccaggguucaagugauucuccugucucagccucccaaguagcuggcauuacaggugcgugccaccacacccagcuaauuuuuguauuuuuaguagagacaggguuucacccuguuggccaggcuggucuugaacuccugaccucaggugauccacccaccucagccucccaaagugcuaggauuacaggcgucagccacuggcagcuggccaggaagaauuuuauguugcuauuuuguuaaggaaguaaagccaucuuuccaucuucgauagaauucaacaguuaaugccuaaaacaaagaccuuuaaguggcauuauaaauguuuuagagauaucgagauaaauaccaaaauaaccagcugaaagaaugcuuaacugauuguuuuuggggagaggaaauagggagagcaggggaacaauuuuuuuuuuuaauuccuuguggaaugucuucugaaauaauguacauaugcaauuuugauaaaaagauuagaauauggggccagcuguggugccucaugccguaaucccagcacuuugggaggccaaggcagguggaucaucugaggucaggaguucgacaccagccuggucaacauggucaagccccaacuaaaaauacaaaaauuagcuggcugugguggcaugggccuguaauuccagcuacucuggaggcugaggcaggagaaucucuugaacccaggaggcggagguuguagugagcugagauugcgccacugcacuccagcaugggcgacagagagagacucugucucaaaaaaaaaaaaaaaaaaaaaaagauaagaauauggaaaaacaaaguggcccaguaagagagaagucuauauuagccacugugguaaaaacagauaagcagacacucaacucagaaucaguagugggugcugaacucugucagcacaaaugagagauucaaacuaagaauuuaauuaguguugcuaaaauaucaccuuucuuuuacagauaaggaaaaugaggcacauuguugaacaauucacuaaagaucagagccagucacaaaauauauuuucuagaguugaguccuauuuuauaggacuaagggaaauucaaauuaggcaagagaaguuaccguagacugaaaaaacugcugcaauuauuuuucuuccugugucccaucccacuaugagguuggcauuuauuuccccaccucuugaaucuggccuggcccagugacuugcuuucaugaaaagaaugugguggaagugacaguaugcaaauuccaagcccuugucucaaagggccuugcauauuugcucccucucuuggaacccggccuaugccaagugaacaagcccuagcuggccuguuggaggaagagaaaacucagaagagcugagaagacuuggccuacagcuaguugaaccccagacaugagagcccagccuaggucaauagagcuaucuacccaaucugcagcuguguaagugagcucaguggagaugagaacugcccaguugaaauguagaccuguaaauuauaauaaauggaguuuuaagccacuacaguuuugagguggccuuuuacacagcaauggcugacagaguugucauguuuacauaaaaauagguuaaaacaagucacacaaagcagaauaaggcugaaauuugugguauaacucaagauuucaaguaguuaggaaagauucaaacugggucacuaaaacaucaagagcuccaaagagaacuguucuaaauguccagagauuucugucuaggugacaucacuagacagaacugauccuacuguuggaaccucuuggcauuaaacagcccugacuguuaguggaaguacaaaucuccuaggaauuagaguuuuuugacccacucuagaaccuuagguaggguguggaggaaaagaaugcauccugugaggagaucaagggguuuucuagguugcugucuuuuagggauccuucuaaguagacagaggauggaagaaggggugauucuuaccuauuagaaggggcucucuuuaccccucaucagcauuuuaucucaauaaacugugaauaggcccugguuacagggaucuugccacuuaaagauucaaucuuuuagacuggcaaugaggauucagacaacucaaucuuuguguaaauacuugguaaagcaacaggacacagaagaggaaugcuggaaaaaucugguuuaugaaaacagaaaucaaaccaaguuacuaaccaaccuccccguccccuccaggcacacaaaaacauuugccuuuguacucugccaaugcuugauuuaauuauaauacacacucaaguggcuguaaaaaaacccaacagaacagaaaccauuuaacaucugaauagugauuuaugaacagauuuccucugacaaauggggccagcuauucuuaaggcuugccaaauagcuguuagaugucuaaauuuuuguaugugccugcguuuguaugugguuacacuguaaaguaaugacagacugaggcuuugauuucagaacuucagauguaucaaaaauacagauuuuuaauauuugauuuuauauuuguauguuuaucuucuuaaauugaagagauuauacaucucagaucuguaggaguugauguauacuuggucaaacauugccuaacucaauguuuuucuuuuuuuuuaaguaaaaaauaaguuugaaaacuguaacucccuagguuuuuuccagccuccaguuccaguuggcuagucauuucuucucucucaacgcugugauuuuuuuuaaggucuuaauauuugaaggaagucaacagucauuuauuccgaauuaaacuugaaguuaauaaaguuucaauucguaauuuuuccaaaccaaccaauguaaaaacccagauuuuccugaauugagucauguaaggauuuuuguaagugacaaaaaaauacauguuaagacuguggaaaaauggagaaaaggccugaauaaaaucaggaguuaauuacuuaaaaaauggcauaugccaggcugggcgcgguggcucacgccugcaaucccagcacuuuugggaggcugaggcggguggaucaccugaggucaggaguucgagaccagccuggccaacacggugaaacccugucucuacuuaaaauacaaaaauuagccggguaugguggcggaugccuguaaucccagcuacucgggaggcugaggcaggagaauugcuugaacacagggagguggagguugcagugagccaagaucgugccacugcacuccagccugggcagcagagugagacucugucuaaaaagauaauaauaauaauugcauaugccuuagagugaguuuuaaaaguguaaauguuuuguguguaaaagcauuaaaaacuaguuucaacagcaguaaauacauuuuuccuuugugaaaaugaagacccuuacaguuuaaccauaaacuuaaaauagcuaaucuaaaaacagacauguuacuuuacuuuuuagugagaaacaccaccaccaaauagaaacaccaccaccaaaaacugcuuuggguauuggauauuuauguggguuuuuuguuugucuguuuuuugagagaaggacuugccauaugguaggcuggucucaaacuccugggcucaggugauccuccugccucaggcuucugaguagcugggauuaaaagugcacaccacugcacugggcuaggaucuuuauguuuuuaucucacuuuagaggauauaggaaaaaagauauuuggacuacaaaaagggaauauugcaguaauauaauuaaucuguaauuaaguaauuccuuauuaaccuaguugaaaauagacauaguuuaaugaggauguguugucuuuagacuauuucuauauaauuuauuuucuauaacaaacaaaagcacuuaccacagaacaccauacagaaugguaaaacuggauaaauaaaccugaauucuuuguggcucaacaugcuguaauaaaaacaaauauuauuaaaaaauauuaauuaucauguuauaugauagauugagaaaguaauauauuuaauauaaaauauauuuaacuugaucuauuuauuuucuaaguauucagacugaauuucuugcuucagaaauucaucuuauuuuuuaguuauaaggugauuaugauaugguaaaacuaaucauaaaauaugaugucaauuugaaauuacaaaguacaguuacauucuaaaaacgggauuucuauuucaauccaaguaagugaaauuagucaaauuuggaauaaggauacauacauuuuuauuuuagaauguauuucugugguccuucaauuuaaaauuuugguaguauugauugacugauugacugagacagggucuuguuuugucacccagacuggagugcaguagcacaaucauagcucacugcaaccuuaaauuccugggcucaagcaguccuucugccucagcuuccccaauagcuaggacuacaggcacaugccaucaugcccugguaauuuuaaauuuuuuuucagagagagggucuugcuauguugcucaggcuggucaugaacuccuugcuucaagcaauccucccaccuuggccuucaaaguauugaaauuacaggcaugagcaacugugccuggucuguuuuuuuuuuuuuuaaagcaaauaaaauuaguccaaguucuuaaaaauugaguguaauccuuauuaagcaaacuacauaucuaaaguauucacucuagugccuccauaauuacuacuacuuguaucuucuaagauaauucccacuaacaaaaguuaauggcaccuccaaaacauaaaguuuacuuuuugaagaauuuaauuugauuucuugguaacauaaaaaauuuuagccuuuugaacaaauaaaaucuuaccuauaaacaagcaguguccacagcacagucaccaaaaguauccgguaucucuuuggugcuagauagcagccaugaauaaagaaggguaagugaguacccaagauaacuggaaauccuugacugaaguaccagugccauggaugagaaccauaaaauguuccccaguucugcagcacguuaaauuucaaaaaauuaaauugaaccagaguccacuggcaccguugaaggaaaaauaaauagaaauguguuagugccaaguaguaaucuuuggcauuaggggauugauacaauuuugacauuaaaucagaauugaagucuaaaaaccaggcaauaguuuacauuaauaauuuuuuuuuuuuuuuuuuuuuaagauggagucuugcucugucgcccaggcuggagugcaguggcgcgaucucggcucacugcaagcuccgccucgcggguucacgccauucuccugccucagccucccgaguagcugggacuacaggcgcccgcuaccacgcccggcuaauuuuuucuauuuuuaguagagacgggguuucaccauguuagccaggauggucucaaucuccugaccucgugaucugccugccucggccucccaaagugcugcgauuauaggugugagccaccaugccuggccuaauaauuuuaauuaaugacuguaugaaauccuucuuaacuguuauuuuuucuucuuuaaguauuaauguguuccuuguuaauuuguaaaacuagauuuuugagauucaaagugagaaucaaacuuauauuuuggcagucuaaguuuguguuuuuauuucaaguuuuugggguacagauggcuucugguuacaugaauaaguucuuuagaggugauuucuaggauuuugguccacccaucacccaagcaauguacacuguacccaauauguacucgaaauaagaauuucucaccccucucucacccuuccccacccugagucaccagaguccauuauaucauucuuaugucuuugcaucccauagcuuagcucccacuuauaaguaagaacauaugauauuuggcuuuccauuccugaguuauuucacuuagaauaauggccuccagcuccauccaaguuuuauauccaguuaagagauaaagaggauaguagacauauuuuuuggacugugugguacuuuacaaugugacauauuaccugugaagauaaagcuuugaaaacauuacaauuugaauuacagcguaaagcugacaauaaugacagaaacagcaacagguaacauucagugcucacuuaauaauucccugccuuaaaauguacucuccugaauauuagcuaggaguacuaauucuuuuauguagaaagcacaacaaauugaaccaaaggcuuauuaggauaugccuagaagucuuuuguaauguaucccauaucauuuaaaaaaucauuugccucuguucuaaaguauuaauggauuaaaaauaaaaauagcuguuagcuuaauauacuuuuacuuacuuggccaaaaaaaauacgaucaaucaucagagacaaacucaaaguaacaaagcugaaaaacaaaaauagcauagugauucacauuuggagcuugcugaaaauccacuauuagcauauggcuuuguacgugccuugcaucaaaagccacuauaaaaaugcuuuacaguuucaccaacugaauauagauuuacacauuuugaaagguaucuacugaaaaagaucaguagauaagauuauauaaucgauuaauauuguaaaaaauauauuaauaaaaagauuauugaaagacuacugcuguauaacaaauuaccccaaaacuuguuaacuuaaacuaugaauauuuaccauuucauaguuccuguggaucaagaaccuagguguugcuuagcugggugccucuggcucgaggucgcucaugaauuguagucaagcucuuagcaggggcuacaguuucaucugaagguucaauuacagguggagagaucagcuuccaaauuugcucacaugguugcugguggggcuaaguuccucaacauauggccguuuccuuaaagcugccucaugacauaauuaacuggcuuaacccaggguaagucagccaagagugagugagacaggcacccaagauggaagccauaaucuuuuuauuuauguauucuuuucuuuuuuuuagagacagggucuugcucugucacccaggcuggagugcaguagugugugaucauggcucacugcagccuugaccuccugggcucaagugauccucccaccucagccuuccaaguaacuaggacuacaggugugugccgccaugacuggauaauuuuuggauuuucuguagagauggggucucacuauauuacccaacuggucucaaacuccgggccucaagcaguacuuccccauuggccucccaaaaugcugggauuacagauauaagccacugugccuggccaccauagucuuuucauaacccagucuuguaagugauaucccaucccuucugcuguauucuacucauuagaauugagucgacaaaucuagcccauguucaagggggaggggauuauacaaagacauaaauagcaggaggaugggaucacuggaggccaucucagagacugccuccaacaaacacauauacagaaaaauacgcuaugaagguaaagcucuaugaaucaucacuacaugaacacaacuguguaccugccauacagagcaggauaaagaguauuagcagcaccaccuugucccuccaaucagucagucccuaccuccuccccaaaaguaacccaaagguaacccuuccucuucccaaagguaaccacuauccuaauuucugauaacauagaugaguuuuaucuuuuuuugaauuuuauaagaauaggaucauaccauauguacucaugucuaaauuccuuuagucauugugcuugugagauugaaccaaguuuuuuugcgugcuguaguucauuccuuuacaauacuguguauuguaacuauguauaccacacuguauguauuccuucuauugauggacacugugcuuccauuuccagcuauugugaauagugcugcaaugaacauucuuuuacacaucuuuugguauccauauaugugcauuucuguuagacauauaccuaggauuggaauuggugggcccuaagguagcggucccuaaccuuuuuggcaccagggucugguuucuugaaagacaguuuucccacaaacagguugcgggggugggaguggggcaugguuucuggaugaaacuguuccaccucagaucacuggacauuagaugcucauacggagcacaaccuagaucccuugcaugugcaguucacaguaggguucacacuucuguaagaaugugacaggagguggagcucaggcaguaaugcuugcuugcuugcucaccuccugcugugcagcccaguuccuaagaggccauggacuggggccaguccacagccuugggacuggugaccccugcccuaaguuguaagugcaacuauguauuuauuuagcuuuuguaaguacuuaaaaguuuuccaaaauaguguauuaguuugcagucccacaggaauauauaaguuccacaucauuuuagccauuuggguggauguauaguauaguaguauuucaugguggcuuuacuuuguuuuuccuugauaacaaaugaaaugagucucuuuauauuuauuggccauuuuaauauuuuuugaaguaccugaugaaaccuuuucaauaauuuuucuaugaguuaucuuuuucuuauagauuuuuaaaaguuuuauauauaaucuggauguaagguuuuauuuuugagauggagccucacucuguugcccaggcuggagugcaguggugcaauuucaguucauugcaacgucuaccucugggguucaaucguuucuccugccucagccucccaaguagcugggauuauaggcaugugccacaaugcccagcuaauuuuuuuguauuuuuagcagagacaggguuucaucauauuggccaggcuggucuugaacuccugaccucaggugaugugccugccucagccucccaaagugcugggauuauaggcgugagccaucgugcccaaccacuagaacacuuuaaaucacuggguaagaauuacaaucccuaacugaugaugauucaaccuacgauuuuucaacuuuaaaaugguacccauacagccauucuguuuuucacuuucaguacaguauucaaugaauuacaugagauauucaaauauuuuauuaugaaauaggcuuuguguuagaugauuuugcucaacuguaggcuaauguaagcguucugagcacguuuaugguaggcuaagcugugauguucaguacguuagauguguuaagugcauuuuugacguagaauauuuucuuuguuauuuauuuuguuuagagacagguuaucacucuguuucccaggcuggagugcaguggaaugaucauagcucacugcaaccuugaacuccuggguugaagggauccuccugccucauccucccaaguagcuaggaccacaggcgugccuagugccaccuauacuuggccaauuuuuaaauuuuuuuguugagauggggucucauuauguugcucagguuguucuugaacuccuggucucccagggcacugggauuacaggugugagccacugugccuugccugacuuaugauauuuucaaccugcaaugaguuuaucaagauguaacccugagucaaggagcaucuguauuguuauaucuuuuucccccacagacuuugacuuugagagcagacacuguaucuuacucacuucugaauuaucaaaugcuggauacaaaguagguuaaaugcuuauuaaaugaauaaguuauuaucaugcugcugaugagauuaaaaaggcuuucuaucucccucagugguaaagccgauaggaacugagccccugcuaucucucugaccucauuauuacauucucccaaacucacucucuuuuagccacaucagucuccuugcuguuccuugaacaugcccagcauacuuaguacuuggcuggccccuuugccuggaauacucucucaucaaguaacuacaugguucacucucucaacuccuuuaaguuuuggcuccagugucaccuuaucauggugaucuuucccaacuacccuauuuaaaaauaacagcucccccauuaccccaagcacuggcauucuauccuucuuaucccacaauuauuuuucccuguauuaccaucacuugacaaauauauauuuacucuuaucuuuuuagcugucugucucucccuacuagaauguaaacuucaugaaggcagguacuuuuuuugguuaaacugaugcaucuccuacaucuggaacacugccuggcacauaguaggauuaaauaauuccugaaugaaugaauacauuuaaugcaauguuauuaauacaucugagaaaugacaacaguagcaacugagaugcaagauaauuuaguccuuuucagauugcuacccgaaaaauacuugugacuagugaauacuaguacagucaugcauugcuuaacaauggggauacauucugagaacugcaucauuaggcaguuucaucauugugcaaacaucauagagugcacuuacacaagccuagaugguacagcuuacagacaucuaggcuauaugguauagccuacugcuccuaggcuacaaaccuauacagcaugauaguaugcugaauauuguaagcaauugcaacacaaugcuauguaucuguguaucuaacuauagcuaaacaggcugggcaugguggcccaugccuguauuuccagcacuuugggaggccaagguggguggaucaccugaggucaggaguuugagacuagcuggccaacauggugaaaccccaacucgacuaaaaauaaaaaaauuagccaggcgugguggcaggcgccuguaaucccagcuguuugggaggcugaggcaggagaaucacuugaaccugggaggcggaggcugcagugaagugagaaugcaccacugcacuccagccuaggugacagagugagacuccgucucaaauaaaaaaauauauauagccaaacagagaaacuaaaguacacuaaaauacgguaauauaaucuuaugggaccacugucauaaaugcaguccagugcuaaccaaaaugucauuaugcggugcaugauuguauauuaaaaagauuacuguuguaagagucagaaugcagucaucccuucaguaaauaauuauucgggguagucuacuagauacuugggauacaacucauccuaggagcucauaguguaguuagaagauguggguuucaauaccaguauagcaaccagcccaaugacuuugacuaauacauuuuaaauuucugcgagccuccuguuuucucuacuacaaaauaaaaacauauauugccuagacugaaguauuaugaaaauuaugagguaauaugugaaaacacauuaugaauuauaaagccuuauacaaauguaaaagaaucaaguaucucuaaaauauaugugagaaauauuuaggaaauaaagcauuggaaaacacuaaguuagaaauaauuacaaaagcacucaguuaagcaaauuaaaauaguuauaaucaggaucauaaauaaaaaauauaaguuuugcauuauucuauuuccuuggacuaagaguucucauugacauuagaagauaaaauaauuaacugaaagauguaaaaucuuguucguaaucugugauuuguaggcuacuaaaauaaauggauggauuauugccacacuuacccuacagguaaaaaaugauguagaauaagaucaagcuuucuugguucuugacagaaaugucugaagagcaaagguguccacagaaugacagcugugggacgaauuaugaaggcaagugccaccagggaugaguauuugacacuauaagaggaaaaugugugauaagacaagugggaaauuaacuugaaguuaucuaucauuuacacugugauuugacauuuuccuuuugguauaaauagcuauaugaacuuuuuuuuguuuuguuuuguuuuguuugagacagagucucacucugucacccaggcuggagugcaguggcaugaucuuggcucacggcaacuucugccucccaggugcaagugauucuccugccucagcaucccgaguagcugggauuacagguguguaccaccaugcccgacuaauuuuuuguauuuucaguagagaugggguuucaccuuguuggccaggcuggccucaaacuccugacgucaggugaucugcccaccucagccuccuaaagugcugggauuacaggcuaauccccaugccaggcuaauuuuuuguauuuuuagugggagacaggguuuuaccauguuggccaggcuggucucaaacuccugaccucaggcgauccgccagccucagccuccuaaagugcugggauuacaggcaggagccacagugccuggccuaaauagcuauauuaacuuuugcagguuacuuacgcuuucugggucuuaguuuuucuuaucuuuuaaaaaagguaauaucuaaagccguuuucagugcucaucuucuaauucuaguauuuucaaauaagaaguuaucauaugucuuaaugccagucuugugugcuaaaaagcaugcuuuuuaccucauaacuuugccaauuacuuucuugauugaaaaaaaaaugaucaaguuucuccuaaggagcuauaagaaagucauaaagagaggcuuucucuaagaaaaagcaugagcauuuaaagaaacaggauuauuuaggcagugaugggcucagaguauuuagaauuuuguuuugaaaguuaauuuuagccaagugaaauauauaugcauacaacugauaaaaggccuacuguauaaacuguaugaucauggauagaaauacagauuuuuauuaacaggacuucucuaaacuaaugguugaaagagacaauuugauaauuuaaucaugaggacuauggauaguauauuauuauguggaaaaauacuuaguccuguaaaaaauuaaaagaaagcaaaauaagacaaccuauauuaccauuauauaccuauuaacuaauaaaaauaacuauaaagaaaucuguaggccaggugugguggcucaggccugcaaucccagcacuuugggaggccgagguggguggaucaccugaagucaggaguucaagaccagucuggccaaaauggugaaacccugucucuacuaaagauagaaaaaaauuagcugggugugguggcaggugccuguaaucccagcuacuugggaggcugaggcaggagaaucacuugaaccugggaaguggagguugcaaugagcugagaucaugccauugcacucuagccugggcaacaacaaugaaacuccaucucaaaaaaaagaaaaaaaaaaaagaaugaauucuguaauguugaugaggauguaagcucaaggauaacacauucaaaugcuuacagagacccaguaaacuauaaaaaugagaaauggggcugggugcagugacucacgccuguaaucccagcacuuugggaggccgaggcagcuggaucacuaggucaggaguucaagaccagccuggccaacauggugaaaccccaucucuacuaaaaauacaaaaauuagcugggcgugguggugcgcgccuguagucccagcuacucgggaggcugaagcagaauugcuugaacccaggaggcagagguugcagugggccgagauggagccacuguacuccagccugggcgacagagagagacacugucucgaaaaaaaaaaauaaaauaaaaaugagaaauguaggcuaaguuugaaccaugguauugucaugaaggaauccuagcccaaaauacuauuagaacuuccaauuuuucaagagaaaguugaaauccagauuuugauacaugagcuugaaauuuaggccagguuugguggcucaugccuguaaucccaacgcuuuaagaggccguggugggaggauuacuugaucccggaguugaacaccagcugggcaaccuaaagagaccccaucuccacaaauuuuuuuuuuuugagacaguuuugcucuuguugcccaggcuggagugcaaucgugugaccucgacugacugcaaccccugccuccuggguucaagugauucuccugucucauccucccgaguagcugggauuauaggcaugcaccaccaaauccagcuaauuuuguauuuuuaguggagacgggguuucaccauguuggccaggcuggucucgaacucccgaccucaagugauccacccgucucggccucccaaaguguggagauuacaggcgugaaccaccacacccggccaauaguugcauuuuuuaaaggagugugcaaaaugucauuuuauugucaggucuggaauaguaucugucaugcuuauacaaggaaaaaugcuuauauagcaguccuuuuguaccaugugacccuugcgcuuccugacugaauuagggaagggcaccugggcccagguagccaaucuaaggcuggccagugugaaauaaaguuauguccagauagagacaaugagauuuaauggaccuaauucgauucucucaagcugaacgugagauauggagaaaucuggguaauugcuagcaaaaacagaaguggagagacuagcuaagccccuaaaugauggaagacuaaggcaggauucauaggcuauuugggauauaaaggcacaacaaaacaguccauuccccaaaacugccuuggauucugcauaacauuucaauucauuuguguggcucagauauucuacaguuuucuuccaguccuagccacaaggcuugagaugcccauuuucccuuuuagccuuaaaauaaaguccucaucauauacguaacuugagugaaugcuuuuucuuguaguuaagagagucuaagacagaaaugaucuuauuugauuugaucauccuaacaaccuuuuguguaggaagaauggauacuagaauuuuaacuagaucccaaauucuggcuuuucuccuuucaguauauccuaaauacugcuauuacaaaagaaguuuuucaaaaucagauuugauuaugucaugcuacucaaacgccucaaaugguucccuauuaccuacagaauaaaauccaaauucaaagucucauuccagccucaucccuucuucuucucuucuuccaugcauccuacaacacucuauaacuacucuggacaaucugccuugaauauacuguaacuguaacuguaaauggagcccauuuacaguucuaugccuucacucauguucccauugcgugguauuuguuuccccaguuuaaaggaagccaaauaaaguccaaguauuuccuauuugcccuuccaaaacucuucuccuccagccuuuauccagucugcacgcaggaaagcugaccugaauggacagcaucaguggcuaccuugcuuucuggcuucugacuguuuuggguugagaggcagaagaguugggucaggauuauuuaguucccuggcugucuccucauuauugcuaaaggcuggcugugccugucccugcuggggcacucucuuacaauuacagcuuuuuauagauuccaguaaccauuucuucuccuugcuccuuggggccuagagauaauacagacuuccuacuauaaccaugcuggggguacuaugguguuuccuuauuggcuuuucuaaauauugucuaaaccuuugcaaauauuccuuuuguuaaacucuccuuaauuauccuguuugaguauuaucuguuuucugcuauaauauaucaacugaaaauuugugguucucaugacucaugaaaauuagggggucuacuagacauuacaauauguugauauuuaagauuuuucaaaaguagaauuuugaacauaauuauuaacaauaauuuuucuuaccuguucauagacuuugaaccuuccaaaggauaguagaaaagagcaauuauagugagaacaguuuccaugguguuuguaaggguucugguacagcaauaccaugugaaccaggagcacaacuggcaaaaaaacuaagaaaaaguacagagcaaacauauaugaaauuggaaauggaaaaccuuaguacauauuaucuucuaaauagcaagcaagucuaaauauugugaaaaggacaucaaaagguagaugauguuaaaguaaguaggcaugcccaaacgucguuuuuagaaaguuacaugaaacacagguuuaugauaauagcagaucuauauuuguucauguuaagaaguuuauacuuucaggugcauuuuuauggcacuucauuugauuuaaaaucccacuuuccauuaaugaaacacauaaaaaacagauucuuugaugguagaguuuacagaugauugaaauucauaacuagauucuuccaaucaauauuucucaaacugucuuauaguacugacacaaguauuaugacuguuuuuuuguugaccuuguuuggaauguugcacuuguuuggaaugucucccuguuuuggaacgcugaugaaaaauuaagacaaaagaggaaagaggaaaaaaaagucaggagacauuauuaaauuuuaauuuggagauugacuaaauuaaugaaucaguuuuuggaagaacaugcacacagagcaccauuaagucuacaaaacaaauguguuaaaagaaacuuguuaguugaggcaauuguuaagcauguggcacuagcuucccaucucaccaaauauagccuuuaaaaaauguucccaauuuucaugaaaguaaagguuuucccuaaacuagaagaaccuagugcuguauccuuuuuuuuucuucgagaaggagucuugcucuugcucugucacccagguuagagugcaguggcacaaucucugccuccuggguucaagcaauucuccugccuuagccucccgaguagcugggauuacaggugucugccaccacgccuggauaauuuuuguauuuuuaguagagacaggguuucaccguguuggccaggcuggucucgaacuccggaccuugugauccgcccaccucagccucccaaagugcugggauuauaggggugagccaccaugcccggcccuagugcuguaucuuuggaggaaggacuucaaagccaucaugacuuuugccuaccauuuuauguugagccuucugcaauguacauaaaguauaagcacaaaauaaugaggcuaaccauauugcugaaucaauuagcaaggacuuaguugcuaaaccaaucuuucuuuuuaaugcaaaggaauagaauaccugcagaaauguucccuuucuaauuuauuaauaaauuauauuucagaaauauguugcuaaauugguuacuuggaauuuagaauguauuuuccaauagaaacaauauaaaaaagguaguuaagacuuucaaacaggcucauauaagcuuauuaacuuuacaaagagccaagugaauuaacgacaguacuacagaauccaaucccucaucaggguauuguuuaaaugggaaaaauccauucaagauuggagugggagaugucaggaaucuaucuucccaccuugaaauaagucaaacgacaaaagauagucuugcauacuauacuuucuuccuuacaugaguccaguaauugcaccaaccuaauauuguuguggcacaaacgacaauuacuuuugcaccaaccuaauacuuccaacaucccauucagaagugagaguuucagugcaaaaagauuucucgggcugcaccucagauagaggcuggcuagaggaacagaacaaggguuguaaauagcuaagaugcuuugugagguagcugguaauuuagaacgaucccuacucaauucuauggaaagagaggcaaggacaguuuugaggagugaaggggcuuccaaagguugucucccaggguuuagacucucauaggguuugagggcaucaguggcuuacacugugcagggcuuaauccgaaggaaagauauggcaggugccacuugcauauuacuguucuuauuuauggaaguaccucuauaaaguuguaugaauuaucuucuaaaauuguuuugggaaucaauguuuccaugugcuuuauacccauaggaacgaaauaacuggcauacagcuucuaaaguauuuaggacuuaccacccaucuugccacuuccugauuuucuaguugcuucauuaaugaguaaagucucacaucugcuacagcagacagaagugcuugggcaagucuaggaauccaaaucuucaucaguuaaaaagaagaacaggauguuaaaaauaucuguugguucaaacugaauuaugauaaaagucaacaagcugauccaacuaucuaugggaagccauucuuaguacaaaaauaggcaauauauuuuucuauucuuccacaaaacuacaucccuacauccccuuuucuacaaaaauuauauucucauuaaaauaaucaauguaguuuuaaguuuuaccagucucauucucuguauguguguguauauaugacauauauacacauauguuauauauaaaauauauuauaaauauaaauauauauauuuauauauaaauaugauauuuaccagucucauucucuguaugugugcauauauaugacauauauacacacacauauauuauaaauauauuuuuaaauuauuuuuuauuauauugauugauugacagggucucacucuguuacccaggcugcagccuugaauccaggagugaagcaauuuuccugccucagucuacugaguagcuaggacuucagacaugcacugccacacucagcuaaucuugccucaaaugauacuuccaccuuggccucccaaaguguugggauuacaagcgugagccacugugccuggcccuaauuuuaauguaaauauuaauagccagucauuuaauuguguuaaguuucuguuuuauuuauuuauuuuuaugagacguaucgcucugucgcccaggcuggaguccaguggcgcaaccgcggcucacugcaagcuccgccucccggguucacgccauucuccugccucagccucccacgcccggcuaauuuuuuuguauuuuuaguagagacgggguuucacaauguuagccagcauggucucgaucuccugaccucgugauccacccgccucggccucccaaagugcugggauuacagguguaagccaccgugcucggccaaguuucuauuuuaaaaguauauuuauauucauuagcaacaacagguuuuuaaaaauucaaauauuugcagcacuguguacuauguaucaugcuauuuuauauguaucaacucauucaguccuaacaaucuucugagucaagaacuguuuuauagaugaggaaacugaggcacagagagguuaacuaauuuuccaaggcugcacagcuaguaaguaugaaagccggcauuauaaacccaggucugccugacuuuaauuacuaaguuaugcugcuucucuauccugcaauauagauaauaagauaauauuauguauaagauaauaagauauaaaauaagauaauaagaaauacuuuuuuuuuuuuugagacggagucuuuuuuuuuuuggagacagagucucgcucuguugcccaggguggagugcaguggcacgaucacggcucacugcaagcuccaccucccagauuccagcaauucuccugccucagccuccugaguagcugggacuacaggugcacgccgccacgcccagcuaauuuuuuguauuuuaguagagaugggguuucaccauguugcccaggcuggucucgaacuccugaacucaggcaauccgccugccucggccucccaacgugcuaggauuacaggagugagcaaccgugcccagcgagauggagucuugcucugucgcccaagcuggagugcagcugugugaucuuggcucaccgccaccucugccucccagguucaagcgauucuccugccucagccuugugaguagcugggacuacagaugcaugccaccacgccuggcuaauuuuuuguauuuuuaguagagacgagguuucaccauuuuagccaggauggucuugaucucgugaccuugugaucugcccgccucagccucccaaagugcuaggauuacaggcaugagccaccgcaccuggcuaacaaauuacuuuuuaaaaaagcacaaauauucugcaauuauaggaacaugguauucagaugacauuaaagaguaaauuuaaguguaaaacugaaauaaagacuaaauguauuacaacuaaauuauaguuagaaaggcuaaugcuaugcacuagcaucucucagaguuaaaaaaaaaggugucauaguuaacacuaacaaaauaacaacugcugguagagcacaauuuaaucuugguuuguuuaaaagauguguuucuaaaaauuuauacgugaguuuauuuauuuuuuuauuuugugugugugugugugagacagagucucacucugucauccaggcuggagugcaguggugcgaucuuggcucauggcaaccuccaccucccaaguucaagcgauucuccugccuuagccucccaaguagcugggauuacaggugcccgccaccaugccuguauaauuuuucuauuuuuaguagagaugggguuucaccauguuggccagcuagucucgaacuccugaccucaggugauccaccccccucacccucccaaagugcugggauuacaggcgugauccaccgcgccggcuguuaauucauauuuuuguugaagcaaacuucauuaaguccacauuauaggagcugcuuuacuuuuaguugucaguggcuuuuagcacuuuauuuucuuuuuguccacaauguguaaauaaaugcuaaaauuggaaaguuaaagguacccaguacuuaauuucacauaaacugugcccuguaaaauacaggaaaaggcacucauguacauaccuucuguuuacucugcauagggagcuauaagcuucauccuuacuucccaggcccccugaaagcaguucauaugaaaagucaauuuggcuacaaacuuaauaugagccaacagugugagguagcuauuaaaaagcuaaaagaauuccugugcucugagaaauguaaguuaauggacccaccauauucugaacuaguuacucugccuucauuauugugucaguuuggagauccacauuuuaagacggauauuaauaaauuacaaagugucuagaggauacuaucuaugauuaugagguuaagagcuagagacauuuaccccgaauaaagagaaguuuuucaagggugguuaaguagaaaucuugaauuuaaaacaaaguagacuuucgcauaacaauaagcggaguucugaacucccagucauuagcaguuucuccagauuuuugaugccauaauuuuccauguuacaguaaggaccugcuaaagaguaaaauaaagcaguggagugagguaaagagaagaacaugccaggcguaacuugagcacuaggccuauguugguagcuccucauuccauacuucuguucuuuacacuccugacuccuccccuaagcuacaggagccaaauacccuuuuguugucuucugacuauucaaagacccuacuguuggcaagcuugguggcucaccccuguaaucucaacacuuugggagguagaggcaggcagaucauuugaguccagccuggccacggugaaaccccgucucuacuaaaaauacaaaaauuagccaggugugguggcagacaccuguaaucccagcuacucgggaggcugaggcaggagaaucacuugaacccgggaggcggcaguuacagccagccaagauggugccacugcacuccagccugggcgacagagugagauuccauuucaaaagaaacaaaacccaacaaaccuuacugugguuccccauucagguuuccccuccucuuccucuuucuuuuuacauguuccaugccaucacaggccaaaagacauauaacaugagccacauguggaauuuuaaauucuauagcuggcaaauuaaaaaguaacaacagagaugacccccaaauccaaaacagguaaaauuaauuucaucuugucuaacccaauauaucuaaggcaucaucauuugaacauuuaaucaauaaaaauuauaaaaauauuuuuauucuuuuuuuguacuaggccuuugacauucaguauguauuuuacauuuucagcacuucucaaauuggacuagccacauuugaagucuucaacagcuacauguagcuaguggcuaccaugguggacagugcagcucuaagccaucuauccuuuuuaaaaauuuuuuguagaaacagaguuuugcuauguugcccaggcuguucucaaacuccuggccucaagcaauccucccaccucagccucccaaagugcugagauuacaacugugagccaccaugccuagcugugcauaagccuuaugcaguuuguagaggagccaucugggaagagcacuaggcugugaguaaauagaccugggauuuagcucuaguucugcuuuuaacacguugugaccuuggucuauuuacuucacuucuccaaccucuucuagcuucaaaauuauguauauaauuugcuuaaaauaaucaauaugagaguaugaaugacugaucauauccuaaugaaucucuacagggucaaguucuagauacgacaaugaguuccuuuuagagggguuggagcaggucaggggaggcuuccuucacaucacaaaaugaccuggugggucagcuacagauggagggcaguggauaggucuuggaggagcaggaaauuuuucuaucuugaagaccucuucauuuguaaucugaccuacuuccugggauauaaacugucauugaugagauuauguauauuuucuugugauuccagacuuuauggauaccuugcauaaucuauaaacuaguagauaacuguaagagaagaaaagccagguugcggcuccuaaauucugccuguuguuaauggaagaaacucugcuacugcucugaauucuccuuccccaucaucuucccauuugaagcaucgguuucacugguuuaacccuaauuucucaauaacggaagcaaauauugcaauggggagaguacaaccccaccuuaaaacaaauacccuagaaccugugucuuucuaagcuacacaaaacacgucaggauuuggacugccuuuggaaugcugagccauuaacccccacugacagaaaucggggggagcacaaacucugagucucaucugaugacagcuuaaaagaucaugggagugaggcuagagaaacuuuuacaccauuaguccugcccuuguacuaucuccuggcaacugaccccagcaauuaauagccuaggaauuacaauccuacuuacuguugaugccuaauuacuauauaggacgaugauuaugcagaucauuaaauguuugucaaauuaaaaauuuuaaaguuuuaauuucaacacuaaauccucaguggguuuagauguauacagacuucauaaaaucauaucacacggucuucuuacaagguaaaaaacacaaaauacaacggugcucucaagugauacuuuuuuugcgggggaugggggaaggaguuucgcuuuuguugcccaggcuagaaugcaauggcgugaucucggcucaccgcaaccuccaccuccuggguucaagugauucuccuaccucagccuccagaaagucugagauuacaggcaugcgcgaccacacccggcuaauuuuguauuuuuaguagagacgcgguuucucuguguuggucaggcuggucucgaacucccaaccucaggugauccgcccgccucggccucccaaagugcugggauuacaggugugagccaccgcacgggcagaucaccucaggucgggaguucgagaccagccugaccaacacagagaaaccccaucucuacuaaaaauacaaaauuagccgggcaugguggugcaugccuguuaucccagcuacucgggaggcugaggcaggagaaucgcuugaacccgggagguggagguuguggugagccaagaucacgccauugcacuccagccuaggcaacaagagcaaacuccgucccaaaaaaaaaaaaaaaaaaaaaaaagaaagaaguauacuucuaauguccaaauaauacauaauauagucauuuugaaaaucugcacaucauaacaggauuccucauagcaggauauuuucaugcucagucuuguauuucagcacaaacuaaagaguuacacaucacaguaugucuguaguaucaugggcuucccagauauggcuggacuucagcaacaguagccuuuuaaaaacaaauuccauggccccaauaucauuuaguuacuuuuauuuaaacuuaccagcaacugaacacuaucuuucccuaaaagaugaagaaucuuguaaaugcuugcaaagauuaagggauaaguguaacuccucagucucucuguccauucccaagucaaauaaccauaauuaguaacauuaaggaguaaauguccaauaauauugaaaccuauuuccguguuuuuuuuuuuuuuaagauggggucucacucucuugcccaggcuggucucaaacuugggcucaagugguccugccucuacaggugcacaccacuucaccuggcaaaaucuauuuucauuuccauuuauaaaacaauauuuuauuuuguggcagucuuaaaacagcauuuuauacuggauauuugcauuaaaaauucaauuggccaacuaaacucuuaacuucuucaaggcaguaauguguuuuuuacuuucucuguauccuccaagugcuaaguacugugggaauguaugcuaacggcugugucaaguauauuaacauaaaagaaagauacaggagaaauauuuguauaaaauaaugguauacuuugaugaguuaaaauuauuuggggaaaauacggaaaacugaaaauauguauaguaguccccccuuaucugugguuucucuuuccauguuucaguugcccagagucaaccacugucugaaaauaugaagauauuuugagagagaccacauaaaaguucacauaacuuuuauuauaguauuguguuauacuuguuauauuuuaauacuguuaaucucuuacuguaccuaauuuguauaaacuuuaucauaagcguguguguauuuuuuacauauauaaaaacaauauauauagaguuugguacugucuacaguuucaagcauccacuagggauuuuggaaacuaucuacugaagacgagggagcaagggggacuacucuaaaagaaacugagcacaauuuccaagaugaauacacacucauagucuggaaaagaaaccacaaaggauauuugaaaaccaugugaugugaaacuucaagagacugccaguauucaucuggaacaaaacuugucugcacuaaaaagcaguuuaauauucguaaagcuaugguaaacaagagcagauaaauauuuucuccaagaagaucugaaaaacagaacaaaacagguaauaguggcacaaaagucaggcaguuccacuugcaaaacuuaaaaucugcugcucugguuggcuccuuguaaggcacaguagugaccucuggucccuccacaccauucuuaaagccaacuugguugguuauacaagcaccacagcgucaucacugggugacugccacucuuuuaguuuaaccaacuuuucuugcaacuuauuguguaaagauaauauuaaaauaaauacaaaaaaaaaagaguggguuaacuaaggccuuaggcuaauuaauuaggucauacuauguguguaucuaaugaaagaaaccagcuaacaaauuacuaauuugggaagcagcccuuuguauaugugcaauauaaaaugguccucuguacauauauauugaugauuacuauuauauaugccaggcacuguguuaauuucuucacaugcaucucacuuaauccuccaaacaauauuaugggauagguauuauuagccccauuuuacagacgagcaaauugaggcccagaaauuaaacugccuuguccaaauaaaguuguaaauuacuuaucaggauucaaacccgggucugugugaugucuccaaaguccugcucuugaccacaaauggacagccugucggccaaauacagaguauuuuuuaaaaaauugaauuuaguugccaacauuuaaaaaucagaauuuauauuaaaaucuguguuuccagcauuucccagcauuucaaaacucaagaucuggcaacacagagcucaacgggcaacuggcugguaaugaaauggaggggguuccuuuuagauggggguaggagcucuccagacaguguccccucacucacccccgcggcgccuggcgcucuucuccuggguguugaaguacaagguagacuuucucuuucgcagcuuuaucuugccgugggagcgguucuggagaccaugcaaagugaggcuggcaucuccgccccccggcuccauuccgcacuugcuuaggggccuccucaucccuggccgccaccuuccuaaggcggaagaaagcugcaguagcgcgcugcucguccauccauuaaguuuggccuuugagagcagucgucgcucgcaagcccggaaguaaccgggaacgggcaacuucguagcucccacccgacgugguggccuccuugcgguuuccuuucgccguuuccgaaccgagggauugcuacucgccuuuggcuuggcggucucugugcucggggguccgaaaacugcuggaaggcccccggucucuggaggggagcaggcgguagcgaguuuagugacguggagcaggcgcagaacaguc

SEQ ID NO: 192075 - RNA, 36714 nt, Homo sapiens
gacuguucugcgccugcuccacgucacuaaacucgcuaccgccugcuccccuccagagaccgggggccuuccagcaguuuucggacccccgagcacagagaccgccaagccaaaggcgaguagcaaucccucgguucggaaacggcgaaaggaaaccgcaaggaggccaccacgucgggugggagcuacgaaguugcccguucccgguuacuuccgggcuugcgagcgacgacugcucucaaaggccaaacuuaauggauggacgagcagcgcgcuacugcagcuuucuuccgccuuaggaagguggcggccagggaugaggaggccccuaagcaagugcggaauggagccggggggcggagaugccagccucacuuugcauggucuccagaaccgcucccacggcaagauaaagcugcgaaagagaaagucuaccuuguacuucaacacccaggagaagagcgccaggcgccgcgggggugagugaggggacacugucuggagagcuccuacccccaucuaaaaggaacccccuccauuucauuaccagccaguugcccguugagcucuguguugccagaucuugaguuuugaaaugcugggaaaugcuggaaacacagauuuuaauauaaauucugauuuuuaaauguuggcaacuaaauucaauuuuuuaaaaaauacucuguauuuggccgacaggcuguccauuuguggucaagagcaggacuuuggagacaucacacagacccggguuugaauccugauaaguaauuuacaacuuuauuuggacaaggcaguuuaauuucugggccucaauuugcucgucuguaaaauggggcuaauaauaccuaucccauaauauuguuuggaggauuaagugagaugcaugugaagaaauuaacacagugccuggcauauauaauaguaaucaucaauauauauguacagaggaccauuuuauauugcacauauacaaagggcugcuucccaaauuaguaauuuguuagcugguuucuuucauuagauacacacauaguaugaccuaauuaauuagccuaaggccuuaguuaacccacucuuuuuuuuuuguauuuauuuuaauauuaucuuuacacaauaaguugcaagaaaaguugguuaaacuaaaagaguggcagucacccagugaugacgcuguggugcuuguauaaccaaccaaguuggcuuuaagaaugguguggagggaccagaggucacuacugugccuuacaaggagccaaccagagcagcagauuuuaaguuuugcaaguggaacugccugacuuuugugccacuauuaccuguuuuguucuguuuuucagaucuucuuggagaaaauauuuaucugcucuuguuuaccauagcuuuacgaauauuaaacugcuuuuuagugcagacaaguuuuguuccagaugaauacuggcagucucuugaaguuucacaucacaugguuuucaaauauccuuugugguuucuuuuccagacuaugaguguguauucaucuuggaaauugugcucaguuucuuuuagaguagucccccuugcucccucgucuucaguagauaguuuccaaaaucccuaguggaugcuugaaacuguagacaguaccaaacucuauauauauuguuuuuauauauguaaaaaauacacacacgcuuaugauaaaguuuauacaaauuagguacaguaagagauuaacaguauuaaaauauaacaaguauaacacaauacuauaauaaaaguuaugugaacuuuuauguggucucucucaaaauaucuucauauuuucagacagugguugacucugggcaacugaaacauggaaagagaaaccacagauaaggggggacuacuauacauauuuucaguuuuccguauuuuccccaaauaauuuuaacucaucaaaguauaccauuauuuuauacaaauauuucuccuguaucuuucuuuuauguuaauauacuugacacagccguuagcauacauucccacaguacuuagcacuuggaggauacagagaaaguaaaaaacacauuacugccuugaagaaguuaagaguuuaguuggccaauugaauuuuuaaugcaaauauccaguauaaaaugcuguuuuaagacugccacaaaauaaaauauuguuuuauaaauggaaaugaaaauagauuuugccaggugaaguggugugcaccuguagaggcaggaccacuugagcccaaguuugagaccagccugggcaagagagugagaccccaucuuaaaaaaaaaaaaaacacggaaauagguuucaauauuauuggacauuuacuccuuaauguuacuaauuaugguuauuugacuugggaauggacagagagacugaggaguuacacuuaucccuuaaucuuugcaagcauuuacaagauucuucaucuuuuagggaaagauaguguucaguugcugguaaguuuaaauaaaaguaacuaaaugauauuggggccauggaauuuguuuuuaaaaggcuacuguugcugaaguccagccauaucugggaagcccaugauacuacagacauacugugauguguaacucuuuaguuugugcugaaauacaagacugagcaugaaaauauccugcuaugaggaauccuguuaugaugugcagauuuucaaaaugacuauauuauguauuauuuggacauuagaaguauacuucuuucuuuuuuuuuuuuuuuuuuuuuuuugggacggaguuugcucuuguugccuaggcuggagugcaauggcgugaucuuggcucaccacaaccuccaccucccggguucaagcgauucuccugccucagccucccgaguagcugggauaacaggcaugcaccaccaugcccggcuaauuuuguauuuuuaguagagaugggguuucucuguguuggucaggcuggucucgaacucccgaccugaggugaucugcccgugcgguggcucacaccuguaaucccagcacuuugggaggccgaggcgggcggaucaccugagguugggaguucgagaccagccugaccaacacagagaaaccgcgucucuacuaaaaauacaaaauuagccggguguggucgcgcaugccuguaaucucagacuuucuggaggcugagguaggagaaucacuugaacccaggagguggagguugcggugagccgagaucacgccauugcauucuagccugggcaacaaaagcgaaacuccuucccccaucccccgcaaaaaaaguaucacuugagagcaccguuguauuuuguguuuuuuaccuuguaagaagaccgugugauaugauuuuaugaagucuguauacaucuaaacccacugaggauuuaguguugaaauuaaaacuuuaaaauuuuuaauuugacaaacauuuaaugaucugcauaaucaucguccuauauaguaauuaggcaucaacaguaaguaggauuguaauuccuaggcuauuaauugcuggggucaguugccaggagauaguacaagggcaggacuaaugguguaaaaguuucucuagccucacucccaugaucuuuuaagcugucaucagaugagacucagaguuugugcuccccccgauuucugucaguggggguuaauggcucagcauuccaaaggcaguccaaauccugacguguuuuguguagcuuagaaagacacagguucuaggguauuuguuuuaaggugggguuguacucuccccauugcaauauuugcuuccguuauugagaaauuaggguuaaaccagugaaaccgaugcuucaaaugggaagaugauggggaaggagaauucagagcaguagcagaguuucuuccauuaacaacaggcagaauuuaggagccgcaaccuggcuuuucuucucuuacaguuaucuacuaguuuauagauuaugcaagguauccauaaagucuggaaucacaagaaaauauacauaaucucaucaaugacaguuuauaucccaggaaguaggucagauuacaaaugaagaggucuucaagauagaaaaauuuccugcuccuccaagaccuauccacugcccuccaucuguagcugacccaccaggucauuuugugaugugaaggaagccuccccugaccugcuccaaccccucuaaaaggaacucauugucguaucuagaacuugacccuguagagauucauuaggauaugaucagucauucauacucucauauugauuauuuuaagcaaauuauauacauaauuuugaagcuagaagagguuggagaagugaaguaaauagaccaaggucacaacguguuaaaagcagaacuagagcuaaaucccaggucuauuuacucacagccuagugcucuucccagauggcuccucuacaaacugcauaaggcuuaugcacagcuaggcaugguggcucacaguuguaaucucagcacuuugggaggcugaggugggaggauugcuugaggccaggaguuugagaacagccugggcaacauagcaaaacucuguuucuacaaaaaauuuuuaaaaaggauagauggcuuagagcugcacuguccaccaugguagccacuagcuacauguagcuguugaagacuucaaauguggcuaguccaauuugagaagugcugaaaauguaaaauacauacugaaugucaaaggccuaguacaaaaaaagaauaaaaauauuuuuauaauuuuuauugauuaaauguucaaaugaugaugccuuagauauauuggguuagacaagaugaaauuaauuuuaccuguuuuggauuugggggucaucucuguuguuacuuuuuaauuugccagcuauagaauuuaaaauuccacauguggcucauguuauaugucuuuuggccugugauggcauggaacauguaaaaagaaagaggaagaggaggggaaaccugaauggggaaccacaguaagguuuguuggguuuuguuucuuuugaaauggaaucucacucugucgcccaggcuggagugcaguggcaccaucuuggcuggcuguaacugccgccucccggguucaagugauucuccugccucagccucccgaguagcugggauuacaggugucugccaccacaccuggcuaauuuuuguauuuuuaguagagacgggguuucaccguggccaggcuggacucaaaugaucugccugccucuaccucccaaaguguugagauuacaggggugagccaccaagcuugccaacaguagggucuuugaauagucagaagacaacaaaaggguauuuggcuccuguagcuuaggggaggagucaggaguguaaagaacagaaguauggaaugaggagcuaccaacauaggccuagugcucaaguuacgccuggcauguucuucucuuuaccucacuccacugcuuuauuuuacucuuuagcagguccuuacuguaacauggaaaauuauggcaucaaaaaucuggagaaacugcuaaugacugggaguucagaacuccgcuuauuguuaugcgaaagucuacuuuguuuuaaauucaagauuucuacuuaaccacccuugaaaaacuucucuuuauucgggguaaaugucucuagcucuuaaccucauaaucauagauaguauccucuagacacuuuguaauuuauuaauauccgucuuaaaauguggaucuccaaacugacacaauaaugaaggcagaguaacuaguucagaauaugguggguccauuaacuuacauuucucagagcacaggaauucuuuuagcuuuuuaauagcuaccucacacuguuggcucauauuaaguuuguagccaaauugacuuuucauaugaacugcuuucagggggccugggaaguaaggaugaagcuuauagcucccuaugcagaguaaacagaagguauguacaugagugccuuuuccuguauuuuacagggcacaguuuaugugaaauuaaguacuggguaccuuuaacuuuccaauuuuagcauuuauuuacacauuguggacaaaaagaaaauaaagugcuaaaagccacugacaacuaaaaguaaagcagcuccuauaauguggacuuaaugaaguuugcuucaacaaaaauaugaauuaacagccggcgcgguggaucacgccuguaaucccagcacuuugggagggugagggggguggaucaccugaggucaggaguucgagacuagcuggccaacauggugaaaccccaucucuacuaaaaauagaaaaauuauacaggcaugguggcgggcaccuguaaucccagcuacuugggaggcuaaggcaggagaaucgcuugaacuugggagguggagguugccaugagccaagaucgcaccacugcacuccagccuggaugacagagugagacucugucucacacacacacacacaaaauaaaaaaauaaauaaacucacguauaaauuuuuagaaacacaucuuuuaaacaaaccaagauuaaauugugcucuaccagcaguuguuauuuuguuaguguuaacuaugacaccuuuuuuuuuaacucugagagaugcuagugcauagcauuagccuuucuaacuauaauuuaguuguaauacauuuagucuuuauuucaguuuuacacuuaaauuuacucuuuaaugucaucugaauaccauguuccuauaauugcagaauauuugugcuuuuuuaaaaaguaauuuguuagccaggugcgguggcucaugccuguaauccuagcacuuugggaggcugaggcgggcagaucacaaggucacgagaucaagaccauccuggcuaaaauggugaaaccucgucucuacuaaaaauacaaaaaauuagccaggcgugguggcaugcaucuguagucccagcuacucacaaggcugaggcaggagaaucgcuugaaccugggaggcagagguggcggugagccaagaucacacagcugcacuccagcuugggcgacagagcaagacuccaucucgcugggcacgguugcucacuccuguaauccuagcacguugggaggccgaggcaggcggauugccugaguucaggaguucgagaccagccugggcaacauggugaaaccccaucucuacuaaaauacaaaaaauuagcugggcguggcggcgugcaccuguagucccagcuacucaggaggcugaggcaggagaauugcuggaaucugggagguggagcuugcagugagccgugaucgugccacugcacuccacccugggcaacagagcgagacucugucuccaaaaaaaaaaagacuccgucucaaaaaaaaaaaaaguauuucuuauuaucuuauuuuauaucuuauuaucuuauacauaauauuaucuuauuaucuauauugcaggauagagaagcagcauaacuuaguaauuaaagucaggcagaccuggguuuauaaugccggcuuucauacuuacuagcugugcagccuuggaaaauuaguuaaccucucugugccucaguuuccucaucuauaaaacaguucuugacucagaagauuguuaggacugaaugaguugauacauauaaaauagcaugauacauaguacacagugcugcaaauauuugaauuuuuaaaaaccuguuguugcuaaugaauauaaauauacuuuuaaaauagaaacuuggccgagcacgguggcuuacaccuguaaucccagcacuuugggaggccgaggcggguggaucacgaggucaggagaucgagaccaugcuggcuaacauugugaaaccccgucucuacuaaaaauacaaaaaaauuagccgggcgugggaggcugaggcaggagaauggcgugaacccgggaggcggagcuugcagugagccgcgguugcgccacuggacuccagccugggcgacagagcgauacgucucauaaaaauaaauaaauaaaacagaaacuuaacacaauuaaaugacuggcuauuaauauuuacauuaaaauuagggccaggcacaguggcucacgcuuguaaucccaacacuuugggaggccaagguggaaguaucauuugaggcaagauuagcugaguguggcagugcaugucugaaguccuagcuacucaguagacugaggcaggaaaauugcuucacuccuggauucaaggcugcagccuggguaacagagugagacccugucaaucaaucaauauaauaaaaaauaauuuaaaaauauauuuauaauauauguguguguauauaugucauauauaugcacacauacagagaaugagacugguaaauaucauauuuauauauaaauauauauauuuauauuuauaauauauuuuauauauaacauauguguauauaugucauauauacacacacauacagagaaugagacugguaaaacuuaaaacuacauugauuauuuuaaugagaauauaauuuuuguagaaaaggggauguagggauguaguuuuguggaagaauagaaaaauauauugccuauuuuuguacuaagaauggcuucccauagauaguuggaucagcuuguugacuuuuaucauaauucaguuugaaccaacagauauuuuuaacauccuguucuucuuuuuaacugaugaagauuuggauuccuagacuugcccaagcacuucugucugcuguagcagaugugagacuuuacucauuaaugaagcaacuagaaaaucaggaaguggcaagaugggugguaaguccuaaauacuuuagaagcuguaugccaguuauuucguuccuauggguauaaagcacauggaaacauugauucccaaaacaauuuuagaagauaauucauacaacuuuauagagguacuuccauaaauaagaacaguaauaugcaaguggcaccugccauaucuuuccuucggauuaagcccugcacaguguaagccacugaugcccucaaacccuaugagagucuaaacccugggagacaaccuuuggaagccccuucacuccucaaaacuguccuugccucucuuuccauagaauugaguagggaucguucuaaauuaccagcuaccucacaaagcaucuuagcuauuuacaacccuuguucuguuccucuagccagccucuaucugaggugcagcccgagaaaucuuuuugcacugaaacucucacuucugaaugggauguuggaaguauuagguuggugcaaaaguaauugucguuugugccacaacaauauuagguuggugcaauuacuggacucauguaaggaagaaaguauaguaugcaagacuaucuuuugucguuugacuuauuucaaggugggaagauagauuccugacaucucccacuccaaucuugaauggauuuuucccauuuaaacaauacccugaugagggauuggauucuguaguacugucguuaauucacuuggcucuuuguaaaguuaauaagcuuauaugagccuguuugaaagucuuaacuaccuuuuuuauauuguuucuauuggaaaauacauucuaaauuccaaguaaccaauuuagcaacauauuucugaaauauaauuuauuaauaaauuagaaagggaacauuucugcagguauucuauuccuuugcauuaaaaagaaagauugguuuagcaacuaaguccuugcuaauugauucagcaauaugguuagccucauuauuuugugcuuauacuuuauguacauugcagaaggcucaacauaaaaugguaggcaaaagucaugauggcuuugaaguccuuccuccaaagauacagcacuagggccgggcaugguggcucaccccuauaaucccagcacuuugggaggcugaggugggcggaucacaagguccggaguucgagaccagccuggccaacacggugaaacccugucucuacuaaaaauacaaaaauuauccaggcgugguggcagacaccuguaaucccagcuacucgggaggcuaaggcaggagaauugcuugaacccaggaggcagagauugugccacugcacucuaaccugggugacagagcaagagcaagacuccuucucgaagaaaaaaaaaggauacagcacuagguucuucuaguuuagggaaaaccuuuacuuucaugaaaauugggaacauuuuuuaaaggcuauauuuggugagaugggaagcuagugccacaugcuuaacaauugccucaacuaacaaguuucuuuuaacacauuuguuuuguagacuuaauggugcucugugugcauguucuuccaaaaacugauucauuaauuuagucaaucuccaaauuaaaauuuaauaaugucuccugacuuuuuuuuccucuuuccucuuuugucuuaauuuuucaucagcguuccaaaacagggagacauuccaaacaagugcaacauuccaaacaaggucaacaaaaaaacagucauaauacuugugucaguacuauaagacaguuugagaaauauugauuggaagaaucuaguuaugaauuucaaucaucuguaaacucuaccaucaaagaaucuguuuuuuauguguuucauuaauggaaagugggauuuuaaaucaaaugaagugccauaaaaaugcaccugaaaguauaaacuucuuaacaugaacaaauauagaucugcuauuaucauaaaccuguguuucauguaacuuucuaaaaacgacguuugggcaugccuacuuacuuuaacaucaucuaccuuuugauguccuuuucacaauauuuagacuugcuugcuauuuagaagauaauauguacuaagguuuuccauuuccaauuucauauauguuugcucuguacuuuuucuuaguuuuuuugccaguugugcuccugguucacaugguauugcuguaccagaacccuuacaaacaccauggaaacuguucucacuauaauugcucuuuucuacuauccuuuggaagguucaaagucuaugaacagguaagaaaaauuauuguuaauaauuauguucaaaauucuacuuuugaaaaaucuuaaauaucaacauauuguaaugucuaguagacccccuaauuuucaugagucaugagaaccacaaauuuucaguugauauauuauagcagaaaacagauaauacucaaacaggauaauuaaggagaguuuaacaaaaggaauauuugcaaagguuuagacaauauuuagaaaagccaauaaggaaacaccauaguacccccagcaugguuauaguaggaagucuguauuaucucuaggccccaaggagcaaggagaagaaaugguuacuggaaucuauaaaaagcuguaauuguaagagagugccccagcagggacaggcacagccagccuuuagcaauaaugaggagacagccagggaacuaaauaauccugacccaacucuucugccucucaacccaaaacagucagaagccagaaagcaagguagccacugaugcuguccauucaggucagcuuuccugcgugcagacuggauaaaggcuggaggagaagaguuuuggaagggcaaauaggaaauacuuggacuuuauuuggcuuccuuuaaacuggggaaacaaauaccacgcaaugggaacaugagugaaggcauagaacuguaaaugggcuccauuuacaguuacaguuacaguauauucaaggcagauuguccagaguaguuauagaguguuguaggaugcauggaagaagagaagaagaagggaugaggcuggaaugagacuuugaauuuggauuuuauucuguagguaauagggaaccauuugaggcguuugaguagcaugacauaaucaaaucugauuuugaaaaacuucuuuuguaauagcaguauuuaggauauacugaaaggagaaaagccagaauuugggaucuaguuaaaauucuaguauccauucuuccuacacaaaagguuguuaggaugaucaaaucaaauaagaucauuucugucuuagacucucuuaacuacaagaaaaagcauucacucaaguuacguauaugaugaggacuuuauuuuaaggcuaaaagggaaaaugggcaucucaagccuuguggcuaggacuggaagaaaacuguagaauaucugagccacacaaaugaauugaaauguuaugcagaauccaaggcaguuuuggggaauggacuguuuuguugugccuuuauaucccaaauagccuaugaauccugccuuagucuuccaucauuuaggggcuuagcuagucucuccacuucuguuuuugcuagcaauuacccagauuucuccauaucucacguucagcuugagagaaucgaauuagguccauuaaaucucauugucucuaucuggacauaacuuuauuucacacuggccagccuuagauuggcuaccugggcccaggugcccuucccuaauucagucaggaagcgcaagggucacaugguacaaaaggacugcuauauaagcauuuuuccuuguauaagcaugacagauacuauuccagaccugacaauaaaaugacauuuugcacacuccuuuaaaaaaugcaacuauuggccggguguggugguucacgccuguaaucuccacacuuugggaggccgagacggguggaucacuugaggucgggaguucgagaccagccuggccaacauggugaaaccccgucuccacuaaaaauacaaaauuagcuggauuugguggugcaugccuauaaucccagcuacucgggaggaugagacaggagaaucacuugaacccaggaggcagggguugcagucagucgaggucacacgauugcacuccagccugggcaacaagagcaaaacugucucaaaaaaaaaaaauuuguggagauggggucucuuuagguugcccagcugguguucaacuccgggaucaaguaauccucccaccacggccucuuaaagcguugggauuacaggcaugagccaccaaaccuggccuaaauuucaagcucauguaucaaaaucuggauuucaacuuucucuugaaaaauuggaaguucuaauaguauuuugggcuaggauuccuucaugacaauaccaugguucaaacuuagccuacauuucucauuuuuauuuuauuuuuuuuuuucgagacagugucucucucugucgcccaggcuggaguacaguggcuccaucucggcccacugcaaccucugccuccuggguucaagcaauucugcuucagccucccgaguagcugggacuacaggcgcgcaccaccacgcccagcuaauuuuuguauuuuuaguagagaugggguuucaccauguuggccaggcuggucuugaacuccugaccuagugauccagcugccucggccucccaaagugcugggauuacaggcgugagucacugcacccagccccauuucucauuuuuauaguuuacugggucucuguaagcauuugaauguguuauccuugagcuuacauccucaucaacauuacagaauucauucuuuuuuuuuuuucuuuuuuuugagauggaguuucauuguuguugcccaggcuagagugcaauggcaugaucucagcucauugcaaccuccacuucccagguucaagugauucuccugccucagccucccaaguagcugggauuacaggcaccugccaccacacccagcuaauuuuuuucuaucuuuaguagagacaggguuucaccauuuuggccagacuggucuugaacuccugacuucaggugauccacccaccucggccucccaaagugcugggauugcaggccugagccaccacaccuggccuacagauuucuuuauaguuauuuuuauuaguuaauagguauauaaugguaauauagguugucuuauuuugcuuucuuuuaauuuuuuacaggacuaaguauuuuuccacauaauaauauacuauccauaguccucaugauuaaauuaucaaauugucucuuucaaccauuaguuuagagaaguccuguuaauaaaaaucuguauuucuauccaugaucauacaguuuauacaguaggccuuuuaucaguuguaugcauauauauuucacuuggcuaaaauuaacuuucaaaacaaaauucuaaauacucugagcccaucacugccuaaauaauccuguuucuuuaaaugcucaugcuuuuucuuagagaaagccucucuuuaugacuuucuuauagcuccuuaggagaaacuugaucauuuuuuuuucaaucaagaaaguaauuggcaaaguuaugagguaaaaagcaugcuuuuuagcacacaagacuggcauuaagacauaugauaacuucuuauuugaaaauacuagaauuagaagaugagcacugaaaacggcuuuagauauuaccuuuuuuaaaagauaagaaaaacuaagacccagaaagcguaaguaaccugcaaaaguuaauauagcuauuuaggccaggcacuguggcuccugccuguaaucccagcacuuuaggaggcugaggcuggcggaucgccugaggucaggaguuugagaccagccuggccaacaugguaaaacccugucucccacuaaaaauacaaaaaauuagccuggcauggggauuagccuguaaucccagcacuuuaggaggcugaggugggcagaucaccugacgucaggaguuugaggccagccuggccaacaaggugaaaccccaucucuacugaaaauacaaaaaauuagucgggcauggugguacacaccuguaaucccagcuacucgggaugcugaggcaggagaaucacuugcaccugggaggcagaaguugccgugagccaagaucaugccacugcacuccagccugggugacagagugagacucugucucaaacaaaacaaaacaaaacaaaaaaaaguucauauagcuauuuauaccaaaaggaaaaugucaaaucacaguguaaaugauagauaacuucaaguuaauuucccacuugucuuaucacacauuuuccucuuauagugucaaauacucaucccugguggcacuugccuucauaauucgucccacagcugucauucuguggacaccuuugcucuucagacauuucugucaagaaccaagaaagcuugaucuuauucuacaucauuuuuuaccuguaggguaaguguggcaauaauccauccauuuauuuuaguagccuacaaaucacagauuacgaacaagauuuuacaucuuucaguuaauuauuuuaucuucuaaugucaaugagaacucuuaguccaaggaaauagaauaaugcaaaacuuauauuuuuuauuuaugauccugauuauaacuauuuuaauuugcuuaacugagugcuuuuguaauuauuucuaacuuaguguuuuccaaugcuuuauuuccuaaauauuucucacauauauuuuagagauacuugauucuuuuacauuuguauaaggcuuuauaauucauaauguguuuucacauauuaccucauaauuuucauaauacuucagucuaggcaauauauguuuuuauuuuguaguagagaaaacaggaggcucgcagaaauuuaaaauguauuagucaaagucauugggcugguugcuauacugguauugaaacccacaucuucuaacuacacuaugagcuccuaggaugaguuguaucccaaguaucuaguagacuaccccgaauaauuauuuacugaagggaugacugcauucugacucuuacaacaguaaucuuuuuaauauacaaucaugcaccgcauaaugacauuuugguuagcacuggacugcauuuaugacaguggucccauaagauuauauuaccguauuuuaguguacuuuaguuucucuguuuggcuauauauauuuuuuuauuugagacggagucucacucugucaccuaggcuggagugcaguggugcauucucacuucacugcagccuccgccucccagguucaagugauucuccugccucagccucccaaacagcugggauuacaggcgccugccaccacgccuggcuaauuuuuuuauuuuuagucgaguugggguuucaccauguuggccagcuagucucaaacuccugaccucaggugauccacccaccuuggccucccaaagugcuggaaauacaggcaugggccaccaugcccagccuguuuagcuauaguuagauacacagauacauagcauuguguugcaauugcuuacaauauucagcauacuaucaugcuguauagguuuguagccuaggagcaguaggcuauaccauauagccuagaugucuguaagcuguaccaucuaggcuuguguaagugcacucuaugauguuugcacaaugaugaaacugccuaaugaugcaguucucagaauguauccccauuguuaagcaaugcaugacuguacuaguauucacuagucacaaguauuuuucggguagcaaucugaaaaggacuaaauuaucuugcaucucaguugcuacuguugucauuucucagauguauuaauaacauugcauuaaauguauucauucauucaggaauuauuuaauccuacuaugugccaggcaguguuccagauguaggagaugcaucaguuuaaccaaaaaaaguaccugccuucaugaaguuuacauucuaguagggagagacagacagcuaaaaagauaagaguaaauauauauuugucaagugaugguaauacagggaaaaauaauugugggauaagaaggauagaaugccagugcuugggguaaugggggagcuguuauuuuuaaauaggguaguugggaaagaucaccaugauaaggugacacuggagccaaaacuuaaaggaguugagagagugaaccauguaguuacuugaugagagaguauuccaggcaaaggggccagccaaguacuaaguaugcugggcauguucaaggaacagcaaggagacugauguggcuaaaagagagugaguuugggagaauguaauaaugaggucagagagauagcaggggcucaguuccuaucggcuuuaccacugagggagauagaaagccuuuuuaaucucaucagcagcaugauaauaacuuauucauuuaauaagcauuuaaccuacuuuguauccagcauuugauaauucagaagugaguaagauacagugucugcucucaaagucaaagucugugggggaaaaagauauaacaauacagaugcuccuugacucaggguuacaucuugauaaacucauugcagguugaaaauaucauaagucaggcaaggcacaguggcucacaccuguaaucccagugcccugggagaccaggaguucaagaacaaccugagcaacauaaugagaccccaucucaacaaaaaaauuuaaaaauuggccaaguauagguggcacuaggcacgccugugguccuagcuacuugggaggaugaggcaggaggaucccuucaacccaggaguucaagguugcagugagcuaugaucauuccacugcacuccagccugggaaacagagugauaaccugucucuaaacaaaauaaauaacaaagaaaauauucuacgucaaaaaugcacuuaacacaucuaacguacugaacaucacagcuuagccuaccauaaacgugcucagaacgcuuacauuagccuacaguugagcaaaaucaucuaacacaaagccuauuucauaauaaaauauuugaauaucucauguaauucauugaauacuguacugaaagugaaaaacagaauggcuguauggguaccauuuuaaaguugaaaaaucguagguugaaucaucaucaguuagggauuguaauucuuacccagugauuuaaaguguucuagugguugggcacgauggcucacgccuauaaucccagcacuuugggaggcugaggcaggcacaucaccugaggucaggaguucaagaccagccuggccaauaugaugaaacccugucucugcuaaaaauacaaaaaaauuagcugggcauuguggcacaugccuauaaucccagcuacuugggaggcugaggcaggagaaacgauugaaccccagagguagacguugcaaugaacugaaauugcaccacugcacuccagccugggcaacagagugaggcuccaucucaaaaauaaaaccuuacauccagauuauauauaaaacuuuuaaaaaucuauaagaaaaagauaacucauagaaaaauuauugaaaagguuucaucagguacuucaaaaaauauuaaaauggccaauaaauauaaagagacucauuucauuuguuaucaaggaaaaacaaaguaaagccaccaugaaauacuacuauacuauacauccacccaaauggcuaaaaugauguggaacuuauauauuccugugggacugcaaacuaauacacuauuuuggaaaacuuuuaaguacuuacaaaagcuaaauaaauacauaguugcacuuacaacuuagggcaggggucaccagucccaaggcuguggacuggccccaguccauggccucuuaggaacugggcugcacagcaggaggugagcaagcaagcaagcauuacugccugagcuccaccuccugucacauucuuacagaagugugaacccuacugugaacugcacaugcaagggaucuagguugugcuccguaugagcaucuaauguccagugaucugagguggaacaguuucauccagaaaccaugccccacucccacccccgcaaccuguuugugggaaaacugucuuucaagaaaccagacccuggugccaaaaagguuagggaccgcuaccuuagggcccaccaauuccaauccuagguauaugucuaacagaaaugcacauauauggauaccaaaagauguguaaaagaauguucauugcagcacuauucacaauagcuggaaauggaagcacaguguccaucaauagaaggaauacauacagugugguauacauaguuacaauacacaguauuguaaaggaaugaacuacagcacgcaaaaaaacuugguucaaucucacaagcacaaugacuaaaggaauuuagacaugaguacauaugguaugauccuauucuuauaaaauucaaaaaaagauaaaacucaucuauguuaucagaaauuaggauagugguuaccuuugggaagaggaaggguuaccuuuggguuacuuuuggggaggagguagggacugacugauuggagggacaagguggugcugcuaauacucuuuauccugcucuguauggcagguacacaguuguguucauguagugaugauucauagagcuuuaccuucauagcguauuuuucuguauauguguuuguuggaggcagucucugagauggccuccagugaucccauccuccugcuauuuaugucuuuguauaauccccucccccuugaacaugggcuagauuugucgacucaauucuaaugaguagaauacagcagaagggaugggauaucacuuacaagacuggguuaugaaaagacuaugguggccaggcacaguggcuuauaucuguaaucccagcauuuugggaggccaauggggaaguacugcuugaggcccggaguuugagaccaguuggguaauauagugagaccccaucucuacagaaaauccaaaaauuauccagucauggcggcacacaccuguaguccuaguuacuuggaaggcugaggugggaggaucacuugagcccaggaggucaaggcugcagugagccaugaucacacacuacugcacuccagccugggugacagagcaagacccugucucuaaaaaaaagaaaagaauacauaaauaaaaagauuauggcuuccaucuugggugccugucucacucacucuuggcugacuuacccuggguuaagccaguuaauuaugucaugaggcagcuuuaaggaaacggccauauguugaggaacuuagccccaccagcaaccaugugagcaaauuuggaagcugaucucuccaccuguaauugaaccuucagaugaaacuguagccccugcuaagagcuugacuacaauucaugagcgaccucgagccagaggcacccagcuaagcaacaccuagguucuugauccacaggaacuaugaaaugguaaauauucauaguuuaaguuaacaaguuuugggguaauuuguuauacagcaguagucuuucaauaaucuuuuuauuaauauauuuuuuacaauauuaaucgauuauauaaucuuaucuacugaucuuuuucaguagauaccuuucaaaauguguaaaucuauauucaguuggugaaacuguaaagcauuuuuauaguggcuuuugaugcaaggcacguacaaagccauaugcuaauaguggauuuucagcaagcuccaaaugugaaucacuaugcuauuuuuguuuuucagcuuuguuacuuugaguuugucucugaugauugaucguauuuuuuuuggccaaguaaguaaaaguauauuaagcuaacagcuauuuuuauuuuuaauccauuaauacuuuagaacagaggcaaaugauuuuuuaaaugauaugggauacauuacaaaagacuucuaggcauauccuaauaagccuuugguucaauuuguugugcuuucuacauaaaagaauuaguacuccuagcuaauauucaggagaguacauuuuaaggcagggaauuauuaagugagcacugaauguuaccuguugcuguuucugucauuauugucagcuuuacgcuguaauucaaauuguaauguuuucaaagcuuuaucuucacagguaauaugucacauuguaaaguaccacacaguccaaaaaauaugucuacuauccucuuuaucucuuaacuggauauaaaacuuggauggagcuggaggccauuauucuaagugaaauaacucaggaauggaaagccaaauaucauauguucuuacuuauaagugggagcuaagcuaugggaugcaaagacauaagaaugauauaauggacucuggugacucaggguggggaagggugagagaggggugagaaauucuuauuucgaguacauauuggguacaguguacauugcuugggugauggguggaccaaaauccuagaaaucaccucuaaagaacuuauucauguaaccagaagccaucuguaccccaaaaacuugaaauaaaaacacaaacuuagacugccaaaauauaaguuugauucucacuuugaaucucaaaaaucuaguuuuacaaauuaacaaggaacacauuaauacuuaaagaagaaaaaauaacaguuaagaaggauuucauacagucauuaauuaaaauuauuaggccaggcaugguggcucacaccuauaaucgcagcacuuugggaggccgaggcaggcagaucacgaggucaggagauugagaccauccuggcuaacauggugaaaccccgucucuacuaaaaauagaaaaaauuagccgggcgugguagcgggcgccuguagucccagcuacucgggaggcugaggcaggagaauggcgugaacccgcgaggcggagcuugcagugagccgagaucgcgccacugcacuccagccugggcgacagagcaagacuccaucuuaaaaaaaaaaaaaaaaaaaaauuauuaauguaaacuauugccugguuuuuagacuucaauucugauuuaaugucaaaauuguaucaauccccuaaugccaaagauuacuacuuggcacuaacacauuucuauuuauuuuuccuucaacggugccaguggacucugguucaauuuaauuuuuugaaauuuaacgugcugcagaacuggggaacauuuuaugguucucauccauggcacugguacuucagucaaggauuuccaguuaucuuggguacucacuuacccuucuuuauucauggcugcuaucuagcaccaaagagauaccggauacuuuuggugacugugcuguggacacugcuuguuuauagguaagauuuuauuuguucaaaaggcuaaaauuuuuuauguuaccaagaaaucaaauuaaauucuucaaaaaguaaacuuuauguuuuggaggugccauuaacuuuuguuagugggaauuaucuuagaagauacaaguaguaguaauuauggaggcacuagagugaauacuuuagauauguaguuugcuuaauaaggauuacacucaauuuuuaagaacuuggacuaauuuuauuugcuuuaaaaaaaaaaaaaacagaccaggcacaguugcucaugccuguaauuucaauacuuugaaggccaaggugggaggauugcuugaagcaaggaguucaugaccagccugagcaacauagcaagacccucucucugaaaaaaaauuuaaaauuaccagggcaugauggcaugugccuguaguccuagcuauuggggaagcugaggcagaaggacugcuugagcccaggaauuuaagguugcagugagcuaugauugugcuacugcacuccagucugggugacaaaacaagacccugucucagucaaucagucaaucaauacuaccaaaauuuuaaauugaaggaccacagaaauacauucuaaaauaaaaauguauguauccuuauuccaaauuugacuaauuucacuuacuuggauugaaauagaaaucccguuuuuagaauguaacuguacuuuguaauuucaaauugacaucauauuuuaugauuaguuuuaccauaucauaaucaccuuauaacuaaaaaauaagaugaauuucugaagcaagaaauucagucugaauacuuagaaaauaaauagaucaaguuaaauauauuuuauauuaaauauauuacuuucucaaucuaucauauaacaugauaauuaauauuuuuuaauaauauuuguuuuuauuacagcauguugagccacaaagaauucagguuuauuuauccaguuuuaccauucuguaugguguucugugguaagugcuuuuguuuguuauagaaaauaaauuauauagaaauagucuaaagacaacacauccucauuaaacuaugucuauuuucaacuagguuaauaaggaauuacuuaauuacagauuaauuauauuacugcaauauucccuuuuuguaguccaaauaucuuuuuuccuauauccucuaaagugagauaaaaacauaaagauccuagcccagugcaguggugugcacuuuuaaucccagcuacucagaagccugaggcaggaggaucaccugagcccaggaguuugagaccagccuaccauauggcaaguccuucucucaaaaaacagacaaacaaaaaacccacauaaauauccaauacccaaagcaguuuuugguggugguguuucuauuugguggugguguuucucacuaaaaaguaaaguaacaugucuguuuuuagauuagcuauuuuaaguuuaugguuaaacuguaagggucuucauuuucacaaaggaaaaauguauuuacugcuguugaaacuaguuuuuaaugcuuuuacacacaaaacauuuacacuuuuaaaacucacucuaaggcauaugcaauuauuauuauuaucuuuuuagacagagucucacucugcugcccaggcuggagugcaguggcacgaucuuggcucacugcaaccuccaccucccuguguucaagcaauucuccugccucagccucccgaguagcugggauuacaggcauccgccaccauacccggcuaauuuuuguauuuuaaguagagacaggguuucaccguguuggccaggcuggucucgaacuccugaccucaggugauccacccgccucagccucccaaaagugcugggauugcaggcgugagccaccgcgcccagccuggcauaugccauuuuuuaaguaauuaacuccugauuuuauucaggccuuuucuccauuuuuccacagucuuaacauguauuuuuuugucacuuacaaaaauccuuacaugacucaauucaggaaaaucuggguuuuuacauugguugguuuggaaaaauuacgaauugaaacuuuauuaacuucaaguuuaauucggaauaaaugacuguugacuuccuucaaauauuaagaccuuaaaaaaaaucacagcguugagagagaagaaaugacuagccaacuggaacuggaggcuggaaaaaaccuagggaguuacaguuuucaaacuuauuuuuuacuuaaaaaaaaagaaaaacauugaguuaggcaauguuugaccaaguauacaucaacuccuacagaucugagauguauaaucucuucaauuuaagaagauaaacauacaaauauaaaaucaaauauuaaaaaucuguauuuuugauacaucugaaguucugaaaucaaagccucagucugucauuacuuuacaguguaaccacauacaaacgcaggcacauacaaaaauuuagacaucuaacagcuauuuggcaagccuuaagaauagcuggccccauuugucagaggaaaucuguucauaaaucacuauucagauguuaaaugguuucuguucuguuggguuuuuuuacagccacuugaguguguauuauaauuaaaucaagcauuggcagaguacaaaggcaaauguuuuugugugccuggaggggacggggagguugguuaguaacuugguuugauuucuguuuucauaaaccagauuuuuccagcauuccucuucuguguccuguugcuuuaccaaguauuuacacaaagauugaguugucugaauccucauugccagucuaaaagauugaaucuuuaaguggcaagaucccuguaaccagggccuauucacaguuuauugagauaaaaugcugaugagggguaaagagagccccuucuaauagguaagaaucaccccuucuuccauccucugucuacuuagaaggaucccuaaaagacagcaaccuagaaaaccccuugaucuccucacaggaugcauucuuuuccuccacacccuaccuaagguucuagagugggucaaaaaacucuaauuccuaggagauuuguacuuccacuaacagucagggcuguuuaaugccaagagguuccaacaguaggaucaguucugucuagugaugucaccuagacagaaaucucuggacauuuagaacaguucucuuuggagcucuugauguuuuagugacccaguuugaaucuuuccuaacuacuugaaaucuugaguuauaccacaaauuucagccuuauucugcuuugugugacuuguuuuaaccuauuuuuauguaaacaugacaacucugucagccauugcuguguaaaaggccaccucaaaacuguaguggcuuaaaacuccauuuauuauaauuuacaggucuacauuucaacugggcaguucucaucuccacugagcucacuuacacagcugcagauuggguagauagcucuauugaccuaggcugggcucucaugucugggguucaacuagcuguaggccaagucuucucagcucuucugaguuuucucuuccuccaacaggccagcuagggcuuguucacuuggcauaggccggguuccaagagagggagcaaauaugcaaggcccuuugagacaagggcuuggaauuugcauacugucacuuccaccacauucuuuucaugaaagcaagucacugggccaggccagauucaagagguggggaaauaaaugccaaccucauagugggaugggacacaggaagaaaaauaauugcagcaguuuuuucagucuacgguaacuucucuugccuaauuugaauuucccuuaguccuauaaaauaggacucaacucuagaaaauauauuuugugacuggcucugaucuuuagugaauuguucaacaaugugccucauuuuccuuaucuguaaaagaaaggugauauuuuagcaacacuaauuaaauucuuaguuugaaucucucauuugugcugacagaguucagcacccacuacugauucugaguugagugucugcuuaucuguuuuuaccacaguggcuaauauagacuucucucuuacugggccacuuuguuuuuccauauucuuaucuuuuuuuuuuuuuuuuuuuuuuugagacagagucucucucugucgcccaugcuggagugcaguggcgcaaucucagcucacuacaaccuccgccuccuggguucaagagauucuccugccucagccuccagaguagcuggaauuacaggcccaugccaccacagccagcuaauuuuuguauuuuuaguuggggcuugaccauguugaccaggcuggugucgaacuccugaccucagaugauccaccugccuuggccucccaaagugcugggauuacggcaugaggcaccacagcuggccccauauucuaaucuuuuuaucaaaauugcauauguacauuauuucagaagacauuccacaaggaauuaaaaaaaaaaauuguuccccugcucucccuauuuccucuccccaaaaacaaucaguuaagcauucuuucagcugguuauuuugguauuuaucucgauaucucuaaaacauuuauaaugccacuuaaaggucuuuguuuuaggcauuaacuguugaauucuaucgaagauggaaagauggcuuuacuuccuuaacaaaauagcaacauaaaauucuuccuggccagcugccaguggcugacgccuguaauccuagcacuuugggaggcugagguggguggaucaccugaggucaggaguucaagaccagccuggccaacagggugaaacccugucucuacuaaaaauacaaaaauuagcugggugugguggcacgcaccuguaaugccagcuacuugggaggcugagacaggagaaucacuugaacccuggagguggagguugcauugagccgagaucggcaccacugcacuccagccugggugacagagcgagauucugucuaaaaaaaaaaaauucuucuugauaccuucaucugugcccaguacccucauuaugguuaguaguucaaagucucucuuucccagccccauucuacuguaugucccauuccagaauugaaccaccuuuuguuguucuuaucuaaacacugaaacuaagcuuucucaaagaguauuuaaaaauagaaacaguaacucagauaucucucuaauugguaaaaugugguagggauuuuuuuucuuaacauuagguuuccugauaauucuugucaaaaccaggauggaaucagcaauguacagucucagauacucccauccucucuauuaccgugaaccuuaccuugguaagaaggaacguauuagugauugcuggaaaauacagaaugccacgcuagauauccaaaauuuuuaaaguguguauaucaagcuaaauaauacaugaugauuaagagauauggcuuuauaaaggaaccaccucaugaaguaucuucuuauaugcucagguuuuuagauuuuauccugaagaguagucaacugagauguaauggauuuuaaacauuucuguaacaguagucugaugaacaugaucugauaggagcccaguguauuuuuuuauuauaaaaauaaaugccgaugguacaaaaauagugugucauccucaagucaucuagucccauuccccagagguaacuauuguuaucacuuucuuaagcaguucuuccagaaauuuucuguauaccgacuuucaaguaucuuuuuguaggcccagauaacaggagcaaauuaaguauuuaggggugauguuuagcauccaguuagcaauggguuguuacuaugugaaaggaaggaaccuauacuuuagucacugggguacacacacagucuuaaaucuucagugauugggauacacaucauuuacgugguggggaugaucacuuucugaagcuaggucauuugaggguggauuauuucagugagaacuccaucuccaaauuugugcgugccauuaaguagacuuacuggaugucaccuacuggaaucuuguucauuuguuuuaaauauugaugaaacaauacuacuggucuauaagaaaaccauggaccuuaggcuucucuugugguucacucagucuagcauuggaacuggaaaaucuuuccaacccuuccuuuagcaacucauuucugaaauccccuuuggaagcuuucagugccagaagguuuaaaaaccccucagaggccuuaaauucaggacucuugacuuauacucuaaaguuggguucuuuucuaacaugugcacaagucauuugaugauaacugaaauuauaaagauauuuucuuuauaugucaaaugcauaguaaugcuuauaggaugcuaaacauguaaauaaaggcaguucuggcugggcgcuguggcucacgccuguaaucccagcacuuugggaggcuguggcgggcagaucaccugaguuugagaccagccuggccaacauggugaaaccccaucucuacuuaaaauacaaaaauuagccgggcauggcggcaggcaccuguaaucccagcuacccaggaggcuaaggcaggagaaucgcuuguaacccaggagguggagguugcagugagccgguaucaugccacuugcacucccgccugggcgaaagagcgagaguccaucucaaaaaaauaauaaucauaaagacaguucuauuuuaaauaagguuuuauccccaaacuucauuuuuaaguuggaaccugaaauauuuuuuucuuagaaauaauacugugacauguaguaaggcucccagaauauuacacaaaagcucaucggauccauaauacuguugaagacaauuuugaauggcaacuguuucaguauccacuguccccaagaaaacuaagcuaucaccugacucucccuggcauuguucagcuguuccuucucuucccagcauuuucuuuauauuacuucucuaaguaauauggagauucaguucucacuaaaaugauccauccuaaaaugagcuaagcucagagaguuaaaaucaccaucauguaaggcaagcauuaccuaacuuaagagacgcucugucucaccaguacugaagaugcuggaaacacaagcauguuaucuuccagcauucuacccagagugcuauuuucacagucuugaucaccaaguauucccauuuugugucacccaccuauacuauuguauuccuagugccauaguuucuuuuuuuuuuuuuuuuuuuuuuuugagacgacaucucgcucugucaccaggcuggagugcaguggcacgaucucagcucacugcaaccuaugccugccggguucaagugauucuccugccucagccugccucagcugggacuacaggcaugcgccuccacaccuagcuaauuuuuguauuuuuaguagagauggguuuucacgauguuggccaggauggucucgaucucuucaccucgcgaucugcccgccuuggccucccaaaguccugggauuacaggcgugagccacagcccccggccuugaaugaacaaauuauuaauaagugaaucacuuuacacaugcucaccuuguaaguaucuucaaauaauugagaacaaacuguaucuucucgggccuugcuguaggaugggcuugcuguaguuuggacguuuguccccuaaaccuuaguugaaauuugauccccacuguuggagguggggccuaaugggagaugcuucgaucauggggguggagccuucaugaauggcuuggcaccauccuggaguaguaagugaguucuccuuauauuagguuccaugagaguucccccgagugcuggcuguacaaaagagccuggcaccuuccacuuucuugcuucugcucucucaccaugugaucucugcacaaacugacuccccuucaccuucugccaugaguggaagcagccugaagcccucaccaguggaugcuucuuguacaaccugcaggaccaugagccaaguaaauauaaauuagccagucucagguauuccaguauagcaguacaaacaaagacaaggcuuuaauguagcuuuuuguauuugagccuacuaaaauagauguuguuuuagccuaccaaccuaaguuaagugcuucaacuuauauuuggggaucugcugugucugugauugggguuauuacagaugguugaacuuuuagaauccuauuuuuuaauuuauuuugagacaguuucacucuguugcccaggcuggagugcaguggcgugaucucggcucacugcaaccucugacaccacgcccggcuaauuuuuauauuuuaguagagaugggguuucaccucuguuggccaggcuggucuugaacuccugaccucaagugauccgccugccuuguccucccaaaguacugggauuacaggugugagcuaccgcaccuggcccuauuuuauucauuuuuauuuucguagagacagggugucacccaggcuggagugcaguggcguggucauagcucacuguccccucaaacucaugagcacaggugaaccuccugccucagccuucccaguagcuggaucuacaggugcgcacuaucacgccuggcuaauuuuuuuuuauuuuaaauggagucucacuauguugcccaggcuggucuugaacuccuggccucaagcaauccucucaucucagcuauuuuauuucaaauaaagcuaguucuaauuaucauuccuuuuaguagguuccucauuuuaccauuucaaacaucuuauaaauguagauuuaagugauaggcuuaguuuucuuaaucuugcuacauuuuucaccacaccacuuuucagauuauucuuuaaucagaacuauuucaaguagauuaaaaaauacuaggugacauggacaugugauauuccaacucaugagguaugaacuguggaugauauuaacauauucauaggaggaacaaaauaaaaaacacugccuuggucccauucaguauuguacuaacauuuugggcaaaccaagguuuggaugaagaauacccaaguucaaaaagaacuauuaucuaguucuauaaaaagaguguauguaaauuaugaacaaaaugucaugcuuacuaauaagcuuaaucuuuuccaguggaaaggccuguucuuuguauucucaguagauccuaauauguccauuaauaguggcuguugcugaagaaaaggacuaucagaggggagagagacuuuuacuuauccuuuuauacccgucuauucauucuacuugguuuuuuccuuugguuuuuuguuuuguuuugccccacagaauaaucccuuucauaaaucaaaaaagaaaaauuguucagcaucuccaaauugccugacuguagugggaaaacaaaauuucccacuguugugggaaaaaaaauguaagacauagcaccuuuucuuccacucauauacuuacggaaaaucucccaggugcccaauggcuuauuuuccuaagaggacacauuauugaaacucguauuacacacuaaaauaccaauuauuagugcuugggagauuaaagagguagguaaauggaauaauuaaaaguccuauuuauuuagcaacuacuauguaccagggcagucacuggacauuuuuucuaacacuugaauaagguacuauuaucccaaugaccagcaaaguaaaacgacuugugcuagaacuggaauucaaaucuggaccuguuggacuccauaaccaucaucuuuccacuauaccucaauaccuuuuacuagaaaaagucaagaccuagaugacaguagugaauggugaauggucagagauaugacuuauugcuuauuucuuauuugucuauaacaguauuacaguuuuugcuauuuccauuaaaaauuacagauguauuugcaguuaacauaacaaaagauugucaguguuaagguucaauaugucuaucuucauauaggauacucauuaacccaccugaaaacauggaagaaaccagcucuaaguuuccuguuuuuaucaaauuuguuccucgcccuuuauacugguuuaguucaucaacgagguacucuugaugucaugagucauauucaaaaaguuuguuacaacaaucccaauaaaucuucagcuucaauauuuauaaugaugccuugccacucuacuccuuauuacagguaauaaaagauguuccacuauaugcuguuaagaaacugaaacugacuacuuuaaaauucccuuucagauuccuggauuugaauuaauuggucacugaucaaaugauaaauuuuaaacucccacauauuuauucacugauggauuuuaaaaaccacuugaacugugucaaagaaaauguuuuaaauaaacuuuuuuucuuuuuuuuuuuuuuuugagacggagucuguucuauugcccaggcuggagugcaguggcgcgaucucggcucacugcaagcuccgccucccagguucacgccauucuccugccucagccucccgaguagcugggaccacaggugccugccaccaugcccggcuaauuuuuucuauuuuuaguagagaugggguuucaccguguuagccaggguagucucgaucuccugaccucgugaucugccugcccuggccucccaaagugcggggauuacaggugugagccaccgugcucggccguaaacuuuauuauucuuuaaaaacaauuuacuuacaccuaauucugauuuaaaucaguauaaaacaauuuguagguaucugauagucuucuuaguaaagaaacucauguauuacuuaccuuacuacaaaucucugugauacaucuuuacacaauuugaauuaaucuuaaaacauggauuuuaggccgggcgccguggcucacgccuguaaucccaguacuuugggaggccgaggcggguggaucacaaggucagaagaucgagaccauccuggcuaagcugggugaaaccccgucucuacuaaaaauacaaagaauuagccgggcgugguggcaggugccuguaguuccagcuacucgggaggcugaggcaggagaauggcaugaacccaggaggcggaguuugcagugagccgagauugcaccaggugcacuccagccugggcaacagagcaagacucugucuccaaaaaaaaaaaaaaaaaaaacauggauuuuaguccagauuuacuacuggauuauugcccucaucuuaaacuagacuucuuuuuuuuuuuuuuuagauggaguuuugcucuuguugcccaggcuggagugcaauggcgugaucuuggcucacuacaaccucugccucccggguucaagcgauucuccugccucagccuccugaguagcuaagauuacaggaaugugccaccaugcccggcuaauuuuguauuuuuauuggagacaggguuucuccauguuggucaggcugaucucgaacucccgaccucaggugauccgcccaccucagccuccccaaagcgcugggauuacaggcgugagccaccgcacccggccuuaaacuagauuuuuaaucucuuuggacaucaguugucucaccuguaaaaaauuagggaaugcgacuagaugauauucuaaugcuugaauuaaguguuucugggaaauauacuaaaauugccucaacuauguauggccuuuaaaaagacauccauuuguuccugugcuuuauuucaggaagcuguauuaguuacuaauuacccaguaaugguauaggggcaaaggagccagauuuccuacagaaaauuauauaccaggcugggcguuguggcucacgccuguaauccuagcacuuugugaggccgaggcgggcagacugccugagcucaggaguuugagacuagccugggccacauggugaaccccugacucuacuaaaauacaaaaaaaauuggccagguguuguggcgcaugccuguaguccuagcuacucgggaggcggagguugcagugagcugaggucauaccauugcacuccaaccugggcgacagagcgagacucaaccuaaaaauaaauaaauaaauacauaaaaucuauaacuauuuaacucagucuggcuuuaaacaaucuggaguuaaugucuccuaugcacguucaauuaauuuaauuacagugguuaucauuuuaggggaauuuaacacuuggaauacuccuauuuaacuaaucauuaaugccaguaauuaauauacaguuuagaaaaauggagauccuagcaaaaaccacaggcuaaaaggaagacaucaaguauccuuucaacuugaggauucccuacuauauguauauguggcugaaaaagggacauucacucuccgugcucacauuagggauaauacugaggagaacaggaauccuagauguaccaagauguucuuuauacuuaacuguagucaguugaugucuuaggcuuugaauaguucaccaaguucuccacaccuuuucaaagcacacaagagaggaaagucugaugccuauuuugcaucagacuuggaaguagagagcaacaucugucccuugauuaacauccaaauaaguaauggcuuuacuguggcauagaaagacuagaguaggccggcagcuuuuucugaggaauuucugcuucccuuugaaacaagaccuucauuuccaauaaauaaaucacuauuaggucuuguguacauuuaauuuuuaugcauuucauaaauaaaccuccugcauaauuacuaacuccauuucuaacuggaaauuuuaaauguuuguaucagugagguuuaauuuuuccuaaggcaauuauaaacauggcuuuuugcaugaccuaaguaacuggcuuaaauugucauaacugguauuagaaaugaauccaucuuuuuuauacucuaaucuuuuuuuuguuuugagacagacucuugcucugucgcccaggcuggagugcaguggcguaugaucucagcucacugcaaccuccgucuucuggguucaagaaauuguccugccucagccucuugaguagcuggaacuacaggcacauaccaccaugcccggcuaauuuuuguacuuuuaguagauacaggguuucaccauguuggccaggcuggucuugaacuccugaccuccagugauccacaugccuuggccucccaaaguucugggauuacaggcauaagccacugcacccggccuacucuagucuuucuaugccacaauaaaaccauuacuuauuuggauguuaaucaguggacauauguugcucucuacuucucaaucaucuuaaauaaaaaaaaaaaacacuucaaacuugccauguggcugggcgugguggcucacaccuguaaucccagcacuuuggaaggcugaggcggguggaucaccugagguuaggaguucaggaccagccuggccaacauggugaaaccccaucucuacuaaaaaaauacaaaaaucagccaggcgugguuggcgggcgccuguaaucccagcuacuugggaggcugagacaggagaauugcugggagguggagguugcagugagcugagauugcgccauugcacuccagccugggugacgagagcgaaacucuugucuucaaaaaaaaaaaacuugccauauaaguaugugauccauccccuaucagagcagaaagggaagagagaaagaauccuuucugauuaugaucacaguuuccuacuuuaucaaauacaccuauggagaauuacucuccuauuaacaaguuaacuuaccugguccugaggaccauuuauguuuccggaacagaauaccaaugcuacagaauguugagucccccuacugaccuacuucccuccuugaaauggacuucuaugcacuaguuugggcuuauagguuauacugcugcugcugcauagguacaugguauaagaaucauguuuuuuuuaucuuugagaaaaugaguuaaaggcuugcuucuucacuuaacugcaacacaguuuacagauucagauuucacauuuugcuaaguauaaaugacauaucuuaagacuaaugaaaacuuucauguuuuacuuguauuuauuaugguaacuuuucuuuucauagccauguucacugcccacuucccaugagauuucuccagugcccgccagaccugacuggaaaaagucauuaucuugaugaagcagauguauuuuaccuaaaucccuuaaacugguuacauagagaguuucaugaugaugcaucauugccuacucacuugaucaccuucagcauuuuggaagagguaaguaaacaugaaaaagaggaaaacucaguauuuuaauuuuaccccagguuuaggaaacccucagguaaauagauaauauaaccuuuuuauggucuguuucaacccacauuucauaauuagucuuuucuccagucaaaauuagccccaguucuguaacuaucaaaguauuuuacuuccuauaaguuaauucuuuuauuaagcaaaaaguuguagacagcaauuagaauaggcaauucuaaaauugacugaaacaguacucagcaaaauguagccuuuauuuacuuaaacauuuauuugcuucuaggaaauaagcgcuuuccuaauuucaagcaauuauaaaagaacugcuguuuucuuccacacucacuugccagagggucgaauuggaagucacauauaugucuaugaacggaaguuaaaagggaaauucaacaugaagaugaaauucugaacuuuccuagauaaauuaacauugcuggguggaaauauucagaugcugcuuaaauacuucgguaaacacuggguaagauucauggaacuuagaaaaaagcuguaugaacugcuuuaccaaauaucacuacugaggaaauguauaaaauaccacauaguauaaaauuacauguuaauacaaugccagauuuuaaauaaagaccuuuaguuuuccuca

SEQ ID NO: 192076 - RNA, 67429 nt, Homo sapiens
gaugccuguuuugaaaguugauggagcgaacugcuuuuccaaagacucuuuugaaaaacuuuuuaaguaggccauucugacuuuaacauuucucuuugucuuaacauuagacaaaaaguaaccuuccugaagaggacaugugauuggaaguugucaauuguugaagcauugguaacuccagucucuaacguuuuagaaaaucauaacaagcgguucucuacccuguaaagguaugguuuuguauuuaucuuuuuuuuuuuugguagugguuuugagcucugucaugucaauuuucaugcgcuuaaauuaugugcaauauaacauacaauaccauugcacguacuguuuuuaaacuaaagacuuaaugaugucuacuaaauuucuugggauuaguuugaaaagugcauuuucagugaccacggaguggguaugaauacugaccgcauucuuccuuucuuuucuguacuugaauaaagaaacauagguuuuuacuuucaggaaauuguugaauaugagagcugauuaggaaauugaauuauucugagagucuugcuuauccucugaggguuguuugacaaaaauucaagcuuauugguguuuuguuuuugauaguauuaauagcuuuuguuuuguuuuguuuuguuuuuuaaauuugagacagagucuugcucugucgcccaggcuugagugcagugguacaaucucgggucacugcaaccucugccucccaggaucaagugauucuccugccucagcauccugaguagcugggaccccacgcuaccaugccuggcuaauuuuuguauuuuuaguagagaugggguuucaccauguuggccagccugcuuucuaacuccugaccucaagugaucuucccaccugggccucccaaagugcugggauuacaggcaugagccaccgugcccggccuaaaaguguuaauaguuuuaauggaggaauguaaguguguguuuuaguauaagguuuauuucuucugggaauuaaaucugcuuuuaaauuaguguuaauucuguuagguuugauaaggguauuguuauguaaggaaauguccauauauuuuagaaauacgaaaugaaguaugccggagugaaagaucugaguggugagugugaugggagauuucauuauauaauucuacuucuggauauuguauuaguuuacuagagcugccauaacaaaguaccauaaacuggguggcuuuaaaacugugugauuucaaaaacagaaauuuauugccucacaguucuggagccugaaagucuaagaucaagaugucagcgggguuggucccuuuugaggacugugagggagaauccguuccaggccuuucugcuuagcuguggauggcugucuucucccuaugucucuucaugccauccucccuguguucaugucugugaucccaguuccuuucuugugaagagaccaugaggguggauuaggacccacccuaaugaccucuuuuuaacuugauucccucuauaaagguccuagcuccaaaaaacauuguauucugagguacugggaguuagggcuucaacaugugaauuuuagggggacacaauucaauccauaaccgacaugucugaaaagcuucuuaauaugacauuuuaaagauuugccucaaaaugcaugcaguaaacauuuguuaagcccagugccuggacugggcuggauuuugagugugugaagaugcauaagacaugguuccugucuacuaacccaugguuuaaucaaauauagggaucuagcuuugugaguguguacguguuuacuuauugcuuccauugaguuguagccacucucacacuugugugucccugggagcacaaucaggguccugacacauggacagccuaaccacaagagacaccuggaaggguucccgugcucugagcacccauaagcauagauuaagagaguggaaggacuucauauucacccaguccauucuucucauuuuacagaugaagaaauugaggcucagaagugcuaaagucauuugcuaauuuguauuagugccaaggcauccuucagaauauccuggcuuccauuccaguguggugaccaaacaauacuguuuucuuugccacaaacucaugcuuuucaccugggaaugaaccccaacccccauuaucagaagucauugugggaaagagccuugauaaaaagcugacauucucugucaagguucuuggauuauaaauaccaaaaaaaaaaaaaagauguuuuggggaugaguguuuauucaugagggcauuuuauccauagaaugaaguuggauuuaauacauuccaaaggaguuuacccccaucuuggcugcucucucugucucuuaccacuuucuccuugucacuuguugaaauaguuaagucacagagguaugacccugcagccauaagaauacaaacaaccauuuuucuucuuucuuggugcuucugcugcccacaagacaggaacuguggcagaaagggaacggucuggugaaaucuugcuggcuggcaggauggcgucacggcaacuaggcugccucucucugcggcuguuucagcuuccgcccucucuggacccucgguaccugagugcucauaggggaaacugucuucuuccugccuccauuucuguuuuuccucaguaggauuaaggcuucuugagauaucugcucaucuuuugcuauuauuccuuucuucucccuuugaacuuguuugauuuagagccagagcucaggcuauagcauacgugauagcugaugagucaugugaagcccauuaaaagcaaaagcugauuaucacaagaaccauuauuuauuugcgcugucuaugcaacagcacauuuucuuuugcgcuucugguguugcugcagcguggcuggggcccugcccucuuggcagagcagagguccugugguguaggcuggggggcagguaggggaagugggugauggaugagauggggugcugcuugagaaaugagcuaucuuugcugcugcuucucugaaggcagaaucugcuuugcucaaacacggguauaaaucauccuuucaagagcugagagcauccauuuuuguuuguuuuucuuguuuuccccguuucauacccuaucaggccuccuuucuugaugacauagucuaagcuggaaucuuuuagcuaucuuuuagcuagaugguaaauccagcaaauagcucaaugauaaguccauucauccagcaaacagugaauggauuugccauuuucacacggagaaggcccagaccacuucaaguuuguaccucugugguguggcaacugagccagccuguggacaaucacugcuugaaaaaucuccuuccuaguguccuucuuguaucugucuugcugcuccuuacauuuuuguucucucuucacucuaaauguccaucucauuuuucccauggccuaaggaaauacuauuauguugaugacacuaaaauucauagccauauucuucuugugagcccuaggucuguuuuccaaaugcaaauuaaacacaacucccuugaugucccucagacaugagagauguuuaacugguuguguaccguacaguguaaugugguaguugagagugugucugagaucacaucuugguucugccauuucuggcugugugaccuugggcaacuuuauuaaccuuucugugcauugguauuuuucaucuguagauuuagggaccuuauacgguuguugugaagacuaaaugaguuagugcuuuaaaggauuuagaauagugcuuaguguuaguuauaauaauuaucaucuucucaaaccaucuuuuccuuuuucaguuaauguuauaccauuuauuuaccaaacuaaaaguuuugguuaucuuuaauuucuauacuagucuguuaagaaguuauauugauuucuaccuccuaaauauaucucaaauuaaucacuucuucuucaucccuacugucaccaacacaauucaaacccucaaaaucucucuccauaugucuuaaccaguucaaacuguuauaacaaaguaccauagacuggauagcuugcaaacaacggaaauuuauuccucauuguucuagaggcugaaagucugagaucaggguaucagcaugcucagauuuuggugagagcucucuuccagguugcagacacuugacuuuucacuguauucucacaaggcagaaagguagcucucuggccucuucuuauaggggcacuaauccccuucaugaaggaucuauccucaaaaccuaauuacuucccaaagaccugccuccuuauaccaucacauuggggauuagauuucaacauacaaauuuuggggagacacaaacauucagucgguaacauuagagccuucugaugcucuguguauuuccagucuccauguggcugccauagagaucuuucuaaggcacacaucucaugguccucuccugcauaaagagcccgugguggccuucuguugcccagaggauaacacacaaacuuuuuagugccaugucacaguccuuuuagacccaggucucaaacacuuucccauguuuucagccucuguucuggauacauucuccccuaccuccaugcaucccuucagccacauccacugcugaaguccuuuaaugcauccuaaguaaccuuagccucuuacaccuuugcaagcgcaaacccucaaacccuuaccugcccgcaucagucagcccaagauguguucccuccugacgguucgaaaccuggucuuuuuuuuuuuuuuaauuuugagcaucaggcauuccuuaccaaauuccaucaaaacucaguuacauguuuuggauuggcaucaagaauuauuugcuuauaguuucuguuaucuugaaaggauaaugcuuauuuggcugacaugugagguaaagucguuccccacauuaucuagugcacuguguaauuuuuguccauucacaucugucacuuguccuuaugugugccuguacacucacauucugacuuuaguccuuagcucagaugccccugugugaaguuuuucugauucccuccuuagacauugugggcuccuucuucucccucuugugcuaucuccccagcccucccaucuccccaacggcuugugcauacuucuguuacaguucuucuucuucuucuuuuuuucuuugagacagaguuuuacucuugucgcccaggcuggagugcaaugugcgaucucggcuggcugcaaccuccgccuccuggguucaaauguuucuccugccucagccucccaaguagcugggauuacaggcaugcgccgccacgcccggcuaauuuuguauuuuuaguagagaugggguuucaccauguuggucaggcuggucuugaacucucaaccccaggugauccgcccaccucggccucccaaagugcuaggauuacaggcaugagccaccaugccgggcccuauaguucuuguuuccaugcauuuuccuugggcauuuccacaaacagcuuaccuauuagacuguugcucuucuagagccacauucuuggugcuuaacauaguggcacauccacaauucuuguuuguuagauguuuaauugaugugcucaugagcuacugcuuaaaugacugaaugaauuucagucauuuaaaccaggcucucucccuccucaguggcaucaagcuuuacuaguauaucuuuggaucauugguggaggccaauuuacuuaucaaaccucauuuaaaauuauuaacagauuuuggagagguauauguaugcuauucugcauuuaacuucuguuauauuugaaguacauuuaauauauauuuuuugggaaauacuuuccuauguguugugaacacuacaacccuuucccacauccuccuaugcuucguaauuuugauaauuucacauuugucauuugagccaaguuuauuuuucucuaaaacagcuuaaaauuucuguuaaaaaacagauccccaucuauucuagcuuauagagguuggaaaaauguuuaaaaucuaaacgugauuaaagguuuguagaaaucacaaaauaaagauuuuggcugggcacaguggcucacacccaaaguaaucccaguacuuugggaggccgaggccggcugaucaccuaaggucaagaguuugagaccagccugggcaacauggcgaaacccugucuauacuaaaaauagaaaaauuaaccggaugugguggugcaugccuguacucccaacuacuugggaggcugaggcaugagaaucaccugaauccagaggcagagguugcaaugagccaagaucggaccacugcacuccaacuccagccugggugacagagugagacucuugucucaaaaaacaaaaacaaacaaacaaacagaaaaaauaacccuggcuauaguugagagacucuuuggagucagguguggacuaaauguuguauucucuuacgauguuuaaugugguuuuuuguaagacuaaagacuccagaauucuguuacagaguuguuugcugauuuguuucuuuuguguaagugcccuuuucauuucuagaucaugguuacucuaacaucguuccucaaauauaugcauuucauggaguuaaaugaaauacagacuuuaggacaauuaaacagacuaauggaaaaacuuggcaaaguuuuuuuaaguggguccuaaauuauuagcuagaauucagaaauuuggguucggcuucuuuaauuuuaaaauuaagaagagacaugggcuggccucuuuaacauacaguguugaauuacagaaugcauaaacguuauuccuugucucucuucagauacuuggcauuuuuauaaucuagugcccuacuuucuagguauuaaaugggggaacccaagugcuaguaguuaaaauuaaauauaguacuguguucaaaagaaaauucggaugauagcuaaugcauuuucgauguuucucuagagggugaaacaccauuucuguuuaaagcauucuacuauaauucuuccucuagugacugcaucucaaguaacuuuuuuuuuuaagcccaagacgggagcgacuuauauaaauguaauauggcacauuugaagacugguuuuggguaaggucaccucaaggaccuggcaccuauuagguauuucacuuuuuagccauucaaauauuuauuaauuacccugagaacuaccucccuuugcucuccccuacccccuggcgaaugcaaaaggaagaaacagaauuacuuugaaagagaaauucuagguagaaaguaugagaaaagagcagaaaccaggaaagugagagaagaagcuagaagaaaggaaagaaaaauaucaaaggcggaauaaauauaaaagcugguaaauuaacagauuaagggaaaaaaguagcagucuccuugauacaugcugaaacaaaaugugauaaaguugacacccauucauaauacucguacuuagcaaacuaggauagaugaacuuccuugaccugauaaaaauauguaccaaaaaucuacagcaaaugucauucuuaacagugaaauguuagaaucaagacaugacgagacugggcugggcgugguggcucacaccuauaaucccagcacuuuagaaggcugaggcagguggguggcuugagcccaggaguuccagaccagccuggacaagggaggcuggggcgggacagucaccugagccugggaggccgaggcugcagugagcugugauugugccauugcacuccagccuggacaacagagugagaucuugucucaaaaaaaaacaaaaaaaaagaaaaaaaagagauaagacuaccuguaucaccaugucuauucacuguuuuuuuguuuuguuuuguucuuaccuauuuuuuuuuuuucuuugagucagagucucacucuguugcccaggcuggagugcaguggcgugaucucggcucacugcaagcucugccucccggguucacgccauucuccugccucagccucccgaguaccugagacuacaggugccuaccaccacgcccggcuaauuuuuuuguauuuugaguagagacgagguuucacuguguuagccaggauggucuggaucuccugacauugugauucgcccaccuuggccucccaaauugcuaggauuacaugcaugagccaccgcgccuggccgacuuuuuauaauuagacuaaaagguaagauuagaaaggaagaaguaauuuauuuuuaccuaauauguuuaacagauugcuggaauuaguauggcuauguaagaaauagaagauacauguuuaaaaguuaucacaguagugacaaaaacaaaguaucaauaaguugaaagauguacaauaucuucaugaaaagaguuuauugaaaacuuuuuuuuuuuuuuuugggauggagucucgcccugucacccaggccagagugcaauugugccauuuuggcucacugcaaccucugucuccugaguucaagcaauucuucugccucagccucccgaguagcugggauuacaggugcaugccaccaugcccagcuaauuuuguaucuuuaguagagaugggauugcaccauguuggccaggcugguuuugaacuccugaccucaugauccacccaccucggccuuccaaagugcugggauuacaggcaugagccacugugccuggcccgaaaacuuuucaaaaagaugcuuuuuuuuuuuuuuuuuuuuuuuuuugagaugcagugagugaucucggcucacugcaaccuccgccuccuggguucaagcuauucuucuaccuuagccucccaaguagcugggacuacgggcacacgcccccaagccuagcuaacuuuuuuuuuuuuuuuugguauuuuuaggagagaugggguuucaccguguuggccaggcuggucuugaacuccugaucucauaaucuggcugccuuggcuucccaaagugcugggauuacagguguaagccacaguacccagccaaaaauauucuuuucuuagaguuuauuuauuuauuauuuuuauuuuuuuuugagacagagucuaacucugucacccaggcuggagugcaguggcacgaucauggcucacugaaaccucugcugcccggguuccagcaauucucccaccucagccuccugaguagcugggauuacaggugccugccaccgcgccuggcuaauuuuuauauuuuaguagagauggggguuucaccaucuuggccaggcugguuuugaacuccugaccucgugauccacccgccucggccucccaaagugcugggauuacaggccaccaugagccaccaugccuggccgaguuuuaguuuuuagagcaguuuuagguucacaguaauacugaguagaaaguacaguuuccauauauucccuucccucccaaaccccccaacaugcauagccucccccacuaucaacaucccauaccagagugguacguuuguuacacaugaugaaccucuauugacacauuaucauccaaaguccauaguuuagauuggaguucacucuugguguuguacauucuauggguauguauacaaauguauaaugacaucuaucuauguuauagugucacacaaaauaguuucacugcccuaaaaaucgucuguucucugccuauucaucucuuucacuucccccacuccaaccccuaauaaccacugaucuuuguacuaucuccacaguuuagccuuuccuagaaugccacauaguuggaaucauacagauuggcuucuuucaguuaguaauaugcauuuaagguucuuccauguuuuuucauggcuugauagcucauuucuuuuuagugcugaauaauuuuccauugucugaauguaccacaguuuauuuauccauucaucuacugacgaacaucuuguugcuucugaguucuggcaauuaugaauaaagcugcuauaauaaauaucagugugcagguuuuuguguggacaugaguucucccuucauuuggguaaauaccaaagaaugugauuggauuguacgguaagaguaaguuuagcuuuguaaacaacugccaaacugucuauaacaaagggcuuguaccauuuugcauuccuaccagcaaugaaggagaguucuggguuuccacauccucaccagcauuugauguugucaguguuuuggauuuuggucauucugauagguguauagugauaucucauucuuguuuuaauuugcaauucucuaauaacauaugauauugagcaucuucucauaugcauauuugccauuuguauaucuucuuuugugagauuugagaauauuuuuaaaggcacuaaaaauacguaaauagauggagaaauaugcauguacuuagguagguaaauuaaacaucaugaacaugucaaucuucuuaauuugaucuauagauuuaugugaucccaaugcaaugcaaugcaauuccaauaagaauccccauaugguuuuugaggaacucagauggaaaugugaaggguucauguccuugguaagguggguaccagucguaacagguaugaaguuauauuuuagggucauagugauuaaggcauuguggcacuggcccagggauggucaaaaugaccagcgaaaccaaauguaaagcccugaaacagauccauucauuuauugcauaucacugggcaaaagauaauuuuaugcaauaaauggugcuaugacgauuguauauacuuaagggaaaaauaaugaaauuggaucccuacauauaccuugaauucucaguguauuaaagacuuaaauaaaaaggcaguaucuuuauaaacauaauauaaaagaauaucuuuauugcuuuagauaagaauuucuuggcugggcaugguggcucacaccuguaauccuagcacuuugggaggcugaggugggaggaucacuugagacuaggaguucaagacuagcuugggcaacauagugagaccccaucucuacaaaaaagaaaagaaaauuagcugggcguggcgacucaugcuuguagucccaguuauugggaggcugaggugggaggaucacuugagccugagaaguugaggcuguagugagcuaugauugugccauugcacuggagugagaccgugucuccauuaaaaaaaaaagagacuuucuugauaugauauaaaauaaauaacuauaaaaaagaauaaauuugacuauuuuaagauuaagagccacuaaaaaagugaaaagacaaaccaaaaacaguaagaauauauuugcaacauacauaacuuauaaauaguauccagaauauaugaagaacugcacauccauagaaaaagaaccuggcugggcaugguggcuuaugucuauaaucucagcacuuuggacggccaaggugggcggaucacuugccgcuaggaguucgagaccagccuggcuaacaugggaaaaccccaucucuacaaaaauuagccagguaugguggugcgugcuuguagccccagcuacuugggaggcugagggaugagaaucacuugaaugcaggaggcagagguugcagugagaugagauugugccauugcacaccagccugggcaacggagcgagacucugucuuaaagaaaaagaacccaauagaaaaauaggagaaagauacaaaugugcauuuuaauaagaggaaacuagauggccaagaaacuaauaaaagaugcucacacucauuagcacucagagaaaugugaauuuagaucacaauguguuaccauuuugagaagucugacaacaagcaccaaauguuggugaagauaugaaguugggaguguaaaacaacuauauuggacagcaauuugacauuaucuuguauuacugaacaugugugcauagguauagcccaggaauuucacgcuuugacgccuacccuagaggaggugacucccccuggugugcacugaauugguucagauguguugagauguugaacccuuugucccucaggguggcuggacagggccuggccuuucuggggcccuaaaaccuauugccuuugaucaagagcauaugcccugguaggucauacaaauaucaugaacaagguuggaaagcaauuuucuagagaaacucuugcuggugugcauuaggagacaggcacauacauauagcaguguuaagugagaccaaaaacaggauagaccugguauagguagugaauucuucuucuaggaaaacacagagacauuaaguaauuagauaaggguaauaagagaaggguucuaaccucuuauuucuuagugucagugguuucaaggagagugagaggugcagagaaggagcuggaggaaagugauacuacaacuccuccucacuguguguuuccuuuuuuuuuuuuuuuuuuuugagacugagucucgcuguaucgcccaggcuggagugcaguggugcgaucucagcucacugcaaccugcgccucccagguucaagcaauucucgugccucagccuggagugcaguggcaugaucucagcucacuguaaccuuugccucccagguucaagcaauucucaugccuuagccuccugaguagccgggauuauaggugcccaccugcacgccuggcuaauuuuuguauuuuuaguagagacaggguuuuaccacguuggccaggcuggucucgaucucuugaccucaggugauccgccagcuuuggccugccaaagugcugggauuacaggcgugagccaccaugcccagccaguguguguuuucauugagauacauucagaugggugguggaugaugaugggcaaggccuaaguuuggaaucugaggaggugccuauugcaggcuccuaagaggagugaaugcugugcaggacaucuagcugucuucccugacauuuccuuuuuacucacugccagauaaagaacuuuacaacagggagauaguaucuggaaacugaguuuaaucagagcagcagggacugcccaucauguccuguguaauugaguuuggcugagagcacccugcuguuauccuuggucuuguucauccugaacuaacagcauguucccucuucuguggcuuguacagucauggcccucuuuuuggagcuuucacuguuggcuacucugccucugucucaagggcagagguaaaugugggccacagggacuggggaugauuuucaagcauuucuuggucauguggcuuugaugaucucucaugcugaaccugccccgauccaaucucaucauccuucccuuccaaaaaucugauaccacccacaaacaccuuaugcccauuccaacucuuucccuuccccacuucaaauguccugcuucuguuggcaacauuauuuuggccuccuggcccccuaggcuuuauucuuugguguucucuuugcuguguccuuuuccaccugauguggaacucuguucuauuauuuuaaaauuaguguaucuuggauccccuucuucccauucccaugcggcugcccucaucuaggcucucaucuucaaggagugagaggugauagaagggacaacugucaccaugaccccacuuaaauuucucaugacuaagcuuugaacuuugaaccuggaaucauacagcauagaaugucuguguuggaaagagaccauuguggucaaaccucuuauuucauauuugauaaaacaaggccugcagagggauggugaccuauccugggucuaaacagaugguggcagaggaaccccauauaccaauggauuagucguccugcucuccucaauuugucacauuaccucauaagcauuccuuugaguuuacagccaguuuuguacuuagaggauuauaucugaggcacauuuguauccuuugaaaugauuagcaagccuccucaauacuuguuaaauugaagucaaaacaugcccuugcaugaaacaugcuguguauccuauucuucacuaucuagcuaaaucuugccuggcuuugaagaaggugcucagcucagguccuggcucuugcuuugagucacggucagauugcucccucuuucuuucuuuuuuugagacagggucucacucugucacccaggcuggaguguggugacauagucauggcucacugcagccuugaacucuugggcucaagugauccucccaccucagccuucugaguagccgggacuacuggcacaggccaccucaccuugcuaauuaaaaaaauuuuuguacaacagcaucucauuauguugcccagguugguuuugaucucuugggcucaagugauccuccuaccucagucucuugaauaggugggauuacagguaugagccuccaugcccgacagauugcuccccuuuucugaccucccagccucuacuugacuuguaaaacaacgaucuuacauguacccaguaguuuacaguuuauaaaaugcauuucacauaauguacccuuuaauccuuccaauaaucuugcuagauaaauauucccauauugaggaaacaguguggggaagcugucuggcucaccacaggacacauagcuaggaaggaaguagcagaguucaggucuuuugacuugaagccccuuucacuuuugauuucuugugcuggcuggugcacaugguguaccagacguuuuucucccugauaauauugucuuauccguccuuuuucguaaaugaguacaucauuccaccucacccuaauuaccaacuucuugaagggagcaguuggauccuguguuucuuucaugccauucguaguugcuagcaccguacuggaaagguaguaauugcuuaccaaauacuguugaauuggauguaaauaugguuuaauuaucaaaaaagcacagcuaucaguggaguccccaaacacuuuuugagucacuucuaaauaaaauuggcagggaauggagggaaccagcggaaggaaaaggcuauuagagaaagcagaugauagacacaauuagcauuugagugacagcuggccaguugucuguccaguggugagggguaguggagaagcaauacacaaaaugagacucuucaggaaauaugcaacuguaccaaagagaugaaacacacccaugaggugggaauggaguacuuaaaaguggcagaugaccuguacaaguuagccaaagcauucauucauauuaauaaacauugauuaaaggaauaccccgaggaggauggauuuaugagaacaggcuuccagggugagaguggaagggauagaguugcaguuugguuucaguuugugaucauucuguuaauuacuggaaccaggagaaaagagacauaaguaggugaggauguugccguugaaacaacuuucucuucccuuucuuauacuaugugcagucaauaggaccucagcccugagcccuggcagucagaagugaaggaaagacaaauaauugcucaugucaucugugcauagagguguguagugaugagcaacuugcuggauuuucugguacugccuccuuuaacguauuuuugugcauuuucuucauaaaucaaagagaugcuuuaaaaguucuaauacuuggacaacuaaauuguguuuccaacucugccuuuucccaaaagggucacaaaaauccauagacauaagccgcagauuuugguuuggaaagucaugcugcauuuuaucuuuauguuugggcugcucccgaguucauaaauauuuugugccugaaagaaauguaaaaccccuuccacuguaauauaugugaaaaauguccaauuucuuaauaguagaagccaaacauuuucuuuugugaguuucugucuccuacagagaacauaagauggagggcuuuuagauuagaaguaauagaauuuuaauaucuguuccuuccugucucagaauuuuucacaguuuauaaguauauuauaagagcuaaaggaauguauaucuaaaaugcuuacaagcaucagaaauuaauggaaauuauuucaaauuaauuaaaaauuauaauuuuuauacaaaauaauuuuaucauguuguaugcuguagauucuaaaagaaaaauaaaaaacuuuuauuucuuagacauucauaugugguuuuaaagugauauaucuaggaaaauagauuaguaccauugaggccuauuguuagauguguugguuuauuuuuaaugcuugauggcuauauagcaauuauauuuuuuaugugauaagcaaguauguauaggaaaguaauaacuuaaaaggaaugucauuauaauauuucuuucuuuaaaaaauaggaagguauuucucgaggucaaaacucaacuuacaaaccuugcagccaaauuuguugguauauaaagucuaacuuuauacuuuaaaauguggacauacuaaaaugugauuguagaauuaugagauugauuuucaugugugacuucugaaaccuuuuuuacuacuuuacaguuaucucucaugcagaaucucauuucaaccucauuuaaaaaauuaaguguacuguuacuuguuuuugugauuuccccugaacacucaaacauaguuucugaagacuuacuuauuacuuaucaauuauccauguuauaaacacguggauacuuacaucuucaugguuuaugcugcucuugucuacaauuuccuuuauccucuugcguuguucucuugcugauucauagucucuuugcuaacacaaagucuuuauuucuguguuaguaaaucuguauugagguuuauuccccgacucuuuuuuuuuuuuaaacaaggcucuuguucuuucugagucacccucuugccugcuuauuuuagcccuuauguucuuaaccucuaggcuucaaauaucuuucucagaggcauguuaagaaaauaggagcuuuguuuccauagauggccuuauccugggcuuagcugaggacagagacaagguauggccuugggggacuaaguucuaaccuggaugcuuggcuuuccaucugccuagguaggaaaacgaaacuuagugaaggaaccuaguuggaauacuuagggagccuuucuuuuuuuuuuuccuuugagacggagucucgcucugucacccaggcuggagugcgguggcacgaucuuggcucacugcaaccucugccucccugguucaagcgauucuccugccuuagccucugggguagcuggaauuauaggcacccgccaccgugcccggcuaauuuuuguauuuuuaguagagauggguuucaccauguuggccaggcuggucucgaauaccugaccucaggugaucugucagccuuggcuuuccaaagugcugggauuauaggcaugagccaccacgccuggccauuagggagccuuucuuucuuuuuuuuuuuuucagagacagagucuugcucugucacccaggcuggagugcaguggcacgaucuuggcucacugcaaccuccgccuccuggguucaagugauucuacugccucagccuccugaguagcugggauuacaggcacaugccaccaugcccaacuaauuuuuguaauuuuaguagggcugggguuucaccauguuggccagcuggucucgaucucuugaccucgugauccacccgccuuggccucccaaagugcugggauuacaggugugagccaccgcgcccggccagggagccuuucaaacugguuggcagaguagaggaaagcaaguugauugaauaaauugcuguaacuuagaagguuagaacauuucucuggcuuuugauaaagcaacaacuacuaugggucuuuuuuuuuguauauagauagauagauacguauaucuguaucuaucugucugucugucugucuaucaaucaauagcuuuugggguuuuuggcugcauggaugaauuauuauuuuauucuguacguuuuuuugagauggaaucucacucugucgcccaggcuggaguacaguagugcgaucuuggcucacugcagcuuccgccucccagguucaagccauucucgugccucagccuucagaguagcuaggauuacaggcacguguccccacgccuagcuaauuuuuguauuuuuuaguagagaugggguuuccccauguuggccaggcuguugaacuccuggccucaagugauccaccugccuuggccugccaaagugcugggauuacaagugugagccacuguauccagccacuuggaugaauaauauagugguaaauuccgagauuuuagugcacccaucaccugaauaguguacauuguacccaauauguaguuuuuauaucccucaccacccucccccggucuuuucuagcuacuguugcugugggcucuaaugaacuguguugucugcccagauguccucuugaauucuuggaaugcugaccuccaagacucccagauccauaaacuacucuuccccuuuguugaccugcuccuuagucucuugguguuugaccuugguaugacuuugaacaccugucugaaaacucccuuuguacuuaaucccuguggguuggaguugauuuugugcugccuugacaugaagccagguagggagugcuagggguuucucuguccccucuaccucaugccgcuuucuccuucccuggaacuuuguaaugguuucaagcaaggguacuuucauguaaaacacuccucaugacacagacauuagcugagccuaauacuagaaauuucuucugaauucauagaaagaaaaugaaguuaguagagaaaaucugaacuuuuacuuugaucaguauuuuaaaaaauuuuuguaccucuuuauucccuucugugcuauaauuuaguauaaaguggcuucugauacagcacaaaauaauauauucucaguuaucuuaaaguugcuauaccaacauuucauuguguucuucaaaccacaucuugacuuuugaggguucauccauauauagauuuuugagcccaucaggacuaaucuggucauauuuucugauggccucaaaguguccauuuagauacaagaaaggaucaccaauguagcugguuacagacauccucccugcaguuuucucucuugccccuuuaaggacaccaguuuccuaucccauggucgaugcugcuucuuugguugccuuuugggcaguuuggccucgauuuuuccaggacucauuuccaggacccuuuccccaggaaugacgcaaugaugguuguucucaagacucuuccuauggucuucuuucauucucuuaagcuuuaaauagcuccucuugcaguucucaccagggacacccaaagcauuucaaaucccucccagauaagaaguguguuaaggugauaucugagagguggcaucuuuaggagacgcugaauaaaagaguguggcagaucuuacaaaugagcugucaacugaagugguuaggcagagaggaaguguuuagggacaaagccaaaggcaaaugagacgauucagagcugcauuguagguagaccuuucugcaaugauuuucuaaauguguacagugagauucuucuuauguccuuguugggucuaugggcguuggugucuugaccuucacuccuuucauuagaauaucacucugcugccaucuguuuuauauguuggggugccauguaagauuuuauuugaagaaacaguuuuauugcuaaagaaaguuugcaaccagcugggccagagcaguuuucugaggcaaugaaagguuuguugcaaugacauuauguagguuuccuaugcaggaacugacugugaagacacucaucugcuaugaaaaagaaguagcccaaacccagaauagcccuuucaugcuucuagaagucagacaacaaacuucccaaagaauaaucucuauagugaucuguaauaaaauguugugaugcaacauguuguguucauucuuuauugcucaauugacuguuguaacaggaugaaagcaaacaucugcugaaacaugugccugagcuuugacugccguuuacugaauguaguucacauguacuuccuuaaauaauuucacaauagacaaauuaauccauucugauuaagcaaaggagagaagucuagugcaaaguacagucuucucaacuaauaauuauaggaauuccaaauaacauguauacguuaaagguagccauaaauagcuuaacaaaguagcauaaguaaauaacuuggaggucucuaaauuugguauguaacuuauuugacuauauacuuuuuuuuauuccaguuuuuaaaaaacauaauagaaggaguccaggcgcaguggcucaagucuguaaucccagcaccuuggaaggcugagguaggcagaucacuugagaucaggaguuugagaccagccuggccaacauagugaaacgccaucucuacuaaaaaauacaaaaauuagcugggcgugguugcgcaggccuuuagucgcagccacuagggaggcugaggcaugagaauugcuuaaacccgggagguggugguuucagugagcccgagaucaggccacugcacuccggccugggugacagagugagauucugucucaaaaaaacaaaaaacaaacauagaaaaaaaaaucuuaauaaguuuacagaacucuuaaaguauuuucaugaaucccagcguuucauagaaaacagacugaaaagcacaaauuuaaugcuucucugaauaaggacugcaaugcuuguucuuuuauuaugcuuuauauucauccucuuuaagacaugaccuugggcuuauuuucuaaaaaugaauaugaucuaggaguuucaacacaccuuucuuagaaacagaugaaguagcaaaaagauaaauaaggauauaucagaucaaaaaccacaacuaacuagcuugacuagaauguauguaauuuugcauccaacuaacaggguguacagauuguuuucacauaaucguggaacauuuauaaaacuuaauucagcccgggcaugguggcucaugccuguaauuucaccacuuugggaggcugagauaggaggaucacuugagcccaggaguucaggaccagccugggcagcaacauagugacaccuugucuuccaaaaagaauuaaaaagaauuauccauuuuugguggugcauaccugugaucccagcuacuuaggaggcugaggugagaggauugcuuaagcuggggaggucaaggcugcggugagacauaauugcgccagugcacuccagccugggugacagagugagacccugccucuaaauaaauacacuuaauuccucuuaaauuccaccaaauuuguuguuaagcagaccacauuuagugaucacaaugcaauaaaauuagagauggacaacaauaauagcaaaaaagccaacuguaaucugacaggcugaguuagaaacuggcuggauggcugugcauuguuguuccucagucauuuugcauaagcaaacgcaagucacaccccauucuauaaacagcugcugauagaaaugcaaacagucaguucugagacucugcauacugaauaauaggugaaauaaggaaagacuuugagaagcaauaagaaauauaucugauuugaccuuguccauuaggugaguuuccuuuuuuuuugguucaguuaaagaauaugauauuuagggaaacauuuaaacauguguuguaaauauauauuaauggagacaguagacuugacaaauaccaaaaagaccuauauauagcuggcugucuacagcuuauugacaacaaauggaagaagcuaagaauccuggcaucauugauuuagugguauuaaaacaucaggaaaagccuugauuuuucugagccuaguuuaauguuuuuaaaagaacuaaguuggcauauaauaaacauauuuauagauacuaauauuuuaaacacgugaucuauuuguaucagaaugcuaccuuuucauuaacauuauggugaaaccaaaacuggcauaguauuagaaacacuugguuuuccagaauggcucuuuucccauacuuugcaggggaaaaacucuuccugauuggaaaagugggaguaccugaagacacagcagcauuaugaauuuauugaggaggguugaacaccuugaaguugauauagcaacucaguguguuacaagaaaagcacuaauauuguuaguuucaugucacuuuuugcacaugcaaaccggaguuuggcaauaguaccuggagaugagggacaggaaagccaggagaggaagaagacuguagagagguuauggcacccagaugaugguuggaagugaggcuguuggaacacagcauggggugugguaggguggauguuugacuauggaaaugaaaaucagcugugaagagauggaaguccugugugcuuuagcaugccaccauguaccugaagaacauauuccugugggcagagaauguaucugcuuaaaugugauuagugccuguagucugggugaggugaugggcgccuggagucccagcugcuugggaggcugaggcaggagaauggcgugaaccccugaggcagagcuugcagugagcagagauugcgccacugcacucacgccugggccacagagugagagucucaaaaaaaaaaaaaaaaaagugguuagugaggaagaggguguuggguaggcaggacaagggaggcaugaagccauaccuggugccucuuaguagucuuuguaaguaucuaugugucaaauugaugguacucauauucucauuuuguacaaagucaaugauaaaugcgcccgucucuuccccaguuacugccaacucauggauguuugucuaauuguuuuuauuauuuggacagucauguuuaacacgucuggcugcuucuaauucaucauguuucuuggaaggaaagaaguaucauugcuccuucagaaagcaaaggguuugcuuuuugaguuggugcauuucccuaacagauuaacaucuuuccuguguugcagcaaacagaaaacuugaggaaguugagaugcaauaggagagucagucuguguuggucaaaagcuuuccaugcauguuucauguucuaggaagaugagucuugacagauuccuugacacuguuuuuaggucuguguuuugcaacuuggaaauucucuuugcaaugugaaguccuuugagugcuaucugauuuuuuuuuuuucuuuugagugcuaucugauuuguaauucucucaguccuggcugggguagcagugcuaucauuucuauuuuuuucugccuuugagccuugggcccacaaguuugguggcacucugagauaaccaaagcuuuucauuuuaccucuucagagcuuguuaauaccagaauucccuguacuuaccaguuggacuugcagauguucuaccuuccagguagcuuaaguuguuccuccuuuuucauuuucaggaaauauuuccacuccauucuuugauagcuuuaugaagucucagugucauccugaagguagacuggaaaaagccccaggaucagugcucaagccugguuuaagccuuaaucugucauaaucauaagaauagcuaugauucauugaucuucaucaggcauuuugcuguucaguuuguacagguaggaggugguauacuauuauuugaauuuaggagaacuugacuccgaagucuguguuucacugucuucuaugugcucacaaaaagcaaccacucagugggagcauacuuuguagauuuugcacucauuccaaauucuuggagacugcuugcuucuugguggugguaagaggcauguuuagcuauggguugagcagacuuuuggagugucgaguggcuguguccauucugagacugccgucacauuauuugagauauuacuaagcaaaucaaacagccacaccuguuuccacuguacugccuauguuuuaccaaugacauauauucuaugugugcuuuuuuuuuuucuauuacccuauaucuauggagcaagggguacuugucacaaacuauaaguacuauaagacccaguguuuuggugaauuuacuuuccauaaaucucuauaaacauucauauucugauccuggaagagccuugggcaacaaauaaugucuuuuggguaaaugaagucaaugguuucaauaaauuaaaaaaaaaagccgauaucucauuugaguuauugacauuggucuuccagaacguuuucugcuuucaggaaucauuucaacgccucuuguuuccuaacauacaguuguuuguguuauuugccuacuggguuauguuggucacccacugaggugaugguaacauuucagaaauaguugauggauuucugggcuaugacugcuuauuuuuuucuucauccuggucuuucucuuuaagaaaaauuaugaacaucuggaagaugcuguuaaaaaugauguauguuuugguguuuuggaagcauuuauaaauguguauauauauuuauauguauuauauauauaucuauaucauauauauaucuuagacgaagucucacucugucgcccaggcuggagugcaguggcauuaucgcccgugaaccuaccggauucaaguaauucuccugccucacccuccugaguagcugggacuacaggcuaauuguuuuguauuguuaguaaaguaaggguuuugccauguugguuuugaacuccugaccucaagugaucugccugccuuggccucccaaagugcuggaguuacuggcaugagccaccaugcccggcccagaaauguauauuuaauucaacaguauuuacagauaauuuuauuuuuugucugaagaacuugcuauaguggaauaucaccaucugcuagaaguuggucuagcaguuuucuagcaguuggugagggaaauggaauauuccuauguagcaagugcauuuauaaauauuaagccaaaugcuauagaacuuaagaucucaacaguuucuagccaugaacuucucugcugccucaacaucacuguuaaggauggacuuauguuauuauuauaaaauacuguacugauaggaaugcacuuaugaaucuuagguuauaggugaauauaaaaugcaguuaucuaauauucugaauuuagauaaaaucaaacucaucuuuuaauaagaaacaagaaagaaucauauuccuguuuccuucuacuuuucaaagguguuagauuuccacuucucuccgccugagauuuugcacaaacaagaugagcucuuuguuuauaacaucauuuuuuccacucuugacauauuagggagggcgcaaccauaucuacgcacaucuagaccagaaguugagaugaguaaacugcacggaagacauaggcugucuccacuuauggaaaugggguuccugcuauugggcaguaugcaucuugcuuuugaaguggaaguagcuguguuccaccucaggguguaggaauuguaauggucugugagaguuguggccagggcucauuugguaaauacaagugucccuacucauauaucuugguacauuauaaaaugccucuucuagccugccucaugccaugugacuucucuuccuugcuuuuggugucucuguuauguguuuccuuccagaaugccggguauggguccacaauggcauuauuaaaacaaaaacaaaauaaaacaaaaaaagcaagaaaagccuacugcuuuuuaacguuaaacauaaaaguacugauaagguuuauauuucuaugccagucauuuguauaugaacauuuucuccaaaucaaucacugaacaaggggauguuaaauuauaugaaagaacaugugguguuauaauucacauaaaugcugauguucugugcuauuugaaaaguaauaguuauauucaucugcuccuguuucucugcaaaaauaauuuugcacugcaauaagugaaguccauaagcuacauaggaacacucaaauauugaaccauucuaaaaaauucaaaauauuuucagauaaaaaauucuuuauaauauaccuuauguuucucuuuauaaaaauuucuccucuugagcucgggaguuugagaccagccugggcaacauagggagacgucaucuccccccaacaacaacaacaacaaaaagcugggcaugguguaugguguugugcacugcugugaucccagcugcuugggaggcugagacuggaggaucacaugagcccaggagguugaggcugucucuuucuucucuacugagcuuuauguguuuuuuuguuuuguuuuguuuguuuguuuguuuuuuugagauggagucucccucugucucccaggccggaaugcaguggugcuaucucugcucacugcaaccuccaccucccagguucaagugauucuccugccucaaccccgcugaguagcugggauuacaggcacccaucaccacgccuagccauuuguauuuuuguauuuuuguauuuuuagcagagaugggguuucaccauaucagccaggcuggucucgaacucgugaccucaagugauccaucugccucagccucccaaagugcugggauuacaggugugagccacugugcccgcccaagcuucacacuuuuauuccuuuuccauguuuauuccuuuugcaucuuugucaaacaugugacuuaggauaugaauuuugaugucauauuguguuauguuuaugagagaagcuuaaaauguucagaaagauggacuuauuugaaaacccaaaggcagguauaguuguugggagaaguuagacugggacauggcuaaaacuauaaggucuaagguaggcaagaguaagagauuuuccacauugaauauaacugaguuggauccccauuguacccuggcaccuagcauauaauaaguauucaaucaauauuuauugaaugaaggaaaaagagagagggccagaaguguccuuacagagacaugaugucagagaaaauaauguuuuuuuuuuuuugagauagagucucgcugugucgcccaggcuguagugcaguggugugaucucgauguuauucucuugccucagccucccaagaagcugggauuacaggugccugccaccaugcccagccaauuuuuuguauuuuuaguagagacagcguuucaccauguuggccaggcuggucuugaacuccuuacuucaggugauccacccuccucggccucccaaagugcugggauuacaggugugagccacugcaccuggccuaaaauaaucuuauucgagaggaaaauacuuauuugagagaaaacggggccgagcaauucuacagguaaaugaaaaauuucaugauugcucugcuugcuuuucauuuugaaaccauaggaaagaaagaugauuuaugggauaugguacaaguauuaagaagaguuauuuuuuuuucuuggauuugcaaugaccagcaagaagcagacaagcucccaauuuaugacuucuguccuuggcagagcccaucaggaugaagggcuucuugauagagggacucugagcacagaaguacagaucccucaacccaaccucucugagagcacaagccuuaauuauaaagcauuuuaucacugcuauaacugcuggcacugaagaaaacuuuugauucuugaauucaagcagcuguaacugagguuucucacucugaaggaaggaauacagacagaagaaaaauaugcauacaugacuagaauuuaggagacaugagaucuagauuagccccaugucuaacuagcugguuuauuucagacuauucauuuaccuucucugaguuucaguuuccucuucuggaaauuagagcauucaacugauggguacuccuaggucugaaauuaccaaaaaucacccagauacaacucauucuuagauuggaaugccaagguagauuuugugauggauagggcgccccaaaaucauuguacuuaacuuaaauuucuuucugugauuuuucugaagguucagguacugguuacauuaagaauagguuauaaaauuacaugccuugcuaaugaagaacguggugaaacuauuaauaauaguauuuuuaauaagucucaauuauugaacacuuagcacagggcaaacaaugugcuaaaagcuuucuguggguuaucucacuuaguccuuaaaacaacccaaugagauuaguacuguuauuaucuccauuuuacaguuuaaagaauaaggcuuaguauaaaaaacuuggaucagaucauacaaaguagaaaagucagaauuugaacucaagccuauuugccaucacacugagaaaacaucagucucuauaugguaugagucuuguccagacaugaaguucuuuuuaaggaugaugagcagauaaaauaaaaucaaguauauuuauuacauguugcuguucaguuaauauuauuccuccccuuucuuuugcucuguacuaaauaugaguaauagagggaaaauuuggcuuucggaaaauggcugaccuaucuagaguaguuuuagaaugauucugccuaauagugggggauccuaagguuggagucuaugauucacuuuaauaugacacuucauggaaaaucugggcugugauaugucuguguguguguagcagagagagagagagggagaaauagaacuagaucuuucccuuuccucuuaacuaaaucuacucucuucuaucuuauuuccuaaaaaacacuuaaaaaguauuuuuaaaaacauuuaaaaaucuuuaaguguuuuuuccuucaacuuaaguucagggguacaugugcaguuauuuuuauuuauuaaauaaauuuauuuaaagaugggauguuaaucuguugcccaggcuacaauguagugaugugagcauaucuuacugcagccuugaacuccugggcuuaagcaauccuccugccucagccucccaaguagcuaggacuacaggcuaaugccaccacaccugccuaauuuauaaaaaaaaaaacaaauauauauacacacauauauauauauauauauauauauaaauaggucuugcuaguugccugggcuagucuugaacuccugacgucaagccauccuucugccucagccuccucagucacugguauuacaggugaaaauauguuuuauuuuaaaaauaaggaagaugauagacuuucucucaccaggcaauuaacaccacauaguacauguugaggaaauggguguuccuugcuuucuauuguuaaucugaugauagugaggguggagagcacuuugaaaaaauauuuguauaaggaggagagagagaagugagcugaauaagaaagucuuuugcauaucccaaauuaaggucauucuugacuuuuuagaagauauuuccuugagguagacagcacuuuucucaaggcaguacagaguuuaaauauauaaccuuggcuucaaauacucuuagcagauccuuauuuuuaaaaauuaauuuuugguuuaggggcucaauguacuuucuuauacuucuaggaaagaaaagaacauugccugcauauugacccuuggaagccagauugcuggaugcugcugcuaauaacagcuaauacuuacauagaacuuacuauguccugugcacuguuccaaacuuuguguguauacacuagcucaguccucacaacagcccucagaaauagcuuuauuauugugcuucauugagucuaaaauauauugaugaugcauucuugaccuugcuagaagaugcuaacaaaaagcuuucacacaguuguaucucuauugcaauugcaauaauagcaauugcaagaugucuuggauuguaagacugaaauguaagaugcaccccaauuuuaaagaaguuaaaauaagaaagcauguuagaauugauaaaauagaaucucuuccuguuuuacaggugaggagcccaaggcaaaagagacuaaauaaauuuuccaaaguuacaugacuggacucaaauacagguggcuugguuguagaguuucugccuuuaaccuccauuuuuuuuuccugucucucaacaauagauuggaauugugcccaugcuaauauguggguagacuggccaagacucaguuacuuaugcccucacugaagcacuuacgauagaacagcucuagaucuuucugagggagacaguguauaugcuauguauagggcagugaugaggauuguugugcuaauguguguaaagugcuugacaugugggcaucugaccuagguuucagacccauuuucagcaagagagugucagagggaagcccuugugaacuggcuucccaaaccucaguaggcuggaguacaagcaggaaauggugagcauacaacguuguuugggugccccaaaugucaaauucugguacuguguguucucacuguuuacuccuuccugaaaugaaaugccaacacaaaaaucauuuacguuauuagauuucuguauuugaggaguggaguauuuucuuucuggaaaacaggcccuaggaauacuacucaggacuugaauaauaaauaagagaacaaaaauuguuuauaugaaaauauaccaucaauugagacuuaacauuaaauugucuucaccuaguagugauaaguagugaugagaaagccacguauggacuugcaggauggaggugggaguauagucugguauagacuagaaugauuuucugcugaaagaugggguaauuccacuaacuccaggcuuucacuaacuggacugcaagcucagauaagaaggcugucgcccucaacaccaugcccaaaccuugaaagaucuguuauuuugaaaaccugccugcccccaacucccuuuauuucucugaaauuuucuuauucuuuggaauucuggucucuuuuaacccagaccagccuggucagcgugaucaguuuugaacaaacucuagacagccuccaaauuugcuaaagguuuuccccaaucagaaucuucauuguugggucaugggugaauauuuugcugccaggucuuucagguaaaaugggaggugaauucucaacccaggaagccugugucacucaucacauauuucccuguuaucugucaucuucuccuaugccagugcuccuuucucccaauccuuuacuguacucgaacacauacaugcuguucgagugugauuauacaguauauaaugguggagauaaauuuuuggauacagaauaucuacaaaugagguaauuuaaaaauaaaauuuuaaguuuguugguuuggcacaaguuuuaaacaccaaacuguuguuuuuguugcuucugauugucauuuuacauuucuaguuuugaacuguuugaacaucugaaauuaauuugaaacauuucagacuguuuugaaccagucuauauuggucuaaaccaguaaaaacaauuuuacagauaacuauaguuaucaaacuaguuuccagcaguucgauagagguagaaccagugugacucaauugaaaguggauuuaauuugucagcacaguuugauuuaguaaaauauacucagaaccaacuaaaacuuuuagaagccugucagaaccugcauguccaagucagagccuauuggaacuagcuaaaaccagucugaagcaauuaaagcuaauuacaaugagacuccaauaauuuugguuagauauaucagguuuuagccaaagucagaaaguuuuguaggagaaccucuuuuaacucaccguaaaauaauaugaaccagauucuuuugaacaacuaugaacuugcuaaaauggaugguguauuuuauauggauuugaaccucuuuuuaaguugaucagaacucuuuugaaguaaacauaucuguauuaaaugaauugcaaaugguuagaaccagccaaaaaggaucagaauuauuugaaagugaucuuuguugacucagccgaccacuuugagccaguuagcaaucguuugugcuagaaagacauguuuuaagcuggccagagucaaucugaaauuuguucuagaucuucagacccagucugaacguccacaauggggagaauaaagugagccaacaguuaaguacccaguauaugccaaccauugugcugggcacuccauaaacaguaucucauugaauccucagaauaauggugugagguaguguauauucuuuuuuauagaacagaaaccuggaaaucuaaggcucaaagacauccaaguaauugguaucugggagauuugggauucaaacccagcucugcuugacuuggugaguuuccuauuagguuaccuuguaagauaccauacuacuggucacuuuaaagcccaaugugcauuuauaacaaaaaugaauaauggauaugaagcuugggguagaauaggcauuggacuuggagcuaggagaucuagauucuagaucgugcaaaucagucuaccucucuggguucuguuuuacccuuuagaaaacugaacccagagaguggaaggucugaacauuuauuuucagaucaagaaagcagauaauugucuuaaagauacaaucugaaaagugcaaacuaugauuaauauugaugguggugucuauaccuucaauuuaugguauuugguuuguuaacagucccuuuaugauuacuuggucaguauugcuauugugaauagaaaacaaaacucacgaagaucauuuguagacuuacaugugugauuacccauggaaaugaaacacauuagagauaguuucauuuaagucuuugaauuccacuuaagugaguuuagagaauucuagaauaugaugccauuggugacagcauuuuuuccuguacccuaagugauguaaaaaacauaguuauaccaacuuuuuuuucaaauuaaaaauaaauaggaaauaagguagucacagugucuucuugcaucauucucacugcaggaucgguauuguuaucugcugcuccauucaguuugaggggaagcccucaaaugagucaacauuaucuggacuugcuuuucaauucuuagcucuuauuuccaauaacuuagagccaggugugaugcugugauaugacgugcuauaauguugauguccaaguugucguuuuuuggagaggaauucuguuauaugucauuaauacuggugaccuauacuugcaaauauccaagcuauaaagacagguaaggcaucaucugugaagugucacucuuuauagugugcaaauagaauuuugaauguuuguagaggcucugcccuuauccacgggcuagccauaccugaaacgugagguugcagaucugcacugaagcacucugaggaaacacacugcaguggcuuuuggggcucagcauucaggaguuuucagcauaaggugaguccccaaguugaggauggggugagggagguaacacugaaaaccaguaaauauucuugucugaguuuuuauuaauuuuauggauauauagaaauaguccuacaggaagcacugaauauggcagccaaguuucuggauauggugcuggguaaaaaggggauaacgccgggagucaguagcauccaauguaggacaucuggcauguguauagauggauaaauauguauguuugaauagucauguagagucgucaguguuaaugagauagcuaguuguuuuuaugauuuucaggagaguuuauuggcauuggcgggggaaacggagagagguugguuaauguguacaagcauaugguuagauggaaagaauaaguucuaauguucaacaguagacuagggugacuauaguuaacaaaaauguauuguguauuuuaaaauagcuagaagagaggacuugaaauguucucaaugcauagaaaugauaaauacucgaggaaauaaauacccuaaauaccuucaugugaucauuacauucuaugcauguaacaaaauauuacauguaccccauaaaaauauacaaauauuauguaucaauaaaauuuuaaugaaaaaguaaaccuccccuggagagagaucccauuucuaguuggacugauauuuuggguuugaaucuauuuagaagguaaauacaaaucaugaaaagugcugauugcaaagaaccaaaaauagccgugguuagguauugcugauauaaaugaauuuuucuucuuuaagguggacuuuuguuuuagucgguacugaagagcugaauuuuuagcaguucuugauagaguacccagguaaacauagguaagcgagcccuugguuguggcacuguggucucugagcagugacuguucaaaucuggaacucaguucccaagugagcagugauacucuagagaagucuggcuuaauauguaguacauauuaauaguaauauguaaggaagcagggacuaaauuuacuugugaaauaacagugucuuugaaggaaccguaauaacaugugaaaaugaauagaauaaaugaaauugccuagauguccauguaaaaagagagaaaaggcaagguucuagcacuaggagacuuucuuucuuucuuuuuuuuuuauuuccauagguuuuuggggaacaggugguguuuaguuacauggauaaguucuuuaguggugauuucugagauuuuggugcacccaucacccaagcaguguacacuguauucaaucuguagucuuuuaucccucacccgccucccacccuuuccacccgaguccccaaaguccauuguaucauucuuaugccuuugcuuccucauagcuucacuccuacauaugagugagaacauaugauguuugguuuuccauuccugacuuacuucacuuagaauaauugucuucaauuccauccagauugcugugaaugccauuauuucguuccuuuuuguggcugaguaguauuccgugguguguguauauauauacagauaaaaaaauugugguguaccacaauuucuuuaucuacucauugacuggugagcauuuggacugguuccuuauguuugcaauugcaaauuuuagcacuaggagacuuugaaaaaggaggggaaauuggaaccacuugcacucuaaugauuacuguuauuccuuauaacauucucuuuccucuguuuuucuuguauuaguuuuuguucuauauggucuacagauaagacuuagugacuguuaccuucuuguugauuaucauucccacuugaaauuuuuguccuaaugguacuauaauauguauguuuuuauuuuuauuuuuauuuuuauuuauuuuuuuauuuugagacagaguuuugcucuuguugcccaggcuggagugcaauggcgcaaucuuggcucacugcaaccuccaccucccagguucaagugauucuccugccucagccuccugaguagcugggauuauaggcaugcaccaccaugccuggcuaauuuuuguauuuucaguagagaugggguuucuccauguuggucaggcuggucucgaauucccaaccuuaggugaucugcccaccuuggccucccaaagugcugggauuaccuguguguuaaauuaaaacuacacuguuaauuacuauuucaauagcuucucaucuagcuaguuauuaggucuucaaggauggugaacaauauguauguaacucucuuuucauacaacccguagacauacagguuaacauuagguguuaaacugaauauuguugucacuuuuuaaauggauaauuaauguuuucuaauggauuuuaauuaaaaaauuuuguguguauuuuacaggugaacuacugaguucuucauuaugucugauggagauuaugauuaccucaucaaguuuuuagcuuugggagacucugguguagggaagaccaguguacuuuaccaauauacagaugguaaauuuaacuccaaauuuaucacaacagugggcauugauuucagggaaaaaagagugguaaguucuauauccuucuauguaaaaauguaaucguuaagucaacauuugcuggucuguuuaguuuacuuuguaggaauuaggaggacaaagguugggaucugaaauuaaagguacauaugaaagugaguuauguucaauccaggcaacaugauugaaaaggcugugcugacagcacuucauauaaaaccaggcagacaaaguggaaguggacaguucuuuaaaaugucaccuugguacucuuuuggcuuguaucuucccucugaacuccgaaaguuauuugucuaccuuugucuugaagccugccaaccaccuugccccucauacucuuguuuuaugggcugugucuuccaccuuugguaucuuauuauuuuuaauggcauuucuccuaauaaagucucagcaguuccacauggaacacuaacuggcagaacuuaucacugcugccaggagggugagguuggaguaggaguggggaaugccaguagugaaugugauguucugcagaauguugaagggagaaacuuuuauuuauuuauuuuuuaaggacuuugagacugaaaguuauucuaguguuggaggggaaggcagaaggucauggugucacaguugcagaugaggaaagauggcuuucuccuuagacuacauuucuuguugaaaaauccauuguuggccugaagcagguaaaccaguugucaggaaauuaaugacaaagguccuuuaauggaucauauucugucagggggaaaggucccuggcuuuuaagacagaagaacauucccuuuugcccauucuaguauuuuauucuacuaccagagaggcuuauagagauuaagacccacugaauaacaguagggcccuaaugaaauuuuuaguauugacguguaguugauagaaucuacauauauguaugugauuauuuuuguugguuacuuauuguauaacuuaaaaaauagauuuguugagauauaauucacaaaaaaaggaaauccauccaucuaaaguauaaaauucggugguuuuuaauauauucggaguuguguggccaucacagccauucaauuuuagaauaguuucaucacuuuaaaaagaaaccucauaccuauuagcaggcauuccucuuucuaccuccccuuagccaccaugaauuuucuaucaauggcuucugcacacaccauauaaauggaauaauauauggccuuuugugucuggcuucuuacauucagccugauguuuucaaggaucuuccauguuguagcauguaucaggacuucauuacuuauuauagcuacauaauauucuauuguauugauacaccauuuuguuuauccauuugucuguugauagauacuguuguuucuuuuucuauuuucuagugcaucauuuuaauucccuuuuuuguuauauguuuuugaguucuuuuuuaaaaauucccuuggggauuacaauuaucuuaauuuuucacaaucuaauuuugauuaauagcaacuuaauuuuaauacuguguaaaacuuugcucuuauguggcucuguuuucucccauauuuuugugccauuauugcuauacgaaugacaucuuucuacauugugugccaucaucaauacagcuuuacaauuauugcuguaugcaguuaauuuuuuuuucuuuuuucuuuuugagacagggucucucucuguugcucagacuggagugcaguggugagaucucagcucaccgcaaccucugucucccagguucaagugauucuccugccucagucucccaaguagcuaggauuacaggcacccgccaccacacccggcuaauuguuuauauuuuuaguaguaaugggguuuugccauguuggccaggcuggucucgaacuccuggccucaagugauccacccaucuuagccucccaaagugcugagggauuacaggcaugagcuaucacucccagccugcaguuaaauuuuaaucuaguggaggaaaagggcuacaaagaaaaaccacguuuauacuguuuuuuauauuuacuaugcaguuacauuuuuacuggugcuuauuauuucuuuguguggauuuaaguuacugucuaguuuccuuucagcuuagucuugagaguugucuguaguauuucuuguaggauaggucugcuagagaugacuuuucucaguuuugucuuaauuuauccuuuaauuuuagaggaccgcuauguuacugauuuuuaaguucuuugaauauauuuauaauuccugauguaaagucuuugucuaauaaguuuaacaucugggccuccucaggaauaauuucuauucguuguuuuuuuccugcgcaugagccauacuuuccuguuucuuugugugucuuauacguuuugcugaaaacuggacauuuaaaauaaugugucuauucuagaaacucagauucuuuccccuaccuggguuucuuguuuuuacugcauauuuauuuauuuuugucguugcuguuuguuuaauuauguuucugggauaauucugcaaaaucuguauucuuuguaugcagcuacugaagucucugcucagucaacuuaguggacagcuaaugaguggagagaguuuauuaaauuccuugaacuaauaagucucuuagcuuuuucugagagucucuguguguuuguugggguauguguuuaauacuacugcaggcaguuuacaacucugccuuagcuuuuauuuucugccugagaagaaccucaaagucagucagaagugagagauuaggaccuuuuuagaucuuuccugggcauuuguagagcccugcccaugaacauggccuuuuagguuccaaggaauauuugggagcauuauagaaaucucauuuccuauuuuuuucuuuaaauuuuuuuuuuguuguuguuguuagacuuuuguuagcccuaacugguauugcuaccucugguagcugugauguuaaauaauuacugcugauaguuuucaacaaaugcccuugggauagggcuguucucaaagagcaagcuuugagugaggucaaagaaagacaaagcuggggcauggagcuuuccaaggggcuuccugacaauuuuucucaguaugggacuuuuagggagcuccaaaccuguuguuccucugcuguccacagugguggcuaggcugauguuuucacaacaaccacauuugugcacaugguuuuuaagucuucuaaaagcuugagugagggggaugggaauagggcaagguaaaaaacaccucaaagcuuacuguuuuuacugauauucggcuguuuuucuugaauaaaugcuccuuggaauguugcaagucuuuguuaauuccuagaguacugaaaaaguugauuuggacaauuuuuaccacuguuuuuguugcuauuguggaggaagaaauuuuugaugguccguucucugcuguucuaggaguguugucuauaaaauucuuuuaagagcacuuuuaaaauuugggaugggacaagggaaaauuguucuaccaaaaauacaucugcacucaaauguuuauugcagcacuauucacaauagcaaagucauggaacuaacccuaggugcuuaucagugguggauuggauagagaaaaugugguacauauacaucauagaauacuaugcagccauaaaaaagugaaauuaugucuuuugcagcaacauggauagagcuggggaccauuauccucagugaauuaaugcagaaacagaaaaucaaaugccacaugcauucucacuuauaagugggaacuaaacaauggguacgcauggacauaaagacagaaacaguagacacuagggacuccaaaagggggaagggagugggagaggggcugaaaaacuacuuauuggguacuacauucacuguuugggugaugaauucaauagaugcucaaaccccagcauuaugcaaucuaucuacguaacaagccugcacauguacccccugguuaaacaaacaaaaaagaugagauugggaaaagccauagaaaaguaauauuuccugaaacuagugacccaagagaacuuugaggaaagguaaacuaauuauuauauuuuauacaaguuguuuuguauucauauuuuacaauauauuuauaagauauauauguauauauuucaauauaacuuauuacauuaccuggauauaauuauuugacauaaauacaaacaugguuguauuccagauggcauucucuuuggaauuuuagaugccuuugggauuuguacugaacaaaaaggugagaagguucgcugguguuagaaguucucuuuuguuuucucuuucacuuugcuguuuuagguguacagagccagugggccggauggagccacuggcagaggccagagaauccaccugcaguuaugggacacagcagggcaggagagguaugagaucuucaguuaugugcuccuuacugaaggaaagggaaaaauaguuacauucuucaaacagugaccugagcaggaaaaagccagccaauucguugguuugcacuugaaugcugccaaauuagcaggaaauuugucaagucugagaugagaaugguggccuuauuucauacaaggucaagggagagguuaugacucuuacuuguggacuuuuuucuuuuccuucuuuuaauuuuuuuuugcuuagauacuuugcuccauuuccuuuugcuauuuacucaaccacaagaaaguggccaaguuacaugcauuauucuuaccugacuguugaaaucuagugggauaucugguuggaauuaauucaugugaccagggguuacuugaccaaaauaagccacaugaaaucuugauauaaaguugcuuucaguuagcuagaacuucuguuuucuuucacagccaccuugaaggauuuuguuuuuuaacuuuuuauuauggaaaacuucaaggauauucaaaaguggaaggauuauaugauaaaccuauguacccauuacucagcuucaacaauuaugaaauuguggccaacagaauuucauuuauaccccuuaccucuucucaccccacccccuuaccauauaauuuagaagcaaauuccagacacuauauuauuucauuuuuaauacuugugguaauguagcucuaaaagauaagagcucuuuuuuguuuuuuuuuugggcggaguuucauucuuguugcccaggcugacgugaucucagcucaccgcaaccucuaccuugcugguucaagugauucuccugccucagccucccgauuagcugggauuacagaugugcaccacuacacacagcuaauuuuguauuuuuaguagaguugggguuucuccauguuggucaggcuggucucuaacuccugacuucaggugaucugccugccuugaccucccaaagugcugggauuacaggugugagccauggccccuggccaagaacucuuuuuaauaaaaacauugauuaaaaguauuugagaaaaaccuaauauugcugauuagaugacaaauucauaccaauauuuucuucccuggagccugccugucaguuacagguuuuacauauaggcaaagacgagaggaaacugacuggugauagggugggguuggggguggggagagagagagagaagacagggaagacagaaggauaaagccuuggaaggcagaguaccaagacagaauaaggucugagucaagagauucuuaccuucaagccaaacaaauggcuaucagagauaagagaucucugcauauucugaaauuaaaagaucauggaacacauuguaaugucaagucaagcuuucacaauaggaaaacauacacuauauugcuuuuggccaaauuaacucauaauuguacauaaauucuugggugagacuaagaucacaagcugguucuugucaucccucuccagcagccucgguuuucaaaucacauggucuguuaacacuuaaacugauauaagugauaaauaacuauccuauauacuuuugaaauaucaccauguagcuuguuauugguaaacuuuuguaagaggcugaaggcauugcuuguaguuuuauauuucaggaguggggccgugguuuaacugaccauucugcuuuuauguuccuagguuucguagcuuaacgacagcguucuucagagaugcuauggguuuucuucuacuuuuugaucugacaaaugagcaaaguuuccucaaugucagaaacuggauaaguaaguguuauuguuccccaguguccugcuacacaguccccucuuauuuauagaaugcccucuuaugcucuacuucugugacaaaucguuuuggaggagaucuuagugcaaauacuauuuuaaggagcaagguuuuuaguuuagggacaaagauaauugaaauacucugcuucucccugguacugauaacuuugauuuguugaguacuuccugugcuccaggugcaaggcagcacuuuaugugugcucuccucuucagucuaucccacagaagagacucuuauucccauuucguagaugaggaaguagaagccuagagaaguuaaaucucuaaguaucugcuugucuauuguaugcuaucaauucuucuaucaucucuggacauuaaauggguauuacauagaugcagauagcuuuuaaagacuuaauggaucauaccccuggcuucaugucuuuucugugcuuagaguccccuucuagcuuuuaggguuagagcaucuuucaggaggauucugccauggaaaacucuacaacugcauugguaaaaguggucaccagugcaauauaugucaaccuuuauuuuggagagauuuuaaccuccuaaaugauugguucauagccauuucgaauucugccacuugacugcauaacagcuuucaaauguauauuuucccuguuuggucauguuaguguaacccuagagaaucuauuagggaaggcuguaauauuaaauucuuaacaucuaaaucuuuaaaacacugauuuaaaaagaucugcuacuuaaacauuacuguuuugggauuaugaaaggguaauuggcuguaguuuugauaguagaaaagcuuagauuaaaaaugaguuuaaaaauaauuuagugcacugugguuuucacauacuuuguaucugauccucacaaucacccugggcaaagauucgggucaguguuguguccuuauuucaggagaaggacauugagccuuaaaaaguaauagacuuauccaaggauaugaagcuuuggcuuuccuuuuuaauggccuuuuuuuugcccguucucaagucaguuggccacuaagaguugaagagcuauuaauuacuuuaaauaugaguuccccaaauauaguaaugcuuacuggggcuucacuucgcuagaugccuggcuaaguugccucauuauuucccuuguagcugaaugacaguggcuguuuauggucucuuacucucagcccguguucaucaucccuccuuugcaucaucagaacaaguucuggggcuuuuuaaaaucaacuauuuuauaaggaucacuagagagugcgcauagaaucuuagcaucaaaaaauaacgcaccuguuuuucauagguagacacuaaaacucugagacauuagauaaauauugccuauccuggcuaacuaguuggauaaagaacaaaauuaugugaaaauauguauacauauguauguauuuuguuuuguuuuccuuagagaguaaaagaauccuuauugcucaguuagguaaagaacacuuauacguauugaagauuuuauauauuuaauagaaaguauucuccacccccuaccauuuaaacaaaaagguguaauguucagugucagaagugguaauaucaaaucuuaauuaggaauaaacauuuguuaauuaucuguacuuuuauuuuuuucuucuuccugucagccuuuugaguauuacaaugaucauucauuucuuaucuuuuuuuuuuuuuuuugagauggaguuucuacucuuguugcccuugcuggagugcaauggugcagucucggcucacugcaaccucugccuccuggguucaagcaauucuccugccucagccucccgaguagcugggauuacaggcgcacaccaacacccccagcuaauuuuuguauuuuuguagagaugggguuucacccaucucccgggguuucauccaacuccugaccucaggugauccacgcgccucagccucccaaagugcugggauuacaggcgugagccacagugcccggcccauuucuuauuuuuuaauaaaaauaauagcuuaauacacacaaauacacacucacacacacacacacacacacacacaaauacauaaaaaucaguggugagugccagaacacaguguugcauuaaagaaguagcugacucgugggcccugauuggccugggagaggagagcaggucuauauacccuccccuuucccuuugcuccuugcagaccccucccucucacucaaucucuccaugcccucuugagaagggugauaaaagucuaaaguaagccccacucagaugaggagacagaacagaggcugaguccucugggccuggauugaaaucugaaaggaauuugguagugugguagucacuguccugucuuccuggaguucagaggaguaagcacgucaugcccagagucacucuucauccagugcuaguguguuuccuaaggaaacuuuaaaguagccuacauuucuaaacuuucuucuguagagucccauaaguggugcaaaaacccaacaguauauauuuuacauauuuuuacuucuuuauuuuuuauucccauuauucucucugucugaaaaacccuuuccacaccugcccccauuuuuuaaccaacuggaguucugcuuauucuuuaaaaccuagcaaagauggccucugugagauucucuguaauaaacuuaguuguguuagauguuuucccuccuuuuaaccccuguuacauuuuauacuguguauaggguccuuauuacauccauuaucagacuguaguuguuuauguaggugacuuuuuucuuagugaaguuuuuaaaauaacugauuaauuugcuuuuuagauaagcacaaucuuaguagaaaaauuaggaaaaaugagacaaaaagaagaaaucaccaauaaucacacuuccuagacuacccaaaauaaauacuguuaaccauaauuacuggugauacuuacaugcucuucuaaaugcuuuaauauauuaacuuaguaguucucaaaugugaaugugcaucucagucaccuggaggacuuuuuaaaacacagauuucuagccccauuuccagcauuccugauucaguagagcuggagugggaccugagacuugcaugucaacaaauucuuagguuaugcuaaggcugguggcucacagucuuuaccugcagaaucacuggauuaauucauuuuaauccuuaccuugacuguauaaaguaaguaguaucauuaucaccauuuacagauggggaaauugaggcagucaaauaacuucaucagggucacacagcuaguaaauggcagagccaggauucaucccuagguacacuggauccugagucugugcucauagcaugacacugggcauggaccuauaacaccuuauaaggcauuaacagagcacagagccacucuggagaccagaaagauaaugagguaaccaugaagcaagucuugaaggaagguugugguuaaguauucagugaugugggaacagcauguguaacaaccuggaggaaagaaagggcauggcuuuucaugaaaugguacacaguuuagucuguccucuguaggucuuauuaccccaguugccccaugagggcaaagaacuguugugaaauuccaugcagaguaucaggccugugcuaaugcucaguaaacaccugccuacuugacuuucucaugauaagauaugaugaacacuacuucauaaugaggaacuaaaauguccacacuuuucugguuaaccaugaugaaaaaauaaauuaggccauaaacucugaaguaugucuuacugugaacguuuaggccuuaauuuuauucuggggugugauggguaagaaaugagguguuauuuuccuacuuugaaagauuaaacuauuuagcuuagugaagcucuuugguuugagucaauugcuuuuuauaauugugccuauuugcagguuuucaggugaaauaaaagcugcggaauaagaauuauaguccucugcuuccacuuggcucuggugacagaaucacuuacuguuuauucugggucuuuucuucucauugaagccuguaucuuguuuguuuuaaaugaguugauucugcccuaggauaauagaaaaaugugaaaaacauuuuggauagaaauagauuaguuuggagaaaaacaauucuuuuagaaaugucauugcuauggagaaaaaaacacauaaaaacaguuuuaagauuagcaguaaacccuaggaacuccugcaacuuucuuuucaaauagccuucauaaaaaagaaagguguuuuguaugugugugugugcauaugugugcgugugcacaugugggcccucacacuugagagguagcacauucuccuauaaacucuccgauaucaauaaacugggguaugugcuuaagaaugguuuuauauuucugccccaacuauucagcuuuacagauaagauuacugaugcuuugaaagcauuaugucaauucccaauaucuauauauacauuauagucuucaaagcacuuuugcauguauuguucacugaucauacacuuacauuauuauuuacauauauaauaaacuuucuuauauuaauaggccagcuacagaugcaugcauauugugaaaacccagauauagugcuguguggaaacaagagugaucuggaggaccagagaguagugaaagaggaggaagccauagcacucgcagagaaauaugggugaguauuuuuguggagaagucuagagaaaacauuuucaauauaaacauuagcaggugaaugguaaugaaaaagauaaaaguggacaauuaaagcaaaaccucagccauaggccuuggggcauguugaauguguccuuuuuauaugauaugauaguaggauccauugacaaugcauguggcaagggccuccuucagugcuuuggucccauuuucucaaacucuuggcauuugcagagagacaacuuugaguugucucagaggcgccuuaaguauguaaggccuucuuuccaagaugcaaauaggagacuccugggguaaagaaauccuccauguugagcgaggaaauuucuuuuuucauuucuuuucuuuuuuuuuuuugagacagagucucacacugucacccaggcuggagugcaguggcacaaucucggcucacugcaaccuccaccucccggguucaagcgauucuccuaccucagccucccaaguagcugggacuacaggaguccaccaucaugcccggcuaauuuuuguauuuuuaguagagaugggguuucugguaccauauuggccaggcuggucuccaacuccugaccuugugacccacccgccucagccucccaaagugcugggauuacagguaugagccaccacacccagccucagcaaggaaauuucaaagccacuucauguacuauuguagagaaugcuagcauauaagaagggcuuauugguuauugcagauuaggugcugguuuugaaauuucuauucugggagaggagugugagaucuccuuuggcuuagucuauggucuugugguggagggucagcaaaauacugucguucuccuugaguucugggaauaggaucauagcagcagcagcagcagcagcagcaugaacuggacaugaaagaaguggucagcugcugcuuauuaaaguauuaaaguguuaagggugccucuaaaaggaauuuuuacuuuacuuucuuucugccucucacacaaugagaacccauauguaaauucaaacccuuaauagcauuaaaagaggaaggaagcaaguggguugagaagggaggggagggaaauagagaugguguagaugguguaggggauguuaccuaguuuguggcuuuggugguuagcagaauccaagaaggccaagagaaaaccuuucccuuuuuauugugugaucacugcuuuauucuuucuuugguugauggagguucagaaagcugguaggguuuauagugggaagggagggggaggauagguuggccagguaggaagaagccagacucuggagggguuugaauaccagguaaggagauuagauuugaucccuggaggacagggaguugcugaaagccuuugagcauggagggauguuauguuuacauuuccagaucagucuauaggcuauagguggggagggaggaaagacuagagauugauagauugcaguggucugugaggugggcagaggcuagcuuugugaaaaaggaaaaggaagaauaaaucaggaaaaacacauagaguagggcaggauuuuagguuuuucucaaggcuagcucagcugaaggauucccauccacuauaggcuuacucuggcaaggauuugcaauugcauguagagguuuuuacccuagggcagaugguguuuaaccauguuagaaacauccagagaacuuuuaacacauucucaugucugggcuucaccucugaccaucagacauaauugguuuggaggaguuucucaggcaggguucacuugaagaagcauaccuauacaugaagggaucuguuacaggaauuugagcauaugcaauugugggagcuggguaaguagucucuguaagguguugucuuugugucugaugcugaagccugaaggacaggacagucagacaggaaggggagaaggaugugaaaugggggauggauggaaaaagugagaaccagcuggugcccauaaugagggacuaaaacccaugucacuuccuguugccucugaccuggcugguguggguguccugcagaaacuggggcccuuugucacagggcuaacaacaucaccuggcccaggugcaggucuaguugcagguuuaugacaauaagaugagccagcagauaagcgacaauauaugagggcuaugaaauggagguugcuucacuuccuacccccaaaauugcccccaaaucucuuuuguggcccacccuaaccagaaagggcauucugggaaauguuguuuagccuagccaagcugacucauuacaaagccugggcauugguaucuuuuaaaaucuccccacgugaucuucaugugcaaugguugagaaccagugacuuaggugauucugagggggaggcugacagagucuuaccggccagucugaaaugucccccugcuccccugagaggcacucauguaacguaguggaaaagaaacagggagagaacgauuaccacagagaaugcuguaguguugaagcugugagguauguugcaauggguaaggaggaaguaagugaugaagcaauggaaaccauggauccuagagcauucuuuugagaguaugucaguaaaugcaaagaaaaaaaagaaaaaggcaguuagaggaguuagcuagaucaaacaagcacauucaaguauauucucaaguacugggggagggucaggcuugacuucuugccccugugggcuuuuucagcccuuugcuuguuuccugugcccucggucuuaggauuccacagccugucugguuucacagagccuaacccugccuucugucauaugggguaucugaggggugugggggacugucuuugaccugugcccaggucacgaugguuauggaguauuucauagagaggagcucaaucuauaguuuuugaauuggguuaaaaugagaaaagaggauuuagcagauaaugauugaaacccuugaagaaaggaaagggcuagaaacagagucccuuaggauacagaaagcauaccauguaguuugguaggcuguuuggcacuuuuagaggaaaauaugauggaaaaauuugguucacaugcauuucacaaauauggcauauaacuuuaaugauuauuuucacagauguuuuguuucauucuuagaacauuuacacugguuacacaugcacuaaaggacuauauuguuuaguuuauccaugugcuaacagucagaaaacaggauaaaguuuauggcauaucuucauauaauuuguauguuguuugauaaauuuacauuuuuuguuacuauuaugcugucuucuauucucaauucauaaaaacagaucacuggggccaggugugguggcucauaccugcaaugccagcacuuugggaggccaaggcagguggaucaccggaggucaggaguucuagaccagccuggccaacauggugaaaccccaucucuacuaaaaauacaaaaaauuagccaggugugguggcgggcaccuguaauuccagcuacuugggaggcugaggcaggagaaucgcuugaacccugguaaggcagagguugcagugagccaagaucgcaccauugcacuccagccugggcaacaagagcaaaacucugucucaaaacaaaacaaacaaacaaacaaaaacaaacaaacaaacaaaaaaaccccagaucauugguuuacaauugguucucuggaauagacauaucaaagaaucaaacaccaugucucagaagaacuuuguaagccuaauaaagaacacuacagugcgaaaauggaauguuaaucugugugugcugggacaaguaaauuugagaaugaggacuucauacaacagacaaaaauguaaagggcaaauuguaugcaugauaaugaauaucagaaaaaaaauuuguaguggccuaagagucuaccgcuaauuuuccauguuuuuuuuuuuguuguuguuuguuuguuuuugcugugaaacuugguuaaauuguaauaugaagcucuuaggucacuuccuaacaaaucaaagugaucucugugguaaaccaauugaauuuuccuggaacaaaugcaacauaaugguuuccaauguauuauauugagugauauugucaaugaaguuggagaagagaacaaaacagaaaguuguucaaauuugcacuccugccagccaagugauuacaguucacaugguuacugaaacacuuuaaaaagauagcuacgaagucagugacaaguagaagagaaagcugaaugaaauauuggcaacauuccucuuuuggaagacacuauuagaucucaagcuucagugugcaucagaaucaaucaccugaacacugggucccgcaguuucugauucaguaggucuggguuggagcccacaaauguauacugaugaucaguuucuagauguugcugcugcugguucaagacaacacuuugaguuccuaucaaagacgcaugcuagcaaacauuuugcuugacaggugagcaugcuagcagauauuuucuuuggacaaagucauucuuguacaggauaugaaccaauugucuacuugugccaugcaugagugagugaaauaugcucaaugacuucucauuggaaaauccaugcuaaagagaggaagauuuuuuuucucacccaguuaauuacaucaccuaugauauaggcugggaagggaccuuggcauugguagugagggagcaccaaccacaagugagcagacaagggcuucacucugugacuaaauaugguugcguugaaaugucuguccauacuuuauucacagaggauaguugguggucauaauaagccuuuguucuugauucagaguugaggaaaauagagaaaaaugugaauaugaucuaaagcugggcaugguggcucaugccuguaaucccagcacuuugggagguugagguggguggaucaccugagcucaggaguucgagaccagccuggccaacauggugaaaccccgucucuacaaaaauauaaaaauuaccuggguaugauggugggugccuguaaucccagcuacuugggaggcugaggcaggagaauugcuugaacccaggaggcagagguugcagugagccaagaucacaccauugcacuccagccugagcaaaagagcgaggcucugccucuaaaaaaaaaaaaaaaaagaaugugaacuaagaaugacaacugaauguacauauuuuguguacugugcaaagaaaugggcagcaaauuuaagaugauguucucccugcugaaggcugcugguuauugcugaggaagaugcucaagaguucuggaaugaaagaggaauuaaaaauauuuauuuacaacauuaauaauaucaguauggaucauuucagggauuucaaguagcuuaauucaacagcaugcucacuguuuucucuaguuugaacuagaugaaaugcgguacaaauagcuugaucucuaauaguuuagucuuuuaaaacuugauuacaucuuuucuugauuugagaaauaacuuagcgauguagcauugggcauguuugaaaaguacacaaauaagucaaacauacaagacugauucacagagcuccauuuaacucagcagaggaucuggauuucauuugcugcaauaucccagguucaaacagucagcacaccagccauuuccuggaaauguuguucaauuagcauccaacagacugugaaaaguagugugaaacucacuucucacuuuagugagacguuuguucauaauuucuagaucuacaugugagccaaauaucuacagccauuugacagaaccaccaaacauacuugcuguuauuccuggcaaccucuaacugagauuuaggaucuuuuaguuuugugagaauaaauaauggaaaagaaaucaggaugcugaccuacgccacaagcaagaucuuggugaaaaacugcaaaugcuuaugccccucucauugauuugaaucuguuuacuuaaauuuuuuauuuuaaaauuugugauuaaucuauuuuuggaaaugcauuauaauuaauggucuccauguacuccaaauggccuuuaaguggccacuuacagacugguaauaacgaugagcagugcugaauuuuuucgucuuuggcaauacggcuccaugguggugcuacauuagcaccaccauguggagaaaaggaacaauagcacucuuucuaugguuaaaaugggaacaauacauccucuugaauuuuuuuuuuuuuuuuuuuuuuuuuuuuuuuugagauggaguguagcucugucacccagcuggagugcagugacacgaucuuggcucacuguaaccucugccucccagguucaagcgauucuccugccucacccucccgaguagcuggggcuacaggugugcaccacugugcccagcuaauuuuuauauauuuuuuuuaguaaagacgagguuucaccauguuggccagguugauccugaacuuuuggccucaagugaugcacaagucucggccucccaaagugcugggauuacaggugagccaccgccuccagccuggaacaucauuuucuuauggaaagaaagucuuaauucagggucuuuucuauggcucucaucuaguuugcuagaugagauuacagcccaauuacuggcacagagcugagaguggagugaacucuauucacuuauuccuguagaaaugaaaaucuuacugccucaaauugcucagaaaacucugagugauuagucuaaggauuuuuaaaguuguuaaccugacuccuggucccaugaccuagagguuuacaaauggcaagaaaguauacuuuuaauugaaagaaguuuguuacuugaauuuggaguuacaaaucuaaaguaugucuuguuaauauugugugucuuuuagcaugaguaacuugaaaaguuagagcucuuauaccuugaaauuauaccaauuaaauauuugcuuaaguuaauaaacauuggacaguagcucacagcucugcuagaagcaucauuuauacgucaguauuaaucaguagaguaagauccauugucuuccagcauuucaugaagauugcuuggaaagugaggaguuuaaugaggaguaagggaggcaaaugcuuuggaggcacaaagcacuuuggccaggacaggucugagugcagcaucucugguguagggaggcguggucccagguaccagaauuagagcaguauuguagauuuuauagaucagcuacauuguggauuaaaccaauguucauggguuaguuugcaaauuuauuuuuauuuuuuauucuuuuuuuuucacacaacacacagauugagaauuuaauguuuaccauguugcuagugacauugcuuuuuugggaugauguauucugaguuuuuguuuuucuuuucugagacagagucucccucuguugcucaggcuggagugcaguagcaccgccucggcucacugcaaccucugccuccuguguucaagagaucucccgucucagccucccuaguagcugggacuacaggcacgugccaccaugcccagcuaauuuuuguguuuuuaguagagacaggguuucaccauguuggccaggcugaucuugaacuccugaccucaacuccgacccugccuuggccucucaaagugcugggauuacaggugugagccacggugccuggcuguguucugaguuuuaaauaacaucauuacaaauaagcuuuuaucaccuaacccaauucuguguuggaaauaagaaacauuuauuguuuguacaugugucagguucugaucuaagugcuuuaaauauuaacucauuuaaucauuacaagaagauacugauguuauuugguauuacagaugaagcagcggaggcacagagguuaaacuuuugucagaaucacaguugguaagauguacuacuaggauuugaagccaggcagcaugacuccagagguuaugacuucuuuuuuuuuuuuuuuuuuuuuuugagacggcgucucccucuguugcccagccuugagugccguagcacgaucucggcucacugcaaccuccgccucccagguuaaagugauucuccugccucagccuccugaguagcugggauuauaggcgccugccaccacgccuggcuaauuuuuguauuuuuaguagagacgggguuucuggucuugaacuccugaccucaggugauccacccgucucagccucccaaagugcugggauuacaggcgugagcuaccgcgcccgaccugagguuaugacucuuuuuuuuuuuuuugagacggagucucgcucugucgcccaggcuggagugcaguggcgcgaucucggcucacugcaagcuccgcuucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccuccucggccucccaaagugcugggaugacaggcgugagccaccgcgcccggccgguuaugacucuuaaccauugauccauguuguugauaacuuccaugcacagguuuuauaguuuucaaaguacuuucacuauguuuucucauuuauuccucaaaaaugauggugaaguaauuuucaggagcuguggaggaaaauuaaggaaucaaaugaggcuggagacucuggaguuggaaagauauuuguaacugauuuugagagaauuuuuaaaaugaaguauacauuauugugauuuagcauuuuaaaaaagcuuacuguucaacuacuuuuuaagaaauuuccaauuuauucuguugcgggagaucugaguuuuucaacugcuuuuucauguaauguauuucugaaaggugauagaauggucaaacccucuccuuaaguauaagaaauguucuguggacauuaacugauuuuuaauggauauaauugagaaagaucauaaugaagaaaauguaacaauuuacauuuugaaaaaucucauucuaaaauucuauucuuguaacaauggcaucacaagcuauccccaggauuuuagcucaauaauauuauagauucuugauaaauaaacacauauugacuccagucacaaaggauugccucuucaaguuguuaaucaaauauuacaugugacuagugagggacagagaugcauuaucuucauuuugugugcaaggugauagauggaggaaaaaagauugacaguaacuaagaggcaagcaggagguuuaaaaacugcgaagaccaugucauuuuucccaacaaacuuuuuucugauuaagauauuuuagagucaggaaauaaaaggaugauagaauaugagcaugguggaguuaggggagcaacucugccuugcagaacucacagguggguggauaaacacucaaaugaggugauaguuucucaaccaguuuuuguuguuguuguuguuguuuugagacggagucucgcucugucgcccaggcuggagugcaguggcgugaucuuggcucacagcaagcuccaccuccuggguucaugccauccuccugccucagccucccgaguagcugggacuacaggcguccaccaccaugccuggcuaauuuuuuguauuuuuaguagagacgggguuucaccauguuagccaggauggucucgaucucccgacuucgugauccgcccgccuuggccucccaaagugcugggauuacaggcaucagccaucgcgcccggccucaaccaguuuuuaauagcugugcuaaaacagagaauugcagagauucaguugcaaggccuuaucaccuccuggaggaaguuaucaaauaauaagacagcauuacugaggaaucauacuggaaaaauagccuuaugucccuacacauauauccucuaaaucagugguccccaaccuuuuuggcacugggaacugguuucauggaagacaaucuuuccauggaccaguggaggugugggugguuuuggaaugauucaaacauauuacauuuauugugcacuuuauuucuauuaucauuacauugccauauauaaugaaauaauuauacggcucaccauaauguagaaucagugggagcccugagcuuguuuuccugcaacuggacagucccaucugggggugauaggagacagugacagaucaucaggcauuagauucucauaggagagugcaaccuagaucccucacaugggcaguucacaauauggcuugugcuccuaugagaaucuaaugaugcugcuaaucugacaggagacagagcucaggugguaaugugagugauggggagcagcuguaaauacagaugaaacuuggcuugcucgcuggcccccugcuuaccuccuguuguguggccugguugcuaacaggccauggauugguaccagucuguggccuggggauugggaacccuugaucuaaauaugcuucuuaguaacaucagaagugaaagaguucugaaaagaucuguaaaagcauuaacaaguuaaaaaagaaaacuuuaccaagcucucauauagaagcuguuacuagccaagaaagaauaaaagaguaagguaaauuguaaucagaguaacugauguaguuguuaacaugcuaugagaauacagaaaaacaaaaacauucuucaagaacaguaaucguggaggacuuuaaaguucuaauaaauuuaagaaauacuuuacugaauucaauugcaggacucccugagauaauaaaauaacuuugcuuuguuguuuugauaucuaagaacauuuugguuagauuccucacaagugguggcaaugaagucaacaguugaaggaaauacaauguuaucacgacuuucauggcuuuauugaaaagcaaggugaauuugucacuugauuaauccuguugcaaagaccaucucaaauguauaaaggaugacuucgacaagaagucugauuucucaagauuaugugaaaaacagcuauacaguuuugaagcaaugcuuugugaguuauuuaaaaauuacaccuguaccacaggucuuuggauaacaaaacaaauguauacuuaagauuugaugggcugggugcgguggcucaugccuguaaucccagcacuuugggaggccgaggcggguggaucacgaggucaggagaucgagaccauccugucuaacauggugaaacaccgucuguacuaaaaauacaaaaaauuaaacgggcgugguggcagccgccuguaaucccagcuacuugggaggcugaggcaggagaauggcgugagcccgggaggcggagcuugcagugagccaggauggcgccacugcacuccaggcugggcaacagagugagacugucucaaaaaaaaaaaaaaaaagauuuguugcucuugagcaacuugaugcuguaaaauucagaaugucuucaaguguaugguccagaaauauagucuggaguugguaaguggcaaagccuuugauaaacauggccagugaccucugaauacuccccaaagccagcguuuucuucuuguacagugcauaagauuuauuuauuuugaaaauccucauacuaguuuggaaccaguagaaccuaugguuaaacuggcugcauuggaauuagcuguggacccaaauccuaacucugcuacuuucuagcauugugaauugggcaaguuccuuucaucuuucucagccuuaguuuaaucauuugugaaaugggaauauuguguaccugaauacaguagugguuauauuuagugaaucauguauguaagacacauaguauuggguagcucaagaaauaauuuuaguuauuuuuuccuucaaucuuaaaugacucauauauaucagcuaguuucaauucaggcaaaccagaacacucugaagagcauauacaagaaaucccugaagcaaaaaagggggaaaagcuaaaaaaaaaaaaaaaaaaaagguuauaguccaggaaacucauuuaauaaaauagcauguugcaaaauuugaauuuacccaguuuuuuucuucuaguuaguaguuuuggaaaucaguauucuuugaacuaaacacugagaagacauuuccuauuuuguuuuacaagacauaguauaguauaugaggaccuguauaagaaaacaggaagagccuacuugcuucucugucauuuauuagcugaauaacauugaucagaccgcuuaacuuuucugggccuucuugccacaggccugcuuuaagaguuuuuuucuaaccuaaagauuacaccaaaaaacauuuagaacugaucaacgaauucaguaaaguuuuaggauacaaaaucaacauacaaaaaucauuagcauuuauauacaccaacagggaacaaucugaaaaagaaaucaagaaagcaaucucauuuacaauagcugcaaagaauauaaaauaccuagaaaucaauuuaaccaaagaagugaagcaucuauacaaggaaaacuauaaaacacaggugagagaaauugaagaggacaccaaaaauggaaaaauauuccauacuuuuggacuggaauaauuaauauuguuaaaaugauaacacuucccaaagcaauuuacugacucaaugcaaucccuaucaaaauaccaauaauauucuucacaaauaucgaaaaaaauccuaaaauuuauauggaaccacaaaagacccucaauaacugacaaaauccugaggaaaaaagcccaaagcuggagaccucacacugacuucaaaguuuacuacaaagcuauaggaaccaaaucagcaugguacuggcauaaaacagacacauaggccaauggaacagaacagagaacccagauauaaauccaugcauuuacagacaacucaucuuggacaaaaguaccaagaacagaggggaaaggacauucucuucaauaaaugaugcugggaaaacuacauagccacaugcagaacaauguaacuagaccccuaucucucaccauauauaaaaaucaacucaaaaugaauuaaaacuuaaauaucggacuugaaacuaugaaacuacuagaagaaaacauuugggaaacacuccaggucauucgucuggacaaaaacuuuuuguguaagaccacaaaacacaggcaaccaacacaagaauagaaauaugggauuuauaucaagcuaaaaagcuucuacacagcaaaggaaacaacaaaaugaagagauaacccauagaaugggauaaaauauuugcaaacuacccaucugaucagggauuaauaacgagaauauauaaggggcucaaauaacucaauagcaaaaacaaauaaucuguuuuaaaaauaggcaaaagaucugaauagacauuucucaaaagaucugcaaauggcaaacagguguaugaaaaaaugcucaauaucacuacucagagaaaggcaaaucaaaacugcaaugagauaacuucucauccaguuaacaugacuuuuauccaaaauauaggcaguaauucccccccccucaaaaaaaaaaaaaccacaccuaaauacaggcaauaguggaugcuggugaggaugcagagaaaggugaacccguacauuguuggugggaaaguaaauuagcauaagcacuguggagaaaaguauggauguucuuaaaaaaaaaaacuaaaaauagaacuaccauaugauccagcaacuccacuaauauauauguguguauauauacauacacauacauguguguauguauacacacauacauauguguguacguauauauguauguguauguauacauacacauacauauauacacuauauauacauauguguauguguguauauauacacacauauauguguauauauguauauguacacacacauauguguauauauguacauguacacacacauauauaugcguauauauguacauguacacacauauaugcguauauauguacauguacacacauacgcacauauaugcguauguguguacauguacauacauauauguguguauauacauacacacacauauguguauauauguauacacacacauauauguauauauguauauacacacauauauguguacacacauauauguauauauacacacauguguguauauauguauacauacacacauauguguguauauauguauauguacacacauacacauauauauguguauauauauguguauauauauuaguggaaguuuucuuaaaaguuuuauguaaguuuucuuaggagagagauauauauauaucccaaaagauauauagagauguauaucagauauaucaaaaggguauuugcucucuguacucccauguuuauugcagcacuauccacaagagauaagauaugcaaucaaucuacccaucaauggaugaauggauaaauaaaauaugguuuauauauacaauggaauguuauuccaccauaaaaagaaugaaaucccaucauuugcagcagcuuggauggaacuggagaucauuauguuaugugaaauagccaaacacagaaagacaaauguugcauguucuuacucauaugugggagcuacaaagguggaucucaugaagauagagaguagauuggagaauaccagaggccaggaaggguaggagggaguggaggaugaagagagauugauuaauagguacaaacauaugguuugauagaagaaauaagauguaguguuagaaggaucaguagggugacuauaguuuacaacaaucuauuguauaucuugaaauagcuaggagggaaaaauuccaaucguucuaguauaaagaaaagacaaauauuuaagauuauggcaaucccaaguauacuuaucuuuacacauuauaucaguguauuaaaugaucauauuuacucugaaacuauauuaugcauaaauaaaaaauaaaauuuucuuacagauacaauugaagucccuuuuaaaauuccuugcugauuccauucuccuuccuaccuccucagagggaaccacacuauaucuacuuccuauagcagauguuguugguugccuagacaauauucaugccuuuauuuauagaaucucaauuuucuuuagcuaucuacucugcuucuagaggacaugcuacuuaagagaggcaggugccagccaccagcccaggaagacugauugguuuaagccagugauggugguguaccauuccucuugccagaguuugguuuaggcauuggcaugugauacaguuuugaccaaugagacacgagggaaagucuuccagggacuugugggaaagauuuccucucuccugagggaggcacacagaggaagaguccuuucuuccuuggaacuucgguguguugagaugugaugccuggaauguuuuaacuucuggggucaugaagggagucagauuguggagaaagcugacauguggaggauggcagaacagaaggaugauaugaaucuaggcucuuuguuucuaccguuuggcaaccgaauuaacacuggaaacucucuaguucuguguucauuaugcauuacaauaaauuccuacuugugauucaugccaauuugagccacaauuuucgguuacuuuuagcuaaaagcagucaaaauuauauauuucuaguccaagaaguuguacuuuuacuacauagauguuuuuauaaugauguguaauuguugucuucacacaaaugaucuuguaucauacaaguugguuuuuuaauucaauguuuaauuuuugccauguugauacaguuuaagcauuguauaauucauuguauaaaaauaucacuauucaugcgcuuauugauggacguuuagguaaauuuuuucccuauuacaaauaguucugcaauaucuauuccauuagacgaugccacgugcacauaugugagagcuucucuagggcugcacuauccagugugauagccacuggucacauguagcuauuuaaguuaaaauuaaaaguucagguuuuuuggccaggugugguggcucaugccuguuaucccagcacuuugggaguggaggcagacagaucacuugaggucaggaguuugagaccagccuggccaacaugauaaaauuagcugggagugguggccuguuccuguagucccagcuacuugggaggcugagggacgagaaucgcuugaacuugggaggcagagguugcaaugagccaauaucacaccauuacacuccagccugggcaacaaagugagacuccaucucuaaaaaacaaaacaaaacaaaaacaaaaacaaaaaagucgcauuuuugguugcauuagccacauuuuaagugcucaauagcuacauguggcuaguaguuauuguacuggaugauauacauauggaaaguuccugucacugugggaaguucuauuggauagugcugcuccagcacaggguuucugaauauuuuucauaggauggcaccugcagaaaaugauaauauuuguacagcucacugggauaaauagauaaggcugcucaaguuuggaggagacugguucagggacucuggcugcccuaagaccuucucaguugcccuaaggacugagggauugcugaugucucauguaucccuguaacucacuuccugcccaucaacaugccuuggcucugcuuuagauguauacccaggagugcuguugcugggucauagugcaugcauguuucaauuuuaucagauauuaccgucuuauuuuccaaaguaguuauuaacaguuuauacuuacauaagcaguaagugcaaguuccucuuuucuucuccuuggcaauacuuaauauugggagauuucuauauuuuugccaaucugaugggugugaguuaauauaccauuauuuuaacuugcauuucccuuauuuugggugagguugaacauuuuuucacaaauguaauuucuuagaauuucccgugcauauccuuagucuguuuuguauuaucuuguuuauuacuuuaauucauuugaggaauuauuuuuucggaugcuaacccguuugcaaguuauaugaaaugccauguauuucggccugucgcucaucuuuuaacuuugcuuaugauauauguuguggcaccaaaguuuuaaacuuuaacauugucaagauuaucaaacuuauucucugugguuugagcuuuuauagcuauauuaagaaauccuuucuuauuccaaugucaaaaagauaagacuguuguauguucuucuaaaaguuuucaaguuuuacuuuucacuuagaggaauuuaaacggcuuucauaccaauaaucaaguuuuaaauucuuaaaacuaggcugggugcagcagcucacaccuguagucccagcacuuuggaggccaaggcggguggguagcuugagcucaggaguucgaaaccagccugggcaacaugguaaaacccugucucuacaaaaaaauacaauaauuagccaggugugguggugugcgccuguggucccagcuacuuggaaagcugagguaggaggaucgaugccugggaagucgccugggaacugagaucgugccacugcacuccagccugggugauagagacucugucucaaaacaaaaaacccuccaaaaacuuaaacgaaaaaagauuuaauucugucucugucuuccagaauccccuacuuauaucuuuuuauaaauuuuuuacaguaaaucaguauguauugccaaaauauauauaugguccuuuaaaaaaugaaaauugauuuuuuuugagacagucuaacucuauugcccaggcuggagugcgguggcacaauauuggcucacugcaaccucugccucccagguucaagugauucuugagccucagccuccccaguagcugggauuacagguguaugccaccauuccuggcuaauuuuuguauuuuuuguagagaugggguuuccgcauguuggccaggcuggucuuaaacuccugaccucaggugaucugcccaccugagccucccagagugcugggaggugugagccacugcgcccagccaaaaauugauauuuugaagagucuaaaauuuccaguuuugcauaucuacuggaaaugcagugugaguauuuuauugucuuuuuaacuuuuuaauguacucuggggugguaaaauguuugucaucuuguauauuuguauucuaucgauucucuaauuugaauuaucaagagcaaaggucacucuccuuucccuccacauguuguuaccucaguugucucugucuuccagaauccccuacuuugaaacuagugcugccaaugggacaaacauaagccaagcaauugagaugcuucuggaccugauaaugaagcgaauggaacgguguguggacaaguccuggauuccugaaggaguggugcgaucaaauggucaugccucuacggaucaguuaagugaagaaaaggagaaaggggcauguggcuguugagaagucaaguaagcgacauaguaguucagguggcccaugccugggaucuucucuaugauugauacauggcacagugagagauuaaugggcauuguguacaaauugcuucucaccauccccauuagaccuacgaauaaagcauccgguucuaaaauuaauuuguugcagcuuuguaaauauuucuuuaagauucagccugagaguuaggagaaauauuucagagccaaaagugccuuauacaaccuuagccuauuauaguaaaucauucaaggauucagaauuuugcagucacagaagaguguauuuauuauguagaaugaaugaggguacugucaccugccuuaauguagguaggcccagagucuuacauuuaagaucuuacaugcaguuauaaaaccgccacagucuucaauccagauuugaagacucaugccauaggugacauucuaaaauaccauuaaagccacuuaaauguuaaauaagaauauacaugcacaucagcucaaugucuuugaguauuaauuuuauguaagcauucuauuuaacaugaauauaggacaaaucauggcuauaucuauagaccuuggauaaacuggauugaccaauuauacacucacggugacuuuuuuauuggugggaaggggauugggguggggcaggcuggcuuaauguaauaugagcaaccaaagugggacuucugucuccccgcuauauucccauugcucugaaugguugauugaagggucagggaacuagauuuuauggcuuuaguucacugugauuguacauuuauacuuggccuaugugcuggccgcaccugaacauagcuggugcuuaugccgaguuauuugcgaugaguaaauauuuaguuucuuuuucuucauauuuauaauguugaucuggcauccucaggcugcagcuuuauuagcuuauaacuuacucaucucuaucuuuaccagcaggcucuguauuguugauauuugcaacuuguuuugcuuuuccauugguggaauugaaauaauuaguuuuuaauuacauaagaugccuguuugcuauuugguggaagauagauguucauauugaagcagucacauuuguacuguaguucaauaaaagaaaaaugaaguauucuguagccuauauuuuucauagagcucaugagcauuuacuguacuugcugggucuugccaagaucauuuauuccgcugcauugccaaagugucuucauaccaaauuaaaggugguuuuaauauauguuucauggaaguuguuuauaaaauucaaagguauuucauuuaggugaaaagucuuauuuauuaaagugguuugaauaaaguagaucaaaacuuccagagaucuuaauggcuauauaggaagaaauaucacucaccauaauuuaaauaaagaauaaaaauacuuguauuuugugguggcaaauguuugguagaacuguaauuagaaaaauacaaguauauuugcgugaugguuacacuagaagcccagacuuuacgacuacacaauauauucauguaucuaaacuguacuuguacccccuaaauuuauuuuuaaaaaaggaaaaauaaaaguaucaugaaaaaaccuauuuuuuuuuccacuguccuuccacuacucccauaacaaacuuauccaugguugguaaaauuuuacauauuucuauccuugaaaugaaggcuucuuuuaaauuccaaagaagucauggaggccugugcauuugaauuguauaugcuagugaggaaaagauuuagacauuucaagagcaggguuggccaggcgcgguggcucacaccuguaaucccagcacuuugggaggccgaggagggcggaucacgaggucaggagaucgagaccauccuggcuaacacagugaaaccccaucucuacuaaaaaaaaaaaaaaaaaaaaaaugggcugggcgugguggugggcaccuguagucccagcuacucaggaggcugaggcaggagaauggcgugaaccugggaggcggagcuugcagugagccgagauugcgccacugcacuccagccugggcgacagaggagacucugucucaaaaaaaaaaaaaaaaaaaaagagcagggucauaaucacacagcagugccuuauauaguugccauaagacuucagugcaguacaacauaauuuuacagcuacauaucagggcauauucuauaugguguauuuguguuagaauaacacauuaaaugucuuuaaacauaaaaauaagaauguuugcauguuucaguuuucaagaaccaaaugaguaauuagcuauagauuccacuggccuuaaacauacaauuaaguguauacaugauauagugcacacacaaaagccaccuuuaauuauugaaauaaccuguauucuuuuuggaaaucauuuaaguuugguauugaaguacuauauuuuuugugcaucaauguauuuuucuauuuacaagccuauguaaaagugaaguguaucuucagugaaccaugugccaauuaagcuguaauaaaaaaguggucuagucugucaaa

SEQ ID NO: 192077 - RNA, 3151 nt, Homo sapiens
cgggccaagaaaaccagcgaaggcccggccccccagcagaggccggaccaugguugaccaguugcgggagcgcaccaccauggccgacccgcugcgggagcgcaccgagcuguugcuggccgacuaccugggguacugcgcccgggaacccggcacccccgagccggcgccauccacgcccgaggccgccgugcugcgcuccgcggccgccagguuacggcagauucaccgguccuuuuucuccgccuaccucggcuaccccgggaaccgcuucgagcugguggcgcugauggcggauuccgugcucuccgacagccccggccccaccuggggcagaguggugacgcucgugaccuucgcagggacgcugcuggagagagggccgcuggugaccgcccgguggaagaaguggggcuuccagccgcggcuaaaggagcaggagggcgacgucgcccgggacugccagcgccugguggccuugcugagcucgcggcucauggggcagcaccgcgccuggcugcaggcucagggcggcugggugagcacgcggcggacaccgggacacggggcgggacgggcagccgggaagcgcccacgaggcuggcacggugaggaacccaccgcgccaggccccuggaacgagguuucgugaaagcagaaaggcucguuucagcgggccuggaacguucgcugugaagucugggguuucuccuccccuggcagaaaggccggcagaaaucggccuucuuagacggccgugaaccguuccgaagcagcugcgcaggcuuaggucugcucacuuggaccuugcccuggccuuagccgucggggacuuuuaggggggcacccacguuaggucugaacguuuugcuccuauagaaauccccaaccaaugaagucagcaauggcggggccccagccaggugggguguuuuucuccuucgccuauuaaaugcgccuuuggagagacucagacccauugaucacaacccccuacgccucucagccuggccagagagguuguggagugugguggucgcccagugguggcgcugacccaagguuccuuaauuucuaguccucugcacccaguccucggugagaacguucuaggccccuggcuuucagcugcaagccuucaucucuguggucaagguuagagggacaggcccuugcccugcagcugaugaucaaggaaagccaccuggugaugagcccacugcaugccucugggggcucugagcuagaccccauuucuuuccccaccaccuuauuggcguugauucaaugacugaaguggcccauguuaucggauaccuauagccaaacuauuaaaaccagcaaguuuuuugauccgaaauguagccuccugggggcaguuuccauuuagaccuuuuucuuuuuuucuuugaggcggagucucgcucuguggccaggcuggagugcggugguggaucccagcucacugcaaccucugccucccggguucaaggauucuccugucucagccuccggaguagcugggacuacaggcgcgccccaccaagccuggcuaacuguguguguguguguguguguguguguguguguguguguguguguuuucaguagagaugggcuuucaccauguuggccaagaucucgaucucuugaucucgugaucugucuaccucagccucccaaaguucugggauuacagacgugagccaccucaccuggcccccauuuagacuuucuauagugacaaguuggguucuaucugagaagggaaagggagugggagguguguuagcaggaacuccugccuuguucauaauguuaguguuggucuucaacccucugggccggugaacucccuucagcugcgugccuaagagccucaccugagcccugucucaauacggcaucuggccccuccgggcucucuguaccugaagaagagauuagaauuggaaaggggccguugaagccuuuuuuuguuguuuuuggcuaaucacuguugaugaaagaauaaucucuuaacaccaaggagcugaaauucuuggcugggugcaguggcucgcaccuguaaucccagcacuuugggaggccaaggcagguggaucaccugaggccaggaguucaagacuagccugaccaacauggugaaacccccucucuacuaaaaauacaaaauuagccaagcacgguggcaggugcauguaaucccagcuacuagggaggcugagccaggagaaucgcuugaacccaggagguggagauugcagugaguugagaucuugccauugcacuccagccugggcaccaagagcgaaacucugucucaaaaaaaaaagcugaaauucucaaauuggguaaacauaguucacccuugucucugcccauugcaguuaaaaugccacagccuggaguucaauucccuuccuaaaugggguuggugcuugcuguagugucaggugauaacuuuucaaucuagugacuugacaguuucccaaaaggcaucucuucuuugcucagaaaagagcauaauaagcuaccuuccucuugguuuugagucaagauaugaguguuccugcaccaagugacaaaguuaaaugcuugcuucuguucacucuguuagacuuaccaauccucacuccucaggggcuccucauuacuggauguguauuggucagaauuuccuuuccuuuuacuuuuuaaauccaaacuuuacuuugcuguuuaaucuggaaguuccugcguguuuugagugagguucucagcaucaugaggcaaucuaacuuuucucucuccccccuguaggauggcuuuugucacuucuucaggacccccuuuccacuggcuuuuuggagaaaacagcugguccaggcuuuucugucaugcuuguuaacaacagccuucauuuaucucuggacacgauuauuaugaguuuuaaaacuuuuaacccgcuucuaccugcccaacugugaccaacuaaaugacagaugugugagaacaagaacugagggaaagcaccuucccccaccccagacguuuuuaucugaaugcauacaaggaguccugagguggugauuuggccaguguuuuaacuugugacaaguacucaggugugaggacaagaaugcaaauggcucuuccuugagugaaagaa

SEQ ID NO: 192078 - RNA, 33737 nt, Homo sapiens
uugcuuuuaaauuguuuuauuacaauuaaaauuacacaaaagcaaaucgauucauuucaaucaaaauaacucauguuuacauauuuauaacuguacaauaaaauauauaaaauguuuucauauuucauacuucaaucaucaucuucuuccucuucaucgcugaucacauacuucuuaugcuuuuuauuugcuuuaucaucaucuucugcuuuucucuuuccggaagguucaccuuccuaaacagauacaauuuuuacaaaucuacaagucaauaaagaacauuuuuaggaugguuuaugaaaaguagcuaugagcugaaugacccucugacaacucaaaguaacgguuccugcagguugugagggagauugugaggugucagcaacugugaacuaaucucucacagggaaaccuuugaacacagaguaggaugugcaggaaacuggagacaggauuugccacagaaggggcggggcucucccgaggaaguucugccugucuaaccacugguccugucaggauauuuuuaccaugaucagguaauuucucaaauuuuuuuucucugccuccucagcauuucacuucuuuucauuaucuaaaauucaguauuuuaaagacuguugauuugguuuuuuuggaacaauuuguuucaaugcauuaaaaacaucauaaagguuuuuaagaaaauauuugaugacauuaaagggcaucuauaaacaaguuuccucuguuuaaaaucauucuguacaaacguucuaacagaaacaaauaauuuaggaaguuaccuaaaaaacauuuuuuacagauagauagaauuugaacaugucaguaucuaaauaucaaauacugauuaaaacaaacugacacuaaaugggaugggccgggcaugauggcucaugccuguaaucccagcacuuugggaggccaaaggggguggaucaccugaggucaggaguuugagaccagacuggccaacauggcaaaacuccaucucuacuaaaaauacaaaaauuagccaggugugguggcgcacgccuguaaucccagcuacucgagagacugaggcaggagaaucacuugaacccaggaggcgaagguugcaguaagcugagaucgcaccacuauacuccggccugggcaacagagcaagcaagacuccgucucaaaaauaaauaaauaaauaaaaauuaaaaauuaaaugggaugaacaaaugguuugaagguugaaguuagggaaagccagacaucuugcugcugugaccacaggcugcuagauggagaaugcaaccugguaugcccacuuuuuucugaugguucucauggcuggcccucugacagacaagauagcaucucacacuuguuuccugccuuauuaucccaaauacauucccacagaccugaaaggccauagaauucaaaggggggaaguuaugaauccacaguaagguauuuagagaaguccuccuccuccauuuacuucccagcugacagcagugaaauaccuaaacagcaauauugaaagauggacccugcccccaagaagggacaagagccccuccuuucuauucugcaggcuagagcaaacccaaauacucccagcgccacaggcaaagagcacauucaaucacacuacuugucuuuuaauuuccaaaggaaaaaucuuaaaacguuuuacaugcaaucacuauuuuuugguaaccuuccaaaagugagccuugguguguuugucuuuucagcucuaaaauccuuuaaugagaugaaauuugaaucacuaaaagaacuagcaugguaauucuaaaagaugguacagccuguccuaaaggccccuggacagcagcagccaggagauggccagggcucucccaaagaagucucacuggcaccaguccuaauccauccucuggaguaagaagcugugaaauucugcuuuagaaagccugccaaggaccggccgggcgcgauggcucacgccuguaaucccagcacuuugggaggccaaggcgggcagaucacgaggucaggaguuugaaaccagccugaccaagacagugaaaccccgucucuacuaaaaauacaaaaaauuagccaggcgugguggcgcaugccuguaaucccagcuacucaggaggcugaggcaggagaaucacuugaacccaggagguggagguugcagugggcagaaaucacaccacugcucuccagccugggcgacagagggagacuccguaucaaaaaaaaaaaaaaaaaaaaaaaagguugggcgugguggcucacgccuguaaucccagcacuuugggaggccgaggugggcagaucacgaggucaggaguucaagaccagcccagccaacauggugaaaccccaucucuacuaaaacuacaaaaaaauuagccaggcgugauggcgggcaccuguaaucccagcuacuugggaggcugaggcaagggaauugcuuaaacccgggagauggagguugcagugagcugagaccacaccaccacacuccagccugggcgacagagcgagacuccgucucaaaaaaaaaaaaaggccugccaaggacugacuucucuggcagcuacacauaagcacagaaaaacacagcaaagggaaugggugcaguggcucauaccuguaaacgcagggcuuugggaggccaaagugggaggaucacuugaggccaggaguuugagugagaccaaccugggcaacaugguaagacauuuugucuuuaccaaaaaaaaaaauuauaauugcuacaaaaaaaaauuuuuaauaaaauaaauaauaaggccguaugugguggcucgugccuauaauccuagcacuuugggaggcugaggcgggcagaucacuugaggucaggaguuagagaccugccuggccaacauggugaaacccugucucuacuaaaaauacaaaaauuagccaggcauggauuuggaggcugaggcaggagaaucacuugaacccaggaggcagaguuugcagugagcugagaucgcggcgcugcacuccagucugggcaacagagcaagacuccaucucaaacaaacaaacaaacaaauaaauaaauaaauaagcaagccagccagccagccaucacacagagcaaagguauauaguuccucagacucccaggacuuagaaaggugagagaauccuucaggaugacuucauuuuugugaaauuacacaugugggaugcugccuuacugaacauaacugcaacagaucccagugucauauauaaaugcaguaaaugacaaaaauauuuuuauuaagucuaaaagaaagcuugcuaauacagucaugaaugcaggucccuguagauacagaaaaagacaguccacaguuaugaagauaaggcaggguugucaaaggggaaauggagucucaagagggagagcuggagaaagagacacagaggggaggcugccugacaucacauucugaguaauccuucacagaacguaccuguuuugucuaagaaagcugaggguuggccuugauaccucuccuuuccacugucuccauguuucuuucagcuugggucuuucccuuuucccagacuccuggagaacagaguaccggcacacacuuucucccccuaccuauuuaucuagaucuuugagguaauuuagauuuuguaaaguuuuaacuacuuaaaaaaaugagggagaauaaaaagcucucuuuuacauuuuucuucuuuuugguaacuuagacucuguuggaaaaggggaaauaguauuucuuguucagcuacuacauauuguguuacuuucaaaucuguuguuuuuaauacuguaaugcaacauuuuuacaagacagcgaguauaaacuccauugaucagaugaggaaauagagauaugagaugacuggcccaaggccauacaagugggaaaggguagcaccaaaaucgaugcaguucacucuaauauagacuggcccuugcccccauuucaaggcaugcuaugaugauaaugguguucucuggacuggggaccuggggucugaaaacucccuuuaaucucagaggcauaccuaggcuccugguguuugagugggcuuuagugugcaaagcacagagagggacuuagaacaggaaugcucccauuccuuauuccauuguaacccauuaccaggacucaaacuaggguaccaugaagaggcaauggcagggguugagagguccagacggaaguaaaauuuuuguugucagggaaggaaagggaagagugcaggaagaccugaaagagaguauuuggguaagggagguagaggaugguuccuguaacagcuagguggccauucccaagaggcauuuuuaagucaggcaguguagguuugcaacugcccagccuagaagaaggcuaucugauggaucacuuaaaaaaaaaaaaaucacuucugagaauacuaggaauaaacaaacagaagucccaugacacuucucaauuuucauucacaguuucuacuugccaagaaaaaaauagcaucugcuuagaugaggacucacauuugccuguuguucagcacuguaaaugcaucauuaagauguugccucaucuaauuuaaaacaaauacguugcagaacaaugaaacaaauuuuggccaggugcgguggcucaugccuguaaucccagcacuuugagaggccgagguggguggaucaccugaugucaggaguuccagaccaaccugaccaacauggcaaaacccugucucuacuaaaaauacaaaaauuagcugggcgugguggcaggugccuauaaucccaacuacuaggaaggcugaggcaggagaauugcuugaacccaggagguggagguugcagugagccaagauggcaccacugcaauccagccugggcaacagaaugagacuuugucucaaaaaaaaaaaaaaaaccaaaaaaaaaacaacaaacaaauuuugucuagugccaggcacaguggcucacgccuguaaucccagcacuuugggugguugaggugagaggaucccuugagcucaggaguuugagaccagcuugggcaacaaagugagacccucuguguauaaaaaauagacugggcguggugguucacaccuguaaucccagcacuuugggagaccaaugcgggcagaucaugaggucagcaguucaagaccagccuggccaacauagugaaaccccaugucuacuaaaaauacaaaaaacuagccaggcgugguggcgggcaccuguaaucccagauacuugggaggcugaggcaggagaaucgcuugaauucgggaggcggaaguugcagugagccaagaucacgccacugcacuccagccugggcgacagugugaaaauccaucucaaaaauaaauaaauaaauaaaauaaaauaaauuuaaaaauaggcuaggcacaguggcucacaccuguaaucccagcacuuugggaggcugaggcaggugaaucacaaggucaggaguucgagaccagccuggccaacauggugaaaccccgucucuacuaaaaguacaaaaauuagccaggcaugguggcaugugccuguaaucccagcuacuugggaggcugaggcaggagaaucgcuuaaaccugggagauggagguggcagggagccgagaucgcaccaccgcaccccugccugggcaacagagugagacccugucucaaaaaaaaaaagaaagaaagaaaggcaugauaacaauguauuagcaagacagaauaucacuaaagugagagaagugauuaaaaaaaaaaaaaaaaagguaccaaaugggaauucuuacacugaaaggguaacugaaaugaaaugugaccagaacagcacaauaguagauuugaacuaggaucagcagacuugauggaucgacagagauuaugcaaucugaagaacggagaaaacagaaugaagaaaaaugaauagucccagagaaaugugagacaccacuaaacacaccaacauacaccuaaugggaauggcaggagaggacagaaaacagcagaaaaaauauuaaaugaaacagugacugaaaacuucccagauuuguugaaaaacauuacccuacacauccaagaaacucaacaaauugcaaguagaauaaaugcaaagagaaccacgugcagauacaucacaguaaaaaugcugaaagacagaaaacuuccugaaagcagcuagagaaaaaugacuugucacaugcaagggaaucucaagacgauaaagagcuggcuucucaucagaacaauggagggcagaaggcagaggauggcauauucaaagugccaaaagaaaucaccauuagaaagcucauuuuucaauaauaauaauggaagccaaaaaucuccugaaagaaaauugcccuaaaauugcacaaccacugaaaauguuucaagaggguaaaauauauuucagauaaagauaccaaagaagaaaauaggaauuucagcuacauagcuuuacaaagguaccaguuaggguaaaggauagaaauaagaauuuuuaaaaaauuauuuauaauuuuuaauugcuaauaaucaugcugucugguacauuacugauuuacuccugaaugaaacuuaagggaaguccuuaucuuagagaguuuaggccuacuugucagagaacaaacugaaauggucaacagucuguuuccaugugccuuuuaacaauuccaauuucaucacauuuugaaauaguaaugauaucuucauaauauaaauauauacuuuucauauauacuauguguaauaaaacuuuauauuaauuuauacacaugauaugauauaaaauuuuaacuuuacagcaacgcugagagaaaaaugagguucagaaaagccagacauuuaagauaaaagauuucagugguagaagcaggauuccaaccuagguagucuuuuaagacuccaaagccucuacucucucagcucugcuaugcuaccuugaucuauagauaccugggaaacagguaaggccauuauuucacaggcacaaucaacauacucucaacaaagcagucagugauccuacuaagaguuaaaucauaucuucucuccucugcugaaaacuuccaaugaaaaccacucagaauaaaaaaccaaaauaaaacaguccaucgcaguggcuuaugccuguaaucccagcacuuugggaaguugaggcaggcacacugcuugagcccaugaauucgggaccagccugggcaacaugcugaaaccccaucucuacaaaaaauacaaaaaaaaaaaaaaaaagccuuacaaauggugugaggcccuaggugaccuggcccuaucauauuucugcccucuuccucucacucacaaggcuccagcuucagccucugugcuuucuucacacaugccaggcagguucccaccucagggccuaugcacuuccuaauucugcaugcaacacucuccagagagcugaagaguucacugucacuaccuucagacguuuacucaaagaucaccauuccagugagagcuucccugaacagcauuucuaaaaguauaacaucccaacucccaagaccccccagagcauucucuauaucguuuuccugcauaauuugucuccuuaucacuuuucaccaucuguuauaccauauauaguauuuuacuuuauauaguauuucacugguauaaugaaaacuuuaaauuucucaguaucuccacaucacccagugggguguuaaauacucacuggaguguuaagaaaaagaggccaggcgcacuggcucacgccuguaaucccaacacuucgggaggcugaggcaggcagaucacaaggucaggagauugagaccauccuagcuaacacagugaaaccccaucccuacuaaaaauacgaaaaauuagccaggcaugguagcaggcgccuguagucccagcuacucgggaggcugaggcaggaaaauggcaugaacccaggaggcagagcuugcagugaaccgagaucacgccacugcacuccagccugggcaacagagcgagacucugucuuaaaaaaaaagaaaaagaaaaauucucagggccuauucucuuauaauaugaaaaagaugcuguuuaaaaauaagauaaaauauuuuuaaauuaucuugaaauaauuuaugucaauaauaaaugaaaauuuauuucaauuuauuaaauuacucaauacaauuucaaauacuuuuugagauggaguuuuacuccuguugcccaggcuggagcacaauggcgcgaucucggcucacugcaacuuccaccucccagguucaggcaauucuccugccucagucuccugaggcugagaguagcuaggauuacaggcaugcgccaccacgcccugcuaauuuguauuuuuaguagauacgagguuucuccauguuggucaggcuagucucgaacucccaaccucaggugauccgcuugccucggccucccaaagugcugggauuaacagccaugagccaccaugcccggccaaauacuguuucaucuaaauaaaaagaaaauagguuuucccaacauaagaaugaaaucauuuucuuuuuuuuuuuuugagacagggucucacucuuuugccuaagcuggagugcaguggugcaaucaugucucacugcagccucaagcaauccucccaccucaagacucugguagcugagacuacaggcacacaccacuacauccagcuaauuuuuguauuuuuuuggagagauggggucucccuauauugcccagucuagucucaaacuccugagcucaagcaaucugucugccuagcccucccagaauacugggauuacaggcaugagccacugcauccaaccaagaaugaauuauuuuccuaauuuaaaaaaaaaauacugagaaguuuuacaaaaaggagauacacccucuggucuaccacacugaaugaucugucauucucucuuggauuagccuugguaugucagggaccugcaccuuuucuuccaggccuuuccaucuauccggagugaccuaccagagacaggacaguuugaccagcaagcuucugaucacucuucaacacccagcaagaagucuuauccuccaugcagccuucuaagaccucucuaagcacagguaucagauccuccucuggaucacucugucuuguuacugcauuuaucucacuggauuucagugacguguguagacaacuaauuugugccugccugaucugugagcucuucauucaaagcaguuggcuccugaguacaggauaaaccccuagaauugaauaaauuuggucuuaccucaucacugguaaguuucuuugcuuugaguaaucuuugagcuuuaucuucuucugaucccucaucacugucugaugaauagauucuggcucguuccucugaaagcaaaaguacagauugugagucaccuuuuuuuuuuucugagacagggucuugcuuugaggcccaggcuggagugcaguggcacaaucauggcucacugcagccuugaccuccugggcuuaggugauccuccugccucagccucccaaguaggugggaccacaggugugcacuaccuacccaugcccagcugauuuuuuuuuucuuuuuaguggagaugaagucuugccauguugcccaggcuggucuugaacuuccuaaaaucaagcgauccuccuucuucagcccccuaaagugcugggauuauaggcgugagccacuguguccaacugugaguaacuuucaaagacagugaccuauucauucuuaaauguuuucuucugauaaauaucuuuaguucccucuguauauuuccucccaggggaaccaaauaauuuuaaaguuuuugauuuaaagauaaguauaaauuuuagauaugcggaaaugaagcagacuuacccucucaaaauacaaaaaccugaccacuuuuaaagaugaaaaagguuugugugcaaggugucuaaagaggcaagauacccuacucuuacgaagucaacuauuaaagccugagacauucuuccaccaguaacaguuaauuccaaaaugaguuugaagguaaagcaagaaagugguuuccugguccuguaaagaccguuuguugccaggcagaccuuucaaagagagauguagaggggcgcccaucugcuccacugcccaagcccaggugaaccucuggguggaauaagagccgaggacuuuagaccaagccccucccgucaaaacccaaagccuucccuuuguccccacaccuugccuaucugauuacuguauggaacugagcacuacuagacucaugugcuagauuuuuaaucucuggugaccugaauguuacacaccucucucucuuaaagcauccuuggauuuuuaaaauuuuuauuuaauuuuugugugguuuauuuccacacaauugaaucuuuuucuaugggaaaucagcauugacaaaaaagaaagggucucuguacugugguccccaaauaaauaauagguagguaauauguaacaggucaccagaccaaaugcagucacuauaagaaaaggagaaaugaguuucaugggacagucagagaaaaauaaauuuggguguuuuaaaaauuuacuuguuauaugccaggcucugggcuaaguacuuuaaauguauuauauuauguaaucuucaaaacaaccuuauguucuaacuaccauuauuaauagguuguuuuugucacaaugagguaacagaaguuaagggaaacuauguaacucuucaaaaguuauacaacuaaaaaguggcaggacucagaugagagcgggcagggucagaaggccagccaggucuucuuaguucgcuuuucaccaugucgucuugcuacuggcuugggggaaccccuggguaagaaccagguggaugcagagucacggcugggacagaugucucggaagucagaugacuuugguuuaagaacugaccaguuagcaacuacgugccuuugggcaaauuagucaaccucucaaagucucaguuuccucaauaaaaacaaggaaauaagagcaacuagaucauaauguuguuaugaggaucaaacaggaugcaugucaaguguugagcauuugccugaaauucaguauguguggaaaaaacguuaaccaucagaaaucagugauacuugugaaaggaggaaauaugcaaaaguaaaucuaagagaaauguagaagaagaaugaaagaaaauaucacauaauuucugaauaguuuaauuucuugauucccaauuagguaauaaaaaagguugacaaaaguuccaguauaacuggcaaauucucaagucagaaagcaaaagcucaagggauaaaacccaaaguaggaacaacagcaguuccuaccuuucaagcucaccugaaugaacuaggucacucaugacaacucguucuuuaaaaauaaaauguccgggcuaggcacaguggcucaugccuguaaucccaguacuuugggaggccaaggcgggcagaucacuugaggucaggaguuugagaccagccuggccaacauggugaaaccccgucucuacuaaaaauacaaaaauuagccaggugugguggcgcacaccuguaaucccagcuacucgggaggcugaggcaggagaaucacuugaacccaggaggcagagguugcagugagccgagaucacaccacugcacuccagccugggugacagagcgagacuccgucucaaaaaaaaaaaaaaaaaguccagugacuuggcagccggauuacaucuaaugccaagaugaaguccagaaucccgaaaugaugaaauguaauuuccauacacgacucaccucgaaugcccccuuuauaucgguuuuuaauggcagccaagcugauggacuccucgccuuccuccuccucaucguaucgaucagguuccagguaacuggcgcucagcccccgcuggugcuguuucucucucauucggcgcugcugagauucccuacguauggaagcccucaaacguucuucuucuuucuguaaagaagcaaauaaccucuuuaaccuaaaaaggagcuacuuuugugcccacuugaacccacuuuuauuacaaauagcauguaaugucugguccagauaacagcugugccguguguguuccccaucccaccucuguggcuccacagggacccucugguuugguuugcaggagcaaaggcaacacaaggguaaagcggcagaagggagcccugacacuaaccggcccaacuggcauuggcacagguguguccucgggagcugugcugguguucugugcugccacuuaacccagagagaagcaacccgccugagaaaccccauucaugcccagcagaaaccuaaauugacucccuggagcagcaguggcuguuccuguucaucccugaaccacagacaacugaucugccccagcucuaccaaacucccauaguucccagauauucuggucccagccccucagccccucaacccagagagcuccucacggcuccugaugacagguuggggagcguccuagagccacaagguagaccuuucauuuccuuugcacugccuggcauucugcaccuugauguuaaaccagguuggggguaggggugguguuggaguagguuucagggauauucugggauuucuuugaaggucuuccucaucccguugcucuguauuaucauauacaacuccaauuauauugcuagaaauucuauggaacagauuguuuuaauaguauguggcuguacggagguuagaguaaaaaucacugucaguaguacagggacuaagaacaaaccagcugacuccuagucuacauuuucacaggagcuggggacauggaggaggguguggggagaugcucaaagugguucaagagcuucuccaauaaugcugagacuggaaucugcagguuccuccaguucccuuagucuguacagaaaagguggggaaauggaacaagcccagcuccaaagcaaaugccgcuauauaccacuagguuagguacugcuauuagaucugguuuaaucugucuccaugaacaaauacaggauggaggaaaaagcaagggcucagagccaaaccuucagcagagccugaccauaagauuuguaagaaaggcccugagguaacuggacugucuuagccucaccaugcccugcuucacuaaacaacguaaucacaagaggcagggugggcaaaggccaaaaucuaguagggauuagagaagauggagaggagaaaugaugagccuguacuacugcauauggcuucucaaaucaagugcugcaggaaaggccaauagccaauaugagcacaugcucuaucgauuagguacaaugccccaaauaaacuugugccuaauuaacagcugggucaaauuugaaaauauaccagguagaauguuacaaauugaccuuaaaaacucauaagcucgucuuauucuuuaccagagucuacuuuaggcacucucucauucaaacuccuggucuauucucuauuuuacacuacucucuaguaucuccacugacuucugacauggauucuaaaccacacauagaugacuuaaugaucuuugaacuuauacaugaaaauucagauauuucaaucaccgguuuguugcugaacucucagggccuggugaagagagaaccugagcccuguuucuguuuuacuaucauugccacgucaccaauuguuuggcaaaugcugaggaaaugaauccagcucccuauucaugucaguuggaagaggaaaagguaggccaauaagagaugacgaacaagcauuuugggaaauacuugccuaauauaccaaagaaucccaggauaacgcuuaggcuuagcaaacauaccuuaaucauuucugugcguuggcauucaggaucacgaccagccauuggcaagauucuaaucuucugugucuuugaacaccuaucugcaagugacagagucaucuuucuauguguggcacuguccguagagugaggucugccaggaaauaaacgaagagcauaucacuguuuaccaaauacauuugugagccagugauacccacgucacagaaguaagagcccagugaccauuuccuagucaccugaaaaaauaggcagagacacucgacugaauauaccaagguggaagauugugaguuuucuucauucuguggcucacugagacauucuuauuccacaaaugaaaaacagaagguuggaguaaaaaagauuguauggcaugaucaccuucuagaagcaauaaauggauacgcucaagcaacauuaauuagauacuacagguuggugcaaaaguaauugcgguuuuugccauuacuuuuaauuaauauuaauauauuaauauuaauauaauuauccuauuuuauagauuuaggaaacugaggcaaaaagagguuaagaaaguggcacaaggucacacaaguagaaauggaauucaaauaugagucuaacugauuccaaagccuguauguuaaccuuuauaauuucaaaaagcuaaaucauaaccaacauuauugugcccccucuaaagauaagcauuacccaaagaggauggucugcuuauaaucaagaaagagaagcaugaacaucucagugcagcacauacucagucuagagaaggaaagugcccucaccagcugaguauuccuguccucuugggggacacaccucugcagugguauuagaugccggggccuacggcacugagauggcccgucucacacugaccaacuugcuggcuuuccuucgauugcaugcacaacaacaaccucuaguuauuagucucccaggucaauuuuacuaaaaacaaaggacacacuggcuagcagacacacguauuuuaggccucuuggcaguuauaauaaccacuggaauuaaauacauugacauucugguuuaccuaacagucucuuguaagucugguuagcaugaccugguucccuaagaaacagcaacuuuuaguguauuugacaaaauaaccuuugaaccuucagaacuaugcacaagaucuugguucuugcugaaucauaccgugggguuacaucaaucagguggcaggcauuacagaaacaucuauguuucacugcuuuuaccauaagaaauaauacauaauaauaauaacaguuaccugaaggugaguuucguuuuaaagacugcuugucccuguagaccaguaccuugucuuauaaaaagaugauuguggucgcccugcaguggggcuuuguacacaucaaacacuucauugccuaaaugcagggacaugcuggaaagagaaacauuucaucuauuaaagucauaaagcuuucacucuaccaucuuacuucacuuaaaggugauucaggcugggcacaguggcccacauguguaaucccagcacuuugggacaccaaggcagguggaucacgaggucaggaguuugagacaaggcuggucaacauggugaaaccccaucucugguaaaaauacaaaaaucagcuaggcauggaggcacaccccuguagucccagccuucgggaggcugagacaggauaacugcuugaacccgggaaguggagguugcagugagccaagaucgugccacugcacuccagccugggcgacaggacaagacuccaucucaaggaaaaaaaaaaacaaaacaaaacaggugauucaacugcugcucucucuuuuuacacagaauuuggaaggaacgaaaauaagaagucauaaugagaaaaacugauggacuacaaagaacuaacacaugcugggauguuuaccaggcucuacuacauucccagugaagggcaauuuuuuuaaaaugucaauuuguggcugggcacggugguugacgccuguaaucccagcacuugggagaugggaggaucgcuugagcccaggaguucaagaccagccuaagcaacauauggagaacugugucuaugaaauuuuuucuuuuuuuuuuuuuugagacggcaucuaguucuguugcccaggcuggagugcaguggcgcgaucucggcuuacugcaaccuccgccuccuggguucaaggaauucucugccucagccuccugaguagcugggauuacaggcguccgccaucacacccagcuaauuuuuaguaaagaugggguuucaccaucuuggccaggcuggucuugaacuccugaccucgugauccacccaccucggccucccaaagugcugggauuacaggcgugagccaccgugccuggcucuuuuuuuuuuuuaauaauccaugcaggguggugcacaccaaguagucccagcuacuugggagaugggaggaucacuuaggacuaggagucugaggcuccacugagcuguuaucaugucauuacacuccaacaugggcaacagagugagaccccauuucuaaaacuaauaauaaauuuaaaacuaaaaaguauuucaaaacuugaucccucugacccguucuggguaugucaauacccuucaggcguuuugugcucaccuuccaucugaccacuugacuauccgagcauugcuuucuuuaauuucauuuccuucuucaucucggcguauccuccaucuuauaguauuuucuaccuguuucacaacacaaguacuuuagaaaauuauaguuuaaaugacucuaugcaucuuguuuuuccucaagaggcacauaaucacagaauaagcauacagaggugacagauguauguguggcaggagaaugaacaacacugaaacccucuuuaaucaccuagagagguuggauaaauuaaaagcagggaaaaaaauaugcuuaagugaauuucugagcuccuagaaucauaaucauagagaaagcuuagagcauuugagcagauggcagauacuaaauguacacuaaccccgagauguguuaagacaguaagaauuacaagggucaggcgauaaaacuugaguccaugugaggcagaaauuuuuuuuuuuuuuuuuuuuugagacggagucuugcucugucguccaggcuggagugcaguggcgcagucuuggcucacugcaagcuccgccucccggguucacgccauucuccugccuccgccuucucaguagcugggauuacaggcgcccaccuccaagcccggcuaauuuuuucauauuuuuuaguagagacaggguuucaccguguuagccaggauggucucgaucuccugaccucauaauccgcccgccugggccucccaaagugcugggauuacaggcgugagccaccacgcccggccgaggaagaaauuuugaagugaaaccccuguauaaagcaaguucucucacagagcuaaaaacuccauaaaaaugagaccaaaaacucugccuauuggcacagagagauaaacuucccauauaugaauaaggauaaauaagugcccuaugaaaaugaaaaccccagauuucaauagguuuagagccuaacuaucuuaccugcaugguggggaaacaccagaguuggcaaaugaaaaccacuguuacugaaaguaaagucagugggaucuccaggaaaacauggcauacuaaacgcaugcaguuuaucacugcugccuccuggaaacccacuaaaaugacaaugaagaguaaaaacaggacauacaaggauagaaagaaugagaaugaagcuggcaacagacagaagccaacaaugugaaaacugccaaugccaagaccaugcuucccucugccuguucccccagugucaauccuaaacacagcugcucccagucccacggagaucgucuggaucuccacuccuuuagcugcaaaugucugugcagcuggguccuaaugauucccccuuccaguuuuuccccuuucccuauuuauuccucacaaauagcuauaaagugugcugauugaauaacuccaucauauuuaugaauuaaacaugaugucauaccugaaauuuguuucagaauagucuggggaagcugggguggggaauauguagaugacaaaagauuguuaacucgacaacuguugaagugggucaugggcacaugaaagaguucauuauauuguuuuuaauacauugguguauguuugaaauuuucagauugaaaacaaaacaaucugucacuauuccugucuuccaucucauacaauagguuggccacauauaaauacacaaauaugccgggugcagggcucacaccuguaaucccagcacuuugggaggccgaggcaggcagaucaccugaggucaggaguucaagaccuaccuggccaacacagugaaaccccaucucugcuaaaaauauacaaaaauuacccgggcaugguggcaugugccuguaauuccagcuacucgggaggcugaggcuggagaauugcuugaacccgggaggcggggguugcagugagcugagauugcgccacugcauuccagccugggcgacgacagagcaagacuccaucucaaaaaaaaaaaaaaaaaaaccacaaauaggccauuauuaauugagaagccguucuaaaaaaugcuuucuauuauauaaagugauucaaauaguaaugaugcuauaauaggacacauugcuaggucuuaaccuaucaggaugaaggacacauaauaguauuucugaagacaggggaccucagagagguacauaagcuguaccugguucccugguuccuuguucuuaaagaauuaacuacaccaugcuuuaagacuggucagcguagucuuaaacaucacucaagaaaauaaggguccaggguuauuuccuaucacacaccaagguuuuaagacaacaguuuauguuaaacaccaacauuuuguagucugaugcacugaaauuuuaggguaaaauacauauuuauaaauuuuuuuuugggggggagacagggucucgcugugcugcacaggcuggagugcaauggcacaaucacagcucacugcagccucaaacuccugggcucaagcaauccucccgccucagccuccuggaguagcugugacuaugggcaugcgccaucucugcuggcuaauuuuuuuuuauuuuuaguagagacaaggucuugcucuguugcucaggcuggucugaaacuccuggccagucuucucaccucggccucccaagguacuggaauuacagauaugcggcaccaugcccggccuuugaagucugacacccauacuagaaucugguaucacauggucuaaaaauauaauagauauauugauacuagcuguagcaucaugacagaaaguaagaaaaaggaaaaagacaaaauuaaauaaauugauaaaaagugaauaaggaacuacuauauuaguuuauauguauaugacaggaaacaaugaaaaguaguagaauuaaagccagaggcacuaaaacaaccaugaaaaauugauacugcuaagccuaaaucaauacauccaugugucccaaagaaauaauauuaacagaugggcuaauaaacagaugaguagaugggugguggagggaggacaggaaaaaaaaauaguguaagcaguauaucuguugacugugugaucuugaacaaauuauuagcaccuguuuaucucaguuuucuuauuugauuugcauuuccauuaagaggaguagugaagucucacugaaaagcuuuuggauagaaaccaucuuauaucaagguuauuuagguaguuguuaauauaccacauugaagagaugguacuauuaaaaauauaaaaauucagugccuaaaaaaugccagacuaucccuuucuaacaauuuaauaagguaccaaggccaggcgcgguggcucacaccuguaaucccagcucuuugggaggccgagguggguggaucaccugaggucaggaguucgagaccaaccuggccaacaucgugaaacccugucucuacuaaaaauacaaaaauuagcugggcaugguggugcaugccuguagucucagcuacuugggaggcugaggcaggagaaucacuugaacccaggaggcagagguugcagugagcugagaucaugccacugcccuccagcgugggcgacacagcgaugcuccuucucaaaaaaaaauauauaaauacccacuagaaaauaagaaauuuacaggaaauccuucggauuuaagaauugaaaaugcauaauuccaguuucaguaucaugcauucaaccaccucuuguucccuugugcaacucaauucuaaaaugucuacuuggccaagugcaguagcaaucaugccuguaaucccagcaauuugggaggucaaggcgggaggaucacuugagcucagaaguucaagaucaaccugggcaacacagcaagaccucauaucuacagaaaaaaaaaaaaggcugggcaugguggcauguuuucuguagucccagcuacucaggaggcugagaugggaagaucacuugaacccaggaaauugaggcugccaagagcuggguuugugccgcuguacuccauccugaacaacagagcaagaccgugucucaaaauaaaaagaugaaacuucugcugaaccuacauccuccuuacuuaaaagauuagaggcccuccuuugauagcgugaccagaugguauaagguaucaaagagaagcauuaaugggaauuuaguacaauaaaauucuuuccuaauagucaacaaaagcaaucaaaagaacacagccauauagugaaguguuagguaaaaaaaucacuuucaaaagcucaaguuucaaguuaguaucuccagguuuuacuuuauaaaagaaaaaaaaggaaaaagcaugaaaugguaccuuuaauuuuaaccugguucuaccuucuucauccagcauuucuucaucuucaaauucaucuucauaauacugaggaucaaaaggucuacaaauuguuuuccaaauaaacuauuaaucauauuuuauaaagaauauuacugcuauguaauaacaucucuauuaauaaacaccauuauaucaaaaaaucauaauauaauuuuaaaaaucauaaugaucaauaucuucaugcuuaacuucaaggaaguaguaauuguacuuuuuucuuuuuuuuuuuuuuugagaccgagcuuugcucuuguugcccaggcuggagugcaauggcacgaucucggcucaccacaaccuccgccucccagguucaagcgauucuccugccucagccucccgaguagcugggauuacaggaaugcgccaccaugccuggcuaauuuuguauuuuuaguagagacaggguguuucuccauguuggucaggcuggucucagacuccugaccucaggugauccgcccuccucggccucccaaagugcugggauuauaggugugaaccaccacacccggccaguaauuuuacuucuuaaaauuuguuguuaauacauauugcuugaaauaaaguacaagcaaggguaaauauucaaaauauccuuucuucuucuuauguaacucugccaaagaauaggcaacauaugcucuagcuuuccacaucauugugccuguggaaaaaaaauuuuaaaagcacaagagcucgaguaaacuuaguaaauaauacccaucaaacacugucuaauuguccaaaaccauuaccuuuucuagaccaacaauagcugcuacaguggacacuggcauuucucuagcaaauuucaucgcuuucaauuucagccuuuucaggguuguacuaauuaaaaaaauaccuugaacacuuguggugucuguuaauucauaagaaaguaucaaacugcuaaaaacaaucauagcauuaaaagccucccuuacuaauacauauuuuuucuaucucaggaugugcuugacuaauuuuuucagagauacacgaucaauuuuccguuuuugugauuugucaacucaaugcgaaauaagaaaaauaaacauucuauguauuucuacucaacauccugaaaaaauuuuaauugauuuccuuaccugggcucuacacugagaaaguugggcaguuuaacaaaauauaagucguuuccuaaaucaguguuuacuuuggguauuucuacuucuauucuggucucaggaauuggcuccucuuccuguugauccugaggcaauccauuuucauccuagugaaagaaucggaaguuuggagcuugacaggaccuuagaaauggcuuccuucaaccuccacacuuuaauuacucuggggugcaagaaacauaauuagauaucacuuuaggacuaaagaaguccccaguccccaucccaacccaccuacacacaaaaugggaaacgaucaauuuggauaccucaguacaaaaaacuaucuccuuuaugauaaaucugucuuccaaauacucaacaaaagugugaaauuaacacuucaauaggaagucacucuaucaauuaaaaccagagaagauuaucaacauagcagacacuucuuggcaugagcaagaaaaacauucaagucaaugguucucaaaucacaaguccucacaguucaguccccuaaggcaugacaccaaccucauguuuggcaguuauuuccacucccccuuauaaccaagaguucccuacauaaugaagaaagucaucuguucaugguauuuucauacuagaauucaguuaucaacuuccuuuccuggaauaagggagacucuucaccuuugaaacuuuaugccuggccuugaauaaguucauguuacuaacugacuuacaacaggcuguccuggaguaggugguuugucuucuccaucacucccugaagagauaucaucugcaccuccaaauaaauccaugguuccacuauuaucuucaaugcagaaggaaaaaggcauuaguguuacuaucuguaacuaagguucuucacagcugaucacuucaacacauucccaagguuucuggaccagcaucagaaaaccaccaaaaacauaaugcugagccuggcucucaaagacccaaccagagaguguggggagagggaagggggcaaaucuagugaaaggcaagcugcacaggaggcacuuauuucuccuuucauuuucaccauccuuguucucccacuuuccuuuauuccccaggagcccaaauguuuccuacagucuagaugcucaaaguuggggcugaagcacuccacagacacccauuuuccauaagucuaucccagauucaaaauuacaguccaggcauagugguucaugccuguaaucccagcacuuugggaggccaaggcagguggaucacuuaaggucaggaguuugacaccagccugaccaacauggugaaaccccgucucuacuaaaaauacaaaaacuagcugggcuuggugacaggugccuguaaucccagcuacuugggaggcugaggcaggagaaaggaagcugccacaccuggcgguagaacuccuuucauccuuccaacuuauaauaccaggugguggugguggugguggugguggugguggugguugcgguuguuguuguuguuuugagacagagucucacuguuguugcucaggcuggacugcaguggugcgaccuuggcuuacugcaaccucugccucccgagcacaagcgauucucgugccucagccucccaaguagcugggacuacagaugcacaccaccucgccccgcuaauguuuuguauuuuuaguacagacagggcuucaccauguuggccaagcuggucuugaacuccuggccucaagugauccacccaccuuggccucccaaagugcugggauuacaggcgugagccacugcacccagccaacacuggguuuuuaugagcucuucaucuaacucacagcucaaagaaucaguuucuucaucuaagucaagaacuuaggaacaaaacaccgagacugucauuauucaaagugaagaauggacauuguaaccuccaucccaauaagaaggucagcccccuaauaaugaauucacucuaacuauaaacagacugggcgcagugauucacgccuguaaucccagcacuucgggaggcugagguggguggaacacuugagaucaggaguucgagaccaaccuggccaacauagugaaaccccaccucuacuaaaaauacaaaaaauuuagccaggcauggugguacguuccuguaauuccagcuaccaggaggcugagggaggagaauugcuugaacccaggaggcagcaguugcaauaagcugagcuugcaccacugcacuccagcgugggugacagagcaagacucugucucuuaaaaaaaaaaaaaaaaacuacaaagaggcagguucuucuucaacuaauuaagcaugagcagcuucucauagcuauauaacuucucugaguacacugagcguauccacacucuuauucugugggucuggcgaucugggguaaacacacucaggguuagaaaugcacuacaguuaaauacagaaagagguauggaaauauacauauauauauaauaauagggauaccuuuuggcaccucagugucacuauccgcuucugaaucagaugcaaucgcauucuugcguuucauucguaaaacuucaucuucacuaucacugccucuugcagauucuauaaggguagaauuagaaguucugcauaaucagucgcauuaguugaauuuuguguuuuaaaagcaauauuggagauaaacaaauugugauacaauggacuacuacucagcaauaaagaggaaugaacugcugauacauguaaccaauuggaugaaucaaaaaugcuauaugccaaguuaaagaggccaaucugaaagacuacauacuuacuguauaacucuauuuauaugacauuuccaaaaaaccaaaaguuuagugacagaaaagaccaguaggugccaggguuuagggguagcagaaagauacgacucaaaagggauagcauaagggaguuuuucagugugacagcgauucugcauccugagugugguggugguuagacaaaucuauagauauguuaacaugaauagagcuguacaugcagaacaugccccccccccaaaaaauuaacucuaguguguguuaauuuaaaaaacagaauucuuaaaauaaauacuggugccaguugugguggcucaugccuguaaucccagcacuuugagaggacgagguggguggaucacuugaggucaggaauucaagaccagccuggccaacauggugaaacccaucucuacuacaaauacaaaaauuagccgggugugguagcgugcaccuguagucccagcuacuuaggaggcugaggcaagagaaucauuugaaccugggagacugauggugcagugagccaagaucgcaccacugcacuccagccugggugacagagcgagacugucucaaauaaauaaauauacuggcuuugcaaguacaaaaacuugguagaaaugagaaaaguagcacuaaaacuuaucaaauuuacauaagacaaauuucagggaaaaaaagguaaaaagauuaaaaaggaacugacaaauauaucauuauuucuagaagggccaauuauuuacguaaaaaugucacaaaaaucaacagaaccacuguugaacuaguaagagauaagcagaaugaccagcuacaagguucccuacuaugacccugcccuugacuuggucuucuaguauuugggauguaguacaugagccuuaaagauucuuucugguaacaguaaaaacagcccuacuuucggccaggcaugguggcucuugccuguaaucccagcacuuugggaggccaaggugggcagaucaccugagaucaggaguucgagaccggccaggccaacauggggaaacuuccucucuacuacaaauacaaaaauuagcuggguuugguggugcacaccuuuaaucccagcuacucaggaagcugaggcagaagaauugcuugaacccaggagguggagauugcagugagccaagauggugccacugcacuccagccuggaugacagagacucugucucaaaaaaaaaaaaaaaaaaaaaaugaguggccgggcgcaguggcucacgccuguaaucccagcacuuugggaggccgaagcaggcggaucacgaggucaggagaucgagaccauccuggcuaacacggugaaacccugucucuacuaaaaauacaaaaaauuagccgggcgugguggcgggugccuguagucccagcuacucgggaggcugaggcaggagaauggcgugaacccaggaggcggagcuugcagugagcugagaucaugccacuacacuccagccugggagacagagcgagacuccgucucaaaaaaaaaaaaaggaugaguucauguccuuugcagggacaugagggacauggaugaagcuggaaaccaucauucucagcaaacuaucacaaggacagaaaaccaaacaccgcauguucucacucauaggugggaacugaguaaugaaaacaguuggacacagggcagggaacaucacacaccggggccugucauggggugaggggcagggggagggauagcauuaggagaaaugccuaauguaaaugacgaguugaugggugcagcacaccaacauggcacauguauaccuauguaacaaaccugcacguugugcacauguacccuagaacuuaaaguguuaaaaaaaaaaaaaaaaccucuacucugaauuaguuauugaaaacuuacugcagucccauagucuacacagaucuauauucaucucuggaaauaugcugcccuccucuucuaauaacaccaagaugugguuucugaauccuguccugugagguguguguuagaugcccucauauuuaagcuaagaagauaggaucaaaauauaauuaauauaaucaaucaccuauggaaaugaagcaauccagguauuucaggaagacuucaacuuaauuaagguaacuuuuauauaauacaaagaaauaugaucucuaauuuuuuguacauucuauaugaagaauguguuaacuugagcagaauagucuaaauggcaaugauaaaagcagguccaggaaccaaaguucagguguaugccuccuguagucuuuagggaaugagugcuguaacccaagcucgucucuguagggugaggauacacccaucaaucugucuuggcucaguaacacuguccauugagaucacccagccauguuugcacuuucuacauauuauacucccugggcaaccuccugauuauuauaauuugccauccacgcuagauuugcccccggggaaacauauggggugauaagggagaaauaacugauccucuugaaacaauuuugcaauucaauuuuauacauuaauaucuuguaaauuugacuaguuugaguaaacuccuuagagcuugaccaucucuggaugaucaaauuuuggaucucaaaaagcugagcugcagcaauggugcccacaucucaguacagcugcucuguggggacacuucaaugguaugguuuuuuuccccaggcuaaucuauucucucacaugaggcaugcucuucaguuauccacagaaauggaaucaacuuaacucauuaucagcucuucuuacaccauaucccucccucuaagacucaauuuuaaguccucuuuaaauuguuuucccccagaccuauccauuaacaaauggaagggaaaggaguaagaaagaauaaguggauuagaaagauuuaaaagaagcaaaauguauucuagaguuagaaaaguuugaaagggaggggacagaagagaaaaaacaggguaauaaagaugggaauaaagacuaaaugggucccugcuguaucugaaugcuucuuucugagccauucugguucucauaaauguauuaccugauuuaugauccuguuccucuucaucaucugaaugccuguguucuucaucugaggccuguggccuuucaucaucagaauuuugcauuuucucuucaucagacagcugugguuguucuucaucaucagaauucuguuucucaucaucauuaucagaagcuaccggccguucaucaucagaauuagccuuuuccuccucagauagcuguugucucucaucaucggaaagcugaggccucuccucaucaucuguguucugcauuuucucaucaucgucagaauucugcagcuuaucuucaucagauccuugugcccucuccucaucaucagaauuuuguaucuuuucaucaucugacuggucacuuuuaucuucucugccccauuuuucaucaucugaaugugcuuuuucagaaccuucugcuucugaaugauggcucccuccauccgaucuaugaccuucgucuucaucaucauuaggggcuucugauccacugugcugaucuacaucugaggggucauuguccucauggucagaacgcucagaagcuucugaucuauugucugaucuuucagagugauuaucacuaccacuaugaugugaagcucccucguccucacugucaucuccaaacaguuccuuauuacuugguuguccugaaucaccucuuucauccugaucacuuucacuuccagaggcauuacugccagaggcagcauucucuugaucagaaucugagucagauccagaaucagaaucuauggggucauauaaacauaggauaacauaagcaaaaaaaggcagaguaaggcagucccaaaguccaucccaacauaaaagcaaugaagaaacuggcaaaaacuguuagaauuaacauucuaaggccgggugcaguggcucacgccuguaaucccagcacuuugggaagccgaggcaggcagaucaccugaggucaggaguucgagaccagccugacaaacauagcgaaacccugucucuacuaaaaauacaaaauuuagccaggcaugguugcacaugccuguaaucccagcuacucaggaggcugagacaggagaaucacuugaacccgggaggcagaaguugcagugagcggagaucaagccacugcacuccagccugggcgacagagugagacuuugucucaaagaaaaaaaagaaaaagaaaaagaaaaauauauuuacuaaaaucaaagagucacuagaggggcucaaccaaagauuugagcaggaaaaagaaagaaucaguaaacuugaagauaccucaguucgacuguccaaucugagaaacagaaagaaaaaagaauaaagagaaaggaacggagucuagaagauuuaugggacaccuuaaguuauaccaauguaugcauaauggagucucagaagaagagaaaugagcagaaaaagauucuuaaauaauagcugaggccaggcauggugguucacaccuguaaucccagcacuuugggaggccaaggcgggcagaucacuugaggucaggaguucgagaccaggcuggccaacauggcaaaaccccaucucuacuaaaaauacaaaaguuagccagguaugguggcgcaagccuguaaucccagcuacuugagaggcugaaacaggaaaaucgcuuggauccaggagguggagguugcagugagccgagaccacaccauugcacucuagccugagugacaaagcgagacucugucucaaaagaauaaauaaaugauagcugaagaacucccaaauuuaugaaaaauauagaucuacacauccaacaaguucaacaaaugacaaguaggauaaacuuacagagguuuacaccuagaaacauuguuaucagacugucaaagacaaagaaacaauuccaaaagcgggcaaaagagaagcaguucaucccauaugaggaacgcucaauaagaguaacagcugauuuuucaucagaaaccaaggaaucccagagccauccauaagaggacacauucaaagugcuaaaaagaaagacugucaaccaagaauuuuauauucaguaaaauuaugcuucaaaaacuaagacgauauggaagacaaaagaaaacauaaauuggacuuccacaaaaugaaaaacuuuugugcagcaaaggacguuauuaagaaaguaggcccggcgcaguggcucaugccuguaaucccaacacuuugggaagccaagguggcuggaucaccugaggucaggaguuugagaucagccuggccaacauggugaaaccccaucucuacuaaaaauacaaaaauuagccaggcaugguggcuuacgccugugagcccacuacuugggaggcugaggcaggacaaucgcuugaacccaggagauggagguugcagugagccaagaucauagcacugcacuccagccugggcaacagaccaagacuccaucucaaauaaauaaauaaauacauaauauugcuaaguuaaguucaaaacugguuaaugucuuagaggacaauaaaaucuuuuggcugggugcgguggcucaugccuguaaucucagcacucuaggagcccaaggugggaagaucaccugaggucaggaguuccagaccagccugaccaacauggugaaacccugucuacuaaaaauacaaaaauuagcugggcaugggggcacacgccuguaaucccagcuacugggaauaaugaggcauaagaaucccuuaaaccuaggaagcggagguugcagugagccgagaucgugccacugcaugaaaggggagacucugucuccaaaaaaaaaaaguaagugaaggccaggcgcaguggcucacgccuguaaucccagcacuuugggaggcugagguggguggaucacgaggucaggaguuugagaacagccuggccaauauggugaaaccccaucucuacuaaaaauacaaaaauuagccaggcgugguggugcaugccuguagucccagcuacuugggaggcugaagcagaauaaucacuugaacccagaaggcggagguugcuguaagccgagauugcgccacugcacuccagccugggcgacagagcaagacuccgucucaaaaaaaaaaaggaaagugaaaaaacaaccuacagaauggaagaaaauauuugcaaaccauguaucugauaagugucuuuauccaaaauauacaaagaacauuuauaacucaacaauaaaaccaauuucuuuguguuuuuuguucguuuguuuucuuggagacagagucucgcucuauccuucaggcuggaguacaguggugcaaucuuggcucacugcaaccucugccucccucaagcgauucuccuaccucagccucccaaguuuaugggcgcacgccaccacaccuggcuaauuuuuuuguauuuuuaguagagauaggguuucaccauguuggccaggcuggucucgaacuccugaccucaggugauccacccaccucagcccccuaaagugcugggauuacaggcgugagccacugugccuggccuaaaaccaauuuuuuuaaaacagaggacuugaauagacauuucuccaaacaaaguuacacaaauggccaauaaauacaugaaaagauguucaacggcugggcgcaguggcucacaccuguaaucccagcacugugagaggccgaggcaggcagaucaccugaggucaggaguuugagaccagccuggccaaaauggcaaaaccucaugucuacuaaaaauacaaaaauuagcagggugugguggcaggcgccuguaaucccagcuauucgggaggauaagggaggagaaucacuugaacccaggaggcaaaggcaggagaaucgcuugaaccuagcacuuugagaggccgaggcagguggaucaccugaggucaggaguuuggaaccagccuggccaacaugacaaaaccucaucucuacuuaaaauacaaaaauuaguaggguaugguggcaggugccuguaaucacagcuacucgggagguuaaggcaggagaauugcuugaacccggaggcggagguugcagugagccaagauuguaccacugcacugcagccugggagacagacugagacuccguuaaaaaaaaaaaaaaaaaaaaaaaagauguucagcaucauuagccuuugggaaaguguaaacugaaaccacaaugagacaccacuugauaacaucaaggauggcuacuuuagaaacaaauaaaaacuuaaaauaacuguuggcaaagauguggggaaagggaacccuggugcauugcuggugguaauguaaaauggcucaaccacuauggaaaacaguuuggcugcuccucaaaauauuaaagaauuaccauaugacucugcacuccuacauaauacccuccucccaaaauuaaaaacaggcacccaaacauguacaugaauuuauuuauuuuuuuggagacagagucucacuuuaucacccagguugaagugaagugaugcaaucucagcucacugccaaccucugucuccuggguucaagugauucucaugccucagccuucugaguaccugggacuacaggcacgcacgaccacaccuggcuaacaguuuguauuuuuaguagagacaggguuucaccauguugcccaggcuggucuucaacuccugagcucaggcaaauccgccugccggaaccaggaauguuuacaguagcacuauucaaacaacccaauguccaucaacagauaaauggauuaacaaauuuagggugugcacauucaauggaauauuauuaaaucauuaaaaaugaauaaaguacugauaugugcuacaaugccuugaagacauuaugcuaaguaaaagaaaccagacacaaaagaccacaaugcaugauucaauuuauaugaaauucccagaacagauaaguacagaaacaauagcagacagggguuggaggaaggagcauaugaggaguaagugcuuuaugaacaguguuuuauuugggggugaugaaaauaacaacuagauauauguugucuacaagagacucacuuuacuuggagccuagaggguugcaagaauucugaacuuggucuuggguucucacuucaaauagcuccuauucauauuucaagugcccguagucucaacuacuuggaggcugaggcagaaggauggcuugagcccagaaguucaaggccaaccugagcaacacagugagacccugucucuaaaaaaguaaacuuuaaaaaaacacccacaauccugugccagaaauaacuuccaagcagcaugcacauacacuaauucauucauuucaucaacaaauccuucauuccuccucucuguacacagaccccaugcacuccccaaucuaacaucacagacuccggaaauucuggaguuucugcacaagcucuuagagaacacauucucuccuaugugaaacaucuaucuguaaccccaucccauuauccgucccagacucgucauccagacaucucaagcucccuaucacaccaugcucugguuucauucaagacggcauucugaggcccucuguaaauucgcccaccccaucccauauuccugcauucauuuccauucauucaaaaacagcccuuacucuacgcuggccugugcaaggcaaggcggaacaggacuccaacguuccuacccgcgcugcgcaggcucgccugcacuuccacccaugccccgcgccccuuucgcuccacaagcucccaggaaccgucugcuccaccgacacccagagccucgaggcgcagacugucugacucuccauccugcccgccggaggaggauggcaccuccgggagugcagggggcgcugaggcaggaguggaggaaacgccaccucuugcccgcggcgcuggagccuccacgguuguccggcucccacagcggaaggccugccacgcacccauccuccgaagaccagcgaacccaccuuuacgcucagcuucgcugucggcgucgcucccgaagagauccuccauauccgccauuaucgcucacguccgc

SEQ ID NO: 192079 - RNA, 1236 nt, Homo sapiens
uuauaaauuugcuuuauuauaagugugugaagaucuuaaugcuuuuggcaaaauagccauuucuuuauuagaauaguucaaacucacucuugcaacaaaauaaaccacaauccaucaagacacaggaaaaaggaauacggggauuuaagaaugcuauacuugcuuuucuucaacuuuagcagcaaaaguuagaaaguuaagauguucccaacaguaacuauguugucuuaagcaacaggauccuggggagagugggggucugaugcaugggccuucaaguucuucucaagguguuucaucuucucagcuggaagagaagcaguugauacuaaccauggacagggacaaguguuugcuguuucgaacuacuccgugacugggaguuggggaggagagaaagaucugcgauagugcuguaacccaggugaggcugacuugggcagugaugggucugaaucuaucagaucucugcugacuuucccaagguccuaccccaggauccccucccaacaaacuucguacagcuagcucccuggggucuggaaaccaagaaauuuugagaagguuaagggaggauggaaggaaaccgagcaaggccaguauggucacucguggcuuccuccacaugcagguucucaaagacccucaccucgggcacgauguucucggugaaaccaugccaggcacaggagcaugcucuucacccgauucuguacacggggccgcccgaaaacggugauuucgacuagguucccugagucaacuauguccacugucagcagggccuggcucguccacuccauuucuggaauuauggcucggucugggccuaaacaaguaaggaaaaacucugaggggcugcacgguggcagguuagaagcuggauuugaagggaauguuggccagggaagggaagaacuggaaggugggcaucacugcaacacuccuggcuugcgaaucugggaaagagacuguagagagcugcucugccaagccucucucagacuggagguggacagcccacuagcacaccuggggucgcucaccaaagagcucgucugccagccaugccucuagguagaacaccaaagggucucucaguuccugcaccggaaaccaccagggccggaugcgaaucuguggcggcggaagugguaaccuacgcagcugcuccagggagugggccggagucuguuugccccgcugggacucagcggcaccagcaucaucgaccau

SEQ ID NO: 192080 - RNA, 60636 nt, Homo sapiens
guggccgcggggcggugucaucgcccccgccccgcccgguccagccagcucggcccgggggcuucgggcugucgggccggcgcucccuucucugccagguggcgaguacaccugcucacguaggcgucaugaggucuccgguucgagaccuggcccggaacgauggcgaggagagcacggaccgcacgccucuucuaccgggcgccccacgggccgaagccgguaagcggcggggucguccaggggcuucgagugggcagcgguaccgggggcggcggucucugggccggcauggcccggguacccgcacccugcgccggcgggaccggagcugcucaggcgcgaggggacauuaagaggggagcccguucagagugccgcucagucccgccugccucggugcgcagaagccccucgggaaccccgggggccgcgaccgugaucgcggagccgagccggggccucggcaggugcagccccaccgggcgggggcgggggcgggggcgggggcgggggagcggcggugcagccggcgcugagcuggugguuauuuuggguagugcugagcaagggacccaguggaagaacgaacugggagagaaucaucaaaugaaugggcuaagguccgagcggaggaccccgguguaagagcaaacuggaggagaaaccugcagaucaguaggcagagggcuguccuucccugucaccgcuagguuuccgccacugcguauccgccagcaugugaccugguagcuucuuaggcggggagggaagacaaaaaaggacuggaguuaacauuugugaguaugcagagggcaacuauuguauaacccagcugauaucuugacauugugcaguaagagacuaaaaacaucgaggacauuuuuuuuccgucuggcagucuaugauuuaaguuaggaaaagguucaguuauccucaagauaccuauggaguucuaaaguaauuugccaaaggucuuggaacaaaucgaaaagcagguacgucauaaagcaucuucccugaauuugagaaaauuaaaauauuuugcuauuugacacuuuuguaauauaguuuauuuaaaaguaacgaaaacuaaagaacaaaucaguuugaaugcauucuauaguuucaaagaucugugcgugagaaagaguuguguuggaaauuugacuuuggcuaacccagaauuguauaguuucuauauuuuuauuuguuuuuaauguuaccagaugguggcaguagagguggcaaccuuauagcuccaucuggcagccgggagcuuauuuuagucaacacaaacuguaaauaccauaccauaguuacguuuuaccuggaagucggacuuaguuccauaaacugaucauuuucuguggcuuguaguguucaaauuguauaauauuccucauaaaauaauauagaaauacagaaauaaaaguuauaauaaagauauuugccagagauuauuacauuguuacaauugaaaaauauguauauguauaaucaaaauuuagcacaaauguuaaacauuauucucaggaaaaugcagauuaaaauuacaacgaggcacuauacacccacuagaauagcuaaaauccaaaaggcugauaauaccaaauguuagcagagauguggauagaaaaguuauacaucucaauaaagauugagauggacaaauguauacauuuaucacguaaauuauacuucaauaaaguugauuuuuaaaaaaguagcuuauagcaucccuuuuaaaaacaaucccuacuugauucauguguugaguguauggaucuuaugguacuggcccuguccuuccuggcuuuagguggcuacguuuguuacaaccauuuccuuuuuuauuuucccucuuuacauacccacuggagagcaagugaaguggaaauaauaguaacauacuguuuuugcuauuuagaauaugauaaguuuuauagagaaggagcauauauggcaauuaagagaaguauauaaugagcccccauguaaccagcacccagauuaaaguuaucaauucauggccagucuugccuuaugcucauacauacuguguauuuugaagcaaaucccagauaccaugucauuucauauguaaauauuucaauuauuuaccucuaaaagauaaggacucuuuuuaacauaacuacaguacuauuaucacagcaaauaaaaauaaugcuuacucacuuugggaggccgaggcgggcggaucaccugaggucagcagaccgagaccaucccggcuaacaaggugaaacgccugaaacgccgucccuacuaaaaauacaaaaaauuagccgggugugguggcgggugccuguagucccagcuauucgggaggcugaggcaggagaauggcgugaaccugggaggcggagcuugcagugagccgagaucacgccccugcacuccagccugggugacaagagcaagacuucgucucaaaaaauaauaauaauaaaauaauaauaauacuuacaaaauacucaguguucauauuuccucaauuauguccugauuuuuuuuuuuuuuuuuuuuuuuugagacggaguuuugcucugucgcccaggcuggagugcaguggugcgaucucggcucacugcagccucagccuccccgguucaagugauucuccugccucagccucccgaguagcugggauuacaggccuacgccaccacacccagcuaauuuuuguauuuuuaguagagacggaguuucaccauguuggcaaggcuggucucuaacuucugaccucaggugauccacccgccuuggccucccaaagugcugggauuacaggccugagccaccgggccgggccuauguccuaauuuuuuauaguguguucaaaucaggaucucaauaauguccauaccuuccaaaugauugaaauguuuuuugucucuuuuaaucuguuuccccugccccgcuccuuuucuuuucccugcaauuuuauauccuuauguuguccuuuaacaucuucugcccuccugauuuacuguaaauugguaauuaguagaucugaagauuugauaggauuaugagucugucugucuuaauuaccgucaugacuauuccauaaguagaauacaaguguagaaaguagaauugugucagcaugcuaauucucccauacacggcucuagacacuggagauacaaagaaguaaacaaaacagaacaaaagcuccugcccuuauagacuuuuauauucuaguguauauuuuccuaaacuuucagcccucuccauuuugcuuucuucuuggguuacaaucaaaguccaacacuuuauuuucuuuuuuuuuuuuuucaggaucucacucuguugcccaggcuagaaugcaguggcucaaacaggucuuacugcagccucaaccucccaggcucaagugacccuccuaccuaagcuuccugaagaacugggacugcaggcaugugccaccacaccuggcuaauuuuuuucuuuuucuuuuuuuuuuuuuuuuuuuuuuuugagacggagucuugcucuuucgcccaggcuggacugcagucgcgcuaucucggcucacugcaugcuccgccucccggguucaugccauucuccugccucagccuccgaguagcugggacuacaggcacccgccaccacgcccggcuaauuuuuucuauuuuuaguucagaagggguuucaccguguuagccaggauggucucgaucuccugaccacgugauccaccugccucggccucccagagugcugggauuacaggcgugagccaccgugcccggccuuuuuuucuuucuuuuuuuuuuuuuuuuuuguagaaaaaaggucucacuuaguugcucaggcuggucucaaacuccugggcucaagugauccuccugcgucagccucccaaagugcuaggauuacaggcgugagccacagcacccagcccaacacuuuauuuucuugccaauacucucgauucccuugcccccuucuuugucaucacauccaucucggugccagcuaucugcuuucuuagugccuacuccugagcacaggcaugcagugcuuaugaaguuacacacuagggcagauuguucccaccaauucuguauggguaucugcucagcauuccuguguuucacugagaaccucaugcccccacucucuucaacaauuucuuacuuuucccagaucccaauuucucacaaaugagaacuaaccucaauuccuaagaaauaaccucaauuccuaauuuccagaaaaaaaaacccauaauaauucacaguuauucugugccaagcacucuucuaaguauuuuacauuacuaacucagugaauccuuauaauaacccuaauucaggcaaaauacuucgacuagugccaagcguauagaaaaugcuuaguaauauuuguuuuuugagacaagagucuuauucuguugcccaggcugaagugcaguggcacaaucacagcucacugcagccuaaacuucccagacucaagccauccucccaccucagccucccagguagcugggauuacaggugcacaacaccacaaccagcuaauuuugaaauuuuuuguagagaugggguuucaucauguugcccaggcuggucuugaacuccugggcucaagcaauccuuccccaucucagcuucccaaagugcugggauuacgagugugagccaccaugcccggcuuguaauaaauauuaucuauuauugucuaggcaugguggcuuaugccuguaaucccaaugcuuugggaugccaaggugggcggauugccugaggucaggaguuugagaccagccuggcuaacauggugaaauccugucucuaccaaaaauacaaaaauuagcuggguguggugaugcaugccuguagucccagcuacucgggaggcugaggcaggagaauugcuugaaccuggaagauggagguugcagugagcugagauugugccacugcacuccagccugggagacagagaaagacuccaucuccaaaaaaaaaaaaaauuauauauuauuuuauguuauuaaacuuaauacccacuaucccacucaauaguguuaguucuuagaguuacuacaauacauaaucuagauacugcagaucauuuagaauguccugcucucccuauguuuaucugucucauuuccauaccucuguacaugcugcugcuuuugcuuggauuguuccaucugucccuacuggugacuuccugcuccuugaagagacuucuccaagaggccuucucugacugucuccacuguccccuccaucagauuaaugugccucuuuuguuccuuuuuauauauacguacauaguacuuugucuuauuggcauaacuuucuccagauaaaaaggaggaagaaauccuuuuuacuaagugccugcuauaaugucuugcaguauuucauuuaauccccaugcagcccaguggguagaugguggucucuacauauuauagcuaagaaaccugagaaugaaaacuaguaaguaauuucuacaaaagcacacagccagugaaaaaucagaaacagauucauucccaggucccacucuaaauuagccuguguacuuucaguuacacccacacacauuccuaaguuuaaaacacauuuuagaagcugauguuuguuuuugaugggugccauguuccuuaugcaagcaugauuuugcuuugaacuugaugcucaauggauguucucucucuuggucaugcaagcaugcuuuuguuggaucaauuucaaagaauauucacauucccaggcauguuuuucuuuacugcuauaccuucuugaaauaaaaauuuucugauugaauauauuuguaaucagcaaccauuuuauuagcuaguaauuguuuauuuuuaauauuucuuagaaucucauaguaauauacuuugugacaccugaguuggcuuuuuauuuucuuuuuuuuuugagacgaagucucgcucuugucccccaggcuggagugcgauggcgugaucucggcucacugcaaccuccaccucccagguucaagcgagucuccugccucaaccucccgaguagcugggauuacaagugccugccaccacgcccggcuaauuuuuguauuuuuaguagagacgggguuucaccuuguuggccaggcuggucuacaaacuccugaccucaggugauccacccgcuucguccucccaaagugcugggauuacaggcgugagccaccgugccuggccgcuuuuuauuuucuaauuacugacuaugcauccaaaaguuaaaguugccugaucuauaacuuguaggucagauuuccaaguaauaccacgaguaauuugaaaucauuuuacuuaccuuucuuucauuucucaacauucuagccccuuguaauucacaugauaagguauaucauagucccaauaaagcaucacuuagggaaaacuaauaauguacaguaaaauaagauaacugcaaauaaggauagaaugaaguaauaacauuacaaauuacaguagcauaaaauagaguuuuuuagaguaagagaauuacuaauaacuucaucccuccccuucacuuacucccacaucuaacauuugggcaaggccuguuaauucugccuuuaaacaucucagaucugcccauuuuucuucacugcugcuuucacuguaguuuaagccaccuucaucucuuagcuggaaagcuacaguaguccuuuaagugaucucccugacuguacauuccuuacacccuucacacuucuccuuucuauagucuccaugcaggguccagaugagcucuuuaaaccaucaaccagauaagcuuuuuaaaccauaaaucacaucucaucacuccuuugcugaaauagguaaugaucuuuuuaaaugcugcauugacaaaacagacauaguacauaaaucuggguuuuucuugcuccaaauugcucaaaguaacacauuuuaaugcacacauuuagcuagauuuuugagucccccauccagacuucuagguaauaucaccugacacagagcaaugauaaagaaaacauguucugcugggcacaguggcucacgucuauaauuccagugcuuugggaggcugagaugggaggauugcuugaggccaaaaguucaagaccagccugggcaaaauagugagaccccgacucuacaaguaaaaauuuaaaaauuagucagauaugcugccauaugccuuuagucccagcuacucaagaggcugaggugagaggaucacuugaguccagggguucgagguuacagaaaguuaugaucacccacuguacuccagcuugggcaacagagcaagacccugucucuaaaaaaaaaaagaaagaaaaaagaaaauguguuuuuuuacaaaacaugccucacaauauccaaaccgucauuaacuggacaacugcccauuugguugcagcagaaagcaaauucgccuagauucuaguaauagagacaaugugaauagaacuuuagaaauucaguucuuacagaucuggaucuaacuaugguagugguaccauaaauuucauagcuguaccccugaagaaaggauuuaagaaugccaaaugaaaaguuuccuguuaaaagaaguuaaucuuacacagggaaaaaaaaauaauagcaguuguuaaacauaggagggcauacagaaaagugaguuggaucauaauauauuaauauaaaccuaaguauaguugugcauauucauuaauguuucagucuaaaucaguucaucugagccaguaucaagacuuuuguauucuguaaaauauauucucuccuuugaugcuagguuaaugaaaacaccaggauucuuaaguaggggaaaaacauacacacauuuauaugauguugaugugucauuaccaaauaaaagcacacauauuuucauuuaauuuuaauaugucauugcuuaaugaaauacauguuuauaucuuuaaagagguauuuaucagccacucagaguuuacuaaacuuaaagauguucagacucuggauuagcuaauuucucuuuguuacuaagagguugauuauccuuagucagcauccugaauccuaucccucuccaauucugcaacucaauaaaagaagaaaaaagagaaacuaugcauaagcccacaguuagaguaauaaauaggucaaacuccuccucucacaugauccuuuuauugguuccuccaaccuacucugcauucuuuuuuuuuuuuuuuuuuuuuuugagacggagucucugucucugucgcccaggcuggagugcaguggcgcgaucuccucucgcugcaagcuccgccucccggguucacgccauucuccugccucagccucccgaguagcugggacuacaggcgcccgcgaccacgcccggcuaauuuuuuguauuuuuaguagagacgggguuucaccgaguuagccaggauggucucgaucuccugaccucaggugauccgcccgccucggcuucccaaagugcugggauuacaggcgugagccacugugcccggcauccuuuuuuuuuaaucauggugguacauucacugauuucccuuuuuacugugagcccuuuacgcuugauaacuacugagcaacugucacagaugcugcaacugucauagguucugcaaguuugcuucuagauucuuaaaugcauuuaguuuacgauggcuuuaaguauuaaucauggcuucugauucaaacccagccuuugaggauacucuucgagguaagaaauuuaucaagagaaauuucaugcccuacccuuggcaguaaauuuuuuuugcuaugcuacauuuaacaaugagauggcuacuaacucauaaucaguaauauaucaugucauuguaaguacucaaguacuuauugaccauguuucagauaguuuuucagaaauaguaaugccauuaaaccuccuuaccugcuuuucucaugccguauaucuuugccagcugacaaggaguagggguucaguuugaaucuggaauagaucuuuuucucagcaaaggugauaaaacuacuaccuccauguuuuaaugaacuuuuuuauaguucaggcucucaugugugaaauuuuuaccaaaacuacagauaugagaaacagcuaaucuuugacaaauguuucuuagauuugcuuaaucuaagaauauucuuuaacauuuuuucauaauuauuuuuguacuuuuaaaaagcaaccuuuuucauuauuuagacaauaucauguaauuaacuuuuuuaauuaaagcagccggguaugguggccaaugccuauaaucacagcacuuugggaggcugagguggguggauggcuugagcccaggaguucaagaccagccuaagcaacauggcaaaacccugucucuaaaaauaaaaauuuaaaaauaaauaaaaauuuuccccaaucuuuauuucagcuccagugugcugcucugcucguuacaacuuagcaauuuuggccuuuuuugguuucuucauuguguaugcauuacgugugaaucugaguguugcguuaguggauaugguagauucaaauacaacuuuagaagauaauagaacuuccaaggcguguccagagcauucugcucccauaaaaguucaucauaaucaaacgguaggugcuauuuuuuaaggaaacaauuuuaauuauccuaaaauacuugcaaguaaaaauauuaaaaggucuuuuuucauccuacagaaacuauacuuuguuuguguauacucugaaucacuuucuuuuuguguuuucccaggaacugauugggcaauaacuuguaacuauagcuacuacugcuaugccguaauacaccuucaucuguuugaaaaguaguucuuccauucccucuauaaacauaccaugcuuaaagaaaauuuggaaaaaccuguuuuauauaacagaaaauuaaacuguuuuaaauuuucuaaauagcuuuuauaggaguauuauuuauaacccuauaucacuuauagaguuacagcugcaagagaguuuagguaaucucaguugcaagaugaaaaacaagaacuggccaguuucuuaggacauucuuuucugaauguacacaugcccaaccuaagccacauaagucauuuugccugccuuauguuauagugguauuaauaaauguguauucaucauuuguuuauaauuaaguuauauauacuucauuuuauguugcuuaucacacgaggagauaguacagaaagaaaagcuaguauucuuuuuagaaguacauuugcaggcugggugcagugacucaugccuguaaucccagcacuuuaggaggcugaggcagguggaucaccugaggugaguaguucgagaccagccuggccaacacggugaaacccugucuuuacuaaaaauacaaaaauuagcugggcgugguagcacacaccuauaaucccagcuacucaggaggcugaggcaggagaauugcuugaaccugggagguggaguuugcagugagccgagaucacgccauuccacuccagccugggcaacaagagcaagacuucgucucaaaaaaauaaauaaauaaaaaauaauaaauuuuuggccgggcgcgguggcucacaccuguaaucccagcacuuugggaggccgaggcacauggaucacgaggucaggagaucaagaccauccuggcuaacauggugaaaccccaucucuacugaaaauacaaaaaauuagacgggcgagguggugggcgccuguggucccagcuacucgggaggcugaagcgggggaauggugugaaccccaagggguggagccugcagugagccgagaucgcgccacugcacuccagccugggccacagcgagauuccgucucaaaaaaaaaauuuaaaaauaaauaaauaaauaaauaaauaaauuuucacccauuuucagugcucacgaagauacuaguucauacuuagaugaaucuccucuaucauucacaagcagagcauucaagcaggaaagaggguuucucucuaaacaaaauaaaucucuccgaaaaucuuuauauuugacuuuaauaauguugcugaguaacauuuggguacacaucacucacuuucuccacuccaaccugugaccuucagggacaauacugcuggaauguacaugaaauccuagaauuccacagauaaacugcaaauugguacccuaaauaaggaaaaguaagaguuugcuuugugucuuuuucuuugcaaagugcuuuuguugacccugcuacuuaucuucaucugccuuauaucagcaguagaaagaaaucccggaaugguucuugacauguuggcuuuguuauacagcuacacugcauuaaaaaugucagauacucagaucagucacuaaaucuucauuaguaccuugcugugugcuguuacuaaugaaaacacagguucuauucacaugaaguuuguggcuugauuuaaauucuugcucuuuggaauuguuccaugugcuuguuuaagugcuucgucugaaauggggagauauuauuaauaucuacauuuaugcauguuaauagccagcacuaagugaacacuaacuguacaucaagccuuauuuuaugugccuauuucauuuccucuucccagaucacacauucgguaaguaauagagcuaggauuaaaaccaagccugguucccaaagccuagcucagccacuacaguuuucugcuuaauagcuuucuggauuaagccugugacucuuuuuuugggagggggaggcagggccgggggggcggcagccucccgagccauaguaggcucagagauacccaagccuuuuuugugauucuuuugugagccuucuuggucauaguuauuauaaagcuucuggcagcucauccugcagucuaguuuuauaaaauugcaagccuucuugaaguuuacgacugucaguucuuuuucauucacuucuaaauacuguauaucuauauuguuaugacucacccaccuacuagaaaguuugcauguucuucaguccaaaauagugguucaaaaucucauuuauauguacuuacaugccaguaagagaaaagagcugcucugugaaggucuuaaaggauuguuuuauucuuuucugauuuuuguaggguaagaaguaccaaugggaugcagaaacucaaggauggauucucgguuccuuuuuuuauggcuacaucaucacacagauuccuggaggauauguugccagcaaaauaggggggaaaaugcugcuaggauuugggauccuuggcacugcuguccucacccuguucacucccauugcugcagauuuaggaguuggaccacucauuguacucagagcacuagaaggacuaggagagguaauuuucuuuucucucuuguuuuacuucuuaccgugugucuccuucucuucuucuuaaagaugucauucuuugguaugaauaugaaccaaaaaauaacguuggaugauaacagggguuuauuuuuuagagaaaggacuaacuagaaaauuaccugaauagauuuuguuugugguaaaugaggucucuaguaggagcaccccgaaauuggaaccuuuacucaaaaaccagagaaaacuuuuuuccaaaagagacuucauagcucauacuuuaggagagaagaaaauaaaccauuaauaaaugguuaagauaguccgggcgugguggcucaugccuguaaucccagcauuuugggaggccaagguagguggaucacuugagguuaggaguuugagaccagccuggccaacaggugaaaccccaucucuacuaaaaauacaaaaauuagccgggcaugguggugcacaccuguaauugcagcuacucgggaggaugaagugggagaacugcuugaacccgggaggcagagguugcagugagccaagaucgcgccacugcacuccagccuggacgacagcaagucuccaucucaaaagaaaaaaaaaugguuaagauugaccauccuuaccucuugugcucuugccaccguuaaacucugcucuaucauugaugcccaagucugaagcacauuuuacacaauagacuguugaguugcauuuaauuucuuuuuuaucgcuuauucuuuuauuuuuucuggucuuguaacuuagagacaaauauuuuaugauuuuauauaacuaucucaauuuaguucuaugauucugcucuuuuuagaaguauuauugauuuuugccucuuuuauuucccuccucuuaauaguuuuaucauuuuuuaaaauuuugauucuugucuuucuuuuccuucccacuuuucuuuuguauuucaucauguguacccccauacuuaauaauuuucacuuuuccuuuauaacuucgaacuucuaccucugaaauccagggaaugguguauuuugcucucuugcauuucuuuaauucaagcaagauaauggccacugggcuugguguagaggaugaagauuauuuuaaguagcaguguaucaugcuguuggaaugaacacuggaccagaguuugaauaauagcucuauuguaucuaacagugaaaccuuagguaagcucuaaucucuagaucucagucccaucauuuuuuaaacugggacuaaaauaccuucccuguuuucagucacagauuagauauaaaauucauaugugauaaggauugcuagaauacuuuggaaauugccagguacuauuaaaagauuuuucauucaucugaauguuuuuauuuuguucuuaucaguagagguccauuaaguaaacccuuccugaucacaaaauuaaaauuacuccucuauuaccagguuccuguucuucuugacaaaguaaaauauacuuaaaucuagcauauuuucucugauccuaguauucaaucuccuugcugaauguauucccauauuuuacuuccaguuuaugccacuaauuuaacauuacggcauauugaucauauuaccacuguuaucucaggugacauuuuauuuauucauuuauuuauuuuuuucuagucuuugagacggagucucacucuguugcccaggcuggagugcaguggcaugaucucggcucacugcaaccuccgcuuccugaguucaagcaauucuccuuccucagccucccaaguaggugggauuacaggcaugcgccaccaugccuggcuaauuuuuguauauuuaguagaggcgggguuucaccauguuggccaggcuggucucgaacuucuggcaucaagugauccaccugccuccgccucccaaagugcugggauuacaggcaugagccaccguguccagccaacaacuaaauagaauuuaaguuguauuuauacucagguucucucguccuucuucaucccuucaauauguaucacaggugcauuuccucauucauaaaggacacuuagauuacuaucuugcauuccuaccaucugauucaccauaaauauaccuacauugucccuagguuuuauaauaaaguuuucuacaacauaaucucugugggcauuuccaaacaucucaaguuuucuucuauaaugacucauccuguggaugcuccaucauauagauucuuauugauuugcaauguaccuaaaucaucuuugccuuccauugguauuacuuuuuuuuaauuccuuuuguuuuuguuuuugaaagagucagcggaaaguacaaaguauuaaaacauuuauucuucucuccacuaauaauagcacuaguuaccauuuaucuuuacaacaauuaugcaaccgccuugaaguucagggagguuaacuaaucuuucugaagugacacagagaguguccaaggagagccguucucucucacuguccugugguaucuccucauuuacccagucucuaugaaacucccuguuuccacauccuguuagcucuccgugucaguaauuggcaucuacuaggcuuguuaucacaggaaaaaaaagaagaaaggcuguaaacaugcuaauugaauucauccuuuuuuuaauaggacuguuuuucugguugauugucagcuugaauuuuuuuucaguaucccaaaauauuagcucaguauuuuuuaaaguuauaaguuaguaauauucccuuucauucaggugauuaauaaagugaaugaguaaaauuaaccuugagcaagaucccuuuauguccucacucaguacaauuauuuuagauuuauuguaacccuuaucuuguugucuuaaaaccaguuccaaaauccaugaaucuuuggggaguuuuacuuuuuuuuuuuaagagauggugucucacuacguuacccaggcugaucucgaacuccugggcucaagcaauccuccugccuuggccucccaaagugcugggauuacaggcaugagccaccacacccagccucaaauucugaaaguacuucauuauaagauauuuucacuuaacacuguaaaaauuucucauuucauggaaccugauucguuugauucuuauccagaaaaugcuuuuguagcaaaauacuuaacuuacuuuaaagcauuaacaaaacuaccuuacauuucaucagaaauaucauguucccuucucucaggguguuacauuuccagccaugcaugccauguggucuucuugggcucccccucuugaaagaagcaaacuucuuagcauuucauaugcaggugagauaacaauuaccaaauuuugcuguaauauguuauguauauaucaaccuuugggaaaaagggccugcauaccagaacgaugcaauguuggauuggaugccccuuuggggagaacauuaaguuucgguaguauaacuuuauuaccaauuuuucucuuuggcucaacaacuuauaguaaugcagcuuaauugacuaaugucauuuuccccaucugccaucaucuauuucaaaguauguuguguuuucagauauugguauagagaugcuauuuuuuuucuuuuucuguuuacuuuuuuggggguuuuaaauuuuauuuuuguuuguuuagagaugcuauuuaaaaaaaagaaaaaaaaaggccaguagcuagaaaauugaguguuuuuguccuuaaauugugauuucuguuuugauuaacuaaugaauguaucaugauucucaaccccucucuucaugcaucuuuuuucuauugcaucuuuauuugccaucauuuugaucuacaggugagauaacaugaguuuuauauaugugaauuauaauuuuaucagauugcauaagaaauucuagccuuucuuucauugacuaaauuaaaauuuuuccaccggacugcuuuuuaaauacaguaguugagaaaaggccucucugugguacuuuuaagcuaaaaucugaaggauaagaacaaaccauucaugcagggagaagagcauuucagccaaucagaacagcauguacgagggcacucaggcaagaaauaacauaaggguuaaaagaaguggaaaacuaccuuggauggcuagaacucagugaguaaggaggaugauggcauaagaugagguuagagaaagagauaagagccggguuauaucaggucuuacaggcuacaggaaaaaauguagauuguuuuuuaagaggcaugauucaauuacauuuuaagaagauuauucuugcagcuauguugagauugacaugagaaaucugaugauagguucaagaacagguacuaucuaagguucccuuuuaccuauugaauaaaucccaaacuccuugaacuaggggcaagauucuuuacagucuucacuacuuuguugcagcuagccuuauaucucuggcagauagugccuagcauggaguagguacucaguaacuguucaacuguccaaccuauuuuuccagcuuuaucugcuuuuccuuuccuuuacccaaaugaaguucccaagccuacucucugcuuuacuacuuccauuccuuugcuuguccuguuauacuaccucuauaucuuuuuucuaaucuuguuucuaugggaccacauuuuagccuuuuuuuuuuuuuugagccagggucucacuccaggcuggaaggcaguggcacaaucgccccucacugcagccucaacagcugaagcgaucgucccaccucaaccucccaaguagcuaaguagcugguacuacaggcgugcaucaccaccauacccagauaauuuuuguauuuuuaguacagauaggaguuugccauauugcccaggcuggucucaaacuccuaggcucaggugauccacccacaucagccucccaaagugcagggauuacaggaaugagccacugugcccagccuguuacccauccucuguaagcaguagacuugucuguccuauccuuguuucucucuccaaaguuuauaaaauagucuuauguguuguucuaggagcacagcuugggacaguaauuucucuuccucuuucuggaauaauuugcuacuauaugaauuggacuuaugucuucuacuuuuuugguaaguuuaaaauuuuaacuaaauuauaauguaacaaauucaaaauguaauaauaguagccuaauaauguuuuaaaaauauaucuuccaaaucacugaaccacaguucugaaacacuuccugauaaccuguuuuucaaguugguaugauuuacuugaccuauuugaguuacgagcugauguuaguuuuggaauauuucucaguagaaaugacuguugauccuguacuuaaauaguacauuugcuaucaaaaaaucacuaucuuagguauuuugaauuucuucucaagcaaaguaggauguucucacuugguaguuuuaauguuuuuuuuuuuuuuuucuuuuuacuuagucccaaggcauuuuauugcucaauuuccuuggcagcaugauacacauuuuuaauaaauuagauuuucacauagacaugucaugcaagaaauauaucugcaaucaaaauuuaaaacucaacuaacaaaaacagacaccuuuggaaauauguagauuguggaaauguaucuucaaaaagauuugucugguagacccugauaggcaaagucaugugguuaaaaguuguuuucuucuggcugggugcaguggcucacaccuguaaucccagcacuuugggaggccgaggcggguggaucacgaggucaggaguucaagaccagccuggccaacaugguggaaccccaucucuacucaaaauacaaaaauuagccaggcgugguggcacgugccuguagucccagcuacucaggaggcugagacaguagaguugcuugaacccagcaggcggagguugcagugagccgagaucacgucacugcacuccagccugugagacagagcaagacucuaucucaaaaaaaaaaaaaaaaguuguuuucuucaaaauguauaagcaauaauacaguuauagcaauuaucccauuaaagaauugagagaaacuugaaauugaauccaaacugaagucaguuuuacauugaauuuauaguuacauaauuuuuucaagacauguaaaaauuguuguuggugcuuucuaauuuuguguuuuuguuuuguuuuguuuguuauuugguacauucuaauuuuaucuaacuauuauuuuucuauuuuaagguacuauuggaauauuuugguuucuuuuguggaucugguuaguuagugacacaccacaaaaacacaagagaauuucccauuaugaaaaggaauacauucuuucaucauuaagaaaucagguauggacuuugacacauuuuaaaaauaaugucagaaacuuuuuuucuucagaauuaagauaucaguuuuuaaaaauauauauuccuauugugcaugcucuagacaaaguagaauaggcaaaugaaaugaacauccaaaguauugucuggcugggugcaguggcucacacuuguaaucccaguccuuuggggaggucuaggugggaggaucauuugaggucaggagacuagccuagucaacauagugagacccuuucucuacaaaacauuuaaaauauuuaaaaaaaaauuuuaaauacauaaauaugaacaaaguauugucugaagaauuucaguucuuucauuuuuuauagaaaguauaguuuuauaaacuauaaaaaauauuuuuaagucauuuuaaaaccuuuuaguguagugauuaucaaaugagucuuaaguuuguuuuuuccacuugauuaguagaaaauaaaauguguuauucaugaaaggauucucauucugaccauuaguuguuagaaaaccaacuaguguguuuauacaguuguacaucccaaaucugaaaauucuaaauccaaaauacucugaaauccaaaaguuuuugagaacccacaugaugcucaaaggaaaugcucauuggagcauuucagaguucagauuuuuggauuuuaagauuuaggaugcuuggccagccugauggcucacuccuguaaucccagcacuuugggaggcugaggcaggcggaucgccugaggucaggaguucgagaucagcccggccaacaugacaaaaccccaucucugcuaaaaauacaaaaauuagcugggcaugguggcacacaccuguagucccagcuacucgggaggcugagacaggagaauuccuugaacccaggaggcagagguugcagugagcugagaucgugccacugcacuccagccugggugacagagcaagacuccaucucgaaaagaaaaacaagauuuaggaugcuuaauugggaagguacgugauacaaauauucuaaaauccagaauccaaaacacuucugguuccaagcauuucagacaagggauauuggaccuguaucuauauuuuaaaugagugucauuaaagaaagagaacagcacauuuauuaugauauaauauuauaauaugauauacaucuguuugcucuucuagaguaggucuuuagaaaaaaguuuauaucuuauuaaaaccagauuucaaucacuuaaucgagcacaaaggcaaaucacaaauaaaaaucuauaauaauucaauauacuaaauucucaaaccauggaaacaaaauguuugccuuuugaguagaauaaaagaagaacauaaaaacauuaggaaagauuaaaauauacacaguuuguuuucagcauucuuguuggcuucaaagucacuuuauuaguuuaagaacauaaaauauuuaagacuuuuccuauuaaauugucaugauugauauuuuauuuuauuuuauuuauuuuuuuuuuuagacggaguuucgcucucucacccaggcuggaguguaguggcacaaucucagcucacugcaaccucuaucucccugguucaagcaauucuccugccucagccuccugaguugcugggauuacaggugcaugccaccacucccagcuaauuuuuuguauuuuuaguagagacgggauuucaccuuauuggccaggcuggucucgaacuccuggccucaagcgauccucccaccuuggccucccaaagugcugggauuacaggcaugaaccacugugccuagcccaagauugauauuuuaaauauuuauauacaauauaaccaggcaguaaaauuaaaaacuuagucuuggcugggcauggugauuuacgccuguaaucccagcacuuugggaggcuaaggcaggcaguuuucuugagcccuggaguucaagaccagccuggacaacauagcgagaccccaucucuaaaaagaaggaaaaauguacucuuuaacauuucuuuuuaaguuuuuuauuuugcuauaaaugucucuacaagcagcugaacuuuaagaauuaugaccugucuugaucuuugccaaagauuggcaaaaacuuagaaacagaagaaaucagcacuguaauaaaguuuuaaccagguggagagcucauauccaagguuacuugggucugagucuucccagcaaaaaaaaaaaaaaaaaaaauuaauacaaguaaaaaagaaaguuuuagcuggguaugguggcacacaagugcaguuccagcuccucaggaggcugaggcaaggggacugcuuaaguccagcaggucaagguugcagugaacuaugaucagccauugcacuccaaccugggcaacagagcaagaccaugucucaaauaaauaaguuaaguuacuuugaaaguuuagaguccuaccugauguuaauugaguuacccacuuuuuuccccuuaaggaacagguaaaaaaaauuuaacacauuauaaacagauguugccauguaaaacuugauauguuuugucauuuucucaacauugauggguaacagcuugcuuucuccaauauuucauuuuuaucaugaucuuccagaacugauaaaacuuuugaguuuguuuaaauuuuuuaaaaagcuuucccuuggccaggggugguggcucgcaucuguaaucccaacacuuagggaggccaagauggaaggauugcuugggcccaggaauugagaccagccugggcaacaugacgagaccucaucucuacaaaaaauuuaaaaauuagccaagcaugagguuaugcacuuguagucccagcuacucggcuggcugcagcaggaggauugagugagccugggaagucaacgguauaguaagcuguguuugugccacugcacuccagcuugggcaacagagcaagacccugucuuaaaaaaaaaaaaaaaaaaaaaaaaaagcuuucucuacaucgauaugugucuuaaucucuccaaacuuagguuguuucucgacacacuucggaaaaaggaauauucagaggcaagagaguuaggaggagaagcccagauugcauuccuuuuuuuuuuuuuuuuuuuuuuugagucuagcucagugcccaggcuggaguacaguggcaccaucacagcucagugcagccucaacccuacagguucaagcagucuucccaccucagccucucgaguagcugggacuacaggugcacaccaccaugccuagcuaauuauuuuuuguagagacggagucucgcuaugaugaucaagcuggucucaaacugcugggcuuaaggagucuuccugccuaagacucccaaaaugcugggauuacaggcaugagucaccuuguacaaccagacugcauucuuaaagcacaugacguuauaguugacaguguuguaaaaugauguguuacgugaagcugcaucuuuaaaucuuggacccaagaaaugugcagcaucuacucauucauucuuuaaacauuuuuuuuugaaacuuuacuaugaccuagguucuuugucagcugaggacuuaaaaaugaauaagaggaaaaaaauaaaacaugguuccuguggggcccaaggucuccagagggagacagacauggauggacagaauuucaauacaauauagccugcauaaugcagugcuguaagguacaggacaucuuuggaacagagaagguggcaguccucagccagccuggggcagacaggaaaagcuuccuugugucagugccuuuuggccaaaggaacacacuuguaguugaacaaguuggguuucuugguucguugcagugaggaagaaagcacaccaugaagaaccauggggcaucuuagugcagaguugagaggaacuuguugcaguuuagacuugcaguaggugacuuugggaaggguuuaaagaaucaauauuuugcucuggauuugauaauucuaugaugaauuuuuaucuagaaggugggguaaagcugugauuaguaagggcacagcagucacucauauuagcugggagaggaagauguuucgcauuuuuuguaguuuauggcauuuguguuuuugucugugcucagacaugacuguggagugguuuuuuuucuuuuucuucuucuuuuuagagacagggucucgcucugucucccggacugucaugcaguggggugaucucagcucacuguaaaguggucuuauuuuugucuugcuccagcaugcucauagaguggccugguuucgguucaacaggacaaccccaggccuagauguuagaaccaggacaguuuagcuuaccgcagcccaggacugcuuuuuuucuuuuuuuuuuuuuuucuuuugagacagaguuuugcucuuuuugcccaggcugaaguacaauggcacgaucucagcucacugcaacauccgccucccaguuucaagugacucuccugccucagccucccgaguagccgggauaacaggugugcaccaccacacccagcuaauuuuguauuuuuaguagaaacgggguuucuccacguuggucaggcuggucucgaacucccaaccucaggugauccgcccgccuucaucucccgaagugcuuguauuacaggugggagccaccacacccggccugacugcuuuuuuucuuucucacuuuccugagagaaagagugauaucuucuagagagagagugacaccuucuaggaaauguggcuguuggguguugcucucgugcauaagguaaaggcaaaaaacagcaggaggaggaacagcuggaagucaggucacagaggguccucugugccucccuaaggagcuuagccuuuauccuuuaggcacugggaugccaugaaguauuuguaagcucgaagugacagaaucagauuugcauuguagauagcuuaugcuggcagucaugucgaaggagaucugagcuggacaagcaagaguugcaguucaaauguuuucucaguuauccaaccaagaaaaagucaguacuuauagguagaaaugugauuucauucuuacaauaaguggauuuuacaauuaugauagcauauauaguucuaauucugauucagaaauuucuacaagaagagaaauaggcuggguacgguggcucacaccuguaaucccagcacuuugggaggccaaggcaggcggaucaugaggucaggaguuugagaccagccuggccaauauggcaaagcuccaucucuaguaaaaauacaaaaauuagccaggcgucguagcgugugccuguagucccagcuacucgagaggcugaggcagaagaaucacuugaaccugggaggcggagguuacagugagccaagaucauaccacugcacuccagccugggcgacagagcaagacucuaucucaaaaaaaaaaaaaauagagaaauaaaaaucuucauugcacgcugcaguuaaauucagaaggaccaucucaugacuagcgagugcuuuaagaucaucagcuacuccucuauguugaagaucuccuuuuaaugaauuauggaaagacauuaccacuucacccauugaaguguucuuuccuauauaucugcuauuuuuguucuucuucuuuucuuucuucuuguuuuuuugagacggaguuucgcucuuguucucuuguugcccaggcuggagugcaauggugcgauccuggcucacugcaaccuccgccuccuggguucuagugauucuccugccucagccucccaaguagcugggauuacaggcaugcaccaccacgcccagcuaauuuuuuuguauuuuuaguggagacaggguuucugcauguuggucaggcuggucucaaacucccaaccucaggugaucuaccagcuucggccucccaaagugcugggauuacaagcgugagccaccacacccggcuucuucuucuuuucuuaauuccaaggauaucaugggguuuucuuguuugguugguucuggguuuguuuuuuguuuuuguuuguguguuguuuuguuuuuugacacaaagucugguucuguugccuaggcuggagugcaguagcaugaucuuggcucacugcagccucccucugccucccggguucaagccauccucccaccucagccuaccaaguaguugggacgacagguguguaccacaaagccuggcuaauuuuuguauuuuuuguagagacaggguuuugccauguugcccaggcuggucuugaacuugugaacucaagugaucugccugccucagccuccaaagugcugggauuacaggcaugagccaccaugcccagccugaagauagcauguuuuguaacuguuuuacuucuccuuuaugccuuuuaggaagaguauacaauuuugcagcauugcgaagcaaaucaaauggggaccuugguuugaauauuuaguugucaaauuaagacagaaauuaagagcauuuuuuacauguaacuuugcuaaaucaauuugcuguuacuugcauuugacaagaaaaauuuuuuuuaaauggcauauuagaauauauucaaguauuugucgagugaucuuacccucuauauuucacacauuucaugacaaauaauuuuuauaguuuguccuuuucuguuucaacuuauauggaaaaaaaguugauugagcuauuauuagaaauucgaugauacauucugaauacaagauucaggaucucauugauuuuuccuucacaaauuccauuaucauuuaaaucuccaaaguauauuugcuuucaaaauguuggcugagcaaaugaucugagcaauuuuaaauuuuuuugccuguauguauuuuccuuuuugggggguggggguggggaggacagagucucccucuguuccccaagcuggagagcaguggcacuaucucagcucauugcaaccucugcuucccggguucaagcgauucucaugccucagccucccgaguagcugggauuacaugcacgcaucaccauucccggcuaauuguuuauauuuuuaguagagccaggguuucacuguguuggccaaguuggucucgaacuccuggccucaagugauccgccugccuuggccuccaaagugcugggauuacaggugugagccaccacgcccagccacgcauauguauuuucuuuuaucagcagugguauuuuagaauaauguagcccucuaauaggaacuuucaggaccaggugcagugacuuaugccuguaauccgaucacuuugggaggccuagguggaaggaucacuugaacccagggguuagagaccugccugggcaacauagggagaccccauuucuacaaaaaauuuaaaaauuacccggugugguggcacaugccuguagucucagcuacucaggaggcugaggugagaggaucacuagagcccaggagguugagguugcaguagccgugaucgcgccucugcacuccagccugugcgacagagcgaaacccugucucaaaaaaaaaaaaaaaaguggcaggcacaguggcucacgccuguaaucccagcacuuuugaggcagguggaucgccugagguuaggaguucuagacaagccuggccaacguggugaaacccugucucuacuaaaaauacaaaaauuagccgggugugguagcaggugccuauaaucccagcuucucaggaggcugagucaggagaauugcucgaaccugggaggcagaggcugcagugaguugagaucgugccacugcacuccagccugggcaacagagugagauuccuucucaaaaaaaaaaaaaaaugcuuucauaauuuuuaauuuuuugccaacaauuagauaugaugaagccaucgagaguauguguuuacauugcuugauuggcaagauaguaguguguuagaaacaauagcaagagaauaauuucuagauccagaacaucaaaaaaagcuguuuuguaccuucuuaagcccaaccuuguguuguccaguaugguagccacuagcuccacguggcuguuauauuuuuaauuuaacuaauuuaauuaaaaauuuaguuuuggccaggcacggucgcucacaccuguaaucccaguacuuugggaggcugaggcacgcagaucacgaggucaacagauagagaccauccuggccaacauggugaaaucccaucucuacuaaaaauacaaaaauuagccaggcauaguggcacgcgccuguagucccagcuacucaggaagcugaggcaagagaaucacuugaaccugggagguggagguugcagugagccgagaucacgacacugcacuccagccuggcgacagagcgagacuccgucucaagaaaaaaaaaaaaauuaguucuggccaggcgugguggcucacgccuguaaucccagcacuuugggaggccaaagugaguggaucaccugaggucacgaguucaagaccagccuggucaacuuagugaaacccccaucucuaccaaaauacaaaaauuagccaggcaugacagugagugcuuauaaucccagcuacucgggaggcugaggugggagaaucacuugaacccaggaggcggagguuguagugagccgagaucgcuccacugaacuccagccugggcaacagagcaagacuccaucuaaaaauaaaaaaauuuaguuauucagucacacauaugucacacauaugacaaggguuuuguuucacuucauuuucuuucaucaaccuguuagaaggacaagauuuaauaaccacauguaacuacugguuacccuguggacaaugugcauauaaaacauuuccaucaucauggaaaguucuacuggacagcacuaccuuaaacucuugaaggauuuuuuuauaaaugucugcuagauacgcggauaguuucuccuaguaacauuugaaaauucaucuuuaacuugaaaguuuuuauaaaugaagacuuucccccugaaauauaacuuguaauguggaaauacuauaaguugaucuuacaauucauauugggagaacagaaaacuguuguguuguaccuagauuacaaaugaacacuaagcuggaauacauacauuucacauucuucuuucuaagccucuaacccugugagccuuguauucguuugauaagcagcuauugagaaccugccaugugaagggcuuauguguuagacauacagcucaucuugguugggugauuguucaaaaacaucagauuaucaaaaacucaauugauauuuauagguugugaaaacauaccagugugacuaaaauuaaauauuucuuauuucagguuauguuuccaagagguaggguacauucuucagaauacauucaguuuucagagaucaaauacauuuacacuuguaccuuucagcauaaaagaaugauuucacuuccuuuguggauuucaaagccauauaaaaagagcuauguuccaaauuccuucaaacucuaaaauccucucugcccugagcuuuucaaucaagaaggauaagggcagacuuuuuaaaaucugaucucuacagcagugggucccaaacuugcugcacauugaaaucacccagggaucuucaaaaacuagggauacuuaccucccacccacccacaaccuauucaauuggucuguggugugaccuuggucucaguguuuuuaaggcuccccugggugauucuuauaugcagcaaaguuugggaacccacugcucuauagaaucaccagugaagccuuuuaaaacuuagauuccuuggcccuacacucagaguuuuuuugccuuacuuguuuuuguuuuguuuauucaauaggcagagaguagaacacaggccccuauaauuguaaaguauagcuggaguugaaaaccacugcuguaaaagaaucaauguucucucuccuucucuuucccuauaucuguacaucuuugaucauauuaaaaaauacaaccaagcgcaauggcucacuggcucacgcuuguaaucccagcacuuugggagaccgaggcuagcggaucaccugaggucaagaguucaccaccagccuggccaauauggugaaaccccaucucuacuaaaaauacaaaaaucagccaggggugguggcgggugccuauaaucccagcuacucgggaggcugaggcaggagaaucguuugaaccucagaggcagagguugcagugagccaagaucgcgccacugcacuccauccuggacaacagagcaagacuccaucucauaaauaaauaauaauuuuuuaaaauuuguaauuaaaaaacacaagagcauaucuacaaagaugucaaguaaaaaguccauaugaaaaaggccagaagaagguugggcaauacugguucuuccucuuuuuaaaauaacagcaacugugaacucugaaggcagaaacauagauugcucuugcuuuugagaaaaacaacagucuuagcguauagaaaauauaaaaaucugaugcccuaaauaucagugguauccaagcuuucuugaucaugcaagaaucaauaaacaggugggaggcucacaaucugaauguauauauauauauuguuuucuuuugagacagaguguugcucugucgccaagcuggagugcagugaugugaucuuagcucacugcaaccuccgcucccugaguucaagcgauucuccugccucagccucccaaguagcugggacuacaggucgcgccaccacauccagcuaauuuuuguauuuuuaguagagacgggguuucaccauguuggccaggauggucuugaucucuugaccucaugauccgccugccucggccucccaaagugcugggauuacuggcaugagccaccacgccuggccguauauuuauucuuaaguuaucuauauguacuaugauacuuauguauaucauaaaauauauacagaaauagacuuuuuaaaggauugauagaugaaauaaacagaauauacauaaaauuuacaucuuaauagaaaaaaacuucuuugcuauaacuuaaaaauuacaaauaauuuguuguuuuuauuuuuugagacagagucucgcucugucgcccaggcgggagugcaguagcgugaucucagcucucugcaaccuccaccucccggguucaagcaauucucaugccucagacucuuaaccagcuggaauuacugcugcgcaccaccacacccggcuaauuuuuguauuuuuaguagagacaggguuucaccauguugcccagguuggucucgaacuguuggccuccaguuaucugcccgccucggccucccaaagugcuggaauuacaggugugagccaccaugcccagccauaauuuguugauauaauaauauuuaaagggagcaauguguuugacuauguuauaguuaaugaucugccauuauuuugcuuggcgaaguaguugacaaaggacucaucaagaaaaguggcagcucagccggguacgguggcucacgccuguaaucccagcacuuugggaggcugaggcggacagaucacgaggucaggagaucgagaccauccuggcuaacacggugaaacucugucucuacuaaaaauacaaaacauuugccagacaugguggcacgugccugugauuccagcuacucaggaggcugaggcaggagaaucacuugaaccugggagagagaaguugcagugagccgaaaucgcgccacugcaauccagccugagcaacagagcgagacuccaucucaaaaauaaauaaauaaauaaauaaauaaauaaauaaauaaauaaauaaauaaaaauaaaagacacuuaaaauaaaucacuuacgcugggggcaguggcucacaccuguaaucccagaacuuugggaggcugaggcaggcagaucacuucaggucaggaguucgaaaccagccuggccaacaugaugaaaccccgccuuuacuaaaauacaaaaauuagccagaugugguggugcacaccuguaaucccagcuacuuggggggcugaggccggagauugcuugaacccgggaggcagagguugcagugagcugagauugcaccacugcacuccagccugggcaauagagcaagacuccaucucaaaaaaaaauacauaggccaggugcaguggcucacgccuguaaucccaacacuuugggaggccaaggcagguggaucaccugaggucaggaguucgagaccagccugggcaacauagugaaaccuugucucuacugaaaauacaaaaauuagucaggcaugguggugcaugcccauagucccagcuacucgugaggcugaggcaggagaauccgacuugaaguggggaggcagaaguugcagugagccgagaucaugccacugcacuccagccugggugacagagcaagacucucuuaaaauaaaauaaaauaguacuuaaacugcaauaugcuauaauacucugagggcaaacaaacaagugaggaugccauuauuaaccucucugaauugggggacucauacgauuuguaaucaccugacauacuccagggccaacauauuuauuaaauauuaauagaguguguuuuuuuauuuuuauaauaaaaaugaguaaaaauggaaauaaauagaaauaugucuuuccucaccccaacagaucaucuugcauaccccuauggugcuuuuacccugcuuuaaagaccacuacugcauauggcugcauacagaaaccuuguauugccuaauuuuuauaaaucauuucaauugaauaaagauuggauaauuaaacaugaauucuaacaggaccuuccaaucucuuuccuuuauccuuaugucaaccucugaaucugaccgugaaacuauauuuuagaaauagagaauucaggccgggcacgguggcucacgccuguaaucccagcacuuugggucggaucacuugcagucaggaguucaagaccagccuaaccaacauggugaaaccccguuucuacuaaaaaugcaaaaauuagccaggccugguggaguaugccuauaaucccagcuacuugggaggcugaggcaggagaaucacuugaacucaggaggcagagguugcagugagccgagauugugccauugcacuccagccugggcaacaagagugaaacuugucucaaaaaagaaaaaaaaaaaaaagaaagaaagaaauagauaaaucaaugcugcaggugacuucugacauucauaaagaauguuuaggguugacauuauagcucuacgaauacauuuuuacuuuuuccucuaaucugaaucauggacuuucuaguuaauauauuuuuuaaaaaaucaaacaacuaaauauuuaucauguauuuugcuauuuaauauuucaaaggaguugauuuaaaaauuuggaguuuacuaauuaaggugauauucuguaugaauucuggauagaguuuuagcugauacgguacagaucuaagcauuaacauagccguaguuuauccuaauuauuccuguuuucuucagcuuucuucacagaagucagugccguggguacccauuuuaaaaucccugccacuuugggcuaucguaguugcacacuuuucuuacaacuggacuuuuuauacuuuauugacauuauugccuacuuauaugaaggagauccuaagguucaauguucaagagguaagaaaaaauaaucaucugcuucuuauauauauaguauaagaccauacacagaauuuguucucaucuguauaaaauucaguuauucuguaucuuccauuuuacucugcuguccuaaauuuuagagauucuuauacaucaaaggacuauuaagaaaaugaaaaacaacccacugaaugggagaaagcauuuauaaaucaaacaucuaauaagggucuaguauccagacauauuaagaauucuuacaauucaauaauaaaaagacaacucaguuuuuaaaaugggcaaaggacuugaauacgaauacacauuucuccaaagauacacagauggccaauaagcacauguaaggaugcccgacaucaggccggguguaguggcucacgccugcaauccuaccacuuugggaggucgaggcagguggauuacuugaggccaggcauuugagaccagaccgggcaacauggugaaacccugucucuguuaaaaauacaaaaaaggccaggcgcggucgcucacgccuauaaucccagcacuuugggaggccaaggcaggcggaucaccugaggucaggaguuugagaccagccugacaaauauggagaaaccucaucucuacuaaaaauacaaaauuaaccaggcgugguagugcaugccuguaaucccagcuacucgagagguugaggcaggagaauugcuugaacccgggaagcggaaauuguggugacccaggaucaagccauugcacuccagccugggcaacaagagugaaacuccaucucaaaaaauaauaauaauaauaauuaaucccagcacuuugggaggcugaggcagaaggacugcuugagcccaggaguucgauaauacagauuggauaauacagcaaaaccgucucuacuaaaaacacacaaaaaaauuaaccgggcaugguggccuacaccuguaaucccagcuacuagggaggcugaggcacgagaaucucuugaacccaggaggcgaagguugcagugagcugaggucaugccccugcacuccagccugggcagcagaacaagacucugucccaggaaaaaaaaaaaaaaugcuaacaaggcugacugcacaacugcacuggcuacauggacuuaccugcuuuaaaaacuauuaaagugaauccucagucacucacauuccaaaguauaccauaaacauuggccuggcuauguggaccaaaccuuaaaacuucaggcagcuaagcugugaagaacuccucugucuacuucugaaaaacaagaucacuauauagaaauauuuccacaaauugcacugacagaaguuaaauugaaacuaggcuuuggcaacauaaugggauggauucauugugagcaaucuuauuuuucccaaguucucuguuaacagagccugauuauaaucuacuacuacauuucaacuauaaaguggggcugauuuuuaaaaaagaaagaaauaaauaauauacuacuacagugauuaauugcauucaacugugcauugaaagguuaauuugguaauuaucauuugggguaaaacugagauccacaggaagauuaaaaauagcaaauccagccgggcccagugguucacaccuguaauaccagcacuuugggaggccgagguggguggaucacuugaggucaggaguucaaggccagccuggccaacaugugaaaccccaucucuacuaaaaauauaaaaauuagccaggcaugguagcaggcacuuguaguccuagcuacucgagaggcugaagcaggagaaucacuggaacccaggaggcagagguugcagugagcugaggccaugccauugcacuccagccugggcaacagagcaagacuccaucucaaaaaaaaaaaaaaaaaaacaaauucucaaaaucauauuaacaaaauaucuuauuuuacuuauaaaguauauuuaaagauuacuacacugauguuucuauuugagauuuuccaggaagaacuauauauggaagaaauaaaauaucaauagcuggccaguaauuaauguuguguacuuuaaaacaaggaucuuuuaucuugcauuuucauagacaaaaagguuuaucuuaauuaaaauuaaaagaaaugugaauauaggaccuucuuucauucuguaaaauaaaaagaaaugugaauagaguuugaaaauaauucuauaauuauauagccuauuuuuuaauugauuuuuuuucuugaaaaucaauguguuacauucaugaaauggccuagguguuuuuguuuuuguuuuuuuuaaauaguagagaugggguuucccauuauuguccagguugguuucauacuccugagcucaaaugauccuccugccucagccucccaaaguguugggauuacaggcaugaaccacccugccuggccaucagauggccuuuguucaaaauaagcuugcuuugagaagcguggcaugccuccuuuuauugcacuuugcuuuauuauacucugcaaauauuguauuuuuuaugaauugaagauuugugcuaacccugcauggagcaaauccguuagcaccauuuuuccaacagcaugugcucacuucagggcucuugaucuuugaaguuaguguuguaauuguuggggggcaccauaauccuuccccauauaagauggcaaacuuaauaaauguugagugucuucugacggcucugccaaccagccacuaccccaucucuuuccuucuccuugagcuucccuauucccugagacacaacaauauugaaauuaggcugguuaauaacccuacaguggccgggcgcaguggcucacgcaccuagcacuuugggaagccgaggcgggcggauugccugugcucaagaguucgagaccagccugagcaacacggugaaaucccaucucuacuaaaauacaaaagaaguuagccaggcauggcagcucgugccuguaaucccagcaccucgggagacugaggcaggagaauuccuugaaccugggaggcagaaguugcagugagccaagaucacaccacugcacuccagccugggugacagagcaagacuccgucuguacagaaaaacaaaauaaauaacccuacgauggccugcaaguauucaagugaaagcaagagucacauaucucucauuuuuuuaaaucuuuuaucuaaaauguguuuauagagaugguuuuccacucaucuugauucagagugcucuuagugcugcuuccuccugaaggaacauccuuccauaagccuugcuuuuccuccuguaggcuggcagaggacaguagagcacccaacacacaaaacuacuguuugugcaugaguaaagaccgugaugauuuuauagcguccugggcacuucacauccaugaaguaggaauuagugcucugcaccaggcauuucuucuuguguuuccucuucuccucuucuggagagggaugaaggaaauuuuuugcaagagguguguucucgucgguaggucgucacaaccagaaacucauuuuauuuuauuuuauuuuauuuuauuuuauuuuauuuuauuuuauuuuauuuuauuuuauuucauuuuauuuuauuuuaagacugagucuugcucuguugcccaggcuagaguucagugguacgaccucagcucacugcaaccuccaccucccggguucaagcgauucuccucugucagccucccaaguaccugagauuucaggugugugccaccacaccuggcuaaauuuuuuauuuuuguagagacaggguuuuaccauguuggccaggcuggucucaaacuccugaccucaagugaucccuuugccuuggccucccaaagggcugggauuacagacgugagccaaugcgccugcaaaaaaauuggaaucaauuuuuuuaaauaaaugaauacaagggaucuuauccuugaagagaaaacuuaacaacuguggaaggugccuguggaauguauaaaugcugaagacuuuaguguauuuagguuguugcccaggcuggagcgcaguggcgcaaucuuggcucacugcaaccuccgccucucagguucaagcgauucuccugccucggccucccuaguagcugggauuacaggcauccaccgccacaccuaauuuuuguauuauuaguagagaugagguuucaccauguucaccaagcuggucucaaacugcugaccucaggugaucugccugccuuggccucccaaagugcugggauuacaggcaugagccaccgugccuagccggcaguuuuuagcauugcaacuugaaguggcaauauuacuaacugugaggaauuaucaaccuuaucccaccaggaaacaaaaucaagaucagaaaauucacuuaucugauuuacuacagcuuauucuuuuuuacuuuccuacuaauauuuugaaaccauuuauucuuauacaggauuuugccacaaauaaugauagaugugaucccaccgugcagaagucuaaauggaauuguguuuuuuuuucuuuuuuuuguuuuuuuucuuucugagacagagucuugcucugucacccaugcuggacugacugcaccagagcaaucuugguucacugcaaccuccaccucccagguucaagcgauucuucugccucagccucccaaguaacugggauuacagucauguaucaugaugcccagcuaauuuuuuguauuuuuaguagauacaggguuuugccauguugaccaggcuggucuugagccccguccucaagugauucuuccuccgcggccucccaaagugcugggauuacaggcaugagccacugugcccagccaagcuuuuuuuguuuguuuguuuaagggaaguagaauaggcaaugcuugaugauuggacgcgaaaaaugagggaaaagaaaccaucaggaaagacucucagaggccaggcgcgguggcucaucccuguaaucccagcacuuugggaggcugaggcggccagaucacuugaagucaggaguucgagauuagccuggccaacauggcgaaacuccgucucuacuaaaaauacaaauuagccgggcguggugacacacgccugcaaucguagcuacucaggaggcugaggcaggagaauugcuggaacccagaagguggagguugcaaugagccaagaucacgccacugcacuccagccuaggcaacagagcaagacucugucucaaaagaaaaaaaaaaaaaagacucuccaguucuguuaaaaauaaacguguguguguguguguguguguguguguguguguaguaaauaaacauguaaugcacuuuugaguuauuguuuuacugggcaccgauaaauuuuaagaaauagauaaauuguaagaaaaaaaugaauggaagggaacuuacagauuuaaagagacauaaaaggcaaaucaaaaaaauuuuaauggccaagacuaaaucgaagugucuagggauguacauuugggugauguaacuauaaauaaaagugaguacaugauuacuauacaccaaaacgagguuaaugcuuauuuaaggggggaggaagagggcucugauaggacuaggaccaugaagugucuucuggcaaggcuggcaaaguucuauuucuugaccuagauggucauuagaaagacucaugaggccgggugcgguggcucaugccuguaaucccaguacuuugggaggccaagguggguggaucacaaggucagaaguucaagaccagccuggccaagacggugaaacuccgucucuaauaaaaauacaaaaauuagccaggugugguagcaggcaccuguaaccccagcuacucgggaggcugaggcaggagaaucacuugaacccaggaggcagagguugcagugagucgagaucacaccccuguacuccagccugagugacagaguaagacuccaucucaaaaaaaaaaaaaaaaaaaaaaagaaugauucauuaagcuauguuuaugugguuuucugcaucugcauuuuauuuuauaguaaaaaaaauuuuuuuuaaauaaaugagugagaauggaagaugaaaauguucaguagggagaauccauaggcuaacaggaagguuugucuucucucacaacccagaucccagagaaacagucaagauuacccgaagcagacaggacuagggcaaggcuuauuucccucugagacagacucuuagggacugccuuggacugaacccuauaauccuucugacagccagacuuauuuacuguaauuauauuaaaaaauuaacaacauauugcuaugcauuuccuuugcuuucaagugguggucauuggcugugaugaauguguauguuuuguuuuuuucucucaccguaauuaauccuguaucuucuuauuccuuccagaauggguuuuuaucuucauugccuuauuuaggcucuugguuauguaugauccugucuggucaagcugcugacaauuuaagggcaaaauggaauuuuucaacuuuauguguucgcagaauuuuuagccuuauagguaagugaagcaaucagguuuuguuuugguuuacaguuauuuaccauguuuacaguuauaggagauaggaaaacaaaguguguuucccacuuuuacacacaguuaacacaauacucaacacagaacaccucgcucuaaucaccaaaauguuuguggggauuucugccuacacauaaccaguucugcagcggacaccagcuagguauccuguaauucaguucugacacuguccagcuggcgguagcaucagauccuauagguugagggcucaguuccacaagaucgccccccuacuucggauaccaaucacaagucccagcuugugaccucugcuucugacugaccggcuauaaaucaggguucccaugacugucuugucagguucaguuaaucugcuagagcaucucagagaacucagagaaacacuuuauuuuauguuuacccacuuauuauaaaggguauugcaaaggauauagaugaacagccagauggaaaagcugcauagggcaacauaugugggaccggguagggaguuuucaugcccucuccuggaacaccacccuccaagaaccccgaccgcaaaaguucauccaaacccugucccuuugaguuuguauggagacuucguuaaauguguaugauugauuaaaucauuggccauuggugacuggcucaaccuucagccccucuccccucucuggaguuuggggguggugccaaaagucccagaccucuaauccagccaccauccugaagcuguauggggacccccagccaccaauugucucauuagcauacaaaagacacuguuaccacuccagaaauuccaaaaguuuuaggagcugugugccaaaaaaccgggggcagagaccaaauauauauuucuuuuuuaaaacaauuuuuuaauagaaauggggucuugcuauguugccccgucuggucuugaauuccuggccucaagugaucuuccugccucagcaucccaaaauguugggauuacagacaugagccaccacacuggccauauuucuuuucuuauuuuuuuucuugagacaggggcucacucuuagcccaggcuggagugugguggcaugaucuugacucacugcagccucaaccuccucagccucaggugauccucccaccucagccuccugaguagcuaggacuacaggcacacaccaccauacccagcuaauuuuuuaauuuuuacugaagacgggguuucaccacguuguccaggcuggucuuuaacuccugaacucaagucaucugcccgccuuggccucccaaagugcugggacuacaggagugaggcaccacacccagccccagccauuuuguuuaauuucuuucuuuaaugggacaaggucucgcuuuauugcccacauuggccuugaacuccuggccuucagcaauccugcugcuucagccucccaaagugcuaggauuacaggugugagccaccacacccagcccccagccauauuuuuuaaaaucacaauaucacaacaguucaagacaaaauaaaaaugauaauauuagucuuuuauuuuguucacauaacaaaacacuaugaugcauuuaagugcauuucuuuacaauauguuucuuuuugaaucauacauuuugaggauuaagauuuauaauauucacugggcgcaguggcuuaugccuguaauccuagcacuuugggaggcugaggugagcagaucacaaggucaggaguucaagaccagucugaccaacauggugaaacccugucuacuaaaaauacaaaaauuagcugggcgugguggcaagugccuguaaucccagcuaccugggaggcugaagcaggagaauugcuugaacccaggaggcagagguugcagugagcugaaaucgcgccacugcacuccagccugggcaacagagugagauccugucucaaaaaaaaaaaauuuauaaaagauuuaucuccaccauggcuuauaauuauuuuuaaaauggcuugcugugccaaacaucaucccucacaauuuuauauaucacugugcuuucagcucagacuuugcaaugaagauuuuuauaucaacuuuagacaagauguaaucaaaguauuuuuaagccuccaucccuuuucuaagugaaugcauuuuaaguuucaauccaaaaauauuuacuagcauuauuauaucaaauaaggagcuauaaaucaaagaacucaaagaacccauaaauaaucauguguuucagacucugcuuucagaaagguaauuuuuuuuuuuuuugagacagggucuugcuccguuggccaggauggacaaccauggcucacugcagccucaaccuucuaggcacaaguaauucucccaccucagucuccugagcagcugggacuacaggucacgccacagcacccagcuaauuauuuuugauuuuuuguagagacaugguuuuaccauguugcucagguuagucacaaauuccugggcucaagcgauccucccaccucagccuuucaaagugcuggaauuacaggcgugagccacugugccuggccuagaaagguaacuuuuaaaacuaucuaaucaguuaggcaugaugguauguaucuguagucccagcuacuccagaggcuaaggugagaaaaucucuugagccuaguuguuugaggcugcagagagcuaugaucacaacacugcacuccaaccuaggcaacagagcaauacccuaucucuaaaaauaguuagaaaaaaauguacguagaaauaaaacugucuaagacaaucauuuaacuuuuuaaaagucuccaguagagacccuggaagucucagugacuauacuucaguaauuacauuauaaaaagacccuggcugggcucgguggcuguugccuguaaucccagcacuuugggaggcagaggcggaggcaggcagauacuugaggucaggagcucaaaaccaggcuggccaacauggugaaaccccaucucuaauacaaagauuagcuuggcguggugguguguggcugucccagcuauucaggaggccgaggcaggagaauugcuugaaccugggaggcagagguugcagugagccaagauuucgccacugcacuccagucugggcaaaaagagugaaaaaaaaaaaauuagccaggcaugguggcacaugccuuuaaucccagcuacucaggaggcugaggcacaagacuugcuuacaccugggaggcagagguugcagugagcucagauugugccacugcacuccagccuggguaacagaaugcgacccuauuucaaaauaaauaaauaaaaguaaugaaauuaaauuaaaucagacaugguggcgugcaccuguagucccagcuacucaggaagccaaggcagaggaucacuugagccugggaagucaaggcugcagugagccaugaucgcaccacugcacuccagccugacgacagugagacccugucucaaaaaaacaagaaaauaaauaaauaaguaaauaaauguaauugaacuuuuuuuaaaguuccucaguugcaguauauacaaauacaacauuuccaucaucacagagagcuauuggauagcacugcuguagacacagaaaaacugacagcccacucauuaagucucuucucauauuuuacgcuuaacugccuguaaugaccaauguguauucuuaucaguuguuaauaauagggaggauuccugcauauuagguggggcagaaaaaaaaaaaaccaaggccgggcaugguggcucacaccuguaaucccagcacuuugggaggcaagguggguggaucgcuugaggucaggaguucgagaacggccuggccaacauggcgaaaccccaucucuacuaaaaauacaaaaauuagcuggguaugguggcccaggccuguaauuccagcuauucaggaggcugaggcaggagaaucacuugaaccuaggaggcagagguggcagugagcccagaucacgccacugcacuccagccugggugacagagugagacuccagcucaaaaaaaagagagagagaaugaagacagagauuuuaaaaaaucuuuuuaagaaacaaggucuugcucugacaacccaggcuggagugcaguggugccaucauagcucacuguaaccuugaacuucugggcucaagcaauccucccaccucagccuccugagcagccaggacuacaggugugcaccaccaugccuggcgaauuuuguuuuuaauauuucguagagacagggucuugcuguguugcccaggcuggccucaaacuccuggccucaagugauucucccgccucagccuccuaacgugcugggauuacaggugugagcugccacacccaggcaagauggaguauuauucuaaccucauccaacagaguuuauuauucaguuuaucuccuuugguuauauguauuuuaaaccacauucugugucagcuauugcuucucucuagaaacauauuuuuaaguuguucuugucuuguucuucucuaacaccauggaauuuuagcugaguuuuggccacauguagauuuaauaacauugcauaaugagauuuuccuuuuauaguauauuaguuguauuacgcccauguuuuccagcauuuuuuuuuucucaugaaauuuguuagucuuccaggcaauauaguguuucuacaguagguggcagcaauuucaaauuucagauuuauaccauauuaagguagagcaaauauuaaugcuggguguuuuuucccuuuuauaacuuuuuaacuccaggaaugauuggaccugcaguauuccugguagcugcuggcuucauuggcugugauuauucuuuggccguugcuuuccuaacuauaucaacaacacugggaggcuuuugcucuucuggauuuagcaucaaccaucuggauauugcuccuucgugaguacuaauauaaagauuugcugugauugacuuuaaauuauauuuuuaaaaauccugauaaaaggccagaggcggugacucacaccuguaaucccagcacuuugggaggccaaggcaggcagauaaccugaggucaggaguuugagaccagccuggccaacauggcgaagcccuaucucuacuaaaaauacaaaaauuagccaggcaugauggcgggcaccuguaaucccagcuacuuaggaggcugaggcaggagaaucgcuugaacccaggaggcagagguugcagugagcugagaucgcaucauugcacuucagccugggcaacaagagcaagacuccaucuaaaaaaaaaaaaaccugauaaaauagauaugauauaaaacuuaccauuuuaaguaugcaguucuguggcauuaaguauucacauuguuucauaacuagcaccaccaacaaucucuagagcaauuucaucuucucaacagaaacuguacccguuaaacacaaucucccauuucuccuuccucccaggcccuggcaaccaacauucuacuuucugccucuauggauuugacuacuauaggaaugacuuuaaauucuuaacaggauuuuaauuuacacaauaauuaaagcaggaaguuguuuuuaaauuuaaacuuuuaacuaucaucaccucuguccacagugcucucauuagaacauugcaauaacucauuacugugucuguucacccaacuagacuaggaacucugugaaggcagaaacucccuuauuguccucagggcucuccauggcacuuggcauguaguaggcauuuugucagaugaaugaaugugaaagaguagacccaauugauuugucuaacuauauuaccuaugugcaaauauauuuguguagcccuugauaguuuacacaucacuuucauaaacacuauccauuuuacccuuaaagcauuccuuugaaguaaguauuuuugcccuauuugaacgcuaaagaaacuuaagagaaguuaagugauuuaucuugcagcacacagcuaauauaauaaaugauagagccaaaacuugaaccuaaaauuuuuacuuuuaagcccaaaauucuuucuacagcuaccucucuggaaauauucuuugagccacauacuucuaaaaccauuuugugccagcugacaagguaaauaagggagcuauguaaauauuuuaacccaaaaguuuuaauacacuuuauuuguaaaaauaauagauauaaauuuauuuuggagaaaagacagauggacucuuacccucuuuucacuaccucaaaaucuucacaccuggacuccuacagaaucuucugauuucuaugaauccucagucuccuaucucuucaauaaauacucuaagauaagcugcacucugucacccaggcuagagugcagugacgccacuguaguucacuguggccuugaacuccugggaucaaguaauccuuccugcucagccuccugagucgcugggacugcaggcauacaucaccaugccugguuaauuuuucaaaaaauauuuuguagagauggggucucccuaucuugcccaggguggucucagucuccuggccucaaguaaucuucccgccucagccccccgaagugcuaggauuacaggcgugggccacagcaccuggccaagacuugagguuuugucaagccuaggauugacgaauagucaaagggauaugggaauugagaguuuuggcaagaaauaguucuaggcuauguuaucgcuuaggauguuuuuaguugaaguauagaaauucuaauuuaaacugggcuaaacagcauaaucuauugauucacuuaauuguauccagaaauaauaggcuucaggcaagaguugauauccagcugccuacuaauaucaccacagauuguuucuuucucacucucugucuuuuacaguaguaguuuuguccuaagacugggucugcuuauaaaaucacacaaugaaaugauugccagcaacaaucaggacuacaugcuucuucauucacaucaagcagaaagaaaaggaucuuuuccucucuccaccauggaaauaaguccugggcuucauuuugguugacccaaacugagucacaugaaccaaccccaauggccaagagaauaucaugugacuuuaggacaaucagcaccuaccccaaaaguuagaagucaaagggucagugccccucagacaucacuauugcuacacagauggggguggggagugggaauggaugcugaggaauccaucgguaacauccauuauaacacaugaagauguaaauaaacaugagucauuuugagccgggcacgguaguucacgccuguaaucccaacacuuugggaggcugaggcggguggaucaccugaggucaggaguucgagaucagccuggccaacauggugaaaccccaucucuacuaaaaauacaaaaauuagcagggugugauggcacacaccuguagucucagcuucucaggaggcugaggcaggagaaucgcuugaacccgggaggcagagguugcugugagccaagauugugccacugugcuccagccugggugacaaagugagacuccaucucaaaaaaaaaaaaaaaaaaauuauaaggaacauaaaauugguucagcagccauccagccagaaggugguaagucacccacaccauuuaauaaaucugaaagguagcuuaggauucaucagguuccugaagucuuauuagaaucucuggaaucugaugagggcccccccugcucucuugaacuagcaaugaaagaaaauuggaucaucggauaaaaauuggagcuauggucggccggguguaauggcucaugccuguaaucccggcacuuugggagaccaaggugggcagaucaccugaggucaggaguucaagaccagccuggccaacauggugaaacucugucucuacuaaaaauauaaaauuagccagguggggugguaggaccuguaaucccagcuacuuggaaggaugaggcagaaaaucacuugaaccugggagguggagguugcagugagcaauugcacucuagccugggugacaagagugaaacuccaucucaaaaaaaaaaaaaauagugcuauugucaaaagaugaaaauagaugcugaagaaaaagaaaaccaaauauccaugguaccuaccuuauaagaucguugugaagauuaaauagaacacgcacagaacacuuugcucauaaugcaauaaagguauuugcauauaaugcaauagauguaauuauuuucuggcuaacuuugagucagguguggugaccagggucacagaucaauccaaguaaaauauuaaagugaugauuggugugcuuucagaaaggaaaaugcugaccacuaaagagccaccauugggucacuaagagccaaaauggcaaaacagucuaacuucucaacauaauuuuuagccuaauagaauaaagaaaauauaguagauuugauaugucaggacuucagccaggccuccuaugauagaugccguuuuggacaagguggagaaagaugaauuggauguacaauuagauaaauuugucacuacuaaauuucaguguaauagcaugcucauuaacggaucuagucauuugagaaacacugugccaggcacuguaccagauguugaagacacaaacaugaaaguaacaugauuccugcuggcaucuguauaagcuuaagcuggccuggaugauggugggucaugucaugaaguauaaugcuggacaggcagcagggggauccugugccugagcuucaagcaucaggugggugguugaagucuacaucuuaaagacccagguccaacccugaaauuuuaugagucuuauaagccgaaaaagacauuuaucuagauaucauaagaagcuaaacagguuuaguaacauaaaugaugccagcaaauaguuguagcaguugggaggaugguaagcaagugccuuugugccucagauaaugaggacugcuguacugguucucagcugacugagacacaacuauuccaaauguaaguaggcccggugagguggcucaugccuguaaucccagcacuuugggaggcugaggcgguuggaucguuugagguuaggagcuccagaccagccugaccaacauggugaaaccccaucucuacuaaaaauacaaaaauuaaccaggugugguggcgggcgacuauaaucccacugacucaggaggcugaggcaugagaauugcuugaacccaggaguuggagguugcagugagcagagauugugcuacugcacuccagccugggcugcagagugagacucagucucaaaaaauuaaauaaauaaauaaauaaauaaaucucaucaaauucaaaauuauuauuauuuguuuuuuguuuuguuuuguuuuugagauggaguuucacucuuguugcccaggcuggagugcaauggugcaaucucagcucaccgcaaccucugccucuuggguucaagugauucuccugccucagccucccaaguagcugggauuacaggcaugugccaccacacccugcuaauuuuguauuuuuaguagagagggaguuucuccauguuggucaugcuggucucgaacucccgaccucaggugauccgccagccucaaccucccaaagugcuaggauuacaggcgugagccaccaugcccagcccaaagucaaaauuauuuaucucccuuaguguguguguguguguguguguguguguguguguguguuuaaaccuugcaguucuagcucaaaggauaacuuucuuauauuuugauucagcucuucagaugagcuuuuuaguuuuucuuuuccaacuggaauuucuucauucaaagcacaucaguuauuucuaguugcaggagucuuggcuacauaucuuauuggggauuacauaucuuagguuuuucauaguugcuuuuuguugugguaacaacugagggcccauucaguguaauacgcuacuaguuaaaacagaggcacuugaggaccauaaacaagccauaaacaaguucaacaccagggcuuguggugaaaaaugaagcaugagaaaauuuaucuuuccuacagauuggguucagugauuacuguguuuuguuuuuuuuaacaagguagcauuguagauuauaacauuauaauauuaaguacugauucagaaucagacaaauugggugacauuuuaugguuuuucuucaucuauaaaaugaagauaauccagcugggugcaguggcucucgccuguaaucccaggacuucggaaggccaaggugggaggaucguuugggcccagcaguucaagaccugccugggcaauauagcaagaucguaccucuaaaaaacuuaacaaaauuuuaaaauuuuaaaaauaaaaugaagauaauccuuccucaugggguugauuuuauaauuaaaaugauauaauaugauauauaaaacccuuauaaacaugucugauaucagguuuuccaauacauagucaguaaacagauacaagguuuuccaauaaauaauauuccuauuaacauauaaauguguacuuggauuuuauaggccuuuacuucuauagacugaaauagagauuuuauguuaucaauguauuuauuaucuuuugaggcagagucacacccugucacccaggcuggaguacagcagcaagaccacggcucacugcagucgcaagcaauccuccugcaauccuccaccucagccuccugaguagcgagcgggucuacagccugagccaacacacccagcuaauuuuguguguuuuuuuaguuuuuguagagagaggguuucaccauguugcccaggcuagucucaaacuccugggcucaagcaauucucccaccucagccucccaaaaugcugggauuacaggcaugcaccaccacacccggccccaaaauagagauuuuucuaugguaauuuuguugcccgaauucaugggaauuagauagauuuucagcuauuaauuccaauaguacuccaacagcacagaauccagacugaguccauacaacuuguuuucuuccaaguggucaucaaucuuucauggccuguccuggccaagugaaauauaaguacuugaaugagcuucuuguugcugacauuuagaauuucauggcauucgucugcacuuaauaucugucacuggaaaggcuggcaacauugcaguugacuccucuuacugccaagguguuaaugguuuaaaaagaaaaaaaaaaaagagaggcucugccaagcuugguuaauuuagauacaccccuaaaggggaugagccaaaaagaucuguacuucaugguuuuguuauagugcuguguguaugcacaaguuuugaacauaaaacuuugugaucuuuauacauaacugaauuaguuaagcagcacuuuuuuuaacugaacuccuccuucuccuuuaaguguuuuuuuuuuguuuuuuguuuuuguuuuuguuuuuuaccaaaaacauuaaaccuaaaucuaaugaacccccuaggaucuagagucuagaaacuaucaguguacaggaaauacaggagguauaagauuaugugaaaugauaccuaagagauacaaucuucaaaguccagaauucaugaauauauacaggacaaacauccuaguaaagggacagcaauuuuaggccaggcgcaguggcucgcuccuguaaucccagcacuaugggaggcuggggcagguggaucaccugaggucaggaguuugagaccagccuaaccaacguggugaaaccccguuucuacuaaaaauacaaaauuacccagguaugguggugcaugccuguaaucccagcuacucaggaggcugaggaaggagaaucacuugaacuggggagguggaaguuguaaugagccaagaucacaccauugcacuccagucugggcaacaagagugaaacucugucucaaaaaaaaaaaaaaaaagaggcagcaauuuuaaaaaugaauuaucgggccaggugcaguggcucacgccuguaaucccagcaauuuggcaauuugggaggcugaggcagguggaucaccugagaucaggaguucaagaccagccugaccuacauggcaugcguguauagucccagcuacuugggaggcugaagcagaagaaucacuugaaccuaggaggcggagguugcaaugagcugagaucgcgccacuguacuccagccugagcgacagagacuccgucucaaaaaaaaaaauguaauuaauggaacaagcaaauuuuauguuugauaugaucucacgucuauaauaacauacuagaaauauauacagacagaaaaaaauaggauauuuaugaaaauguuaauguugaucaucucuauggggaagaauuauagguaauuuuacuucauuauuuuuuucuuuuuucguauuaauuuucaaaaauuaauuacaauugaauuuucaaaucaggaaagaaauuuuuuuuaacuuaaaaaacuuuaagcuagacaugcuaagcuuucuguaugaaaaugauaucucagaacuuuccuauaucacuauaaaaagggguuauuuccauggcuguguuccuguauguaauuuuuuuuuuuuuuuuuuugagacggagucucgcucugucggccaggcuggagugcaguggcgcgaucucugcucacugcaagcuccgccucccagguucacgccauucuccugccucagccucccgaguagcugggacuagaggcgccugccaucacggccggcuaauuuuuuuguauuuuugguagagacgggguuucaccauguuagccagcauggucucgaucuccugaccucgugauccacccgccucggccucccaaagugcugggauuacaagcgugagccaccgcgcccagccuuccucuaauguuaauguuuuuuguuguuguuguuguuguuaauuuuuauuuuuuuuauugaucauucuuggguguuucucacagagggggauuuggcagggucauaggacaauaguggagggaaggucggcagauaaacaagugaacaaaggucucugguuuuccuaggcagaggacccugcggcguuccgcaguguuugugucccuggguacuugagauuagggaguggugaugauucuuaacgagcaugcugccuucaagcaucuguuuaacaaagcacaucuugcaccgcccuuaauccauuuaacccugaguggacacagcacauguuucagagagcacaggguuggggguaaggucaccgaucaacaggaucccaaggcagaagaauguaucuuaguacagaacaaaaugaaaagucucccaugucuacuucuuucuacacagacacggcaaccauccgauuucucaaucuuuuccccaccuuuccccccuuucuauuccacaaaaccgccauugucaucccagcccguucucaaugagcuguuggguacaccucccagacggggugguggccgggcagaggggcuccucacuucccaguaggggcggccgggcagaggcgccccucaccucccggacggggcggcuggccgggcagggggcugacccccccaccucccucccggacggagcggcuggccgggcagaggggcuccucacuucucaguaggggcggcugggcagaggcgccccucaccucccggacggggcggcuggccgggcggggggcugaccaccccaccucccuccuggacggggcaucuggcugggcggggggcugacccccccccaccucccucccggacggggcggcuggccgggcagcagggcuccucacuucccaguaggggcggccgggcagaggcuccccucaccucccggacggguuggcuggccgggcggggggcugacccccccaccucccucccggacggggcggcuggccaggcggggugcugacccccccaccucccucccggacggggcggcuggccgggcgcggggcugacccccccaccucccucccggacggggcggcugccgggcggagacgcuccucacuucccagacgggguggcugccgggcagaggggcuccucacuucucagacggggcggcugccgggcggaggggcuccucacuucucagacggggcggcugggcagagacgcuccucaccuuccagacggggucggggccaggcagaggcgcuccucacaucccagacggggcggcggggcagaggcgcuccccacaucucagacgaugggcggccgggcagagacgcuccucacuucccagaugggauggcugccgggaagaggcgcuccucacuuccuagaugggauggcggccgggcagagacgcuccucacuuuccagacugggcauccaggcagagggucuccucacuucccagacgaugggcggccaggcagagacgcuccucacuucccagacgggguggcggccgggccuaauguuaauguuaaaaugcuacuuaacuauugaaaugcaaguuuuucaccagcugaauauaaaaucccauugcaauaagacauuuuauuuagacauaaaauuucacaagaacacaaccuggagcagaauagcugucuauugaaagaagcagccaggcgcuguggcucauacuugaaaucccagcacuuugggaggccgaggcaggcagaucacuugaggucaggagcucgagagcagccuggccaacauggugagacaccggcucuacuaaaaauacaaaacuagcccagcaugaugguggaugccuguaguccccgcuacucaggaggcuaaggcaugcuugaacccgggaggcagaggcugcagugagcugagaucaucccacugcccucaagccugggccacagagugagacucugucucaaaaaaaaaaaaaaaaaagaaggaaagaaugaagcuguuuaaauguguaucacaauaauaaacgucuaugaaaauguuucuacagguaugcugguauccuccugggcaucacaaauacauuugccacuauuccaggaaugguugggcccgucauugcuaaaagucugaccccugauguaaguagauaauuuacuuguaaacuggaaagguuuuggagcugcacaucugugucaaaguucaguguauuuuaauuaaguuuaaaauucuaaauguucuuaugaaauucuuuuuagcaacaaaaagcuaaaugccuuaauggaugggaaaguauauuuucaaagaacaguuuuuggauuuuagacaaaacaauugaacuaagucaaaugaagacacuguagcugaaaccacacaaguaguuaaaaguugugauauuggccgggugcaguggcucaugccuguaaucccagcacuuugggaggccgaggcagguggaucacgaggucaggaguucaauaccagccucaccaacauggugaaaccccgucucuacuaaaaauacaaaaauuagccggugugguggcaggugccuguagucccagcuacucaggaggcugaggcacaagaaucgcucaaacccaggaggcggagguugcaguaagccaacaucaccacugcacuccagucuggcaacagagcaagacuccgucucaaaaaaaaaaaaagaauuucaggacauacuuacagacuuucuuauuaccaaauauacugauuucagacauauauccgacagauaguguuccuacuucuucuccacaucuaccauuucuaauuccuuaagugacacgguaccuguuacuauuuccucucacuuaauaaaaaggaauguuguagaaaugcuuuuucuaaaguucugugucucaauauggacauguccaaaauguuuaaccuuguccucauggagcaggguggcaacaccagaaccuaagucagcucacuaccauguguucauuucacuuacugauaaugccagcacuucugcuagggaaauauggauuccugaauuacagucuuguauguuuacaagugggaacugcgcuugauuugggauauguuacagcauuuguuuaaugcuauuaaaaggauaucacuguuuuagcugggugugguuuguaccuguagucccagcuacuuaggaggcugaggcagguggaugcauaagcccaggguuuugaggcugcagugagcuaugaucaugccucugcacuccagccugggugagagcgggagacccugucucaaaaaaauaaaauaaauaaaaaauaaaaauaaaaaaauaaacaaaauaaaauaaguuucgcacuccguugcccagucuggaguacaguggugcagucucagcucacugcaaccucugccucccaaguucaagcgauucuccugccucagccucccagguagcuggaacuacaggcacucaccaccaugcccugcuaauuuuuguuuuuuguuuguguguguguguguuuuuugguuuuuuuuuuugagacggaguuucgcucuuguugcccaggcuggaguacaauggcgcaaucucagcucaccacaaccuuugccucccggguuccggcgauuuuccugccucagccucccgaauagcugggauuacaggcaugugccaccacgcccagcuaauuuuguauuuuuaauagagacggagcuucuccauguuggucaggcugguuuggaacucaggugauccgcccaucucggccucccaaagugcugggauuacaggagugagccacugcacccggccaaauaaaacucuaaaguauauuauuuuuaaaaaggaaaagcacacacuuaccuucacaauuguaauuucuuucuucuuuuugagaugaagucucacucgucccccagguuggagggcaguggcgugaucucagcucacugcaaccuccgccucccagguucaaacaauucuccugccucagccucccaaguagcuaggacuacaggcacgugccaccacacccggcuaauuuuugaauuuuuaguacagaugggguuucaccauguuggccaggcuggucucgaacuucugaccucaaaugauccacccgccucagccucccaaagugcugggauaucaggcaugagccaccgcgcccagccuguaauuucuuacuuugagcacugccucaaaaacuuuguggaaugagucagcauauaaauaaauaaugcaauaauuaaaauucaaagugugucugagguucaauguuguuauaaacaaaacaguauucucuaaaaacugguggaauuuuuguuaaaaaacaaacuaggagcugugugagacuuguaguacaacgauugauuuuaaguucacucauugccuucagauaacacugaaguauuauuuugucccagagaccacacagggcagcuuugucuuaguaauccuaagaagcuguuucaaacauuucuuucugguauaagauguaauuauugacugauuccucagcagaauuuaagaugaguaucuaagauuuuuuuucauuaaaaugcacucaucucagacaaguauagccaccacaggguguuucuuucuucauguuucuccuuuuuucccaaauaaaugaccucauacuggcuucccagugccuucucuuucacuuccucauugcuaguucuacugcuuguuuguuuggguuuuuuguuuguuuguuuguuucuuuguuuuuugagacagggucuccaucgcccaggcuagagugcaguggcgcaaucauggcucacugcagccucaaccuccccaggcucaggugaucuuccuaccucagccccccaaguagcugggacuacagauguacacuaccauguccagcuaauuuuccuacuucuuguaaagaugggguuucaccaccuugcccaggcuggucucaaacuccagggcucaagguagccaccuaccucggccucccaaagugcugggauuacaggcaugagccgccaugccuggccugcuugguuuuuuuuguuuuguuuuguuuuguuuuugagacggagucucacucuguugcccaggcuggagugcaguggcacgaucuuggcucacugcaaacuccgccucccggguucacgccauucuccugccucagccucccaaguagcugggauuacaggugcccaccaccacgccuggcuaauuuuuugucuuuuuaguagagacgggguuucaccuuguuagccaggacagucuccaucuccugaccucgugauccgcccaccauggccucccaaagugcuaggauuacaggcguaagccaccacgccuggccugguuuauuuauuuauuuauuuuugagacggaguuucacucuuguuccccaggcuggagugcaauggcaugaucucagcucacugcaaccuccgccucccagguucaagcaauucuccugccucagccucccgaguagcugggauuacaggagccugccaccacgcccagcuaauuuuuguauuuuuaguagggacagggucucgccauguuggccaggcuggucuugaacuccugaccucgggugauccacccaccucagccucccaaagugcugggauuacaagcaugagccaccacgcccaaccaguuuuguuuuguuuuguuuuugagagggagucuugcucuguugcccaagcuggagugcaguggagcgaucucagccucacugcaagcuccaccucccagguucacgccauucuccugccucagccucccgaguagcugggacuacaggcaccagccaccacgcccggcuaauuuuuuauuuuuuuaguaaagacgggguuucaccauguuagccaggauggucucgaucuccugaccucaugauccgcccgccucggccucccaaagugcugggauuacaggcgugauccaccacgcccggccguguguuucuuaguuaaugcugcaaauguagucaccacucugguuagacugaaauugaaaaaauccaaaaaaugguuguuaaagguagucacaugacccagaaauuuagauaacugucugauauuuuuaugccacaggguuauacacugaacaguugucuuacugacagaucccauguuauauccugcuuuguaugccauucaagaucuuuuauacuugccaggccucucucugaugucacagauccucaaagcugaacuugaguucaucuuaacaguauuuacuugauccaccugacaccuuucaccugagaacccaggagaccgugcacaggcauaagacuuucuuaguguuaguuaguguuaggcaugauucagggacaugccaguacacuuuuuauugaaguauaucuaucuaucuucaguaaacuuuuuauugaaguauaacuuuuuuuaaaugcacaaauccaggccaggcgugguggcucacaccuguaguaccaucacugcgggaggcugaggcgaguggaucacuugagcccaggaguucaagaccagccugggaaacauggcgaaaccccaucucuaccaaaaauauauauauauauguauauguauauauauacguauauauauauauauguauauguauauauauacguauauauauacauauauauacacacacaaagaaaauuagccaggcaugguagcaugcaccucuaaucccagcuccuuggaaggcugaguugggaggauugccucagcccagaaaguggaggcugcagugagccgagauugcgccacugcacuccagcccgggugacagagugagacucugucucaaaaauaaaaacaaaaauaaauaaaugcacuaaucuaaagugugcagcuagaugaauuuccacaaaguuaauacaucuguguaaccagcacccaaucaagaaacagaauauuaccucccucaguaagaccccagguaccauuuccuccuauuuuuccuucacccucaccaaguggaaccacucucccaacuuuuaaccccauagauuaguauggucugacuuugggcuuuauauaaauggaauaauuuaguauguaccuuuuuugucuggcuucuuuugcuucauauuuuguuugugagcuguauuuaugauguuguagcccauucucauugcuguauuguauuacguugaacaaauauaccacuauccuacugcugguggacauuuggguuguuucaaggaugaggcuuuuaugaauaauguggcuguuuuaacacucuugugacacuaucuuuuuaaugaagugaacuacacacaaaauuuuauuucacuugcauuuuuugucuuccuuuauagaacacuguuggagaauggcaaaccguguucuauauugcugcugcuauuaauguuuuuggugccauuuucuuuacacuauucgccaaaggugaaguacaaaacugggcucucaaugaucaccauggacacagacacugaaggaaccaauaaauaauccugccucuauuaauguauuuuuauuuaucauguaaccucaaagugccuucuguauuguguaagcauucuaugucuuuuuuuaauuguacuuguauuagauuuuuaaggccuauaaucaugaaauaucacuaguugccagaauaauaaaaugaacuguguuuaauuaugaauaauauguaagcuaggacuucuacuuuagguucacauaccugccugcuagucgggcaacaugaaguaggacaguucuguugauuuuuuagggccauacuaaagggaaugagcugaaacagaccuccugauaccuuugcuuaauuaaacuagaugauaauucucagguacugauaaacaccuguuguuguucacuuuccucauaaaaauugucagcucucucugacacuuagaccucaaacuuuagcaucucuguggagcugccauccacuguauaauuucgccuggcaacuggacugaggggagugugcccaggcagcugccaagcacucccucccuggcuucagggucagagugcccagcguuuaucagaggcagcauccaagcccagagccagugucgacucuucggcuggugccuuuccucugaggggcuaucaauguguagauaaagcccugaguaggcaagagcagugagauccacugcuauggucuugauacauccucaaacuuucccuucccagcacagaggaauauuggcuggcaugcaaccugcaaaagaaaaaugcgaagcggccgggcacgguggcucaugccuguaaucccagcacuuuggggggcugaggugggcgaaucaugagaucaggaguucgagaccagccuggccagcauggugaaaccccaucucuacuaaaaauacaaaaaauuagcugggcguggugacgggcgccuguaaucccagauacucaggaggcugagguaggagaaucacuugaaccugggagguggaaguugcagugaaccaagaucacgccacugcacuccagccugggcgauggagcgagacuccaacucaaaaaaaaaaaaagaauaaagaaagaaaagugcgaugcccagucaaucacaaauaagaucauccugguuuaaaucuacucucacauggaucacaguauaaauuucuaugugcuguguuuuguucguuuguauuuuguagagauggggucucguuuugucgcccaggcugguuuugaacuccuggcuucaagcgauccuccugucucggccucacaaaguguugagacuacaggcaugagccacugugcccagccuguucuauguuuuuaagcuacacgagaauuuuuuuuuuaauuaauucucacuguuuguucagucugucuucaucuaaguuuguguugcaguuuaaaguuaaagugacuuuuaaaggccacaucaccugagacuaggguaaucaucuuuacuucugguuccugaaaucauauuuuuccaguggaccauccuccaguggcugugguuguugagcaugcuuucagaacaccuauguggcuuaaaacuuaguuuauguuuuguguucaacacuacguguaauauuuuaaaacuguuuaaugugaugugaauacauuuauguacauuuauuuuuaaauuuguaaauagcuuuaaauugcuauggcaauguuucuuuuauaaaucaucaaaauaaaccuuugugaauuga

SEQ ID NO: 192081 - RNA, 6254 nt, Homo sapiens
agagcggauagagccguacugccgcucuaguuuuucuuuugcucucuaugguuaggagcgcaagccucucuucggcccggaaagauuuaaguucgugaaugcauacgcaagacucggagguaguuccgguuccggcguggccauuuucguuggugguguucaguuguggcgguugcuggucaguaacagccaagaugcugcggaaucugcuggugaggagcuucucaucuugcauucaugaugggggcgagggaguggagaggaggcugaggcaccacgacagaaaacccucaccugggaggggugccgaaggcggcuaaugaagucaccuugauucguguccuuuuucccugaccuuacuuucccuuccgucuauuccucucgccccaggccguuacuggguagauguaaggaguggagaggcuggggaagugaccagagacucguggguuagacccgucuuggguucuuagucaccaccucuaacccugucggucauugaugagguuaguagcuccgaucugaguaaaaccaagacccagguggggagugucugacacccggaagcaucaagcagaaagguguuuuucugguacugaaagguuuuaaguuucaaugguuuugagcuuugcgagcuugagaaggcaguuuaaaaaccaagccauucaauuuuggguggaacuuuaggaauagucauggcugaagugcaguguuauuuccgucaggcgauugugcauuguccuucaccccuccaucgacuuugagcaugugaaauauuuccccaaauuuugauaaagaaaaaugcgacaaugauuauuuuauuuuuuaaauuauuuaaugaaguuuugcuucauuaaaauccucaauguaauuuuagaaaaucgagagcauauuuguuucauuauuuaauucaacuggauauguagugcaugucucuucuuuaaaagauguauacccucuuuaaaauuuuuuaggaaaaauguaaugagagaagcauuuuaauugagaaggaaucaugccagucuauuugcugucaaguaauaggguuuuuuuuguuguuguuguuuuuauuuauuuuauuuuauuuuauuuuauuuuauuuuuuuuuuugagacguagucucacucuguugcccaggcuggagugcaguggcacgaucucggcucacugcaauuuccgucuccagguucaagcgauucugcugccucagccuuccaacuagcugggauuacaggcgcucgccaccaagcccuacuaauuuuuguauuauuaauagagacgggguuucaccauguuggccaggcuggucucggacucgaccucaagugauccgcccgccucagccucccaaagcgcugggauuacuggcauaagccacugugcacggccuuuuuuauuuuuuuauuuuuuauuuuuauuuuuugagcggaguuucauucuugucgcccaggcuggagugcaguggugcaaucucggcucacugcaaaccccgccuccuggauucaagcgauucucccgccucagccuccugaguagcuagaauuucaggugcgcaccaccaugcccagcuaauuuuuguguuucuaguagagacgggguuucgccauguuggcuaggccgggucuugaacuccuuaccucaggugauccacccaccuuggccucccaaaguacugggauuacaggcgugagccaccgcgccuggccaaguaacagauuuuuuuuuuuugagauggaguuucacucuuuuugcccagucuguagugcaauggggcgaucuuggcucaccacaaccucugccucccggguucaagcgauucuccugccuuagccucccgauuagcugggauuacaggcaugcaccaccaugccugguuaauuuuguauuuuuaguagagacaggguuucuccauguuguucaggcuguucucgaacuccggacuucaagugaucugccugccuaguaauagaauuuuuucuuugaaacggaguuucacacuuguugcccaggcuggagugcaauggcgcgaucucagcucacugcaaccuccgccucccagguucaagcuauucuccugccucagccucccaaguaucugggauuacaggcaagugccaccacgccuggcuaauuuuguauuuuuaguagagaugggguuucuaauguuggucagaguggucucgaacuccugacuucaggugauccgccccccuccccggccucccaaagugcugggauuacaggugugagccaccgcgccuggcagguuuuugaugauauggcaguauauuaugaaaauauuuggguuugguguauuuugguuaagcacuauuuuuguaauauguguaugucaauauguuugcaucaaggauuauaaaaugcuacugguucuguucagguagagaucaugauuuuauuuuuugguuagaaucuauaugaauugcuucuugaauauguuauuuggagacugcagaauguaauucgaagagcagaggauggauaacaaauugaaaaaccuggaugcucuugcaugacuuugcugcugacaaaucagauaugcuucaagucucaauuuaccuuuucuauaauaugaacgacugaaaauaguugguuuugaagguuucuuuaggcucuaagucuauuuaauaauauuuucauuuuaggcucuucgucagauugggcagaggacgauaagcacugcuucccgcaggcauuuuaaaaauaaaguuccggagaagcaaaaacuguuccagguacugaaguauuuuauaggagauguuacuuguaauuauuagauuaccaaaagguaagaguugggauaaacaaguauguguauaaauuagaucauaugacaauauaaacauuacaaaaaaagucaaggacauguaccauagugcuaauagugguugucucuuggggaaagaccugguggagcagagcaauuuaccuuuauaaguaguuugauuaugagugauuuuuguuuuauuaugguuucuagcuuuuccuaaauaaagcuuaaagugauuaaaaauaguuguaucauauauaccuaaaaauacaauacuuuauugaacagauguacuaaauagcuacuguaugcuggauuagaugcuagggauauaauuuaggguuauaaaccaaaaucccuuccccacuuuuuuaagggaaaaaaaguuuccuaugacuaaaucuaauguguggcaauuauugguucuuuuauauuuaaguuauauuaaaguuguugagaucaguguguauguuuuauagcuuuaauguuuauauauucuuuggaaagaccgucauuaauggaucucaaauuaacggugaaagaagaaugcugacuuuuaggaauucuuauuuuaaaaguaguaguaguagagacggaauaaagaaaauuguaggucuuuuaaauuuuaauacuuaaaauacuuuaauucuagggauuuaaggagcuauaucauuuuauaugccuguucuuuugaaacuuaguuggaaaugagugagacauuuauuauugucuuuuuuuuuuuuuuuuaaaucuaggaggaugaugaaauuccacuguaucuaaagggugggguagcugaugcccuccuguauagagccaccaugauucuuacaguuggugguaaggccuuuggaauguuugaagguuuauagaaaaguaauaguaaugauaacugauaacuuuauugcuuuugcuaugccaguauuuuaaugcaggcaguuugucuccagaauuugauaucuuacuauaucucauaaugauucaagagggugacugauacauacuguauaagagcauugugaugucuucuuuuuuuuuugaaauggaguuuugcuccuguugcccaggcuggauugcaauggcgcgaucucggcucacugcaaccucugccucccggguucaagcgauucuccugccucagccucccgaguagcugggauuacaggcgugcaccaccaugccuggcuaauuuuguaguuuuaguagagacggaguuucuccguguuggucaggcuggucuugaacuccugaccucaggugaucugcccgccacagccucccaaaguauugggauuacaggcaugagccacugcgccuggccuugaugucuuaauaaaaaaauaacaccaguaagauuugaugauuauguugugauagaguuggcuuucugagucccauugauggcagugaaggcuauauuucagucaaaaacauccauuauaucccaccucuuacagcaagggcuuuaaaacauuuugacugugaugcaaaauaaaagcacacuuuacaucuaaacuuuguacagacauauuuaugaccaaaacaaaauuuguacagaacaauacuuccacuggaagguaaagagaagggaugcuauauuugagugauuauuuuaugccuaucauauucauaggaaugccacauacuuggauuucugugagucuugcaugaagucuauaauauguccucauuuuaaagaugaagaaaucauauuaauuaccuguuugggaaacucuacucucacaccacaacaaucaacauggaagaucucuguugccaaauguguggggguuuuucccugcacaccaaguaauggacaccagcuagguguccuccaguucaguuuccacacuaucuacugggagauagcaucagauuccacagguugauggcacaagacuguccccuccuucccaccaguugcaaguuugggucuucggaacuucugacugacuggcuuuaaguugggguucccacaaucuccucguuggggaaacacauuuaccaguuuauuauaaaagguauaggcugggcaugguggcucaugccuguaaucccagcacuuugggaggcugaggcuggcagaucaccugaggucaggaguucaagacuagccuggcacacauggugaaacccugucuguacuaaaaacacaaaaaugagucgggugugauggcacacacuugcaaucccagcuacucgugaagcugaggcaggaagauugcuugaacugguaggcggagguugcagugagcucagauugugucacugcacuccagccugggcgacagagggagacuccaucucaaaaaaaagaaaaaaaaagauaaagcccuaaauuccuuuuggccaaugugacauuucuuagacauucugguaaguaguuuuuaaaaugaaauuccaguuaucagcuuuuuuuuuuuuuuuuuuuuuuuugagauggaguuucgcucuuguugcccaggcuggagugcaauggcgcgaucucggcuuacugcaaccucugccucccagguucaagcaauucuccugccucagccucccaaguagcugggauuacaggcaugcaccaccacgccuggcuaauuuuguauuuuuaguagagacaggguuucuccauguugaggcuggucucgaacuccugaccucaggugauccgcccgccucggccucccaaagugcugggauuacagguuucagcaacuaugcccggcccaguuaucagcuauuuuuuauauuacauuugauuacuuuaaaauuauaucacucuuuuuuuuuacauucacuuuagggaaggcuugcauauuuugaacucuuuuuuucuuuggcauuuaaucauccuuagcauuucucaggcagucuuggguuaauauggaaauaaccuuuguauacguucuuaaucuuauuuuuaaaaauuuuugcauuuuauguugacaaauauauuauugugccacacuuucuauauuaaaacuagauuaaauauauuuuacauauauuuauuuaaaauuuuuccagcaccuaucaaaauacuuuuuuguguuccaauuaagguagucuuaaugcaaacuuacaacuuuugaacuggaauauuaaauuuauacacuuagaucuuagaauuuaugguuaaguucuuuuuuguuuuuuauuuuuaggaacagcauaugccauauaugagcuggcuguggcuucauuucccaagaagcaggagugacuucagucaucccagcaaucgcuugguucaguuucauucagcucucuauggaccaguaaucugauaaauaaccgagcucuucuuuggggaucaauauuuauugacuuguaguaacugccaccaauaaagcagucuuuaccaugcuuugucugauuuuaucacuuuaugccaauaauuucaacuuuuggucagccuuguaaaucuuagguaaggaucaaagaaaugauucuuuugccacuaaacuugugaaagcaa

SEQ ID NO: 192082 - RNA, 3173 nt, Homo sapiens
uuaaauuauauuuuauaucuuuuauuucagaauauugucuuuaagacacuuuaucuuuauauuuauuugcauuacauuuguuucaaauucugcucuaaaaauccacagaacaauuucaaacagaguuuuauuaaguaaauacuauuuuucuagaccaacaauaacuucauuagccuugaaaaagccccaaacugggaacuguuuauugugcagaacgcuuagcuuuuaccaacuucauuauguucuuacaaaacuguuucauaaauagcauuaacuuugggaccauacagucacaugaauacucaaacucuccauuuaaauacuaaaaggauccaccauuucaaaacgaucucccaagucuauuuauauuagacauugcuacaguuugauucucagcuauguuaaguaauaauuaucaucggaaccaagaccauugaauacuccugcccuucauccuuuuuucaaagcaaacuugcacacacuguaauucuuuuaagaaucuuuauuuuuuuuuuuuuuaacaauucagucgguuggaucucgaugcaguuuauuaaaaaaaaaucaguacauuuucauauaaacugcaaucaaaaaaguaauuuacuuugucaaagaaguuaugaaguugcaaguuauuuuuuguaauaugcagaacaguaaaauguaagcaugcucuuggaugcaggugcuccugugcaccauggaguuauuuugaagagccugcuaacgucugcaggcaguuuauaggaugcaauuauuuucuccacaacuuagguacaugagaauaaaacugauauuuaugaauaaaguauuuuucucgaaaaaguugaggcagcuuuuguugaaugcuaucuguguggguacacuugcuacaccuugaacuguacugagagagagacagacagcaagaagcccauguucaugcugaaaccugaaaaaucccuccauacguguugaggaguuccaagaaaaagaagaggguaaaacacuauacacaacuguucaucgucuuacauuaacagaacacaccgagaaacuuuacauaacaaggaagcaaauccccuucacugcuuuuagucaaaguccguuguaucuauaguggaggaugaaaguggagcaagccuaguagggauaaagcuuaagucuacaucucaugcagaguuguccuuggucuguccucuaauauuucucagacauccgaguuagaacugagguucguuaaucugggguccgcauugauuucauaucuguaaugauacccuuccaugugaucccugcaggcaucucugauguuaugcauccacuuuuuuauccccuugcgguucaaauacaaaaccaggaggaaaauagcgccuaucagggcuaaaacaauacccaggaagacauaagagguuugcagggaugggggaagaaucgggucacaguccaggucagcacuguugaguuccaagaggacccgauuccucauuuuuuccggauaugcacaggugagccggucuuugcccugcacuaccucuguuuccuugagccaggucaccaugucugccauguggcagucgcagacccagggauuguuguccaggaaaacccuaaugugggguagaccuugcaacucagccagggugccauugugaaggaccuugagggcauuguccuccagguggaggcuuucuagaugugucagguugcggaaggacacguaggucaggcucaccagcgaauuauuacuuaaguccaggugccugaggcugggcaguugggccagcacaucccgcggcagguaaaggaagugguugcuggccagcuccaagcggcggagccccugcagugcacggcccgccagcagggccgccaccaccaugcccucgaagcuccgguucugccgcucaucuucagggggcacgaugugguucaggaucaguuccacaaggggacugggggccgagacgcuggcauugcugcccgagaaagcgaagggacugaggucggccaguggguuguggcugaggucgagcuggcgcaggcugggcagaugcucgaaggcgcccgcgcgcaccucguccaggcggcugccgcugagguugagcgcggccagcuccgccagcggcggccggcgggcgaaggcgccggcagggagcacggccagcugguugccgguaaggaagagguugcgcacguaggcgggcagguccgugggcaccucggucagauugcgguuaacgcacuugacugugcgcgcugccucggagcacucgcacagcgcggggcacugguccggcagcgggggcugggcggacacggcggaagccaggaacggcgccgaggaggagaaggaggaugccgaggaggugggagaagacgaggagacccagcccaggaguaccagcgcuagucgcgccagccgcagacgcccguccccggcggcggggccccgggagcaccccccaggcaucgcggcucgcguuuccccggagcugggcugggacggcgcccgcuccgaaggcucgggaggcugggcccggagggcgcgagccggcggaagcgucuggaaaaaaaaaacuuuccucucguggaaccgagggaguggcgccgcagccggaacuuggcuaacccccucgccaccgggcgcuucccucaggggccgauucccccgccccuucccuccagaaaguacgcacggcgggucgggacgcuccgcuccgcgcuccugcucccgcuccucuuccugccgccgcccuggugccaccucuucgccucuuguuggcgccccucgcuggauccucugagggaccugggacaagcaggagagaggcgugaacagcgguggcugccgcggcuuccggagugcaaaaaccggccuuuucgagucuagucgucuccagucugucccagagaccuccuuccaaaagcccgccccggccucgccuccccaaccccuccggucacuuuuacuccggagggggacgcgcauccgacacccagaccgcaaagucuuccuucuucccuggcccacacuaaauaaacccgaccggccucccgcccuccgccuuucccgaggagacucgucucccgcgucuaacuuaccgcuuaauccccaauuccuucccuaccaaacuucucccucucccguuccuuccugcaccgccucggcggaaggucggccuccgggu

SEQ ID NO: 192083 - RNA, 59196 nt, Homo sapiens
accaucuagcaugaaaacauaugauuauaguuuaaacauguaaaguguaacauuuuagccauaacugauaaacaugucacaucacuuauuucacuugagagaaagcugcuaaaaaacuaauuauuaacugggcuugcaucggaaaaacaauauggagaaaauuacauggacagucuaaguuugcuaugaaaacaauguacuuuuauuaauuaaaagucaaaaacaacaaaagggaaauuucacaaccuuuguuugcaacuauauaaucuuuauguagaaaaacuauaaagugacagucugaucuggaaagcagcucaacaauaaaucuaauccuuacauuaaaaguaaguaaauuauagaaucaguucacccaaaagaaauugucuugcuguagaauauuuuagcccaacugauuucaacuauauuauucucauuucugacaaacugucuuuccugauauuucaaaucaccagagauguaacagacaagaacccguugaaguaaaagaauaaaacacaaauacuccaagcacaauuacaugugacaugaugagugcauuuaaucuacaaucuacaaaacuauacaaauuaccaauuauacauauaauccauuuacauugaagcuccaugaggugguacugaauaaacacugaggcaucaaauuuucaacaauggaacaaggcucacggaacagcagcacauucccaccuuuuagucuagcaucacaacacuuccccugggauuuguacuuauuuauauauuaucuaaguccuaggaaguugguaacaaaaauuuuaagucaaaaggauaaugaauuaaacacucccuaaaaucuauucuaaaacaugcgugugaaauaugaagagaucaagcacuuuguaaaugugagauuuuacagucacguguuccuuuaaacuuauacuaguaucuucacuaguaucugcacaauuuucuguaauuaggcuuuucacuaaaacuuaauagaagaggaaaacaacaaagaaaaaaaccuuauuuguaaacuguacagucuuagaaaagugguacuauuuauuuuuaaaaccaacuuucucugcuaaagaaaucacacuguguggucaucagaacaguuuaagucacuuuggcaauacagagauuuauuuacccuuauuuugaauaacaauaaugaugaugauaaacuauugucacggucauauaauuuuucagaacuuacgccaccauggaggcaaauguguacagaauauuucuaauaaaccuaaauuuaaucacaguuaaaauuucucaaaaguauuuucaagugcucaagaauauuaaaguuuggggggaaauaccuaagucauaaauaagcaaguauucccuccaagauucacuaauugggauaaaagucucaggguaagcccacaagaauggucugcaauaaagaaaaaucaggucuguguagaguaauuucugccaucuuuagcagaaaagccaaaaacauucugagccaaauaaaagcaaagaucuuuugauucagcgccuuuuguuguguuaguuuuaauuucuaacuucucaacauguuauagcucagaaauucccauaugcuuacuaucuguaauaaggaacuauaacguuaaagaaaaaauucagagacgugaucauuuuccaucauaggucugucucucuuugguaagaaacagaucaagacuuacuuauuuucucucaccuacagaagagaggggaguuaaaugucauuaaccuaguaaacaaucccuguguauaaacauuaaguuggaggguaaagagccuaagucaugcccuuuauaagaacuguggaaaacaacucuggcacguagcugugguagaggacaguaaguguccacagauagaacaugaucuuuccugcaacuggaagaccaugcuuaugaacauucuagucaaccuauagaaauuuugcucuguaacuugaguguccuucagacaagaaacaugaauaauaagcuauuauaaaaauaugguagaauaucuucccccuuauaagucaccaauuucugaucccauuaaacuuucauagaauccaugggaguauuaaguagguuuacucuagguaauuugucaugaaguaaaacuggaaauaaccuaucuaauaauaccauuugcaauucaagaaaaaaaaauccaauacaaucuaauauguacauuaacaaacuucacagaauauauauucuaucaggccuaagaaauccucacccacccaaccaaaagaaagucaguuucacccacuguaagauaaaccaugacacuuguaucuggauccagaaaaaaagaacugcuaaacuccaauguaguaggaaaaauauuacaaauaagcacccaaaacugaccuaaaauuuucuacucaaucccgcaggaugucuuuuuuugaagagaaauaagcaucccuugcaacuugacuggaaagauuauuaccugaccaauuauuucuaagccuauacuagaaaccagugcaagauggaaugccaaaaucaccaccaacucgacacgaccguuauuuuugcaaagaaagguaguuauauaaaauuccauucucccaggcaaugagcaggggagaaaaacauguuacuuuuuaaauggcuacauuuguagguuuuugaguaucagcaccaaauguucacuuuuaauuauucugaacaaauuuuuaggaauuaauguuuccuaacaaaauggacuaacaaaacagugaauaaggaaauaacuuucaagcaauauuugcaugcugauaagaaccauuaaguaaaacagugauuggcucauuuccaaagcuacuguaggugugcaccguuuggaaauaguguaucucacugcucagcuaauauaggaacucuccaaaccaugggugcacaucuuauuuugugacuaggcaagauuaaguaaaacaaguugaaaagauuuuuuuaaaaagcaagcuaaaucaaaauaauccauuguuagaauaguuuucuacuuucucuuuuagggaggaaaaaaaaaacccaucaaaccaguguaugaagugccuacauaaaaaacugaaaucaagauucacaaauaauagugucaguucaauucuacauaacccuuuauuauauuuauagcaguauuaugaccaacauuacacaaguuuuauuucuuccucauaccguagcaaauuuauuuucauaauagaguucaacucugcaaaugguuuaaaucaacuuuuugcaccuugaauuuacaaaccauuagauacgaaguuuccugaaaaacauuuuauuuuuaaauuuuacuuaaagcuauaacuaaacccaagucucuugggaguggggggggaccaacuaagcuguuuaaacacaaacuuauaaaaaauauucugaugccaguguuugaaagauagccuacagaagauuauaaaaggucaacgaucauacaagagaauucuauggccaaaccuuguuagaaaauuuguuuuacaaauaaacuucuuucauaauagaagaggaaaugaaaagauauuuaauuucccccuaaaaguaaguaguugcucagaacauggguuggauguauggaaaucauauugcuucugugaaaaaaauguuuuagccaggcauuccacuaacaaaacgccaugccauaucuaccuagucuuugauaucuggguauuaguauuacccaagagaaacuuaucaaaagcaaaugguuagcaaaccaccaaauaggagucucaggucccuuaauuuggauagucaucuuaguaaauauaaaacuuaagcuacuugaacacuggggcuuauaaagugcaucagguauaagaagcacaacaguagugugaaacucaguaggacuuuaagggacuuaauaucaccgguggggcaaaaaaacaacauuauaguuuucuguucagauuuuauuugaaaucuaauucaaauugucaaagcuacaaaaggggggaagacaucuguauuauuuuugcuaagucacaacauccuaaaacaaaauacuacuacugucagcagauccauuauacacauuucugaugaaauccauuagaacaauaaaaauuucaucuugagaaauagccacaaugaaaguaauuuacacaauauaaaacaaugacagaucuacagaugcaguugcucaugaguuuacacaugcauacacaaacaaacaaaaaaccccaggaaugcucuuucauuugauuuuuuguuuuuuuaaaaaacagaccguucaggcacaaaacaaaucgcauuuccaauaagugacagcaucuuaaaaauuuacgucaguguuuguuuuucuuugacuuuuuaugagaccuguguggagaucuggacugggaucuggacuucuuuccugauuuuuuaggagaucuagaccgugaucgccuagaccuuuuagguguccuugaaccagauggugaucuaaggaaacaaacaaaaaaaucccaauugauaaaguacucaugugaucaaaacuguuuauccuuaaacgaucgaaaaugaucuuuaacagggcacagugaaaaaucacugcaauaagacuaugaacuucuaaaauuuaaacucuauuguacacacacacacacagauuauuuuguacuuacuaugcacugcaucaaugaucaucaguagagcgcuuguuuauaaagacagauuucugugccuuaucacugcucuacugaaucaaaaucucuggaggauggaacuaagaauuugcauuuuuaacaagcuccauaagugacugauaacccccaaauuugaaccuuuaaucuacaagauaaaguucaaaguugcaccuaagaucaugcacaaaauuuaaaaaacacagcagcuuugaaguuuaucauccugaagcaaacaacuacugcaguaucauucaagggcaucauuuaagacauaauuuuguaagugcuguucaugaaggauuacuuaaaccaauaaagauacauguacauauacauacauauauaacacauacauacauauauauacaggugccauuuagaaaaggagaaagguaucuauucuguaaagauuuuacuaaaaauaguuacaauaauaaaguauuagcauacaaagcaguuuuagcucucaggaaaauuccucuauguaucaccagauaaauaaaacauuucugaaccauuuuucuggaacuaaaggaaaaaaaaguauacaaaauacuaaaauacauacugaaaaaaugguauucaugauauguauuuccaaaaauaucuacccaagaacuugcuaauaauauugcuaugggggaaaaauguguguuucuuucagcuuugacaaaaaucaaauaauauucuauagaaacuaaagaacagaacgaaaaguaaagcagcuaacccuauuccacagaaaacauuggauaugauguuuaaaauucuuggcugguccucacuuguuggaagccuucacuucagucaugaaagagauugggaugaggagguggggaggaauaaccaaaaaugaaaguguaucucuuugguuuucuaaaauccuuaaaaaaaaaaaaaaauguaugccaaccaaauuauuuucaaaagcugaugaaaugacaaggaaacugguaucugaaauauuagcaaaaaugacuugcauuuaccuuuuggcuuuuuugcuaacaucucuaggagaaucuuugugagaugaccuggaccgugagcucucuuuaugagaucuuucugaacgcucugaucgcuccgauuuuggugauggggauuucacucgucuaccacugcuacugcgagaugggcugggggauguacugugucgccucuuccuauggaacaaagcccccaaaacauuccauaaaugagcaaaggaucggguauucauuuuccuuuacuaaauuagcuauuaauugcuaccagcuuacucuuuuauucuaaccauguaauguuacuuuuaacaauacucaaaguccuuuguaacaagaacaaauaaguguuaaagauagguugucaagagacaacaacugaauucaacuaaauuggauuuucucuuugcaauaagagguuauugaaacaacuggcaaaaucuaauuaaggucucuggauuaaauaucaguuuuuuaaaauguugaaugugguuaagagaauggggcaucauguuggcaaauuauucuuaaaugguuggaggugggacagaagaggaagaauaaagcaaaaguagaaauacuuuaacauuuggguaaugugggugaaggguaacuaucaauuauacuauucuugcaacuuuccuauaaaucuaaaacuaugucaaaauaguaauaaaagucaaaaaagugacagacuuuuaaccaauuggcauaacuuguuauuuguaacuaucuguagcgugacuaagcuagacuuuuauuugcaauggcuuggucuuuuuauuaggaaaaccucaguucaguuaagggaaacaauuuucuuuacucaaucagagauuuaggaaccgugagaguaagacauaaaaacugaaagagaaaugcuuuugauuagaaugaagacuuaaggugagcuuuggccuauguauacaaccuccuuucaagauaagacuaagacucaaguuuacaaguagcagccucagcacagauacuggaaaauaugcuuaaauuggaugcaacaaggaaaaucuagcaaguuguuuuguuacuuaaaccucagguuugauaucuaauacuguaauugaauccuugcacugaacuaaggcuaaggauaccauauaaaccaugugaagggaugaugcccugguuaacuaagucaagugccaacuaaaugccccauuucuccgcuauuucugccuucugcaagcaggacccaaacaaguuuaucaugaacaaacacuuccaguuugcgggcaucaaugaugaaaguauuauaaaacaccacugcaaaucuugaaaccaguauaugcaauuaaauaugagaaauguuauaccuuuccuuccuugucggaguacacucaucuuuuuccuucuugucuuuggagcgagauuccaauuuuucuuuaucuuucuugucucuuucucguucucuuucuaacucuuucucuuucuccuguuauuuuuuauagaaaauauuaaguuguuuaaaaauaucaauguggguuaaucucauuuauagaacaauaucuucucuuacaggaaauaauuuuuuaaauuacuacuuaagguacaauacuauuaaaaaaaaaaaaaucuaccccuucagggaaacuagucauuucuuuugcuuauacugaauaaaacuaauccuagcaacagcagcuauacauuuacugagugcuuaccacaggccaaacaauauacuaaacagcuuuccacagaccauuucauguaaucauuuaaagcaucccuaagaaaauuacuauuauccucauucuagagaugaaaauugagacucagaaagauuaaguaccaugugcauggucacacaggagagucaggucagaauuugagaccaagcucuagagucagagcucuucccccacugucccaccugccgaaaaauuccaaucagaaaaagcuaacaauguacugcccuuuccauaaguuacaauaaaauagucaguaaaagugaucccucuaacuauaaacaaauugauuuaaucaaaaagagcucuuaccaaagaaaaaaggcuagaaaaggaaaaugguuauucacaauaaucuuccaucgaaguuuuauuagugggaaacaaguaccaauuacacugcaaauuuuaaauccuaaauacaaacugacuacaugacucuacaaucaaccaaaaaaaaaaaaaaaaaccaacacauuugcuuauccccagaugcuacaacugccacuucucauuugaaauucugauuuugguauauaauuaaaggaguggcuacagacaauaaauccacacaacuaacuuaguucuucacuaaauggaauuuaauuucucuacgauucauaugcaucaagcaagcuaugugauagcugauucuucugauuucuaaaaggugaaaagaaccuauaccagauguuggcaaacacuuuuuguacagagccagacaguaaaugcucucugcuuugugggccacauacagucucugccacaacuacucaacucugccacagcagagugaaagccacccuacaaaauaccuaagucaaggugcauggcuguguucuaauacaacuauuuacagaaucaggcaaggaccauauuccuucucuccaauuauaaucaaaggagacuaaagugguaacacaaauauuauguauuuugugcuugcuaccaucagaacagugagcaucucaagguguaaucuccuaugggguauagguaaguagcaucuuauuauuauuuuuuuagacagaguuuuccacucuuguugcccaggcuagaguguaauagcacgaucucagcucacgacaaccuccgccucccagguucaagugauucuccugccucagccuccugaguagcuaggauuacaggcaugugccaccacacccagauaauuuuguauuuuuaguagagacgggguuuauccaugcuggucaggcuggucuugaacuccugaccucaggugauuugccugaggugauugcccggccucccgaagugcugggauuacaggcgugagcaacugcgcccagccauaaguagcaucuuuuacaaaaucucauuuaucuuuuuuccaaauauauagagggcaacuuuuaaacaguggugcuaagcagacugacucccucuggugaucuguaggaugcauucuccugauugauaaugaaaaugaaaaugaucuccuaauugagaugccuauuuuauaggaaccguauagcuaaaauacuuauaaugaagaguaacaguaauaauauuagcuauuaucuaacucauaaucuuacaaaauugggaguaucaacccaguuucagagaaaaagcaggcugcagugacuugccuaggaguacacagcagagagcaguacuagcauuccacaggucugagcagcaccacaguugcuuuaccagacugcuccccaacacguuuuguacauuaacagcuuuauagugauuguaaguucccuuuuuauggcucuuuccuauuucacuuucuauauaaucucauuauuauugguuuuucuuuuuuuuuuuuuuuuuuugcaacgacagucucaacaaaauuccugagguuccugguucuaaaauucucugcacaugccuauaaauuuugugaugcacgagaauauaaagucccucaaacacucagagcucaccaaugagguauucuaccacuugcugucccucccuggaaaccaugagaaaugaaaauaaacuucucaacaccagaacuucccaaacccugccuccaucuuuuucuuucuguacuaccucucaggguuguuggcgucucacugucacaaaaugugacuuguccugaaggguuuuccaguuuugaaagcaugcucuuagcagaauuaaucuucuuguccacagguaauacucagaauaaaauagugugcugcugccuuuaagcuccuuuccaaucaaaauacuuuuaaaauaucaaauuucaaauguuucugauugcccuacuaguauucaaaauuuauacaaaggauauaauuugaaaucaucuuuagguauaccaguauucuaggaagucaaauaaauaacuucaaaauauguguauuauuggguauacuuauuccuuacucguugaagaaguuuaucucuguaguguucuacuugcuccugaaaacucuggccugguuuuuuaggucuuuucccagauuccaauucauccugaaacuucauaacuuugagcugugaaauaaaauauuuuaaaaauaagcauuuucaucauucuagauucucaagcacuguuuugcuucuuuucuauagcaaaguaguaacuaauuaguacucagucaaaauauaaccucaccugaaggccacuugucagacaaguccaacuaggcaaaaaucagcugaccagaugggaacccucucuggucaugagaggacucaaaaaccgugaaccgugcuucauggcuguaagaacucacuuauucucucaacacaauuauaacaaauuugguaucugguuccccaaauuagaaaagcaagguugcuaaagacacgcacacugccagcaugauaugacagucagaaugcagauuaaacaucuuuaaaaaagaggcggggaugggaggugggaaggcuguggcauucugguucagcucauguaagaccaaacacaaagcugcacacagucugaagguuucacucacagugcaaucaccagauaucaaaacacaaagaaaagguuaaaucacauuuggaggguacuuuaugagacaguaagagcaaauacugauuaaaacagaccaggccgggcgcaguggcucacgccuguaaucccagcacuuugggaggccgaggugggcggaucaccugaggucaggaguucaagaccagccugaccaacauggagaaaccccaucucuacuaaaaauacaaaauuagccaggcaugguggcacaugccuauaaucccagcuacucgggagacugaggcaggagaaucgcuugaacccggugggcggagguugcggugagccgagauggcaccauuguacuccaugccugggaaacaacagcaaaacuccgucuaaaauaaaaaaaaaaaccagaccagaaaaacuuccaucucuuauuaccuauauaagugcacaaagguauuuuacaagauauucauugcagcauuguuuguaaaaacagaccaccuacaucuuuacccagagauuucuggcuaauacaccuccacacaaacaaauacauguaauauacuuauauacuggcaauggauaaagaucugaaaaaacuaguaaaaucaguuacagggagaggaaaaaccugcaauaagugagcuuaauuuuacuuuuuauucuggagauauaaguaucuuaaaauuuuguacuauauaaaaauaguaaaaagaauaaauucaugauuuauuuugaauuuaaaaauaaaaacuucacaaagugguuaaaauaaaaacuauccuaaggcuuaaaggagcuuaaauuauccaaaaaauuuacaagggugaaaauaccuucuucuugaauucuacgggaggacaaauaaggugaaaaguaugaggaccuggaagauccuccaagugguagaaagcacauggaucuuggaugauaccacugggcugccaaucugcucaauauuguuccacucaaagagaaagaggaagcauucuugucccaugaaauuacuguagaugcuaacauuuuauccuauuuuauucagacacugauauauccuuuaaauggacuaaaugcuacuacagcauuuuauuuauacuucaaaaacaagacuucauuugcuuguuaccccccuuuauuacaaauuagucuuuaccauuucuccccauuccaagugguauuuucuuucuuuuuuuuuuuuuuuuuuuuuuuuuuugagauggagucuuacucuguugcccagacuggagugcaguggcacaaucucggcucgcugcaaccuccaccucccagguucaagcaauucucccgccucagcuucccaaguagcugggauuacaggcgcacgccaccaagccuaauuuuugaaucuuuuuuuuuuuuuuuuuaagcagagacaggguuucgcuauguuggccagguuggucucgaacuccugaccucaggugauacacccagcuuggccucccaaacugcugggauuacaggaaugagccgccaugcccggccccaaguggcauuuucacuauuuuugacuucaugaauguuucuuauacguucuccaauucuguccuuuuuccaucuauuuucacuuuuuaauuaauuauuuuuugagacggugucucacgcugucacccaggugcacugcaaccuuggcacacugcaaccuccgccucccagacagucucccagguucaagcaauucuccugccucagccuccaugccugacuaauuuuuguauuuuuaguacagacaggguuucaccauguuggccaggcuggucucaaacuccugacuucaagugauccgcccaccucggccucccaaaguggugggauuucagacauauuuucacuuccauaaucagggucuuuuauaaucagagcuuugauguucucuccuucucuucuuucaaagcucucuaaaagucuacauuuuucguguguuuuaaucaugacugcauuuaaaaagauaagauguaaggcugagaaagcaaggggguggggugggcaacauaaauagcuaaguucaucgcugugugaagccucucgugaccaagaugacucuuccacagaauguauuuguaguaaaucaguuugcguuagaaagagucaaacaacagacccaaauguuacuuaggggagagaagggauuccuaagauaaucauuuuaaaaaucacuauacaaucccuacuuauaguuccugcugauacagucuaacugaggcucaagcacaaguccaagacacacagaaaacagaugaucaagggucucaacacaaaaggaaguggcccaugcaauggcuucuuaacuauccagcccuuauugccuucaggcaacagacagguaucaccuuccaacucaacuguucacucuuuccucagggaccaggacagaaagugaucucucucuuccaacaagacagaagacccuccacuugguuccccacccacuauucuacucuuccaaccuuguugguagaaauggggacaauaguagaauaagaaaaggaaacuccagccuaggcacugcucucagugguaugugaaagauuaagaacuggcuucugaccccguccgggagggagguuggggggggucagccccccgcccggccagccgccccguccgggaggugaggggcuccucugcccggccgccccuacugggaagugaggagccccucugcccggccagucgccccguucaggagggaggugggagggucagccccccgcccggccagccgcccaguccgggaggugaggggcgccucugcccggccgccccuacugggaagugaggagccccucugcccggccagccgccccguccgggaggcgggagggggggucagcccccugcccggccagccgccccguccgggagggagguggggggggucagccccccgcccagccagccgccccguccgggaggugaggggcuccucugcccggccgccccuacugggaagugaggagccccucugcccggccagucgccccguccaggagggaggugggggggucagccccccgcccggucagccgcccaguccgggaggugaggggcgccucugcccggccgccccuacugggaagugaggagccccucugcccggccagccaccccguccgggaggggggagggggggucagcccccugcccggccagccgccccguccgggagggaggugggggggucagccccccgccaggccggccgccccguccgggagggagguggggggaucagccccccgccuggccggccgccccguccgggagggagguggggggaucagccccccgccuggccagccgccccguccgggaggugaggggcgccucugcccggccgccccuacugggaagugaggagccccucugcccggccagccgccccgucagggagggaggugggggggucagucccccgccuggccagccgccccauccaggagggaggugggggggucagccccccgcccggccagccgccccguccgggagggaggugggggaggucagcccccugcccggccagccgccccguccgggaggugagcggcgccucugcccggccgccccuacugggaagugaggagccccucuacccggccaccaccccgucugggagguguacccaacagcucauugagaacgggccaugaugacaauggcgguuuuguggaauagaagggggggaaagguggggaaaagauugagaaaucggaugguugccgugucuguguagaaagaaguagacaugggagacuucauuuuguucuguacuaagaaaaauucuuuugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacauggcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaaaaaauaaaaaauaaaaaaauaaaaauaaaaaaaaauaaaaaauaaacuaaaaaaaaaaaaaaaaaagaacuggcuucuggccaccacaacaucauauagguacaagauuuuuguguuuuuacaaaggauguuaguauuuuauaacacgaaucauuugguuuuuauuuauuccaugcuacaaacuguucagcuauagguaucuuuauuaggacacacguggggaugcaaaauuacaguauauauacuauagaauauaauagaacuaauuggagaaacugauuuagaacuuuauucuuaauuuaaugguucuccaauaaaaggguuuggauucuaaaucucgaaauggauauccaaauuuaggggcagagaagagagcuaguugugaaaagcccugggauaaagcucaugagcuccgaguucuaguccaaguuugccaccuguuguggaacuuuauuccauaugacuaaaucucucagaggaaacacaagagaagauuagauaauuuuaagaugaagccaagauaaacauuuuaaaaucaggacuuaguucaugguccaaaucccagaaagacaacuaaguugugagaggcagucacuaugaaagcaggagaaauaaucacugaauacauaaaggacaggccagauuacaaaagagcacaugaaguauggaaauguaugcauauaugugugcaaugugcaugcacguguaucgcauauauacguauacaagguggaaagaauaagguuuguaaaaacgaccuaaguuaacaaaaaagcuaaauuacaugcuuuccucucuuuaaguuaauaaggaaacagaacauacuaaacaguuggggcauuuauaugagggaauagcuuguauuaucaagaaaauacacuucuauuuaacucaagucuauuucuacuccaacaguuuucaucaggucagaaagggagugcucuuuuuuuuuuuuuuuuuuuuuuugacggcgucucacucugucgcccaggcugcagugcaguggcaugaucuuggcucacugcaagcuccgccuccuggguccacaccauucuccugccucagccuccugaguagcggggacuacaggugcccgucaccaugcccggcuaauuuuuguauuuuuaguagagaccggguuucaccguguuagccaggauauucucgaucuccugaccucgugauccacccgccucgaccucccaaagugcugggauuacaggcaugagccaccgcagcuggccaaggcagagcuucuuauaaggugagaggaguaaaagaggagcauguguagguugaaaaggugcacaggugaguguguucacugacacacaucuuauccccugaaaaauauuuaaaauguauaugaauacaucccaggaaaaaauaaaucaacuaaucaacucugaaaauccuucaucucuacuuaaaaaugacaccacgcugacucuacauaagguuaaaacaaaaugcugucuguuuacuuuucaguuuggugaugucugacaaagaggugggcaagaacuuuuaucagcccaacagugacuauguggagaaguggcaaugagguaacuaaugugauagguaucauaaguuaguaagggagauaguacugacauacaguaggcauucaaaaauaccguucaaugaauguauacaguaugaaaauucacucucauacauucuuuagagguuugagacugauugcuaaacuacugcuagcauuuacugggaauauuucauccccuugagggcauuacaaagcccuucucugagaugucugaauagccuuggacaaaagaaaaggcauuuaaaaaggagagggugagaccagccuggacaacauagugagaccucaucucuauccaaaaaaaaaauuagucgggcuugguggugcacaucuguagucccagcuacuccagaggcugacaugggagaaucucuugagccuggugguuugauguugcagugagcuauggucacaccauugcacuccagccuggucaacagaaagaaaccccgucucaaaaaaaaaaaaaaaaaggagaggggagaggggaaaagggaaagggagggaaaugucugccugagauagucugggcucuucuauacauuuccccaucuuuuaguauuaagacccacucaaugucuauucuccuucauaugguacagacauuaaaaaugagccuaauaaaauguaaacauaacagaauaugccagaaaauauuuuacuuuuuccuaguugcauaacuaugaacacucaagaugaaauggauuucuugccgggugugguggcugacaccuguaaucccagcacuuugggaggccgaggugggcggaucacgaggucaggagaucaagaccauccuggcuaacacggucaaucccugucucuucuaaaaaaaauacaaaaaaaugagccgggcaugguggcuacuccggaggcugaggcaggcgaauggcgugaacccaggagggagagcuugcagugagccgagacugcgccacugcacuccagccugggugacacugcgagacuccaucucaaaaaaaaaaaaaauggauuucucacaguacauaacacauaauguauuacauauauauauauauauauacauauaaucuauacauuagaauccauuucuucagaggaucuccuaugugucauguauuagacauacaaugauaaagagaaaacagacauggccuuuucccuucauggaaagugcagccuaauggggaagacagacauuaaauaagcaagcaagcaaguaagcaaacaaacaaaauacacauucacauacauaccccacaauacauauaaaaucacacagaaauaaauaggaagaagcaaguaaguccaaaaggguaagaaaaggcugugagugaacagacgguugaacuaagaggccugaagaaaagucaucugguaugaagaguucuaagcagagagaaggaacaguauguacuacgguacaaugcaaagaggcaacuuaguuugguggagaaagugaaaagccaauaaaguguaauuuaaguuucacugcaacaccaaccucaauuucacgaaguuuggcucguuuuuccucacucauuucagaguacuuagagaacuuagacucagucauuucuucuuugauuggauuagaguacaaaugauguucuucagauuuggaacuuugaguaucuucuucaucuucacuuucuucuucuugacuuuagaaacaagcagaauacauuguaugucaaggcagcaagagaguaccauauuuuacagucuaccuauuuuauuuuucauugucuuagagcuuaaauaacauagccaaaacauaauaggacaauucauaccucaagcauauuuugcaaaauauuuuaucaauauuuuacagacaauuuuauaaaacacuucuuuccuccacagaaaaugugugagcuucaacauaagcauacuguaauaaauucugcuuauguuguuaucugugugccuuccauuugcaacaaacuuuccuugcagcaguuaaaugaaacgaauaaucaaguuucugcauacuucacaguucagagugauuucaagaagcuuuauguucuccauuccugaguuauuucacucauauugugagcaacaauauucacaaauauucuauguucucauuuauaagugaaaguuaagcuauaaggauguaaaggcauaagaauaauacaauggacuucugggacauggaaggaugggaggggggugagggauaaaagacuauauauuggguacaguguacauuguucaggugacaggugcaccaaaaucucaguaaucaccacuaaauaauauauccauguaacccaaaaccacuuguaccccaaaaacuuuuaaaaugaaaauuaaaaaaaauuaaaaauaaaaaaagcuguaugugugccuuuaguaacuucagcagagccuauaaucaaucuagaaaauacaugagcuugagucacagaguuacuaagaaauaaccaauacagcugguaaagaccuuaucugauuagcacauaaccuuaauaauaaagcaauguaugcauuuuauauauuagcaaauaccgguauucacauuucaguugauucugaaaguugcacugguucugggucagacaagaaaauaaaaaccugagagacuaucaugaguaagucacuuaggauacaaagaagaaaaauucuccuguccuuccagaagcagucuaguggaaacacaaacaggcaacuguguguaaagcuggucaucaaugcuaguacaggauuaaccaaauguucuugaagcacaaagaacaaaugguuuuuuuaaaaaaaauacauucugagacuggguuguguguguguguguguguguguauacuauuggcaaauaaaucugggcaaaacaagauacccauauacaaacaaacucagaauguuuauauauauacaaacaaaauuccuuacaaacaauguugacugugauaacauuacuggcauaacccagaacaaacgcuguuuugccuuuaauacuugaaucucgcaagcccuucuauguugguauuuggguacuaaggacauucuacgaugagcagaaagauuccuuuuaauauacauguagaauuauucuuaauaauguaaaaaguuauaaucaaauucuuuccaaauaaaauuuaauuaaagucuuauguaauaagaccuucauuguaugagagaaaaauuuacaccaggcagauaaaaagaaaggcugucaauucagaaucagaaaagauaugguacugagaaaacucugauacuagcuuuuaaauuucucaaccaaagguccuuucuagacauuacuaaaauauuuuacuaacuucaucuucagaaccacacaaaucauuaauaucaccauacagguacaacucaauacaauauuagcuaaggaagaaaaaaguccaaaccaacaguuuaaaaauauucuucuuggaaaaaaaguuuuacuuaauauuucucauuaauuugucauaaauuuccuaaauacaguuuuuaguuaauuuuuuuaaaacacaagaauuuccuguuuuaugguacauaaaauuauacaaguguuucagaugcuuuuagauugaaguguauguguguuuauguaaacagggauguuuacugaagaauuauucuagaagacucaauaaggacgugacuuuguuaaacugagucacaguuacuaugaaacaauaauacagcagauauugauuacuuaaccaauucuagccuguaaaauuuuuucuaauuuuuuuuugcaauuucaaauauucuuugguaaacauccuuguauguuuaccaaaauguuugcuuucaaucauagaugaauacagaacagguaaacagauuaaaauggcauaauaccaaugacauugaaugaaaaacgugucacagaauagcauguacaguaauauuacaucauuuaugucaauaguuaugcauguuuuuauacacacagaaagggucuagauggcugaacauuaaacauuuaaccauauuacuuaagacuuuuuaaaugagcucuauucaugauuuaaaauauguaaauauuuuaaauugcuauuauaauuuuuucaaggcuuaagcaguuuuucuaaacugguuuuggccuuagcuuuuagccacaauucgagguucaaaucuuaucacagcuucuuccucuucuuuuuuuaaaaagacaugcaaauucaagauucuaaauccauacaguauucaauacaaaugaaacugcuuuuuguaacuuuucuccaaaacaugcuuuaaaaaucacauuucugccacgaaucacaauauugccacaaaauauaauaauuacuaguuacaaaaucagccuuaaguaaaaagacauuuaggauucagccacuagagaguaguagugaggcaugagaacauuucaaggaucacaagcugcacaaaagcuuuuuuuccuugcuuuguacuuuguuauuuuuacauuaucaugauuuaccugaaauuccuaagaaaaaugaaaaaucuaaaauuauacuucuagugauccaggcuuccauuaauguaugcguauuccaacaucaaugcuaaaauguauucauauuccaaacauuaacacaaauaucaguuuuaugccaaaaaacuaauaccuuuagaaauaaaacuaauagaacaauacuuuuuucaguucaacggcuuuucuacccuuccuucccccuaaauuaaauaauuauuuuaugaguacguauacuacuuuuaaagcagugauucuaaaaugguaagauguuacuaaucauaggaucacgaacauaaaaaggguucagaaaaccacuguuuuaaagcaaacugaacuaaacgguucucaauuuguguauuccuaaacagccucagauagguauuuccauuagcaagccacaucuauaacauuauguaaauauuuugucaucaucauugcugacuuguucuaaucacaccaacauuucugaaaaaacaucauuguagacaaguuuucaccaucguaucaaacuguguuucuauagccugcugauugaucacauuuucccaacaauccaaaugcccauuuauuaaauccacacaaaugcccauauugugcuaggacacacagggguuuucucuuuguucccacuuccauuggagaauagaagaacgcaaaauuuuuaaagacaguaaccugugcuuuguguuugugauaccaucucuuccuacucauuuaaaaaaaaaaaaaaaaaaaaauucaacucccuuugcaaugauuuuaaaaagugucaagaacuuccuaaaaacugccaauacagacuugcaggagaaucugagaggagagauuccuacaaccacacagugucaaauacaaaaacaauuuuggggugauuaccaaacagcaaaaucaaaauuauuauuucucuauauuucaaaagaaaagauuuuuuccuuuguauucauucuuaguucuucugaaagguuuauauuuaaauaacacaauggccauaaugcaaucuuuuucuuagaauguacaauccaaaagaaaggaguauaaccuuuccuauucacauuuuaaaaaccacuuuuuauggagcccaaaacaguauuugauggcaaagguuugaaaaaaaugcaguugaccaauuaguaacuacaaagugagaauauaaccuagcguaaaaaacucaaaagcaaaaugaaaccagauccaucaagaccagaaaacaaaagcucuuuauucacuggaaaaccaauggagaacuaaaaaugauccucucccaaaauuuuuuaagagugaaguuuuccacuucacuauuauuucaacuauaucucuuaaugaaaaggggaguguauaugaacaagaaacaguauauucaaaacuuagauucuuacuuuugauuuucuucuucuucugauucuucaugcuggucaaauaauucccauuuagaaguuguaacagcugaaugaaaggaaaaggaggauguaauuccacgagguaaacuagcauuuuuucaguaguacaguggaagcucaagcuuuagaauugaaaaguuuauauuacagaaguuuuuuuaaucuauguuuaucaauucucuaaauaguuauuucuauaugccaaaucucuuuccucacaccuacaauauaauucaaauucaugaagugacgaauaaugucauccuuauuucuguguugaauauuaagauuuauuucauuagaaccuacaaauagcaacaauuagauuauuagcacuaggauacaggucuaaguaagugugaaagacaggucuaaauugcaucuaaucagucuagcauuaugggagggucaaagcuugguuucuaugaaacugaccucuauguagauuucuacguagguacagcuuccaaucuacauuugcuacuaaaaugccuuaaccugaaagguuuucagugauaucucauuacucucaaagcuuccaaacugaaggaccuaagaaaauuguaacagcaacaccaaccacaauaaaagcauacauuagacacaaaauaugacaacauugagcauuaagguuaaaacguguuauaaaacauaaaaggaaaacauauauacaagcacaccaauaauuaacguacaaguacuuaauuuaaaaaauauuuauuuuacuuuuacucacccugugcuuccaauucagauucauccacagcuucccauuuugauggggcaacuuuaaauauaggcucauucuuuuuugagucuucaguugcauccacuauuagggaaagauaagccauuaacccugacuacuaguggaugacccgaaguauuacauucauggguauucaccauauuauuaaaaagcaaaguaaaauaaggacacagauggacaaauaguaauacuaagaacaaggacuaugacuaaaccaauucucugcaucugagggcaauauuuuuaacaguauauauaucaauucagaaaauacagguuaguaauauauuaagcaagugaagaaguugagaaguaaaacaaaucuuuaauaucuuuaccuaaucucugaaauauaaaacugcauacauuauucaauauuuaaacauauaauucaaauguaccaaagagcugucuacaguuccuauuuucaaaaugauuuuaggcagcuaggaaaacugaaguuguaaguuagaaaaacuaauaaaaacugauaaaaccagguaccuaggaucaugcauaacugagcacaagauuuugccuauaauuuccugacaagacaaaaagagaaacuugcuaauauuauaggaggcugauugucccagcaaagaaaugugaccagaaaaaaaugcuucuucuuggccuuuuauauacauagcauacaaauaaauguauuacuggguauaugaauuuugaaaaaaaucagaaauagaaaaguuaauaacuugauacguucaugagaaacuauaaccuuuuuccauaucagcauguauggaaauuagaguuuuggucaccaaauguauuagcuagauuuaaucaguuugaaaucugaacuuacaaggcacuccaucaagaucaucaucaagacuuuuuauagggacuccaucaagaucaucgaugggaguagcaucaauaggaauuccaucuacaucuuccagaggugcaccaucaagcucuuccucgaugggggcaccaucaaggucaucuggaacauccuauggaaauguguacuauuauaacauuuuccuuugcuugcugaagucacauugcuuguaagauuaauuuguaauccaguacaagccaacauaacuggauacccacaaucugagguacaauguaagaacauauucuaucauccaguuugcuaaagaagcagucaguugugcauuuaucuaauauuuaccaagugcucacuggugccagguaccuugugaggcaaugaugagcaaaaacaaguuuggucccccuguuauagagccugguaaagguuuuugcuguuguuuugcaggggugggggaaccaggaaaucagaucaucacaacaauauauacuuaucuguaacuaugguaacugcuacagcaaaagggcguaucauacuauuagcauacuaaguuucacuuaaagaggucagagaaggcuaagguuauguuugagcugagaucugaaggaucucaggugaagauaagucccagaaagagggaaggacauguacaaaguccaaugguagguggaaacacacauuuaagaaacugaaacaaggaccacguggguugcaacaguaaggccaauuaggaagauccugcaggagugaaagugaaaacauaauagcuugacuagcauggcagaauuaaacauuaaggauucaguaauuauuuaggagguaaaaaagaaaaaaaacaacagaauggugauguauaucugcuaucaugugaugcaucuuuucaugcacauauuuuacuuauauagcuaucuuuaacaaaauaaagucaugcuauacauauugcucuauuacuugcuuauuuucuacuauuaacaauauaucauaacucuuauaucauuaaauaaaaaaaacacucaccaauuuucacauaaggacacaagacagagaauuccuguuacauguaauuuugacuucuggguuccagcaauaaaaauccacuacuuaaugguaagcaauagauauuuuucacaaagaaauguaccucacauauguaacacagaacaacuccaagaaaccuccaccccagaaacgaauuuuaaaaacaaccagacaaauacagacugccuaccucuguuuccuuuucuucaauaauauuuacaaguccuaagaaaauauuuuguaguuugaucaaaaaugguucuggauaaauugcccaaucuucccaugcucugaagcaagucauuacccguugcuaaagaaacaggaaacagacaacaaacuuuuauuuugggcuauaugucucaaauuucaguucaugagaaugaucaucaagauuugcuaaauuugccuuuaaacugauguuuuuuuaaacuuuaaagaaaauaacuauauaucauuaccauauuuuuuaaaaaaaucaaugucaccuucuaauuaaaaggaaaaaaaccccuaaaaauaaauauaaugaaaaauaaacaguaacuauuugcucuuuaccaccuaaggucagcucccauaccauuaguacuacccaugagccacauuccagaaacacuuacauagaaacuuacuaaaacuggaaaccaaaguagccaaguuuugaccugaaucccuuaugguccaauaaaguacuuccuaauucuggcuaauacuuuacucuguaucuuccugaaacuugucuuuaaauucuaacuuauggucaaaauuuaaggucaaaaacuuuuaaaaugggaguugucugaaugcccuaaaugguggcgucacugggcaucuuccgaaacuaaaaauuuuucuuaaaaaagucuucuucccaugaaagcauauuuacuuauucaauuauaagugaaguacuacacuuggcuuuucuuaacacuggucuagagcuuaagagguuauaaaaaaauugguaacagaauagacuuucuaaacaugauuaaaauguaugucuuuaauccagccaaauaguauauaccauuacaaaacaagugauucuucuguauguuuuaugaaaaaagacuaacauuuauaauuuuuaaacaauauuuaaaacuaaaauuaaaccugacaaaauaguaucuuuuaaauuuuugauuugauaaaaacaaaaacgacagaauuuuaaaacaguaacuucuguaacaucuaaguuuuaaauuuaugucucauacuugucuuaugcacuuuucuagcccuucaaugcccuccccccacccauuuaaaacacuagggcaaaaauaguaaaacaauaaacguaccuuaaaguuuucagauuguaaauggccuugaauuguacgauagguggcauugaggucugaaaauaucugacauaacuuuguuucaaaacugaaauucaaauaacacauucuuuaaaauaaaauguuuaaaauuccuuucccuuuuagcaugccagccaaugaaaaccccuccugaacuuaaaauacuuacaaaucaagaaauuauuaaaaaucaaaaacuagguguuuaaacucuaaaaccguaacugaauugcuugaacucuuauuacucugaauuuuucuccuacaaacuccccaacagucccuacuaguucccuuuacgagcaagaaacguuauaucuaggauaugcugaaccaucucguccaauuucuuuauuuuauaaaacagaaaacuuagaaaagugacucguccaaggcaaaaaaacuaauagcagaccuaagaguaggauccagcucucuaaauuucuuuucagagcaacauccuagggaaaagcuucccuuugccuaauucauaaaauaaacacagaaagagagcucuggggaacagaggaaaaguuauacuuuuuuuuuuuugagauggaguuuugcucgucacccaagcuagaggacaauggugccaucucggcucacugcaaccuccgccucccggguucaagcgauucuccugccucagcuucccgaguagcugggauuacagaggcacaccaccacgcccagcuaaucuuuguauuuuuacuagagaugggguuucaccacguuggccaggguggucucgaacuucugaccucagguaaucagcccuucuuggccucccaaagugcugagauuacaggcgugagccacugugcccagcugaauuauacauuaauuauaauacagcaacguaacuuccuuuugccuuaggaaacauuuacaaugaacuaaaaucaauaugcugaggaucagaagagaacacagauucuauaguuaauaguaugucuuuggucucuuauguuugccaguauauacacuguuucuauuuauuauaugaauagcuagauaugcaauaaaguucucuuuaacaccuauuuguuauacugucaauagcuaagaaagugauaugauauaaaaucuuuccaaaaaauugguaauuuagcuuaaguguaagccaauuuuuuaaaaaauucuacaaaccauuaagaaauucaaauuagucuucccucaguauccauggggggacugguuccaagaccucccauggacaccaaaauccacagaugcucaaguuccugauugaaaauggcauaauauucaccuguaaccuauccucauccucccaucuguuaaaucaucucuagguuacuuacaauaccuaauacaauguaaaugcuauguagaguuuucauacuauauuguuuagaaaaugacaaggaaaaaagucuguacagguucgguacagauacaauuuuucuucucaaauauuuucaauucaugguugguugaauucauggauaaggaacccacagacauggagggcugacuguacuucuuauucuugcaggauguuaacaaaacaauccucuuuucugaacuccuuacccuuaaauacuuuauuucaggaauaucaguuauaucauuauacuuacaauuuucuauaauaugaagcauuagcaacuuuggcugaagaguuguacaaaacaucagaaaccaaauauaaucuggcaaucuauaauaucaaaagauaacacaaaauagguuaauauaaggcuaauguuuagcuauaauuuaauuauggcuacuaauuagaagaguuauaugaagcucaguaucaccacaacuaugacucuggcagagaugaaauuuguuaacccauuuacauuucaacuuguuuguuaacuuguauguuaaugaaccuaaauuuccaagcagaaauaacauaagacugcaugggaaaaaucucaucagucaagugcuuugugcaaaaaggaaaccaauucuaaucccaaaagacgucaacuaucuccccuuuucuuaaaauucauucccauaccuuuuuaggaaggggugucuuuaagauggacaacgacucaguaaugcaauccacuauuucuucagcagcuucagcauuauuaagacagaaaaccauugcaucuccaauaucauuuuuccuuggaguuaauccccgcaagauuucuuccaauuuaucccucugucugaacauaaauuguuuuaacuuauaaauauuuagauacaauuucaaaugccauuguagcuuuugcucacaaacuaauuucuuuaaaaccuacucacauaaaauaauucugaagacuguaauacauucagucugauuuguguugugucccccaaaauuguuacaauuuuuugaagaauuuauauaagaauacucuguagaauaagauuccaauuauguuuucagcuuacaaauuaaguaaauuuaaaaucauacgcauuucuucaagcgucuuuaagagcaccccagucuuaccaucccaugauacugaagaacuuucauguucuuuacuccccuucuuugaaggaagucuauuacuuuaacacuucugccugggauuacgacaggcuaauuuuuucuguaaaggaaaagacuggcugggugcgguggcucaugccuguaaucccagcacucugggaggccaagguaggcggaucacaaggucaagagaucaagaccauccuggccaacauggugaaacccugucuguacuaaaaauauaaaaauuagccaagugcaguggcaggcaccuauaaugccagcuacucgggaggcugaggcagaagaauugcuugaaccugggaggcagagguugcagugagccaagaucgugccacugcaugccagccugggugacacagcaacacuccaucucaggggaaaaaaaaaaaaaagauuacaaauauuuuaggcuuugcaggccauaugaucucuaucccccugcuggcauagcaccaaagcagccagacaacauguagggaagggaauugacuguauuccaguaaaacuuuauuuuccaaaacaggaggcagccauauuuagccuaugagcugaguuugcagauccuaggauuacagugauuaugaacauacaucuucagaaguaaauacacucaaacaguaucacacuccauugccaaaugcucucauaggcaaugaaucaaugcaacaaguauuaagauuuauagacugcagugaaguacauacaggcauaucucaaagagacggauucaguuacagacuacugcaauaaagcaaauaucacaauauagccaaucacauaaguuuuuugauuucccagugcauguaaaaguuauguuuauaccauauuguagucuauuaaguaugcaauagcaguaugucuaaaaaaacaauguacacauuacuuuaaaaauacuuucuuguuaaaaaugcuaacaaucaucugaacucucagugagucauagcauuuuugcugguggaagguuuugccucaauguugauggccaacugaucaggguggugguagcugaagguuaggguggugguagcugaagguuagggcggugguagcugaagguugggguggcugcagcaauuucuuaaacaauaaaguuuaccgcaucaacugacauuucucaucacaggggauuucucugcagcaugaguuguuguuuguuaacauuuuacccagaggagaaugucuugccaaacuguagucaauccucucaaacccuguacuacuuuaucaacuaacuuuauauauauucuagauccuuucauuucaacaauguucacagcuucuucaucagaaauacauuccaucucaagaaaccacuuaauuugcucaucccuaagaagcaacuccucauuuauuaaaguuuuaucaugagaucacagcaauucagucccaucuuugagcucuacuucuaauucuaguucccuugcuauuucuaccauaucuggaguuacuuccucuacugaagucuuaaaucccucaaagucaucuaugagggacuaacuucuuccaagcuccuguuaaugucgauuuuuauaggcaaaaaaacugaaacggauuuuuaagauuuuuuuaaauuucuuuuuaauagaaauggggucucacuauauugcucaggcuggucuugaacucuuggccucaugcuauccuccugccucggccucccauagugcugggauuacaggugugagccaccacaccuggcccacaaauguucuuaauggcauuuggaaugauaaaugcuuuccacaagguuucugacuuuuucccagacccacuggaggaaucacuaucuauggcagccacagccuuaugaaauauauuucuuaaauaauaagacuaaaaggucaaaauuacuccuugaucaaugggauagagaauggauaauguguuaacaggcaugaaaacaacuuaaucucuuugcacaucuccaucagagaucuucagugaucagguacauugucaaugagcaguaauauuuugaaaaaaaucauuuuauugagcaggucucaacagugggcuuaaaauauucaguaaaccaugcuguaaacagauaugcugucauccaggcuuuguuguuccauuuauagagcacaggcagaguugauuuagcauaaauucuuaaugguccuaaaauuuuuggaaugguaaaugagcacuggcuucaacuuuaagucaccagcugcauuagccccuaauaagagagucagccuguccuuugaagcuuuuaacccaggcagugacuuccccucucuaguuauaaaagugcuaaauuacauuuucuuacaauaaaaggcugcuuugucuacacugacaaugugauuuaguguagccaccuucaucaaugaccucagaucuucuggauaauuugcuacagcaucuacaucagcacuugcugcuucaccuugaacuuuuauauuaugaagauggcuucuuuccuuaaaccucaaaaaccaaucacugcuagcuucaaauuuuucuucuggagcauccucaccuguuuccacagaauugaagagagugggccuugcucaggauuaggcuuuggcauaagggagugcuauggcuggucugaucuucuauccacaccaccgaaacuuucuaucaguaauaaggcuauuuugcuuccucaucauucauguguucauuggaguggcacuuuuaauuuccuuuaaaaacucuuccuuugcauugauaacuuggcucacuguuuggugcaagaggccuagcuuucagccaaccucaucuuuugacaugccuuccuaacuaagcuuaaucauucuagcuuuugauuuaacgugagagaagugagacucuuccuuucaccugaauacucaagaggccauugugggauuauuaacuggccuaauuucaauaguguugugucucaggaaauagggaggccuaagggaaaacagcuagucacugaacagucagaacacaccuuuuuugauuaaguucaucuucuuauaugaccauaguuuguggugccccaaaacaaucaaagaucacugaucaccauaacagauacaauaauaaugaaaaaguuugagcuauugugagaauuaugaaaaugugacagacaugaaguaagcacaugcuguucgaaaaauaaugacaacagauuuguuugacuuaggguugccacaaaccuucaauuuauaaaacacacuguaucugcagagcacaguaagucaaagcgcaauaaaacuaaguaugucuguacuuaauucuauauucuaaaaaugcuuuuagccaauguuuucccaugagguauacaggauguccucugaacauuuaauaaguauguuuuugcuucuuaaaccagcuagcugcacuguacaauuguuaagugagacuaauaacaacacauacuuccaugguggccaucucacagcucaccacacacugcaaaucaagugugaaaguuaucauguagcggcuuugcauagccacaaucugaucccacuagccacacaauaguuuuucuucuuuauguugcauucagagaagcaagaauucuagggauccuccaauaauuucuguaagaaucugaaguacuccaaugcuaaagaaauaagucaaucauguuuaagagaucaucacuaauuuuaccaggagaaaacucaaggacaacaggacacacaccuauacuuguuaggauguuuaaaauuauaaagcacaugaugaaagauguuacuauuuuaaacauucacaagugaaaaaaauuuauuuuaggguuaacaucuuaauaagaccauuaauuaaagcaaccauuacaguuacuuuucugaauauauaauagaaaggaaaaauaucuuacucuuccuuaagugcucccuuuuuacuagguuccucuacaaaagcuucuguuucuugcucuucugacauuccaugcaaguacggauuuaauggugguggccuccaaaaagauccauuuuugaacauacgaaaaucuuccguccgccauuuaguuggagaaucucccuaacaaacauuuagaguuauuauaaaggucuaauuacucagagucaaaauuaacaaaguaauugauucuacuugccugcagaauagaauaaagcuuccaccuauaguaaacaugggcuggugucugguuuucaaauaagaaccuacacaaaacaaacaaacauuaaacaucauauucuuuaacaaagagcuaucuucaauuaaauauaaauaaaugagaaauauuauuugccuauuuaguucuaaauaaaacaaaaacaaagaucccugaagagaaucucacccacuaccacccgcuaccuauccccauuccuuuacugcagcccuagacugccuuagugacugacauuaauacucagaaggcaugcaucaugagucuuaugaucguuuucacugaacacuuacauggcagauacugugucuggcaauggagagauuuucccaauauguaauuacaaaagcagugauuuuacauuacuuaaguguuaaacuagugucuaagaauaccguaacaauucagaggauaagcaauuuauuuuaaaacucauuuguucaacuguaucucacuuaugauuccuucauugaaaagcauaaugaaauguauuuuccuccuagagaaugcuaaaaacaauacuauuuaaucaaccaaaucaaaaucugauggaaaauuguccucaauacauucuacucugauuacuaaaacugucuucccaucccguugcagaacuaaucccauacuuuuacaacuuuauucuuggaaauauuuuuaauucuaauaaauuaaaaguaguuuuaaacugcaugccugaagauaaaauauaguaaauacauauaauggaauauuauuuggccuuaaaaaaggaaaucccgauacaugcuauaauacagaugaauccugaggacauuaugcuaaaugaaauaagcuagucacaaaaggacaaauauuguaugauuauacucaugugaguuuacccugaguaaugaaauuacuaagagacagaaaguagaauggcaguugccggggcuaacgggcuagaagacugaggaguuacugcuacacagguaaagaauuuccauuuuggaagaugaaaaaaguucuggagauggaugguggugaugguuguacaacaaugugaauguacuuaaugacacugaacuguauacuuaaaaauaguuaaaaugggaaauuuuauguuacauauauuucacaauuuuuaaaaaaugcacaccugaacauaggauuguugauuucucuguucauaaucauagcuucaaacauuggcccuucacguacaacaaacucuaucauucgauguaucagggcgagcaaauuccuacaacaacaacacaguuaaagaaaauggauucagaccuaccacuauauaaaacuacacuugaccuaaguuacuauaauugugcagaaaaugauuauucugcugacuaacaccgaauuuaauaccaaaaaaguaaccuggagcauauguuaaugccuugugcauuaagaggguguggggcagugggaguagggaagugggaggggauggaaaggugagggaggguaggaaaccacaauacagccucauaguaauauuuaauuuucuaaaugucacuuauuuuccaaaaguaaaacauuaaauuauaaaucacaacuaauuagaaagcugcaaauauugauauauaaaaucaguaacuuagagccugcauguuauuacagccaucuagaaauuuacacacuaucucaguuuaaaaaaaaaaaauuccuaaaccaagcacuuuuauggugcuacugaaauguuauaaccaugacuauaauuuauaaaaaugcaaaacuauuuaacaaguuuaaggccugauuuaauaaaaaauccauccaacuccuguguuuuucugguacacacaccagaugcauuuuuuauuaaaucugaccuuuaaugaggcaacaucccuuuggaccacacuucaaacuaguucacaauucaugaaauagauaauucugccuuuauauaucuuuuuucccuccaaaacaagagauugauaugccuguacacuaucaaucaaugaagaaauuauguugccaaagccuuaagugaauggaguacuacucuuuccaaaauauugcaaaaugggguacacggugagaugcccuucccauuuucuguaacaauuauuuuccaauauuuuaccaaaaauaaacauaugugaguaauuuuuuaguacagucauuuuauugacugaacucacaggaagucuuuaucugaagcuggguccuaaaaucaugugauauuuuauuagacuccaaacacaauuuuggacauugauuauggugucgggcaaaaaugacucagguuauuuauaagcugcuuuugauuccucauuucaccaguccccauccauacacagcuggcaaauaacaauugggaaaagcaaaaggauauuggcucuugguacaaagcacacacuaaauuacaccuuuagcauucccagcucaaauuacguucauauaacugcuagaauguaaauaaauauauaguuauagaacaagacagacuuuuguggcucuauaaugcccuauuucagaguacaugaacaauaaaauaaucuaucucaaggugacuauaauuauuuucucauagcuuucaaacaaaccuacuuaaaaugaaaucucuccauagugaaaaaaauuuaagccuaaaggaaguaaaaaaaauugcaucacaguuuaaaucuuuacaaaggggaaaucaugcauuuaaaacuacuaauucaaccucaaauugucaaaacaaaaaacuaaaaacauugcuuaauuuucuauuuaaaaauuauuucucuuucacagaaguaauugcucugcaaauaugcaguucuucagcauucauaugguuaaugacauuauuuugaaggaagggcgauaauguaaaguuaugauucaauuccaaaacuccccacugauaggagccaaauuaaagcuaagggaaauuuuauguauaagacuaauuacuagguggacaaauguuauacauccagaaacuugugugaauuaagucaaaagcaacuugacuuuagcauuuaagauagaggaaaauuguuuagcaaguuuaaaaacaaaggauucauccuaauggugagugaagacuuucggcaaaacgcacacucaaaauuuuguuuagaaauaagcugagccacauacauguaaagcuaccacuagauaugugcuuuuuuugaaugcuacaaaaauacuauccugugaaugcuuuuaucaguggugaaaaacccacuauaguuuuaaacaggcuuguaacugauaaaucuauuuuuagaaaauuaaaaguuuauaaguauuuuuaaaauguuucaugauuauuuaaaaucaaaaucugacaauuaauuguuauuaacuugaugucaagauuacuaaagaacuguaaucacauucuucuuccuuaaggauuguguuuauuuuaaaaauggugacuuuucuauuagaauaaaacaguguaguacaaaaagaugauauauuuaaagugcauuauuuaauuuuaaaaugguaauuaucuuauucugggcaacaauaaccaaaaaaaaaacaaaaacaaaaaauugucucucaguuauaauaaaaccacauuuauuggagucgaucguaccaaugucuggucaaaaacuguauacuuucccaauccaucccaugauguuuuccuggucccccgcugccgcagacaguucagcugguguugcucaccaaggccaaugucaaagagaauuugguauucuuuuguguucauuuauuauucaaccaguguuguguuccuguguuugggaaaaggcuuagcuugacugagcaagagcauaccuacagcaugaauucuucugcuuuaauaguguguugaaagagaaaaaaaggaagaaaggaaaauaaaagaauuccaaauaccuuuguuaccaugaaaagaaaguuucuaguauguccaguguucaugacaauaauaggaauuucuucuuaaaaucaauugaaaaaacaaaaaacaaagcuaugccuucaguaaggagaacucaaaccaagguuauauauuaaaugcagauaauucagaaaacaagaaaaaaauaacaacagauugggucaaacuguaacguuaucugaaauuuacgacacacuuaaaacaucuauuuucccaugacaauagucuauugucugacuccaaaucagagcuaauaaauacacucuaacuagucaaacuauaaacauucccuacagugauaacaauaaaaacaaaaaaagauacugacauaaaauugcaaaguauacaaaaguuaguuaaauuucacacauccccccgcaaaaaguacugggaaggaaccauugcucagucaagauacuaccuuuuccucaacaccauuucuuuuuaaauucagaaggggauauugucuauauuuagaucaguaauaauaaagaaaaacauguaccuuucuguugggauaaccacuuugacuauggcuugcgacagagucuguauaugaagucacaucagauaauaaacauagaauaugugaguauuguuaacaaguaacaagcaaaaauauacauaugcauugaaaauacuacauaucuaaucacaaguuuugcaggcaaucacugcauuugaagucauuauacacuaagcaauuacauaaaugcaaauggauguguucagugaacaauaaacguucaccaaaugcaaagaaucagaacauuccugccagaaugcacaucaaugcacugaaauagguacuacacugagaauuaucagauaaagauuuuaauuugugaaauaauuaacuguuugccucugaccauacaguucgcuacuuuguucccaagccuuuaaaaccagcccugucauuuuaaguguaauuaauucauaauagaaccaacgaauucuuauaacuugaaauuaaguugguuuuauuuacuaaaaagaaaauacucacccuuugcuuuuacuagauuaacuauuuuuuacaaaccacauaaaucuucucaaauauucuaauaccucagaucuagcugccauccaaacaauaacuacuuaggaggucuuucuaauugaaaugucacuuaaccaaauacaaaguaucacuuucucagaacaaaguaaauuuaguuaauacacuuaagcaaaucuggauacaacacuggacaaaggaaaaaaaacuuaacaaguggucaaaaaaggaaugguagccacaaauaaaaauaugaccuaguauuucaaauauaggguuuccaugggcuaaggcagggaacacaucuacuuauuucuuuaaaaguugccaaacagaauuacacacacauuuucuauaaaauuguugaaaagaaauacuaccacagcuuuaguauuuacaaauuagaugcggccuuauguccauuuuuuaaauuaccuucucaaaauccucuuuguuuuuagguggcgguaacauaggagcauuaggguuuuuuaaccgcucucuaggcugcgcauuaaaaggcaguccggauggaggugggggaagcguauguuccaucauagaaggcggaauguauauuggauguggaggaauagguacagcuuuaccccaaccuaacuucauuucaaaagacauaaucauuuuuccuacaagaaagaaaugaaaggucauuuuguuaacucucaaaaguuuccaaacaaaauuuuucuggugaguugaaauaauuuucauuuuaaccucuccauuucagguccaauccuuccuaguuuuuauaaauacuuuuccaaaccaaagaaauaucugaauuguauaaauggauaauaaaaauguucuuaccauucaaauuuuuuaaagcucuuucagcaucucuucuauucauaaaggccacaaagccgcaauuucucucucuggcucuuucuucaucaguucuaggccacaugauuuucacacuggcuaacgguccaaaucuuccaaauucuuggcacagcauuucuucauucaucuauuaaaaaggguaaaagauuuuuauuaugcaaaaaagggaaaagaaaaaauuauuuucagaaaacaaaguaguuuuuacaaaauaaaaagcaacauagcaacgugcuucaauuuuccauuuaaguaccaggaacgccacacaaguaaaaucccgcguggggcauucauaaaucauuucauacuauaaauauucugguuuauuuaagaugccaggguggggaaguucaguggaugaagaaaucaaaaucauuuuuacucucuaucuuccuuuguuuuaagguccuggaucuaaguaagauguuuuauagugaugguuuguuuaggcauuuaguaacauuuuucaagcaggcaugguuaguacauuuaaauuaaagaggaaauauguauugacaaugaagaaaaaaaguaucuaaucaucuguucuaacaaucaacuacccauguaaucaaaugcagagaaaacagguaacaguauauaugcaaaauauaauuuuuaauaauagcauauuauauacuaccguuacuacauuccccauaucauaauuaacagcaccaaugcaggaaaagaauuaaaauauaaaagacaaaccacaaagaguaguuuacuacuaugagaagaaaaagggacuccacaaggaaacaaguaugcaucagaaguggacagucucaaaauaauauuauucaucaauggucacacccugauuuaauaauaaaaucagcaccuaguaaaacauuucaaauccagaguucaaucuaguuacugaaagaggaaacaagaauauguggcaagacaaccugggccauaccaguaagacaacucuaaagacuauccaauuccaucagauuugucagcuucagaaucuugauuuuuuuugacuaacaaagcuuucuuccaaaagcauaaagcauaucaaucaacauucaucuuacuuaauauuaccuguggauuaauguuuccaagguauaaauuaguagugcuuggaucuccuacaucaugugagccaggugcguaaucaucaagaacuagggcagaaagaaaaaaagaauuauaaccugcaaaacauaaaguuuggaaaauuuaucgauuaaaagagcaaaaaacuguauuaccaccagaugaucuauuucuucuugaaggcgcguccacuuaaaggggagaaaagaagacaauuauuaguuuuuauaauacaguaguccccccuuacccucaccuuuguuucccccaguuuguuacaguaagguauuucugagagacaaaaagagagaccacuucacacaacucuguuguuguuguuguuguuuuuugagacagacucuugcucugucgcccaggcuggagugcaauggcacguucucggcucacugcaaccucugccucucagguucaagcaauccuucugccucagccuccugaguagcugggauuacaggcacgcaccaccacgcccggcuaauuuuguauuuuuaguacagacaggguuucaucauguuggccaggcuggucucgaacuccugaccuuagguaauccacuugccucggccucccaaaguguugggauugcacauaacuuuuauuucaguauauuguuauaauuguucuauuacuuauuguuguuaaucucuuacugugccuaauuuacaaauuaauuuuuaccacagcuaugaauguguaaggaaaaggauaguauauauccaugguuucagacauccacuggugauccuuggaauguaacccgccacggauaaggugggaacuacuguaauuaaucacaagcauacacauuaaaauaaaugccacuuacuagaacgacgcugaccaucagaaucugacugaggagguucaaaucgacuuaaucugccuuuuguuuuaugucucucaucacguuccucuugaauucuguugaaaauauuuacaaucacuuauaaugagccaaaauuuguucauucacauuucagaauagcgcuuaucaaauuacuaucaucaaauaacuagaaauaucuguaauuaaauacugguacugauaaccaagauuagagggucccucagcuauaauacaaccacgagcaaauuucugauauaucauacuaccaauggaacacaaagccuacuuuaaaggugaggaggaaauuaaacacuaaaaccacugaauuuguuucuugcuaagucuaacugccccucacucccaucccagugaguauacuguuuccacugcaaacaggacucuggacauuaaguaaaucaauugaacugaauccucguaaugcaagcaacccaggugcuggacuaaaugcuaauuuauuuucaaagauagcccaccaaauauuauaauaucuaaaacaaucucauagcaaacugguuaguaauaacuaacugguacaguauauucuuuauacuugcaucuguuuauguaucagcucaauacaccuaugauaguuauucuccacacuauaaaacuuacugcuuuaauucuucuuugaagaguuccaaauugcuuuuuuucuuuucuuucucuccuuuuuuaaguggcuauaaaggauaugacaaguuauacuucaaacaaaaggauaagcaaaaccaaugauucaauaauaagagccuuuuuacaucauuucaguacaaauuguauguucuaauuauuuaaauuaaaaaggaagaaugcuuuucuuaucauugaaccucccuuccccuuccuucaaaauaacaaacaauuaaauuauuacuacaauuaaacaauuaaaaugacaaccaguagucagggaaauuaaugaacaugaaguaacugaacugccauggaaaguaacugccaaaaauacgcacucuucaaaaaucaccucuggaggacaugaguuacuggaacaguaaguaacaucuuuggaauccucuuuuaaaacugcuucuuaaucuacuuuuggaauccuucuuuuagaagugccaacauaauuuaauagggaagaauaaucuuuucaacaaauggugcuuggacaacugaauaucuacauacagaaaaaugaaguuggacuucuacuuuacaccauauacuaaauguacaaaaauuaacucaaaaugguucauggacauaaaaguaagagcuaaaacuauaacacuuuugggagaaaaccacaggaaugaauauucauaaucuugaauuaggugaugguuucuuagauaugacaccaaaagcguaaacaaaagaaaaaaacugauaaauuggacuccauuaaaguuuaaaaccuccaugcuuccaucaagaaaaugcaaagacaacccagagaacagaaaacauuuccaaaucauauagcugauaagaaccuugacucaagaagauguaaaauacucuuacgauucaacaacaaaaauacaaauaacccaauuaaaaagugggccaaguaucugaacagacauuucuccaaaagaaacuuauaaauggacaauaaacacaugaaaagaugcucaauauaaucaaguacaugcaaaucaaaaccacaaugaaguacaacuucacacacacuaaaaugacuaaaauaaacuuuucaaacaaaauaguuuuguuuguuuguuuguuuguuuuugagauggaguuucgcucuuguugcccaggcuggagugcaaugcugugaucuuggcucaccacaaccucugccucccgaguucaagcgauucuccugccucagccucccgaguagcugggauuacaggcaugcaccaccaugcccggcuaauuuuguauuuuuaguagagacgggguuucuccauguuggucaggcuggucucaaaguguuaguguacgacgugagaaaacuggaacccucauacauuacugguggaacuguaaagugauacaaccacuuuggaaaaacuggcaguuucucaaaaggcuaaacauaguuaccaugugacccagcaauuccacuucucgguguguguauauacauguauccaagagaacugaaaacauaaguucacacaaaaaaagcccacacaugaauguuuacagcagcauuauuucuaacagcagaaaaguggaaacaauccaaauguccaucuacuaaguaaugcauggauaaacaauauaugguauguccauaaaauggaguauuauucaaccacaaaaaggaaugaaguacugauucaugccacaacaaagaugcaccuugaagcauuaugcuaaguaaugaagccagauacaaaagaccacguuauauaauaccauccauaaaaaauguccagaauagacaaaucaagagacagaaaguagauuaguaggcugucagggacugaaguuaauagaaaaaaaaaaugggagugacugauaauggguagggauuucuuuuuagggugauaaaaauauucugaaauuagaguggugauuguugcacaauuuucaacauacuuaaaaccacucaauuguacacuuuauuuaaauuuuuuuucuuuuuguaaagauggagucuugcuauguugcccaggcuggucucaaacuccugggcucaagccauccuccagccucagcuucccaaagugcuaggauuacaggcauaagccacugcaccuagucaacuguauacuuuaaaaggauaaauuuuagccaggcgucuguaaucccagcacuuugggaggcaaaagugggcaaaucgcuugaguccaggaguuugagaccagccugggcaaaauggcaaaaccccauuuucacaaaaaaauaccaaaaaauuagcugggcaugggacuacauugccuguagucccagcuacucaugaggcugaggugggaggaccaccugagccuacgagguugaggcugcaggagccguaaucacacuacuacacucuagccugggugacagagagacugucucaaaaaaaaaagguaaauuuuauuguauuguaugugaauuauaucucaauaaagcugggguuuuuuuuucauugcuuuuagagauauuuuuuaagccacacaaaaaaaaccaggcuuacuauucaaugcaaucauauuuauucaccacauuugguuccaaaugacaugacccacaucugucuaccaucucccauaaaaacuaaacccucaaagaaaaaaaaauuuuuucuaacacugagaauauuuuaagugucacuaauucugacaguaauucccaaaauguuccaaaaauguucugggaaauauacacuacacauacuaauaauuuaaauaccucaguucagaaaugcuuaaaaagacaaccccauugcaagucaaauauagucaauuuuugacuugcaauauagucaauuuuugacuugcaauauauuaugagcauaaauagcaaauguucacugcucaaaaagcauaaaaagaauaucaucuacgugucccaauucauuaacucucaucuaaguaaauuacuggguuagaaagcaucaaaacuuaacaucuaccacccugcccccaccaaaaacgaaaaaaagccaaagucuugcuuacaguggaaguaucacuggcagugucaucucugaacauaaauggucaauuacuuaaguaugacuuacagguuuuuugguuucuaucacaagaagagaugguggucuuucauuggaagacugauuuggaggauuuuuuugaucugcaaaucuugaagauggcuuauagauuuuaccucuuuuuucaucuguuucauguucuucugaaauuuaaaauacuaaguuucaaaacuaauuucgcaauauuuuucuuuacuguuuuauuuaaaaacaaguaaaaauuaguaaaaugcuuuuaguauuaagauguaucacuauuaacaaauaugaaauuaaauucaaauaucaccucaauaaugcuaauuuaaucauuucauagcaaaacuaugacacauauuaaaauuugugacaagugcucugcugucuuaaaacuugaaaggaacuaaauauguuuaaaagcuaucugucuucagcaucucauuaauugacacuuggccauuuaucuugcuaauuaauaauaaccacuagagggugcugauagaaaauguaaaauucaaaagcaaccaaacuuccuuucauaauuaucuaccugcagucauucaaccaagauggggcucgcucaaaaacuguaauacaguuaugcuuuauuagcaguuauacuuuauaaacuuaccuuuagcugcauuaacaacacccccucgcacaaauguuuucacuuuauuaccaucacuuccuucaaaagcagcaagaaacuccucauaaaucucagcagcugccuuuucauccuccuaaauacacaugaaaauauuaauauuacacaauacaaaaauuguuaauguacacaaggcuaaauucaucaaggaauaauauggacgaaaacccucccuucccagguuaagcaguccuaacaaguaauaacgucuaaucuuuagaagauauuaaguauuaauuaaugaaaccaagagaggcuuugcuccucuaccggcaauuugcagaacuagaaaagaaccccuaaguauagauuaauuaguaaauuugucuagagacaacucaagcaucaaauuauaugacaacugacuauaugaaaacauauuuugcuaguaauguuuaccaaguuuccaaggcaugaugauuuaauucagugaauauaaauauuuuucaaaucaccaaaaacaugaguauuagaaguugaagcagcaauaucuacugacaaguggcauuaaggaaagcucagaagaaucuugauauaaagaaagcucagaagaaucuugauauuuucaauuauucuaaauguccccaaaacauguaugaacagaagaaaggccaauggaacauaacagaaaauacagaauaaaauugaauagcauguggaaauuuaguguucaauaaaaggagcaucucaaaucagugggaaauagacaaacuuuucaauaaaugauacuaggauaacugaauaauuauuugaaaaaagacaaaaauuaaucuauucuugacaccacauaccagaauaaacuacaaaauaaucugauuuaauauucuuaaaaaagaaaccauucaguaguagaggaaaacaugaggaaauuucuuuauaagcugguaauggaaaaaacugaaaaaccagaaaucauagggaaagacugauaaaucugauuguacaauaguuucugcauggagcaaaacaccagcagcaaaauaaaaagacaaucaacaaagugagaaaaaaaauuguaccuuguauaacaaaguguuaauauaacuuauagaaaaaaaugguucagauaugagcagacaguucacagaaacaaacacaagaaaaacuguuaaacuuuacucauaaugagagaaauccaaauguaaaacuacacugagauaccauuuuucauguaggagauuggcaaaaguccucuacuggcagugcuauggggaaacauucauucauacacuacugacaggggugcaacaugucacugccccuacagagagcaauuugacaaugacaaauauagaaaaacuacauuuaugcauuuaucacucaacccaguaaucucacuuauaagaauauaucccaaaucucaccuauaagaauauaucccaaagauaacacuagcaaaaaaaccaaacauaugcauaacauuauccauaacagcauuacuuuuaauggcaaaagaacaaaacauaaaugcccucgauagaauuuuaguugaauaaaugauugcauaucuacacagccauagcaaaugaauaaggaguauuucuauauacuugagguaauuucugagauacaauguuaaguuaaaaaagcaaguaggaaaaaaguguacuguauaaagcaugcuaucauuaaucuaaggggaauggguacaaugugucuacacacacauacacuuuacuuauacaaaaagaauagauuagaaaauagccaaaacuauaacaaagaaaaaagaaacagggugagggaacaaggauagaagcucaacuccuaggaauauauguuguauuacagacuugacucagaggcggaccugagaauauccuagagguuaagaaucuucgggaaacauuccucuaauacacuuacuaaccccuuagacacauucauuuccaaggauaauucaaaauacauuuucaacauuaccuuuuucuuuaauucuuccuguuccuuuuuacuuaaaguucgcuuagcuguacucauuuuuccaauacugaaugcuuuaaguuuguuuuccagaagaggcuaagaaauaaaaagcauacuuuuacauauagauucuuaaugcuaucuaaaacuuuaauacacaucaacugauaacuaagucuucagaauagacugccguuuuuuuuuaaauuucauuguaaagaaaaguuggggcuacucuacacaucaggugccuaucuuacuugacucugauguuaaguauucaucaaagaaugucuucauuuacuagcucaaggucaaaaacaugcaaaagucauguuaaaaaaaaaagguaaaaauagaagagacugacacuaaugcuuagaacaagaauaaaagcauuugagggggaaaguacagauguuucuggggaaaaguugcaaugacagaaaacagauccucaaauaagcaaauggaggcaaacauuuccaugguccuggggcaggaauuuaccaccuacaacacucauuuuacauauuauaaaucacuuauuuuuuauaauuugguaaacuaccucauucuucgucaauaauacugauauuuaugaacauaauuucauucuuugcugggauuaaaauaucaccuacaauauuuaaaguuucagcucaaguaaaacuauaucaauuuuaaauauaagaaaacacuauuuuaaugaagucuucauuuauguaacuuagaagcaacuuccuucugaaauauagccugaauacauugucuguagaccuuuuuguucagucaguuacucauuugauuuauaaacuuaaaagguaggaaauguuuauuaaauacaaccuaaaauacugaaaucugaagguuucucucuccuacuaaaaugagaagcuaaccaauuacaaaaucaagacuuuaaauucccuagucauuaaauaggcuugccuuugggagaugcagaauagaagaguaacauugcugcuaacuauuuuaaauuuauauuaaaaucccuuugagaaaaauaaagcaguuuauaaccuaaaagucaauauuggguuucaggagaggauucaaaauaaauuuucucaaaauagaaagaaaaucguuuugccaucauucagucucuuugguuucaacuucaaaaguuuaaacaaguggcaaaauuauauaugaauuaaaugaaacccaaugaaaaauuaccaugcucaaauuuuauuuauacccuaagagcuaaauucagauacccaacagagauguggcaaaggaaacuauggaguauuuuucaaauaaacaauauaagcaaucauuuaaaaguuuguuuacagaauucuugcagaaaugaaaaaaaauuuauaacuaaaaacaggauauuuuaaaacggauucuuauaaaaauaaaucuaggcaaaguaaaaauauauuuaugccuagaaauauuaaacaagaaaaauacuuuguuaccagugguuaauacuggcuggugaugacuguguuauguuacaaauuuaaccacaagaaaauauuacuugacauagaauaaaagucuaaaagagccugagagcacuuuagagaucuaaaagugaagaagcuccuucucuguguuccuguauuacccugggcacugcacucauuagagugaauagcaccugcuccuguuugcuuucagagugagacuauaagcucagugggaacacgaacaguguuucaaugaucugugcauuuccaguaacugguauuucgcacuugguucaauaaauguuuaaguggggaaagauaaacuugacaauuaaccauuuuaaauccaaacacuacuuuguuuuucaaauaaaauuuaaaacucuaaaaugaaauaucucacauuugagcuaaaaagaugucccuacauaaaugaguuuacuguuaucccaaauacaaaaagaaugcuauuuucaaauagaauaagaugaaacacauacaaaaccaaauauucgaccacuaaauucagucaaagacagauuaaaaucauuaacuauccuuucuuaucuuuaccuuaucuuaucuauacucacucuugagagauucugaugaggagaaucacaaaggcuuucacgggcacuuucauuccuauaauuauguuuucuugggcucuuaggucguguccgacuuggcauaucacuaucugaggguccagaugcauccaucuucaggaaaaguaaaacaagagaaaaaaacaaaccacacauauauacauauauagcacugaaaacuaggaauaagccaugccagauauugacaaauuucauuguagauuaucaaaauaucacaucccuuaauaucaccauugauuucaccaaaaaaguucuuaagaacagggaaaguuuucaauaacucuaacucacaagcuugaauuuuauauugguaacaguuguuuuccuugaaguaacagguucguuaccuucauuuucaagaaaaugucugccaaaauccccaagucugauucaccauaguuugccugucagucacucccaaguaaaacugguguuucaugaaaaaagcagcuaguuucauuucucaacucaaacaaacaucacauuuugguaagcauaaguguuauacguacuucuuauuuuaucacacagaauauuaagacgaacuacacaaaagaugaagacaauaguaauaauuuuuacugcuugaugaaguaguaaaauaguaguaacuuuuacugcaucaucaagcaguaaaaauuauuucuaauuaugcuaguuuuuuaagugaaauuauugugccugguggggaagaauauaaugacuacaaguauacucuggugucacugccuugaucugugcugaagugccaacaguuuacccaccaaaugcuuuuguaccuccagcuacacuugcauuagugcaaaugccaaaauggugaaaaaggcauaaauaaugccuuaguauuauuacaaaauaguuuugaauucacagacccuucucagagauucucagugacuccaggggucuucagacuacacuuugaacacugcuguaauaacauauauuaaaaaaauacuuauuguaguauuaucuauccaaaauguuacuugaaagcuuuaaacaaaaaauauaugcccaucaacaaagaaauaacaaacaacugcacuuccccaccacagaacauuaugaugccuuaagaaagaacagauuagagcuguuaacaguuuaccugcagggauuuccaacauauguuuugugcggugagaaaggcauaugcauaaugcaaucccauagucaaaguauaaguauagauacguuauguauguacagauuuuuacacaauaaaaaucauaaggaaauauacauacuagguuucuaacaucgcuucagagggcuaaguuaugcaagcagaacauaaaaaaaaaaaaggaaggcgccuagaaaaaaaagaguaaaagaaaaaagcacauacaauuguauuuauuugucaaguaaaaucauugauguagggauacauaugaggagaaguuaaauuuuaaaggaaaaaagacaaagauugccuucuauacucacaugugcaucugaagauccagaugaaugaacaucugaugaucucgucuacaaguaucaaaaauaaaagucaauaauuuaaaaugucuuauacuaacaaaacaugucucucguguuauacaaacuuaagaguuuccuaacuucuggcaauuucuccucagcuaauaaaacugagcaaaggcagucucugacuuaugaaaagauugugauacaaaguaaauguguaagucauuucuuuaaaauucagccugcauauuuccaaaaauauaauaaacacuagugggauauauaugaggcaaaauuaccucuuuauaguauacacuggaaaccuaaccaccauuuuuacacaguuuuaugcaaaagcucuuccuaaucauagaugcaucguuuacugccacagcacugcccagcaacuucuugguccacagcacgagaacucucuuucucuaaucacccaaagccacauaaagaaauccacauauaaauccuugcugucuauuaaaagguacaaauucugcaaaguuccagaaaauauuaucaaauccccaauaaggcaccauuuacaacucguuuuaagggagaugauucgauagcaugucacaggcugccugguggcaugagaaagaguucauauaauaucuuccagugaugucaacuguuaaaacuucaacuuuucuuaagugaucuaccuaucagauuauacaugguaugcaauaacuuguugccacuacacauguaaagacaaagaugacaagcuguaggacgauuaacuaaauaauguaugcuaucuuucugaaagaaagauucuccaagaauuuuuacuuggggauccaaaauauaacugucacugagcuguuuuuauuuuugaggguauacgguagugaaauuuuacuuguuuuuauuuauauauuuaagugucaaauguucaaaugaaaucaagaauauugagaucacaaauaucucaccugaccccaacucccagacaagaugucauauaaaguacaagauaaaauauuaguuuaagagaaaaacugaagauucauguuauuuaaaaaagagcaaagauccauacaguauuguuuuauuuacauuguccagacauaaggcuaagaacagcugguaagauuuuuacacugaaucaauuuacuccucugaacuccacuguauugcgcauuagcauaggcaaaaaucagcccaggacaacaggacaaccaagcacugggaccccucccaucucauucuuucuuucauuuuuuuuuuuucuugagacagagucuuacucugucucccaggcuggaguacaguggcgcgaccucggcucacugcagccuccgccucccggguuccaguaauucuccucccucagccuccuggguagcuaggaguacaggcacgcaccaccaugccuggcuaauuuuuguauuuuuaguagagacggaguuuuaccacguuggccaggcuggucucgaacuccugaccucaggugaucuguccaccucagccucugaaagugcuaggauuacagacaugagcgaccgcacccggccccaucucacucuuucuguccaugguuuuucuguccccaacuuuuguguccacccugauuuucuucuagcggcuaaucuuucuuaaaugucaaggugguauaaaagaaaauuuuuaguauuuauuaacuaugaaacacacccugaaacauaucuugaaaugcauaaauuuacaaauaucuagaaauuuaaaaauccaaaagaauaaauaacuacucuuacaaaagaaaaacaaguucaggcaagaggcugaagggacugaaaaaaaucaacugccugggccaggugcaguggcucacgccuguaauccgagcacuuugggaggccgaggcggguggaucaagagauggagaccauccuggccaaaccuggugaaaccccaucucuacuaaaaauacaaaaauuagccaggcgccuguagucccagcuacucgcugaggcaggagaauggugugaacccgggaggcagagcuugcagugagcugagaucgcgccacugcacuaccgccuaggcgacagagacuccauaucaaaaacaaacaauaguaacaaaaaaaacucaauugccuuccaauacaccaguauuaacuugcuaagcaacaaaaacauccuaaucauaaaagcaacaaaaaauauaaaaacaucuagaaaccaauuuaagaaauguauauaacccuugugaagaaaacaaaaacuucgagaaaaauccaguuacucaagccaccuuuucaaaagauucauauuacuggaugggaaaauucaauauuaagauaaugucaaugacaccuaaauuucuuuacauauuuaauacaauuucauucaaccgcucuaaauuccaaagggaaauauuugcaagggggcaaaagaauugccaaaacaauucuaaaguucacccagaaagaauaagcauccaaaagaauaacuaagaaagcgcuacccuuucuguagucuuugaugccaccacauccaaaucaucauuucuaggauuuaaaaacaaaagauacaagaaccuaggcauucugccuauuuccauauaguuaacucuucccugacuccaagucaucaaaagaugaagcucuauaaucuucaaggaucucacuugcguaaccauucaccaaauuaaauaaucucuaauacaaaaauaaucaguucaaaaguaacaauuuugucagcuuucaaaauuacacaauuugauaaauuugcaaacagagcaguaacagcauaguguagcacaaugcaccgguguaggacaaugcaccagcugauuucaguuagcuuaagaugucacuaaucacauuuacugcaaaccagacauuuuccacugauacauaccuacagcuacauagcauucagcacggaacuuuaacaguucaaacagcaguuaacacaauuuuuaaaauaaucaucaacuucuaaagauaacagucaagguaaacaguaaauauagcacuacuucagaagcugagcuucucccucuuccuaaccuggaacugaacuguauucuuugucuugaguuuggcuuuuuauuuuuaacugaagaacacaaaccaaugaugccuaaagaucuccugaagucggccgggcgcgguggcucacgccuguaaucucagcacuuugggaggccaaggcgggcggaucacaaagucagaggagaucaagaccauccuggcuaacacagcaaaaucccgucucuacuaaaaauacaaaaaauuggccaggugcgguggcgggcaccuguagucccagcuacucgggaggcugaggcaggagaaugacgugaacccgggaggcggagcuugcagugagcugagauagcacuacugcaggccugggcgacagagcgagacucugucucaaaaaaaaaaaaaaaaaaaucucuugaaaggacccaaaagcugcuggagggaguggcucaugccuauaaucucagcuacuagggaggcugaggugggacgacugcucgaggccaggaguucaagaccagccugggcaacauagcaagaaccccugucucuggaaaaaaaaaaaaagaaaagaaaagaaaaauacaaaaggaagaagugaaaaggcagacuaagggaaguuugacacaauaaaguagcauacacaagagaaauuuauuuuaaggcagagaaagcagacaguagaaauguggggagggacagcaagaaaauccaaaaggaaaaaagaucauucugauggcugcuaaagggauaaaagugaagccaacuacacuaccuguugcccuauagcuugcuggcugagaacaaaacuaguuuucuucuggcugcuccaauuuuacuuuaagugaaaaccccacaucugaguuuccaaauuaccaagcuauccacagcaacauuccuccaacacuaccauucugccuagugagcucuccauucguguaucugucuccuaaucucccacguuucuccucucacccucuaagagaagcaacuuucaucuccacaaguuuaacaaucucuccuauaggaagcauaacaccaccuuaauugcauugugcugacucucuucuacuagacagcaugcuccucaaagauggguacauucuuuuuuuugagacggaguuucgcucuuuuugcccaggcuggagugcaauggcaugaucucggcucucggcaaccuccgccucccagguucaagcgauucuccugccucagccucccgaguagcaugugccaccaugcccagcuaauuuuguauuuucagcagagaugggguuucuccauauuggucaggcuggucuugaacucccgaccucaggugauccacccgccuuggccucccaaagugcugggauuacaggcgggaggcacugugcccggccgcuaaaaauggguacauucuuauuuaacauuuucuaacucaacaucaagcacaagaucuggcaagcgacagagucucaauauacuugacuugucagaacaagugccuaccaccaaacaaaauuacacuccacacuaucaacauacuaugcuguccacucauuaacaacagcuaccuagcuuaauaccacuauccaagccaaaucaagguauccaucuuuaaaaaacauucacaaaaucauuaauacaagcacuauauaaauaaaguuaaauaacaaaccuaagaugauuuuuuaaauuauucaaaacacuaccaauacuauaugaaaaguuguaaguacacucugaauaaccuauaguuuaucuaaacugaggaagggccuugugaaaaaacuuaacucaaggaauauaugucuaacacuaccguuagccucaagugcuacugacaaauguaucuugcuuucaaaaacguuauuucagcaaaauauccagcucacagcugaugugcaauaaaauguuaaaaccaccuauacuagaaugaggcaaauaguuuguaauauuacuauuuuugauuuuaauaucuuguagcaaguuuuucuuuuuauuccaaaaaugauggcuccuugaaaaaaaggguggaggguagagggguagauacuucaaccggcauacuaaaugagcucuucucucaaugauacccaguaaggcaaauggguaucuuucuuagguuuacuuuccaaggaaaacaaagcuucagaaauaaaaaacaaaaagugaaaauaaaaacuggacuuucagaaaacaauucaauccagaaagauaggaauuauuuuuaaaaccauaccaacaggcauauucuagcacccgugcugcagguucaaguuucgaaaaaguuaucaaucgagaaaauggaaggaaguucaguucuaccuuccagaccaaaacaaaaccuucuaccaaaaaaacuaccuuacauuuuaagauaagguuacaaccauaaaccauaauaaagauucaguuuaaaauuggcaaacuguuugaaagccugauuuucaagguuuguauuuuguuuggacuuuuucauaaacuuucagguaccacaaaaaaugaaaacuggcaguaauaaauaccuaagguucacaagccuugaacagguccucaguuuacuuauuucuuaaaagugauacuuuuuguuaaucagcaaaggcagucaaucaaaacaguucccaaagcaauucagcacuggauguccaaggaagccuguaguauuuuguuuuauccauucaccuaacucaauuuuuggcgauacggcaaaaaagaaaaaaaaaaaaaaagccauagucacagagugaaauagcagggcacacaauuacauuacauuagcaauauuaccagcacaggagauggcagaaggaaagaaaauacuacauuuucuucauauccuaauuuugcugaguaagcaaacaauugacagucaaaaacaguaauuuuuuuauaaauuaaauucuaaggaaauaugcuuaacaauuuuauaaguaaacaauuacaggcucucucucucuccucucaaaaugaaagcuacuacauaacaucaacaccccuccccaaccaagcaauauuuuagacuagugauaaacaaacaaaugcacaggaaaauuuuagcucauuucuagaacauuuguuaaaugucuacaucugccaggcucuaaaaugcaaagcacaacaaaauuacacagaaaauuaaagugcacaggggucucuucauuagggacaauuaugaauaaagguaagucauucaaguacauacacauacauaaaguaucauuuuaaaacuagaagccaggcacgguggcucacgccuauaauccccgcacuuugggaggccgaggcggggggggggggucacaaggucaagaggccaacagaugaaaccccaucucuacuaaaaauacaaaaauuggccaggcgccuguagucccagcuacucgggaggcugaggcagaagaauugcuugaacccaggaggcagagguugcagugagcugagauugcaccacugcacuccagccugggcgacaaggcaagacucccucucaaaaaaaaaaaaaaaaaaaaaaaaaaaacaccccaacuagaagaccuguagagguuaucuaauuuaaucuuuuuauaauuaagaaauguuaauaauuuugccauauuguacauuuaaaauuaacauuuucccaaugucuagaaauauaauaagcaucccuauccauauuaacgggaauguaacuaccaaagaaaacgacgaaucaugaaacagaaguaucuguucacuccaucuguauuguaaaauauaagccacucaucuguucuuuccagaggaaaggaaaucaaaccagauaucaaaggcuagaaauucuaaauacuguaguauuagccaaaaugaucuuacaauuucucuaauaaauuauguguuagaaauaaaaagcagggaagcagggcggggcacgguggcucacgccuguaaucccaucacuuugggaggcugaggcggguggaucacgaggucaagagaucgagaccauccuggccaacauggugaaaccccgucucuacuaaaauacaaaaaauuagccgggcguacuggcgggcgccuguagucccagcuacuagggaggcugaggcaggagaaucacuugaacccgggaggcggagguugcaaugagccgagauugugccacugcacuccagcacuccagccugggcgacagagcgaaacucuuucacaaaaaaaaaaaaaaaaaaaaaaaagaaauaaaauaaauaaaaagcagcuaucugggcagucauuaugacagcugaugacuuagauuccaaaucacaggauuaaaauuuauccugacauuuugaaagcuaagaacuuuugauuuccucuaaaaacaaaaagaggggaaagaaauuaagauuuauuauguacuucauagacauuaucucauuugauccuuauaucaaccauguaaaaaaagaauuauaucuacauuacaaaugagggaauugaggcuccagaguuuaagcaaucugccuuauuaucgcaaauauaauuaauuaccaagucaggauuugaacccaaaucucuuguuaacaaaauucauaaucuucccacuacauuaugcagccuccaaauuaguuaagauauucugauuccuuucacagacaucaguaagaaaucugcuaauagcaucaagagauuauaaucuaaggcaauauaaacagaaaagauuacuggauaauccaauaauuuauuuauugagaacagccauacauucagucaugagaagcacuauuuuagaaggaagccugaacacagacauugaaauguuuucaauguauccaagaccucaaguagggaauacuuaaaauauuacuuugagaagaaacaaaaauugugaggcuuaugcacgacuuguuaugaacguagcuagcuuuaguaauagcucccuaacgguauguucuugucaggagucuguugagaagaguugguagagcucgcccccaaagagagggagacgagaaaauguacugaggagggggaaaaaaaacugacacaauaccuuguaaagaagccgaaacuggccccucaccaaaguuucuauguaacuaaacgaugucuguuaagaccauuacuaauuaugaauuaauuauuuugguguacaucguucaccaaauggcauaaacagucggauuagagaaagcaaguagaaaacgaguuaugauguuucucagaacuguaaacgcaagcuucucuccuaccguaaauuuaacuuucuaauagccgauuuacagucacacacucuuuaagauuuaacagucccuagcaccugaaaguguuacacagcuucuugcaucagcaucggaaaguuuaacuaccucguggcaguaccaauuacuuuuaauauauucgagaccagaaacccaaaccaaaaaacgauuaaaugucccgcccaagauggcaacuaagaacccaaccguacuaaugcuuaacuacuaccacagcucacugguuucacaauacgugcccaggguucccuguaaacacaaaugcaauuuacuaaucguauguagcuuacaagucuacggagcuucucuuuucacuguuucuucaacauaaagaaagagaccacgaguccucuacccucaaaagugcuuuuuacuucccguuaagguaaagaccacguguagacuguacauuaaccuuggcuaugcagcacugcaaaggagagcugcucccgccucugcauuucccacuccgugucuuugcccuagugguccuccccucacagcuggcgacccuagagguuauucauuccuuggagggaaacugagggaggccggaagugagugagauccaaaaccgagaaaaaagcagcagacauuuaagcaccgggaagcgauucccgccucucucccaggcgcugucuggcggccucagggcgcaggaagcugagauacaggagagcguuuucacugcuucagaccucaaucugaauuccugauuucacuccaaugccaagcgcgggccgaagcacucacgccuccacccacugggcacgccagucucgagcugaaucccggcugggacuauggggagauaccaggccucucaaccugcgcacaacggugcggcggcgcccgggccuaccgucgcgacuagaaugcagaccccaaucccaaucgccucucacaggccagaagcgucugugggccccaaacgacagugguagauccgcugacuuacgaaauuuugucagaaauuaccuuugaacuggccuucugagauccgccuggcguuuuguccgccaucuugagcuuugccccuccuucggcggcggcagcagcacgggcgagucgagcaccgaaagagcggaucucagugaagcccgccagaggcgccugcaaggc

SEQ ID NO: 192084 - RNA, 59196 nt, Homo sapiens
gccuugcaggcgccucuggcgggcuucacugagauccgcucuuucggugcucgacucgcccgugcugcugccgccgccgaaggaggggcaaagcucaagauggcggacaaaacgccaggcggaucucagaaggccaguucaaagguaauuucugacaaaauuucguaagucagcggaucuaccacugucguuuggggcccacagacgcuucuggccugugagaggcgauugggauuggggucugcauucuagucgcgacgguaggcccgggcgccgccgcaccguugugcgcagguugagaggccugguaucuccccauagucccagccgggauucagcucgagacuggcgugcccaguggguggaggcgugagugcuucggcccgcgcuuggcauuggagugaaaucaggaauucagauugaggucugaagcagugaaaacgcucuccuguaucucagcuuccugcgcccugaggccgccagacagcgccugggagagaggcgggaaucgcuucccggugcuuaaaugucugcugcuuuuuucucgguuuuggaucucacucacuuccggccucccucaguuucccuccaaggaaugaauaaccucuagggucgccagcugugaggggaggaccacuagggcaaagacacggagugggaaaugcagaggcgggagcagcucuccuuugcagugcugcauagccaagguuaauguacagucuacacguggucuuuaccuuaacgggaaguaaaaagcacuuuugaggguagaggacucguggucucuuucuuuauguugaagaaacagugaaaagagaagcuccguagacuuguaagcuacauacgauuaguaaauugcauuuguguuuacagggaacccugggcacguauugugaaaccagugagcugugguaguaguuaagcauuaguacgguuggguucuuaguugccaucuugggcgggacauuuaaucguuuuuugguuuggguuucuggucucgaauauauuaaaaguaauugguacugccacgagguaguuaaacuuuccgaugcugaugcaagaagcuguguaacacuuucaggugcuagggacuguuaaaucuuaaagagugugugacuguaaaucggcuauuagaaaguuaaauuuacgguaggagagaagcuugcguuuacaguucugagaaacaucauaacucguuuucuacuugcuuucucuaauccgacuguuuaugccauuuggugaacgauguacaccaaaauaauuaauucauaauuaguaauggucuuaacagacaucguuuaguuacauagaaacuuuggugaggggccaguuucggcuucuuuacaagguauugugucaguuuuuuuucccccuccucaguacauuuucucgucucccucucuuugggggcgagcucuaccaacucuucucaacagacuccugacaagaacauaccguuagggagcuauuacuaaagcuagcuacguucauaacaagucgugcauaagccucacaauuuuuguuucuucucaaaguaauauuuuaaguauucccuacuugaggucuuggauacauugaaaacauuucaaugucuguguucaggcuuccuucuaaaauagugcuucucaugacugaauguauggcuguucucaauaaauaaauuauuggauuauccaguaaucuuuucuguuuauauugccuuagauuauaaucucuugaugcuauuagcagauuucuuacugaugucugugaaaggaaucagaauaucuuaacuaauuuggaggcugcauaauguagugggaagauuaugaauuuuguuaacaagagauuuggguucaaauccugacuugguaauuaauuauauuugcgauaauaaggcagauugcuuaaacucuggagccucaauucccucauuuguaauguagauauaauucuuuuuuuacaugguugauauaaggaucaaaugagauaaugucuaugaaguacauaauaaaucuuaauuucuuuccccucuuuuuguuuuuagaggaaaucaaaaguucuuagcuuucaaaaugucaggauaaauuuuaauccugugauuuggaaucuaagucaucagcugucauaaugacugcccagauagcugcuuuuuauuuauuuuauuucuuuuuuuuuuuuuuuuuuuuuuuugugaaagaguuucgcucugucgcccaggcuggagugcuggagugcaguggcacaaucucggcucauugcaaccuccgccucccggguucaagugauucuccugccucagccucccuaguagcugggacuacaggcgcccgccaguacgcccggcuaauuuuuuguauuuuaguagagacgggguuucaccauguuggccaggauggucucgaucucuugaccucgugauccacccgccucagccucccaaagugaugggauuacaggcgugagccaccgugccccgcccugcuucccugcuuuuuauuucuaacacauaauuuauuagagaaauuguaagaucauuuuggcuaauacuacaguauuuagaauuucuagccuuugauaucugguuugauuuccuuuccucuggaaagaacagaugaguggcuuauauuuuacaauacagauggagugaacagauacuucuguuucaugauucgucguuuucuuugguaguuacauucccguuaauauggauagggaugcuuauuauauuucuagacauugggaaaauguuaauuuuaaauguacaauauggcaaaauuauuaacauuucuuaauuauaaaaagauuaaauuagauaaccucuacaggucuucuaguugggguguuuuuuuuuuuuuuuuuuuuuuuuuuuugagagggagucuugccuugucgcccaggcuggagugcaguggugcaaucucagcucacugcaaccucugccuccuggguucaagcaauucuucugccucagccucccgaguagcugggacuacaggcgccuggccaauuuuuguauuuuuaguagagaugggguuucaucuguuggccucuugaccuugugaccccccccccccgccucggccucccaaagugcggggauuauaggcgugagccaccgugccuggcuucuaguuuuaaaaugauacuuuauguauguguauguacuugaaugacuuaccuuuauucauaauugucccuaaugaagagaccccugugcacuuuaauuuucuguguaauuuuguugugcuuugcauuuuagagccuggcagauguagacauuuaacaaauguucuagaaaugagcuaaaauuuuccugugcauuuguuuguuuaucacuagucuaaaauauugcuugguuggggagggguguugauguuauguaguagcuuucauuuugagaggagagagagagagccuguaauuguuuacuuauaaaauuguuaagcauauuuccuuagaauuuaauuuauaaaaaaauuacuguuuuugacugucaauuguuugcuuacucagcaaaauuaggauaugaagaaaauguaguauuuucuuuccuucugccaucuccugugcugguaauauugcuaauguaauguaauugugugcccugcuauuucacucugugacuauggcuuuuuuuuuuuuuuucuuuuuugccguaucgccaaaaauugaguuaggugaauggauaaaacaaaauacuacaggcuuccuuggacauccagugcugaauugcuuugggaacuguuuugauugacugccuuugcugauuaacaaaaaguaucacuuuuaagaaauaaguaaacugaggaccuguucaaggcuugugaaccuuagguauuuauuacugccaguuuucauuuuuugugguaccugaaaguuuaugaaaaaguccaaacaaaauacaaaccuugaaaaucaggcuuucaaacaguuugccaauuuuaaacugaaucuuuauuaugguuuaugguuguaaccuuaucuuaaaauguaagguaguuuuuuugguagaagguuuuguuuuggucuggaagguagaacugaacuuccuuccauuuucucgauugauaacuuuuucgaaacuugaaccugcagcacgggugcuagaauaugccuguugguaugguuuuaaaaauaauuccuaucuuucuggauugaauuguuuucugaaaguccaguuuuuauuuucacuuuuuguuuuuuauuucugaagcuuuguuuuccuuggaaaguaaaccuaagaaagauacccauuugccuuacuggguaucauugagagaagagcucauuuaguaugccgguugaaguaucuaccccucuacccuccacccuuuuuuucaaggagccaucauuuuuggaauaaaaagaaaaacuugcuacaagauauuaaaaucaaaaauaguaauauuacaaacuauuugccucauucuaguauaggugguuuuaacauuuuauugcacaucagcugugagcuggauauuuugcugaaauaacguuuuugaaagcaagauacauuugucaguagcacuugaggcuaacgguaguguuagacauauauuccuugaguuaaguuuuuucacaaggcccuuccucaguuuagauaaacuauagguuauucagaguguacuuacaacuuuucauauaguauugguaguguuuugaauaauuuaaaaaaucaucuuagguuuguuauuuaacuuuauuuauauagugcuuguauuaaugauuuugugaauguuuuuuaaagauggauaccuugauuuggcuuggauagugguauuaagcuagguagcuguuguuaaugaguggacagcauaguauguugauaguguggaguguaauuuuguuuggugguaggcacuuguucugacaagucaaguauauugagacucugucgcuugccagaucuugugcuugauguugaguuagaaaauguuaaauaagaauguacccauuuuuagcggccgggcacagugccucccgccuguaaucccagcacuuugggaggccaaggcggguggaucaccugaggucgggaguucaagaccagccugaccaauauggagaaaccccaucucugcugaaaauacaaaauuagcugggcaugguggcacaugcuacucgggaggcugaggcaggagaaucgcuugaaccugggaggcggagguugccgagagccgagaucaugccauugcacuccagccugggcaaaaagagcgaaacuccgucucaaaaaaaagaauguacccaucuuugaggagcaugcugucuaguagaagagagucagcacaaugcaauuaaggugguguuaugcuuccuauaggagagauuguuaaacuuguggagaugaaaguugcuucucuuagagggugagaggagaaacgugggagauuaggagacagauacacgaauggagagcucacuaggcagaaugguaguguuggaggaauguugcuguggauagcuugguaauuuggaaacucagaugugggguuuucacuuaaaguaaaauuggagcagccagaagaaaacuaguuuuguucucagccagcaagcuauagggcaacagguaguguaguuggcuucacuuuuaucccuuuagcagccaucagaaugaucuuuuuuccuuuuggauuuucuugcugucccuccccacauuucuacugucugcuuucucugccuuaaaauaaauuucucuuguguaugcuacuuuauugugucaaacuucccuuagucugccuuuucacuucuuccuuuuguauuuuucuuuucuuuucuuuuuuuuuuuuuccagagacagggguucuugcuauguugcccaggcuggucuugaacuccuggccucgagcagucgucccaccucagccucccuaguagcugagauuauaggcaugagccacucccuccagcagcuuuuggguccuuucaagagauuuuuuuuuuuuuuuuuuugagacagagucucgcucugucgcccaggccugcaguagugcuaucucagcucacugcaagcuccgccucccggguucacgucauucuccugccucagccucccgaguagcugggacuacaggugcccgccaccgcaccuggccaauuuuuuguauuuuuaguagagacgggauuuugcuguguuagccaggauggucuugaucuccucugacuuugugauccgcccgccuuggccucccaaagugcugagauuacaggcgugagccaccgcgcccggccgacuucaggagaucuuuaggcaucauugguuuguguucuucaguuaaaaauaaaaagccaaacucaagacaaagaauacaguucaguuccagguuaggaagagggagaagcucagcuucugaaguagugcuauauuuacuguuuaccuugacuguuaucuuuagaaguugaugauuauuuuaaaaauuguguuaacugcuguuugaacuguuaaaguuccgugcugaaugcuauguagcuguagguauguaucaguggaaaaugucugguuugcaguaaaugugauuagugacaucuuaagcuaacugaaaucagcuggugcauuguccuacaccggugcauugugcuacacuaugcuguuacugcucuguuugcaaauuuaucaaauuguguaauuuugaaagcugacaaaauuguuacuuuugaacugauuauuuuuguauuagagauuauuuaauuuggugaaugguuacgcaagugagauccuugaagauuauagagcuucaucuuuugaugacuuggagucagggaagaguuaacuauauggaaauaggcagaaugccuagguucuuguaucuuuuguuuuuaaauccuagaaaugaugauuuggaugugguggcaucaaagacuacagaaaggguagcgcuuucuuaguuauucuuuuggaugcuuauucuuucugggugaacuuuagaauuguuuuggcaauucuuuugcccccuugcaaauauuucccuuuggaauuuagagcgguugaaugaaauuguauuaaauauguaaagaaauuuaggugucauugacauuaucuuaauauugaauuuucccauccaguaauaugaaucuuuugaaaagguggcuugaguaacuggauuuuucucgaaguuuuuguuuucuucacaaggguuauauacauuucuuaaauugguuucuagauguuuuuauauuuuuuguugcuuuuaugauuaggauguuuuuguugcuuagcaaguuaauacugguguauuggaaggcaauugaguuuuuuuuguuacuauuguuuguuuuugauauggagucucugucgccuaggcgguagugcaguggcgcgaucucagcucacugcaagcucugccucccggguucacaccauucuccugccucagcgaguagcugggacuacaggcgccuggcuaauuuuuguauuuuuaguagagaugggguuucaccagguuuggccaggauggucuccaucucuugauccacccgccucggccucccaaagugcucggauuacaggcgugagccacugcaccuggcccaggcaguugauuuuuuucagucccuucagccucuugccugaacuuguuuuucuuuuguaagaguaguuauuuauucuuuuggauuuuuaaauuucuagauauuuguaaauuuaugcauuucaagauauguuucaggguguguuucauaguuaauaaauacuaaaaauuuucuuuuauaccaccuugacauuuaagaaagauuagccgcuagaagaaaaucaggguggacacaaaaguuggggacagaaaaaccauggacagaaagagugagauggggccgggugcggucgcucaugucuguaauccuagcacuuucagaggcugagguggacagaucaccugaggucaggaguucgagaccagccuggccaacgugguaaaacuccgucucuacuaaaaauacaaaaauuagccaggcaugguggugcgugccuguacuccuagcuacccaggaggcugagggaggagaauuacuggaacccgggaggcggaggcugcagugagccgaggucgcgccacuguacuccagccugggagacagaguaagacucugucucaagaaaaaaaaaaaaugaaagaaagaaugagaugggaggggucccagugcuugguuguccuguuguccugggcugauuuuugccuaugcuaaugcgcaauacaguggaguucagaggaguaaauugauucaguguaaaaaucuuaccagcuguucuuagccuuaugucuggacaauguaaauaaaacaauacuguauggaucuuugcucuuuuuuaaauaacaugaaucuucaguuuuucucuuaaacuaauauuuuaucuuguacuuuauaugacaucuugucugggaguuggggucaggugagauauuugugaucucaauauucuugauuucauuugaacauuugacacuuaaauauauaaauaaaaacaaguaaaauuucacuaccguauacccucaaaaauaaaaacagcucagugacaguuauauuuuggauccccaaguaaaaauucuuggagaaucuuucuuucagaaagauagcauacauuauuuaguuaaucguccuacagcuugucaucuuugucuuuacauguguaguggcaacaaguuauugcauaccauguauaaucugauagguagaucacuuaagaaaaguugaaguuuuaacaguugacaucacuggaagauauuauaugaacucuuucucaugccaccaggcagccugugacaugcuaucgaaucaucucccuuaaaacgaguuguaaauggugccuuauuggggauuugauaauauuuucuggaacuuugcagaauuuguaccuuuuaauagacagcaaggauuuauauguggauuucuuuauguggcuuugggugauuagagaaagagaguucucgugcuguggaccaagaaguugcugggcagugcuguggcaguaaacgaugcaucuaugauuaggaagagcuuuugcauaaaacuguguaaaaauggugguuagguuuccaguguauacuauaaagagguaauuuugccucauauauaucccacuaguguuuauuauauuuuuggaaauaugcaggcugaauuuuaaagaaaugacuuacacauuuacuuuguaucacaaucuuuucauaagucagagacugccuuugcucaguuuuauuagcugaggagaaauugccagaaguuaggaaacucuuaaguuuguauaacacgagagacauguuuuguuaguauaagacauuuuaaauuauugacuuuuauuuuugauacuuguagacgagaucaucagauguucauucaucuggaucuucagaugcacaugugaguauagaaggcaaucuuugucuuuuuuccuuuaaaauuuaacuucuccucauauguaucccuacaucaaugauuuuacuugacaaauaaauacaauuguaugugcuuuuuucuuuuacucuuuuuuuucuaggcgccuuccuuuuuuuuuuuuauguucugcuugcauaacuuagcccucugaagcgauguuagaaaccuaguauguauauuuccuuaugauuuuuauuguguaaaaaucuguacauacauaacguaucuauacuuauacuuugacuaugggauugcauuaugcauaugccuuucucaccgcacaaaacauauguuggaaaucccugcagguaaacuguuaacagcucuaaucuguucuuucuuaaggcaucauaauguucugugguggggaagugcaguuguuuguuauuucuuuguugaugggcauauauuuuuuguuuaaagcuuucaaguaacauuuuggauagauaauacuacaauaaguauuuuuuuaauauauguuauuacagcaguguucaaaguguagucugaagaccccuggagucacugagaaucucugagaagggucugugaauucaaaacuauuuuguaauaauacuaaggcauuauuuaugccuuuuucaccauuuuggcauuugcacuaaugcaaguguagcuggagguacaaaagcauuugguggguaaacuguuggcacuucagcacagaucaaggcagugacaccagaguauacuuguagucauuauauucuuccccaccaggcacaauaauuucacuuaaaaaacuagcauaauuagaaauaauuuuuacugcuugaugaugcaguaaaaguuacuacuauuuuacuacuucaucaagcaguaaaaauuauuacuauugucuucaucuuuuguguaguucgucuuaauauucugugugauaaaauaagaaguacguauaacacuuaugcuuaccaaaaugugauguuuguuugaguugagaaaugaaacuagcugcuuuuuucaugaaacaccaguuuuacuugggagugacugacaggcaaacuauggugaaucagacuuggggauuuuggcagacauuuucuugaaaaugaagguaacgaaccuguuacuucaaggaaaacaacuguuaccaauauaaaauucaagcuugugaguuagaguuauugaaaacuuucccuguucuuaagaacuuuuuuggugaaaucaauggugauauuaagggaugugauauuuugauaaucuacaaugaaauuugucaauaucuggcauggcuuauuccuaguuuucagugcuauauauguauauaugugugguuuguuuuuuucucuuguuuuacuuuuccugaagauggaugcaucuggacccucagauagugauaugccaagucggacacgaccuaagagcccaagaaaacauaauuauaggaaugaaagugcccgugaaagccuuugugauucuccucaucagaaucucucaagagugaguauagauaagauaagguaaagauaagaaaggauaguuaaugauuuuaaucugucuuugacugaauuuaguggucgaauauuugguuuuguauguguuucaucuuauucuauuugaaaauagcauucuuuuuguauuugggauaacaguaaacucauuuauguagggacaucuuuuuagcucaaaugugagauauuucauuuuagaguuuuaaauuuuauuugaaaaacaaaguaguguuuggauuuaaaaugguuaauugucaaguuuaucuuuccccacuuaaacauuuauugaaccaagugcgaaauaccaguuacuggaaaugcacagaucauugaaacacuguucguguucccacugagcuuauagucucacucugaaagcaaacaggagcaggugcuauucacucuaaugagugcagugcccaggguaauacaggaacacagagaaggagcuucuucacuuuuagaucucuaaagugcucucaggcucuuuuagacuuuuauucuaugucaaguaauauuuucuugugguuaaauuuguaacauaacacagucaucaccagccaguauuaaccacugguaacaaaguauuuuucuuguuuaauauuucuaggcauaaauauauuuuuacuuugccuagauuuauuuuuauaagaauccguuuuaaaauauccuguuuuuaguuauaaauuuuuuuucauuucugcaagaauucuguaaacaaacuuuuaaaugauugcuuauauuguuuauuugaaaaauacuccauaguuuccuuugccacaucucuguuggguaucugaauuuagcucuuaggguauaaauaaaauuugagcaugguaauuuuucauuggguuucauuuaauucauauauaauuuugccacuuguuuaaacuuuugaaguugaaaccaaagagacugaaugauggcaaaacgauuuucuuucuauuuugagaaaauuuauuuugaauccucuccugaaacccaauauugacuuuuagguuauaaacugcuuuauuuuucucaaagggauuuuaauauaaauuuaaaauaguuagcagcaauguuacucuucuauucugcaucucccaaaggcaagccuauuuaaugacuagggaauuuaaagucuugauuuuguaauugguuagcuucucauuuuaguaggagagagaaaccuucagauuucaguauuuuagguuguauuuaauaaacauuuccuaccuuuuaaguuuauaaaucaaaugaguaacugacugaacaaaaaggucuacagacaauguauucaggcuauauuucagaaggaaguugcuucuaaguuacauaaaugaagacuucauuaaaauaguguuuucuuauauuuaaaauugauauaguuuuacuugagcugaaacuuuaaauauuguaggugauauuuuaaucccagcaaagaaugaaauuauguucauaaauaucaguauuauugacgaagaaugagguaguuuaccaaauuauaaaaaauaagugauuuauaauauguaaaaugaguguuguaggugguaaauuccugccccaggaccauggaaauguuugccuccauuugcuuauuugaggaucuguuuucugucauugcaacuuuuccccagaaacaucuguacuuucccccucaaaugcuuuuauucuuguucuaagcauuagugucagucucuucuauuuuuaccuuuuuuuuuuaacaugacuuuugcauguuuuugaccuugagcuaguaaaugaagacauucuuugaugaauacuuaacaucagagucaaguaagauaggcaccugauguguagaguagccccaacuuuucuuuacaaugaaauuuaaaaaaaaacggcagucuauucugaagacuuaguuaucaguugauguguauuaaaguuuuagauagcauuaagaaucuauauguaaaaguaugcuuuuuauuucuuagccucuucuggaaaacaaacuuaaagcauucaguauuggaaaaaugaguacagcuaagcgaacuuuaaguaaaaaggaacaggaagaauuaaagaaaaagguaauguugaaaauguauuuugaauuauccuuggaaaugaaugugucuaagggguuaguaaguguauuagaggaauguuucccgaagauucuuaaccucuaggauauucucagguccgccucugagucaagucuguaauacaacauauauuccuaggaguugagcuucuauccuuguucccucacccuguuucuuuuuucuuuguuauaguuuuggcuauuuucuaaucuauucuuuuuguauaaguaaaguguauguguguguagacacauuguacccauuccccuuagauuaaugauagcaugcuuuauacaguacacuuuuuuccuacuugcuuuuuuaacuuaacauuguaucucagaaauuaccucaaguauauagaaauacuccuuauucauuugcuauggcuguguagauaugcaaucauuuauucaacuaaaauucuaucgagggcauuuauguuuuguucuuuugccauuaaaaguaaugcuguuauggauaauguuaugcauauguuugguuuuuuugcuaguguuaucuuugggauauauucuuauaggugagauuugggauauauucuuauaagugagauuacuggguugagugauaaaugcauaaauguaguuuuucuauauuugucauugucaaauugcucucuguaggggcagugacauguugcaccccugucaguaguguaugaaugaauguuuccccauagcacugccaguagaggacuuuugccaaucuccuacaugaaaaaugguaucucaguguaguuuuacauuuggauuucucucauuaugaguaaaguuuaacaguuuuucuuguguuuguuucugugaacugucugcucauaucugaaccauuuuuuucuauaaguuauauuaacacuuuguuauacaagguacaauuuuuuuucucacuuuguugauugucuuuuuauuuugcugcugguguuuugcuccaugcagaaacuauuguacaaucagauuuaucagucuuucccuaugauuucugguuuuucaguuuuuuccauuaccagcuuauaaagaaauuuccucauguuuuccucuacuacugaaugguuucuuuuuuaagaauauuaaaucagauuauuuuguaguuuauucugguauguggugucaagaauagauuaauuuuugucuuuuuucaaauaauuauucaguuauccuaguaucauuuauugaaaaguuugucuauuucccacugauuugagaugcuccuuuuauugaacacuaaauuuccacaugcuauucaauuuuauucuguauuuucuguuauguuccauuggccuuucuucuguucauacauguuuuggggacauuuagaauaauugaaaauaucaagauucuucugagcuuucuuuauaucaagauucuucugagcuuuccuuaaugccacuugucaguagauauugcugcuucaacuucuaauacucauguuuuuggugauuugaaaaauauuuauauucacugaauuaaaucaucaugccuuggaaacuugguaaacauuacuagcaaaauauguuuucauauagucaguugucauauaauuugaugcuugaguugucucuagacaaauuuacuaauuaaucuauacuuagggguucuuuucuaguucugcaaauugccgguagaggagcaaagccucucuugguuucauuaauuaauacuuaauaucuucuaaagauuagacguuauuacuuguuaggacugcuuaaccugggaagggaggguuuucguccauauuauuccuugaugaauuuagccuuguguacauuaacaauuuuuguauuguguaauauuaauauuuucauguguauuuaggaggaugaaaaggcagcugcugagauuuaugaggaguuucuugcugcuuuugaaggaagugaugguaauaaagugaaaacauuugugcgaggggguguuguuaaugcagcuaaagguaaguuuauaaaguauaacugcuaauaaagcauaacuguauuacaguuuuugagcgagccccaucuugguugaaugacugcagguagauaauuaugaaaggaaguuugguugcuuuugaauuuuacauuuucuaucagcacccucuagugguuauuauuaauuagcaagauaaauggccaagugucaauuaaugagaugcugaagacagauagcuuuuaaacauauuuaguuccuuucaaguuuuaagacagcagagcacuugucacaaauuuuaauaugugucauaguuuugcuaugaaaugauuaaauuagcauuauugaggugauauuugaauuuaauuucauauuuguuaauagugauacaucuuaauacuaaaagcauuuuacuaauuuuuacuuguuuuuaaauaaaacaguaaagaaaaauauugcgaaauuaguuuugaaacuuaguauuuuaaauuucagaagaacaugaaacagaugaaaaaagagguaaaaucuauaagccaucuucaagauuugcagaucaaaaaaauccuccaaaucagucuuccaaugaaagaccaccaucucuucuugugauagaaaccaaaaaaccuguaagucauacuuaaguaauugaccauuuauguucagagaugacacugccagugauacuuccacuguaagcaagacuuuggcuuuuuuucguuuuuggugggggcagggugguagauguuaaguuuugaugcuuucuaacccaguaauuuacuuagaugagaguuaaugaauugggacacguagaugauauucuuuuuaugcuuuuugagcagugaacauuugcuauuuaugcucauaauauauugcaagucaaaaauugacuauauugcaagucaaaaauugacuauauuugacuugcaaugggguugucuuuuuaagcauuucugaacugagguauuuaaauuauuaguauguguaguguauauuucccagaacauuuuuggaacauuuugggaauuacugucagaauuagugacacuuaaaauauucucaguguuagaaaaaauuuuuuuuucuuugaggguuuaguuuuuaugggagaugguagacagaugugggucaugucauuuggaaccaaauguggugaauaaauaugauugcauugaauaguaagccugguuuuuuuuguguggcuuaaaaaauaucucuaaaagcaaugaaaaaaaaaccccagcuuuauugagauauaauucacauacaauacaauaaaauuuaccuuuuuuuuuugagacagucucucugucacccaggcuagaguguaguagugugauuacggcuccugcagccucaaccucguaggcucaggugguccucccaccucagccucaugaguagcugggacuacaggcaauguagucccaugcccagcuaauuuuuugguauuuuuuugugaaaaugggguuuugccauuuugcccaggcuggucucaaacuccuggacucaagcgauuugcccacuuuugccucccaaagugcugggauuacagacgccuggcuaaaauuuauccuuuuaaaguauacaguugacuaggugcaguggcuuaugccuguaauccuagcacuuugggaagcugaggcuggaggauggcuugagcccaggaguuugagaccagccugggcaacauagcaagacuccaucuuuacaaaaagaaaaaaaauuuaaauaaaguguacaauugagugguuuuaaguauguugaaaauugugcaacaaucaccacucuaauuucagaauauuuuuaucacccuaaaaagaaaucccuacccauuaucagucacucccauuuuuuuuuucuauuaacuucagucccugacagccuacuaaucuacuuucugucucuugauuugucuauucuggacauuuuuuauggaugguauuauauaacguggucuuuuguaucuggcuucauuacuuagcauaaugcuucaaggugcaucuuuguuguggcaugaaucaguacuucauuccuuuuugugguugaauaauacuccauuuuauggacauaccauauauuguuuauccaugcauuacuuaguagauggacauuuggauuguuuccacuuuucugcuguuagaaauaaugcugcuguaaacauucaugugugggcuuuuuuugugugaacuuauguuuucaguucucuuggauacauguauauacacacaccgagaaguggaauugcugggucacaugguaacuauguuuagccuuuugagaaacugccaguuuuuccaaagugguuguaucacuuuacaguuccaccaguaauguaugaggguuccaguuuucucacgucguacacuaacacuuugagaccagccugaccaacauggagaaaccccgucucuacuaaaaauacaaaauuagccgggcaugguggugcaugccuguaaucccagcuacucgggaggcugaggcaggagaaucgcuugaacucgggaggcagagguuguggugagccaagaucacagcauugcacuccagccugggcaacaagagcgaaacuccaucucaaaaacaaacaaacaaacaaacaaaacuauuuuguuugaaaaguuuauuuuagucauuuuagugugugugaaguuguacuucauugugguuuugauuugcauguacuugauuauauugagcaucuuuucauguguuuauuguccauuuauaaguuucuuuuggagaaaugucuguucagauacuuggcccacuuuuuaauuggguuauuuguauuuuuguuguugaaucguaagaguauuuuacaucuucuugagucaagguucuuaucagcuauaugauuuggaaauguuuucuguucucuggguugucuuugcauuuucuugauggaagcauggagguuuuaaacuuuaauggaguccaauuuaucaguuuuuuucuuuuguuuacgcuuuuggugucauaucuaagaaaccaucaccuaauucaagauuaugaauauucauuccugugguuuucucccaaaaguguuauaguuuuagcucuuacuuuuauguccaugaaccauuuugaguuaauuuuuguacauuuaguauaugguguaaaguagaaguccaacuucauuuuucuguauguagauauucaguuguccaagcaccauuuguugaaaagauuauucuucccuauuaaauuauguuggcacuucuaaaagaaggauuccaaaaguagauuaagaagcaguuuuaaaagaggauuccaaagauguuacuuacuguuccaguaacucauguccuccagaggugauuuuugaagagugcguauuuuuggcaguuacuuuccauggcaguucaguuacuucauguucauuaauuucccugacuacugguugucauuuuaauuguuuaauuguaguaauaauuuaauuguuuguuauuuugaaggaaggggaagggagguucaaugauaagaaaagcauucuuccuuuuuaauuuaaauaauuagaacauacaauuuguacugaaaugauguaaaaaggcucuuauuauugaaucauugguuuugcuuauccuuuuguuugaaguauaacuugucauauccuuuauagccacuuaaaaaaggagagaaagaaaagaaaaaaagcaauuuggaacucuucaaagaagaauuaaagcaguaaguuuuauaguguggagaauaacuaucauagguguauugagcugauacauaaacagaugcaaguauaaagaauauacuguaccaguuaguuauuacuaaccaguuugcuaugagauuguuuuagauauuauaauauuuggugggcuaucuuugaaaauaaauuagcauuuaguccagcaccuggguugcuugcauuacgaggauucaguucaauugauuuacuuaauguccagaguccuguuugcaguggaaacaguauacucacugggaugggagugaggggcaguuagacuuagcaagaaacaaauucagugguuuuaguguuuaauuuccuccucaccuuuaaaguaggcuuuguguuccauugguaguaugauauaucagaaauuugcucgugguuguauuauagcugagggacccucuaaucuugguuaucaguaccaguauuuaauuacagauauuucuaguuauuugaugauaguaauuugauaagcgcuauucugaaaugugaaugaacaaauuuuggcucauuauaagugauuguaaauauuuucaacagaauucaagaggaacgugaugagagacauaaaacaaaaggcagauuaagucgauuugaaccuccucagucagauucugauggucagcgucguucuaguaaguggcauuuauuuuaauguguaugcuugugauuaauuacaguaguucccaccuuauccguggcggguuacauuccaaggaucaccaguggaugucugaaaccauggauauauacuauccuuuuccuuacacauucauagcugugguaaaaauuaauuuguaaauuaggcacaguaagagauuaacaacaauaaguaauagaacaauuauaacaauauacugaaauaaaaguuaugugcaaucccaacacuuugggaggccgaggcaaguggauuaccuaaggucaggaguucgagaccagccuggccaacaugaugaaacccugucuguacuaaaaauacaaaauuagccgggcgugguggugcgugccuguaaucccagcuacucaggaggcugaggcagaaggauugcuugaaccugagaggcagagguugcagugagccgagaacgugccauugcacuccagccugggcgacagagcaagagucugucucaaaaaacaacaacaacaacaacagaguugugugaaguggucucucuuuuugucucucagaaauaccuuacuguaacaaacugggggaaacaaaggugaggguaaggggggacuacuguauuauaaaaacuaauaauugucuucuuuucuccccuuuaaguggacgcgccuucaagaagaaauagaucaucuggugguaauacaguuuuuugcucuuuuaaucgauaaauuuuccaaacuuuauguuuugcagguuauaauucuuuuuuucuuucugcccuaguucuugaugauuacgcaccuggcucacaugauguaggagauccaagcacuacuaauuuauaccuuggaaacauuaauccacagguaauauuaaguaagaugaauguugauugauaugcuuuaugcuuuuggaagaaagcuuuguuagucaaaaaaaaucaagauucugaagcugacaaaucugauggaauuggauagucuuuagaguugucuuacugguauggcccagguugucuugccacauauucuuguuuccucuuucaguaacuagauugaacucuggauuugaaauguuuuacuaggugcugauuuuauuauuaaaucagggugugaccauugaugaauaauauuauuuugagacuguccacuucugaugcauacuuguuuccuuguggagucccuuuuucuucucauaguaguaaacuacucuuugugguuugucuuuuauauuuuaauucuuuuccugcauuggugcuguuaauuaugauauggggaauguaguaacgguaguauauaauaugcuauuauuaaaaauuauauuuugcauauauacuguuaccuguuuucucugcauuugauuacauggguaguugauuguuagaacagaugauuagauacuuuuuuucuucauugucaauacauauuuccucuuuaauuuaaauguacuaaccaugccugcuugaaaaauguuacuaaaugccuaaacaaaccaucacuauaaaacaucuuacuuagauccaggaccuuaaaacaaaggaagauagagaguaaaaaugauuuugauuucuucauccacugaacuuccccacccuggcaucuuaaauaaaccagaauauuuauaguaugaaaugauuuaugaaugccccacgcgggauuuuacuuguguggcguuccugguacuuaaauggaaaauugaagcacguugcuauguugcuuuuuauuuuguaaaaacuacuuuguuuucugaaaauaauuuuuucuuuucccuuuuuugcauaauaaaaaucuuuuacccuuuuuaauagaugaaugaagaaaugcugugccaagaauuuggaagauuuggaccguuagccagugugaaaaucauguggccuagaacugaugaagaaagagccagagagagaaauugcggcuuuguggccuuuaugaauagaagagaugcugaaagagcuuuaaaaaauuugaaugguaagaacauuuuuauuauccauuuauacaauucagauauuucuuugguuuggaaaaguauuuauaaaaacuaggaaggauuggaccugaaauggagagguuaaaaugaaaauuauuucaacucaccagaaaaauuuuguuuggaaacuuuugagaguuaacaaaaugaccuuucauuucuuucuuguaggaaaaaugauuaugucuuuugaaaugaaguuagguugggguaaagcuguaccuauuccuccacauccaauauacauuccgccuucuaugauggaacauacgcuucccccaccuccauccggacugccuuuuaaugcgcagccuagagagcgguuaaaaaacccuaaugcuccuauguuaccgccaccuaaaaacaaagaggauuuugagaagguaauuuaaaaaauggacauaaggccgcaucuaauuuguaaauacuaaagcugugguaguauuucuuuucaacaauuuuauagaaaauguguguguaauucuguuuggcaacuuuuaaagaaauaaguagauguguucccugccuuagcccauggaaacccuauauuugaaauacuaggucauauuuuuauuuguggcuaccauuccuuuuuugaccacuuguuaaguuuuuuuuccuuuguccaguguuguauccagauuugcuuaaguguauuaacuaaauuuacuuuguucugagaaagugauacuuuguauuugguuaagugacauuucaauuagaaagaccuccuaaguaguuauuguuuggauggcagcuagaucugagguauuagaauauuugagaagauuuaugugguuuguaaaaaauaguuaaucuaguaaaagcaaagggugaguauuuucuuuuuaguaaauaaaaccaacuuaauuucaaguuauaagaauucguugguucuauuaugaauuaauuacacuuaaaaugacagggcugguuuuaaaggcuugggaacaaaguagcgaacuguauggucagaggcaaacaguuaauuauuucacaaauuaaaaucuuuaucugauaauucucaguguaguaccuauuucagugcauugaugugcauucuggcaggaauguucugauucuuugcauuuggugaacguuuauuguucacugaacacauccauuugcauuuauguaauugcuuaguguauaaugacuucaaaugcagugauugccugcaaaacuugugauuagauauguaguauuuucaaugcauauguauauuuuugcuuguuacuuguuaacaauacucacauauucuauguuuauuaucugaugugacuucauauacagacucugucgcaagccauagucaaagugguuaucccaacagaaagguacauguuuuucuuuauuauuacugaucuaaauauagacaauauccccuucugaauuuaaaaagaaaugguguugaggaaaagguaguaucuugacugagcaaugguuccuucccaguacuuuuugcggggggaugugugaaauuuaacuaacuuuuguauacuuugcaauuuuaugucaguaucuuuuuuuguuuuuauuguuaucacuguagggaauguuuauaguuugacuaguuagaguguauuuauuagcucugauuuggagucagacaauagacuauugucaugggaaaauagauguuuuaagugugucguaaauuucagauaacguuacaguuugacccaaucuguuguuauuuuuuucuuguuuucugaauuaucugcauuuaauauauaaccuugguuugaguucuccuuacugaaggcauagcuuuguuuuuuguuuuuucaauugauuuuaagaagaaauuccuauuauugucaugaacacuggacauacuagaaacuuucuuuucaugguaacaaagguauuuggaauucuuuuauuuuccuuucuuccuuuuuuucucuuucaacacacuauuaaagcagaagaauucaugcuguagguaugcucuugcucagucaagcuaagccuuuucccaaacacaggaacacaacacugguugaauaauaaaugaacacaaaagaauaccaaauucucuuugacauuggccuuggugagcaacaccagcugaacugucugcggcagcgggggaccaggaaaacaucaugggauggauugggaaaguauacaguuuuugaccagacauugguacgaucgacuccaauaaaugugguuuuauuauaacugagagacaauuuuuuguuuuuguuuuuuuuuugguuauuguugcccagaauaagauaauuaccauuuuaaaauuaaauaaugcacuuuaaauauaucaucuuuuuguacuacacuguuuuauucuaauagaaaagucaccauuuuuaaaauaaacacaauccuuaaggaagaagaaugugauuacaguucuuuaguaaucuugacaucaaguuaauaacaauuaauugucagauuuugauuuuaaauaaucaugaaacauuuuaaaaauacuuauaaacuuuuaauuuucuaaaaauagauuuaucaguuacaagccuguuuaaaacuauaguggguuuuucaccacugauaaaagcauucacaggauaguauuuuuguagcauucaaaaaaagcacauaucuagugguagcuuuacauguauguggcucagcuuauuucuaaacaaaauuuugagugugcguuuugccgaaagucuucacucaccauuaggaugaauccuuuguuuuuaaacuugcuaaacaauuuuccucuaucuuaaaugcuaaagucaaguugcuuuugacuuaauucacacaaguuucuggauguauaacauuuguccaccuaguaauuagucuuauacauaaaauuucccuuagcuuuaauuuggcuccuaucaguggggaguuuuggaauugaaucauaacuuuacauuaucgcccuuccuucaaaauaaugucauuaaccauaugaaugcugaagaacugcauauuugcagagcaauuacuucugugaaagagaaauaauuuuuaaauagaaaauuaagcaauguuuuuaguuuuuuguuuugacaauuugagguugaauuaguaguuuuaaaugcaugauuuccccuuuguaaagauuuaaacugugaugcaauuuuuuuuacuuccuuuaggcuuaaauuuuuuucacuauggagagauuucauuuuaaguagguuuguuugaaagcuaugagaaaauaauuauagucaccuugagauagauuauuuuauuguucauguacucugaaauagggcauuauagagccacaaaagucugucuuguucuauaacuauauauuuauuuacauucuagcaguuauaugaacguaauuugagcugggaaugcuaaagguguaauuuagugugugcuuuguaccaagagccaauauccuuuugcuuuucccaauuguuauuugccagcuguguauggauggggacuggugaaaugaggaaucaaaagcagcuuauaaauaaccugagucauuuuugcccgacaccauaaucaauguccaaaauuguguuuggagucuaauaaaauaucacaugauuuuaggacccagcuucagauaaagacuuccugugaguucagucaauaaaaugacuguacuaaaaaauuacucacauauguuuauuuuugguaaaauauuggaaaauaauuguuacagaaaaugggaagggcaucucaccguguaccccauuuugcaauauuuuggaaagaguaguacuccauucacuuaaggcuuuggcaacauaauuucuucauugauugauaguguacaggcauaucaaucucuuguuuuggagggaaaaaagauauauaaaggcagaauuaucuauuucaugaauugugaacuaguuugaagugugguccaaagggauguugccucauuaaaggucagauuuaauaaaaaaugcaucugguguguguaccagaaaaacacaggaguuggauggauuuuuuauuaaaucaggccuuaaacuuguuaaauaguuuugcauuuuuauaaauuauagucaugguuauaacauuucaguagcaccauaaaagugcuugguuuaggaauuuuuuuuuuuuaaacugagauaguguguaaauuucuagauggcuguaauaacaugcaggcucuaaguuacugauuuuauauaucaauauuugcagcuuucuaauuaguugugauuuauaauuuaauguuuuacuuuuggaaaauaagugacauuuagaaaauuaaauauuacuaugaggcuguauugugguuuccuacccucccucaccuuuccauccccucccacuucccuacucccacugccccacacccucuuaaugcacaaggcauuaacauaugcuccagguuacuuuuuugguauuaaauucgguguuagucagcagaauaaucauuuucugcacaauuauaguaacuuaggucaaguguaguuuuauauagugguaggucugaauccauuuucuuuaacuguguuguuguuguaggaauuugcucgcccugauacaucgaaugauagaguuuguuguacgugaagggccaauguuugaagcuaugauuaugaacagagaaaucaacaauccuauguucaggugugcauuuuuuaaaaauugugaaauauauguaacauaaaauuucccauuuuaacuauuuuuaaguauacaguucagugucauuaaguacauucacauuguuguacaaccaucaccaccauccaucuccagaacuuuuuucaucuuccaaaauggaaauucuuuaccuguguagcaguaacuccucagucuucuagcccguuagccccggcaacugccauucuacuuucugucucuuaguaauuucauuacucaggguaaacucacaugaguauaaucauacaauauuuguccuuuugugacuagcuuauuucauuuagcauaauguccucaggauucaucuguauuauagcauguaucgggauuuccuuuuuuaaggccaaauaauauuccauuauauguauuuacuauauuuuaucuucaggcaugcaguuuaaaacuacuuuuaauuuauuagaauuaaaaauauuuccaagaauaaaguuguaaaaguaugggauuaguucugcaacgggaugggaagacaguuuuaguaaucagaguagaauguauugaggacaauuuuccaucagauuuugauuugguugauuaaauaguauuguuuuuagcauucucuaggaggaaaauacauuucauuaugcuuuucaaugaaggaaucauaagugagauacaguugaacaaaugaguuuuaaaauaaauugcuuauccucugaauuguuacgguauucuuagacacuaguuuaacacuuaaguaauguaaaaucacugcuuuuguaauuacauauugggaaaaucucuccauugccagacacaguaucugccauguaaguguucagugaaaacgaucauaagacucaugaugcaugccuucugaguauuaaugucagucacuaaggcagucuagggcugcaguaaaggaauggggauagguagcgggugguagugggugagauucucuucagggaucuuuguuuuuguuuuauuuagaacuaaauaggcaaauaauauuucucauuuauuuauauuuaauugaagauagcucuuuguuaaagaauaugauguuuaauguuuguuuguuuuguguagguucuuauuugaaaaccagacaccagcccauguuuacuauagguggaagcuuuauucuauucugcaggcaaguagaaucaauuacuuuguuaauuuugacucugaguaauuagaccuuuauaauaacucuaaauguuuguuagggagauucuccaacuaaauggcggacggaagauuuucguauguucaaaaauggaucuuuuuggaggccaccaccauuaaauccguacuugcauggaaugucagaagagcaagaaacagaagcuuuuguagaggaaccuaguaaaaagggagcacuuaaggaagaguaagauauuuuuccuuucuauuauauauucagaaaaguaacuguaaugguugcuuuaauuaauggucuuauuaagauguuaacccuaaaauaaauuuuuuucacuugugaauguuuaaaauaguaacaucuuucaucaugugcuuuauaauuuuaaacauccuaacaaguauagguguguguccuguuguccuugaguuuucuccugguaaaauuagugaugaucucuuaaacaugauugacuuauuucuuuagcauuggaguacuucagauucuuacagaaauuauuggaggaucccuagaauucuugcuucucugaaugcaacauaaagaagaaaaacuauuguguggcuagugggaucagauuguggcuaugcaaagccgcuacaugauaacuuucacacuugauuugcaguguguggugagcugugagauggccaccauggaaguauguguuguuauuagucucacuuaacaauuguacagugcagcuagcugguuuaagaagcaaaaacauacuuauuaaauguucagaggacauccuguauaccucaugggaaaacauuggcuaaaagcauuuuuagaauauagaauuaaguacagacauacuuaguuuuauugcgcuuugacuuacugugcucugcagauacaguguguuuuauaaauugaagguuuguggcaacccuaagucaaacaaaucuguugucauuauuuuucgaacagcaugugcuuacuucaugucugucacauuuucauaauucucacaauagcucaaacuuuuucauuauuauuguaucuguuauggugaucagugaucuuugauuguuuuggggcaccacaaacuauggucauauaagaagaugaacuuaaucaaaaaagguguguucugacuguucagugacuagcuguuuucccuuaggccucccuauuuccugagacacaacacuauugaaauuaggccaguuaauaaucccacaauggccucuugaguauucaggugaaaggaagagucucacuucucucacguuaaaucaaaagcuagaaugauuaagcuuaguuaggaaggcaugucaaaagaugagguuggcugaaagcuaggccucuugcaccaaacagugagccaaguuaucaaugcaaaggaagaguuuuuaaaggaaauuaaaagugccacuccaaugaacacaugaaugaugaggaagcaaaauagccuuauuacugauagaaaguuucggugguguggauagaagaucagaccagccauagcacucccuuaugccaaagccuaauccugagcaaggcccacucucuucaauucuguggaaacaggugaggaugcuccagaagaaaaauuugaagcuagcagugauugguuuuugagguuuaaggaaagaagccaucuucauaauauaaaaguucaaggugaagcagcaagugcugauguagaugcuguagcaaauuauccagaagaucugaggucauugaugaagguggcuacacuaaaucacauugucaguguagacaaagcagccuuuuauuguaagaaaauguaauuuagcacuuuuauaacuagagaggggaagucacugccuggguuaaaagcuucaaaggacaggcugacucucuuauuaggggcuaaugcagcuggugacuuaaaguugaagccagugcucauuuaccauuccaaaaauuuuaggaccauuaagaauuuaugcuaaaucaacucugccugugcucuauaaauggaacaacaaagccuggaugacagcauaucuguuuacagcaugguuuacugaauauuuuaagcccacuguugagaccugcucaauaaaaugauuuuuuucaaaauauuacugcucauugacaauguaccugaucacugaagaucucugauggagaugugcaaagagauuaaguuguuuucaugccuguuaacacauuauccauucucuaucccauugaucaaggaguaauuuugaccuuuuagucuuauuauuuaagaaauauauuucauaaggcuguggcugccauagauagugauuccuccagugggucugggaaaaagucagaaaccuuguggaaagcauuuaucauuccaaaugccauuaagaacauuugugggccaggugugguggcucacaccuguaaucccagcacuaugggaggccgaggcaggaggauagcaugaggccaagaguucaagaccagccugagcaauauagugagaccccauuucuauuaaaaagaaauuuaaaaaaaucuuaaaaauccguuucaguuuuuuugccuauaaaaaucgacauuaacaggagcuuggaagaaguuagucccucauagaugacuuugagggauuuaagacuucaguagaggaaguaacuccagauaugguagaaauagcaagggaacuagaauuagaaguagagcucaaagaugggacugaauugcugugaucucaugauaaaacuuuaauaaaugaggaguugcuucuuagggaugagcaaauuaagugguuucuugagauggaauguauuucugaugaagaagcugugaacauuguugaaaugaaaggaucuagaauauauauaaaguuaguugauaaaguaguacaggguuugagaggauugacuacaguuuggcaagacauucuccucuggguaaaauguuaacaaacaacaacucaugcugcagagaaauccccugugaugagaaaugucaguugaugcgguaaacuuuauuguuuaagaaauugcugcagccaccccaaccuucagcuaccaccgcccuaaccuucagcuaccaccacccuaaccuucagcuaccaccacccugaucaguuggccaucaacauugaggcaaaaccuuccaccagcaaaaaugcuaugacucacugagaguucagaugauuguuagcauuuuuaacaagaaaguauuuuuaaaguaauguguacauuguuuuuuuagacauacugcuauugcauacuuaauagacuacaauaugguauaaacauaacuuuuacaugcacugggaaaucaaaaaacuuaugugauuggcuauauugugauauuugcuuuauugcaguagucuguaacugaauccgucucuuugagauaugccuguauguacuucacugcagucuauaaaucuuaauacuuguugcauugauucauugccuaugagagcauuuggcaauggagugugauacuguuugaguguauuuacuucugaagauguauguucauaaucacuguaauccuaggaucugcaaacucagcucauaggcuaaauauggcugccuccuguuuuggaaaauaaaguuuuacuggaauacagucaauucccuucccuacauguugucuggcugcuuuggugcuaugccagcagggggauagagaucauauggccugcaaagccuaaaauauuuguaaucuuuuuuuuuuuuuuccccugagauggaguguugcugugucacccaggcuggcaugcaguggcacgaucuuggcucacugcaaccucugccucccagguucaagcaauucuucugccucagccucccgaguagcuggcauuauaggugccugccacugcacuuggcuaauuuuuauauuuuuaguacagacaggguuucaccauguuggccaggauggucuugaucucuugaccuugugauccgccuaccuuggccucccagagugcugggauuacaggcaugagccaccgcacccagccagucuuuuccuuuacagaaaaaauuagccugucguaaucccaggcagaaguguuaaaguaauagacuuccuucaaagaaggggaguaaagaacaugaaaguucuucaguaucaugggaugguaagacuggggugcucuuaaagacgcuugaagaaaugcguaugauuuuaaauuuacuuaauuuguaagcugaaaacauaauuggaaucuuauucuacagaguauucuuauauaaauucuucaaaaaauuguaacaauuuugggggacacaacacaaaucagacugaauguauuacagucuucagaauuauuuuaugugaguagguuuuaaagaaauuaguuugugagcaaaagcuacaauggcauuugaaauuguaucuaaauauuuauaaguuaaaacaauuuauguucagacagagggauaaauuggaagaaaucuugcggggauuaacuccaaggaaaaaugauauuggagaugcaaugguuuucugucuuaauaaugcugaagcugcugaagaaauaguggauugcauuacugagucguuguccaucuuaaagacaccccuuccuaaaaagguaugggaaugaauuuuaagaaaaggggagauaguugacgucuuuugggauuagaauugguuuccuuuuugcacaaagcacuugacugaugagauuuuucccaugcagucuuauguuauuucugcuuggaaauuuagguucauuaacauacaaguuaacaaacaaguugaaauguaaauggguuaacaaauuucaucucugccagagucauaguuguggugauacugagcuucauauaacucuucuaauuaguagccauaauuaaauuauagcuaaacauuagccuuauauuaaccuauuuuguguuaucuuuugauauuauagauugccagauuauauuugguuucugauguuuuguacaacucuucagccaaaguugcuaaugcuucauauuauagaaaauuguaaguauaaugauauaacugauauuccugaaauaaaguauuuaaggguaaggaguucagaaaagaggauuguuuuguuaacauccugcaagaauaagaaguacagucagcccuccaugucuguggguuccuuauccaugaauucaaccaaccaugaauugaaaauauuugagaagaaaaauuguaucuguaccgaaccuguacagacuuuuuuccuugucauuuucuaaacaauauaguaugaaaacucuacauagcauuuacauuguauuagguauuguaaguaaccuagagaugauuuaacagaugggaggaugaggauagguuacaggugaauauuaugccauuuucaaucaggaacuugagcaucuguggauuuugguguccaugggaggucuuggaaccaguccccccauggauacugagggaagacuaauuugaauuucuuaaugguuuguagaauuuuuuaaaaaauuggcuuacacuuaagcuaaauuaccaauuuuuuggaaagauuuuauaucauaucacuuucuuagcuauugacaguauaacaaauagguguuaaagagaacuuuauugcauaucuagcuauucauauaauaaauagaaacaguguauauacuggcaaacauaagagaccaaagacauacuauuaacuauagaaucuguguucucuucugauccucagcauauugauuuuaguucauuguaaauguuuccuaaggcaaaaggaaguuacguugcuguauuauaauuaauguauaauucagcugggcacaguggcucacgccuguaaucucagcacuuugggaggccaagaagggcugauuaccugaggucagaaguucgagaccacccuggccaacguggugaaaccccaucucuaguaaaaauacaaagauuagcugggcgugguggugugccucuguaaucccagcuacucgggaagcugaggcaggagaaucgcuugaacccgggaggcggagguugcagugagccgagauggcaccauuguccucuagcuugggugacgagcaaaacuccaucucaaaaaaaaaaaaguauaacuuuuccucuguuccccagagcucucuuucuguguuuauuuuaugaauuaggcaaagggaagcuuuucccuaggauguugcucugaaaagaaauuuagagagcuggauccuacucuuaggucugcuauuaguuuuuuugccuuggacgagucacuuuucuaaguuuucuguuuuauaaaauaaagaaauuggacgagaugguucagcauauccuagauauaacguuucuugcucguaaagggaacuaguagggacuguuggggaguuuguaggagaaaaauucagaguaauaagaguucaagcaauucaguuacgguuuuagaguuuaaacaccuaguuuuugauuuuuaauaauuucuugauuuguaaguauuuuaaguucaggagggguuuucauuggcuggcaugcuaaaagggaaaggaauuuuaaacauuuuauuuuaaagaauguguuauuugaauuucaguuuugaaacaaaguuaugucagauauuuucagaccucaaugccaccuaucguacaauucaaggccauuuacaaucugaaaacuuuaagguacguuuauuguuuuacuauuuuugcccuaguguuuuaaauggguggggggagggcauugaagggcuagaaaagugcauaagacaaguaugagacauaaauuuaaaacuuagauguuacagaaguuacuguuuuaaaauucugucguuuuuguuuuuaucaaaucaaaaauuuaaaagauacuauuuugucagguuuaauuuuaguuuuaaauauuguuuaaaaauuauaaauguuagucuuuuuucauaaaacauacagaagaaucacuuguuuuguaaugguauauacuauuuggcuggauuaaagacauacauuuuaaucauguuuagaaagucuauucuguuaccaauuuuuuuauaaccucuuaagcucuagaccaguguuaagaaaagccaaguguaguacuucacuuauaauugaauaaguaaauaugcuuucaugggaagaagacuuuuuuaagaaaaauuuuuaguuucggaagaugcccagugacgccaccauuuagggcauucagacaacucccauuuuaaaaguuuuugaccuuaaauuuugaccauaaguuagaauuuaaagacaaguuucaggaagauacagaguaaaguauuagccagaauuaggaaguacuuuauuggaccauaagggauucaggucaaaacuuggcuacuuugguuuccaguuuuaguaaguuucuauguaaguguuucuggaauguggcucauggguaguacuaaugguaugggagcugaccuuaggugguaaagagcaaauaguuacuguuuauuuuucauuauauuuauuuuuagggguuuuuuuccuuuuaauuagaaggugacauugauuuuuuuaaaaaauaugguaaugauauauaguuauuuucuuuaaaguuuaaaaaaacaucaguuuaaaggcaaauuuagcaaaucuugaugaucauucucaugaacugaaauuugagacauauagcccaaaauaaaaguuuguugucuguuuccuguuucuuuagcaacggguaaugacuugcuucagagcaugggaagauugggcaauuuauccagaaccauuuuugaucaaacuacaaaauauuuucuuaggacuuguaaauauuauugaagaaaaggaaacagagguaggcagucuguauuugucugguuguuuuuaaaauucguuucugggguggagguuucuuggaguuguucuguguuacauaugugagguacauuucuuugugaaaaauaucuauugcuuaccauuaaguaguggauuuuuauugcuggaacccagaagucaaaauuacauguaacaggaauucucugucuuguguccuuaugugaaaauuggugaguguuuuuuuuauuuaaugauauaagaguuaugauauauuguuaauaguagaaaauaagcaaguaauagagcaauauguauagcaugacuuuauuuuguuaaagauagcuauauaaguaaaauaugugcaugaaaagaugcaucacaugauagcagauauacaucaccauucuguuguuuuuuuucuuuuuuaccuccuaaauaauuacugaauccuuaauguuuaauucugccaugcuagucaagcuauuauguuuucacuuucacuccugcaggaucuuccuaauuggccuuacuguugcaacccacgugguccuuguuucaguuucuuaaauguguguuuccaccuaccauuggacuuuguacauguccuucccucuuucugggacuuaucuucaccugagauccuucagaucucagcucaaacauaaccuuagccuucucugaccucuuuaagugaaacuuaguaugcuaauaguaugauacgcccuuuugcuguagcaguuaccauaguuacagauaaguauauauuguugugaugaucugauuuccugguucccccaccccugcaaaacaacagcaaaaaccuuuaccaggcucuauaacagggggaccaaacuuguuuuugcucaucauugccucacaagguaccuggcaccagugagcacuugguaaauauuagauaaaugcacaacugacugcuucuuuagcaaacuggaugauagaauauguucuuacauuguaccucagauuguggguauccaguuauguuggcuuguacuggauuacaaauuaaucuuacaagcaaugugacuucagcaagcaaaggaaaauguuauaauaguacacauuuccauaggauguuccagaugaccuugauggugcccccaucgaggaagagcuugauggugcaccucuggaagauguagauggaauuccuauugaugcuacucccaucgaugaucuugauggagucccuauaaaaagucuugaugaugaucuugauggagugccuuguaaguucagauuucaaacugauuaaaucuagcuaauacauuuggugaccaaaacucuaauuuccauacaugcugauauggaaaaagguuauaguuucucaugaacguaucaaguuauuaacuuuucuauuucugauuuuuuucaaaauucauauacccaguaauacauuuauuuguaugcuauguauauaaaaggccaagaagaagcauuuuuuucuggucacauuucuuugcugggacaaucagccuccuauaauauuagcaaguuucucuuuuugucuugucaggaaauuauaggcaaaaucuugugcucaguuaugcaugauccuagguaccugguuuuaucaguuuuuauuaguuuuucuaacuuacaacuucaguuuuccuagcugccuaaaaucauuuugaaaauaggaacuguagacagcucuuugguacauuugaauuauauguuuaaauauugaauaauguaugcaguuuuauauuucagagauuagguaaagauauuaaagauuuguuuuacuucucaacuucuucacuugcuuaauauauuacuaaccuguauuuucugaauugauauauauacuguuaaaaauauugcccucagaugcagagaauugguuuagucauaguccuuguucuuaguauuacuauuuguccaucuguguccuuauuuuacuuugcuuuuuaauaauauggugaauacccaugaauguaauacuucgggucauccacuaguagucaggguuaauggcuuaucuuucccuaauaguggaugcaacugaagacucaaaaaagaaugagccuauauuuaaaguugccccaucaaaaugggaagcuguggaugaaucugaauuggaagcacagggugaguaaaaguaaaauaaauauuuuuuaaauuaaguacuuguacguuaauuauuggugugcuuguauauauguuuuccuuuuauguuuuauaacacguuuuaaccuuaaugcucaauguugucauauuuugugucuaauguaugcuuuuauugugguugguguugcuguuacaauuuucuuagguccuucaguuuggaagcuuugagaguaaugagauaucacugaaaaccuuucagguuaaggcauuuuaguagcaaauguagauuggaagcuguaccuacguagaaaucuacauagaggucaguuucauagaaaccaagcuuugacccucccauaaugcuagacugauuagaugcaauuuagaccugucuuucacacuuacuuagaccuguauccuagugcuaauaaucuaauuguugcuauuuguagguucuaaugaaauaaaucuuaauauucaacacagaaauaaggaugacauuauucgucacuucaugaauuugaauuauauuguaggugugaggaaagagauuuggcauauagaaauaacuauuuagagaauugauaaacauagauuaaaaaaacuucuguaauauaaacuuuucaauucuaaagcuugagcuuccacuguacuacugaaaaaaugcuaguuuaccucguggaauuacauccuccuuuuccuuucauucagcuguuacaacuucuaaaugggaauuauuugaccagcaugaagaaucagaagaagaagaaaaucaaaaguaagaaucuaaguuuugaauauacuguuucuuguucauauacacuccccuuuucauuaagagauauaguugaaauaauagugaaguggaaaacuucacucuuaaaaaauuuugggagaggaucauuuuuaguucuccauugguuuuccagugaauaaagagcuuuuguuuucuggucuugauggaucugguuucauuuugcuuuugaguuuuuuacgcuagguuauauucucacuuuguaguuacuaauuggucaacugcauuuuuuucaaaccuuugccaucaaauacuguuuugggcuccauaaaaagugguuuuuaaaaugugaauaggaaagguuauacuccuuucuuuuggauuguacauucuaagaaaaagauugcauuauggccauuguguuauuuaaauauaaaccuuucagaagaacuaagaaugaauacaaaggaaaaaaucuuuucuuuugaaauauagagaaauaauaauuuugauuuugcuguuugguaaucaccccaaaauuguuuuuguauuugacacugugugguuguaggaaucucuccucucagauucuccugcaagucuguauuggcaguuuuuaggaaguucuugacacuuuuuaaaaucauugcaaagggaguugaauuuuuuuuuuuuuuuuuuuuuaaaugaguaggaagagaugguaucacaaacacaaagcacagguuacugucuuuaaaaauuuugcguucuucuauucuccaauggaagugggaacaaagagaaaaccccuguguguccuagcacaauaugggcauuuguguggauuuaauaaaugggcauuuggauuguugggaaaaugugaucaaucagcaggcuauagaaacacaguuugauacgauggugaaaacuugucuacaaugauguuuuuucagaaauguuggugugauuagaacaagucagcaaugaugaugacaaaauauuuacauaauguuauagauguggcuugcuaauggaaauaccuaucugaggcuguuuaggaauacacaaauugagaaccguuuaguucaguuugcuuuaaaacagugguuuucugaacccuuuuuauguucgugauccuaugauuaguaacaucuuaccauuuuagaaucacugcuuuaaaaguaguauacguacucauaaaauaauuauuuaauuuagggggaaggaaggguagaaaagccguugaacugaaaaaaguauuguucuauuaguuuuauuucuaaagguauuaguuuuuuggcauaaaacugauauuuguguuaauguuuggaauaugaauacauuuuagcauugauguuggaauacgcauacauuaauggaagccuggaucacuagaaguauaauuuuagauuuuucauuuuucuuaggaauuucagguaaaucaugauaauguaaaaauaacaaaguacaaagcaaggaaaaaaagcuuuugugcagcuugugauccuugaaauguucucaugccucacuacuacucucuaguggcugaauccuaaaugucuuuuuacuuaaggcugauuuuguaacuaguaauuauuauauuuuguggcaauauugugauucguggcagaaaugugauuuuuaaagcauguuuuggagaaaaguuacaaaaagcaguuucauuuguauugaauacuguauggauuuagaaucuugaauuugcaugucuuuuuaaaaaaagaagaggaagaagcugugauaagauuugaaccucgaauuguggcuaaaagcuaaggccaaaaccaguuuagaaaaacugcuuaagccuugaaaaaauuauaauagcaauuuaaaauauuuacauauuuuaaaucaugaauagagcucauuuaaaaagucuuaaguaauaugguuaaauguuuaauguucagccaucuagacccuuucuguguguauaaaaacaugcauaacuauugacauaaaugauguaauauuacuguacaugcuauucugugacacguuuuucauucaaugucauugguauuaugccauuuuaaucuguuuaccuguucuguauucaucuaugauugaaagcaaacauuuugguaaacauacaaggauguuuaccaaagaauauuugaaauugcaaaaaaaaauuagaaaaaauuuuacaggcuagaauugguuaaguaaucaauaucugcuguauuauuguuucauaguaacugugacucaguuuaacaaagucacguccuuauugagucuucuagaauaauucuucaguaaacaucccuguuuacauaaacacacauacacuucaaucuaaaagcaucugaaacacuuguauaauuuuauguaccauaaaacaggaaauucuuguguuuuaaaaaaauuaacuaaaaacuguauuuaggaaauuuaugacaaauuaaugagaaauauuaaguaaaacuuuuuuuccaagaagaauauuuuuaaacuguugguuuggacuuuuuucuuccuuagcuaauauuguauugaguuguaccuguauggugauauuaaugauuugugugguucugaagaugaaguuaguaaaauauuuuaguaaugucuagaaaggaccuuugguugagaaauuuaaaagcuaguaucagaguuuucucaguaccauaucuuuucugauucugaauugacagccuuucuuuuuaucugccugguguaaauuuuucucucauacaaugaaggucuuauuacauaagacuuuaauuaaauuuuauuuggaaagaauuugauuauaacuuuuuacauuauuaagaauaauucuacauguauauuaaaaggaaucuuucugcucaucguagaauguccuuaguacccaaauaccaacauagaagggcuugcgagauucaaguauuaaaggcaaaacagcguuuguucuggguuaugccaguaauguuaucacagucaacauuguuuguaaggaauuuuguuuguauauauauaaacauucugaguuuguuuguauauggguaucuuguuuugcccagauuuauuugccaauaguauacacacacacacacacacacacaacccagucucagaauguauuuuuuuuaaaaaaaccauuuguucuuugugcuucaagaacauuugguuaauccuguacuagcauugaugaccagcuuuacacacaguugccuguuuguguuuccacuagacugcuucuggaaggacaggagaauuuuucuucuuuguauccuaagugacuuacucaugauagucucucagguuuuuauuuucuugucugacccagaaccagugcaacuuucagaaucaacugaaaugugaauaccgguauuugcuaauauauaaaaugcauacauugcuuuauuauuaagguuaugugcuaaucagauaaggucuuuaccagcuguauugguuauuucuuaguaacucugugacucaagcucauguauuuucuagauugauuauaggcucugcugaaguuacuaaaggcacacauacagcuuuuuuuauuuuuaauuuuuuuuaauuuucauuuuaaaaguuuuugggguacaagugguuuuggguuacauggauauauuauuuaguggugauuacugagauuuuggugcaccugucaccugaacaauguacacuguacccaauauauagucuuuuaucccucaccccccucccauccuuccaugucccagaaguccauuguauuauucuuaugccuuuacauccuuauagcuuaacuuucacuuauaaaugagaacauagaauauuugugaauauuguugcucacaauaugagugaaauaacucaggaauggagaacauaaagcuucuugaaaucacucugaacugugaaguaugcagaaacuugauuauucguuucauuuaacugcugcaaggaaaguuuguugcaaauggaaggcacacagauaacaacauaagcagaauuuauuacaguaugcuuauguugaagcucacacauuuucuguggaggaaagaaguguuuuauaaaauugucuguaaaauauugauaaaauauuuugcaaaauaugcuugagguaugaauuguccuauuauguuuuggcuauguuauuuaagcucuaagacaaugaaaaauaaaauagguagacuguaaaauaugguacucucuugcugccuugacauacaauguauucugcuuguuucuaaagucaagaagaagaaagugaagaugaagaagauacucaaaguuccaaaucugaagaacaucauuuguacucuaauccaaucaaagaagaaaugacugagucuaaguucucuaaguacucugaaaugagugaggaaaaacgagccaaacuucgugaaauugagguugguguugcagugaaacuuaaauuacacuuuauuggcuuuucacuuucuccaccaaacuaaguugccucuuugcauuguaccguaguacauacuguuccuucucucugcuuagaacucuucauaccagaugacuuuucuucaggccucuuaguucaaccgucuguucacucacagccuuuucuuacccuuuuggacuuacuugcuucuuccuauuuauuucugugugauuuuauauguauugugggguauguaugugaauguguauuuuguuuguuugcuuacuugcuugcuugcuuauuuaaugucugucuuccccauuaggcugcacuuuccaugaagggaaaaggccaugucuguuuucucuuuaucauuguaugucuaauacaugacacauaggagauccucugaagaaauggauucuaauguauagauuauauguauauauauauauauauauguaauacauuauguguuauguacugugagaaauccauuuuuuuuuuuuuugagauggagucucgcagugucacccaggcuggagugcaguggcgcagucucggcucacugcaagcucucccuccuggguucacgccauucgccugccucagccuccggaguagccaccaugcccggcucauuuuuuuguauuuuuuuuagaagagacagggauugaccguguuagccaggauggucuugaucuccugaccucgugauccgcccaccucggccucccaaagugcugggauuacaggugucagccaccacacccggcaagaaauccauuucaucuugaguguucauaguuaugcaacuaggaaaaaguaaaauauuuucuggcauauucuguuauguuuacauuuuauuaggcucauuuuuaaugucuguaccauaugaaggagaauagacauugagugggucuuaauacuaaaagauggggaaauguauagaagagcccagacuaucucaggcagacauuucccucccuuucccuuuuccccucuccccucuccuuuuuuuuuuuuuuuuugagacgggguuucuuucuguugaccaggcuggagugcaauggugugaccauagcucacugcaacaucaaaccaccaggcucaagagauucucccaugucagccucuggaguagcugggacuacagaugugcaccaccaagcccgacuaauuuuuuuuuuggauagagaugaggucucacuauguuguccaggcuggucucacccucuccuuuuuaaaugccuuuucuuuuguccaaggcuauucagacaucucagagaagggcuuuguaaugcccucaaggggaugaaauauucccaguaaaugcuagcaguaguuuagcaaucagucucaaaccucuaaagaauguaugagagugaauuuucauacuguauacauucauugaacgguauuuuugaaugccuacuguaugucaguacuaucucccuuacuaacuuaugauaccuaucacauuaguuaccucauugccacuucuccacauagucacuguugggcugauaaaaguucuugcccaccucuuugucagacaucaccaaacugaaaaguaaacagacagcauuuuguuuuaaccuuauguagagucagcguggugucauuuuuaaguagagaugaaggauuuucagaguugauuaguugauuuauuuuuuccugggauguauucauauacauuuuaaauauuuuucaggggauaagaugugugucagugaacacacucaccugugcaccuuuucaaccuacacaugcuccucuuuuacuccucucaccuuauaagaagcucugccuuggccagcugcgguggcucaugccuguaaucccagcacuuugggaggucgaggcggguggaucacgaggucaggagaucgagaauauccuggcuaacacggugaaacccggucucuacuaaaaauacaaaaauuagccgggcauggugacgggcaccuguaguccccgcuacucaggaggcugaggcaggagaaugguguggacccaggaggcggagcuugcagugagccaagaucaugccacugcacugcagccugggcgacagagugagacgccgucaaaaaaaaaaaaaaaaaaaaaaagagcacucccuuucugaccugaugaaaacuguuggaguagaaauagacuugaguuaaauagaaguguauuuucuugauaauacaagcuauucccucauauaaaugccccaacuguuuaguauguucuguuuccuuauuaacuuaaagagaggaaagcauguaauuuagcuuuuuuguuaacuuaggucguuuuuacaaaccuuauucuuuccaccuuguauacguauauaugcgauacacgugcaugcacauugcacacauauaugcauacauuuccauacuucaugugcucuuuuguaaucuggccuguccuuuauguauucagugauuauuucuccugcuuucauagugacugccucucacaacuuaguugucuuucugggauuuggaccaugaacuaaguccugauuuuaaaauguuuaucuuggcuucaucuuaaaauuaucuaaucuucucuuguguuuccucugagagauuuagucauauggaauaaaguuccacaacagguggcaaacuuggacuagaacucggagcucaugagcuuuaucccagggcuuuucacaacuagcucucuucucugccccuaaauuuggauauccauuucgagauuuagaauccaaacccuuuuauuggagaaccauuaaauuaagaauaaaguucuaaaucaguuucuccaauuaguucuauuauauucuauaguauauauacuguaauuuugcauccccacguguguccuaauaaagauaccuauagcugaacaguuuguagcauggaauaaauaaaaaccaaaugauucguguuauaaaauacuaacauccuuuguaaaaacacaaaaaucuuguaccuauaugauguugugguggccagaagccaguucuuuuuuuuuuuuuuuuuuaguuuauuuuuuauuuuuuuuuauuuuuauuuuuuuauuuuuuauuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgccauguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcaaaagaauuuuucuuaguacagaacaaaaugaagucucccaugucuacuucuuucuacacagacacggcaaccauccgauuucucaaucuuuuccccaccuuucccccccuucuauuccacaaaaccgccauugucaucauggcccguucucaaugagcuguuggguacaccucccagacggggugguggccggguagaggggcuccucacuucccaguaggggcggccgggcagaggcgccgcucaccucccggacggggcggcuggccgggcagggggcugaccucccccaccucccucccggacggggcggcuggccgggcggggggcugacccccccaccucccuccuggauggggcggcuggccaggcgggggacugacccccccaccucccucccugacggggcggcuggccgggcagaggggcuccucacuucccaguaggggcggccgggcagaggcgccccucaccucccggacggggcggcuggccaggcggggggcugauccccccaccucccucccggacggggcggccggccaggcggggggcugauccccccaccucccucccggacggggcggccggccuggcggggggcugacccccccaccucccucccggacggggcggcuggccgggcagggggcugacccccccuccccccucccggacgggguggcuggccgggcagaggggcuccucacuucccaguaggggcggccgggcagaggcgccccucaccucccggacugggcggcugaccgggcggggggcugacccccccaccucccuccuggacggggcgacuggccgggcagaggggcuccucacuucccaguaggggcggccgggcagaggagccccucaccucccggacggggcggcuggcugggcggggggcugaccccccccaccucccucccggacggggcggcuggccgggcagggggcugacccccccucccgccucccggacggggcggcuggccgggcagaggggcuccucacuucccaguaggggcggccgggcagaggcgccccucaccucccggacugggcggcuggccgggcggggggcugacccucccaccucccuccugaacggggcgacuggccgggcagaggggcuccucacuucccaguaggggcggccgggcagaggagccccucaccucccggacggggcggcuggccgggcggggggcugaccccccccaaccucccucccggacggggucagaagccaguucuuaaucuuucacauaccacugagagcagugccuaggcuggaguuuccuuuucuuauucuacuauuguccccauuucuaccaacaagguuggaagaguagaauaguggguggggaaccaaguggagggucuucugucuuguuggaagagagagaucacuuucuguccuggucccugaggaaagagugaacaguugaguuggaaggugauaccugucuguugccugaaggcaauaagggcuggauaguuaagaagccauugcaugggccacuuccuuuuguguugagacccuugaucaucuguuuucugugugucuuggacuugugcuugagccucaguuagacuguaucagcaggaacuauaaguagggauuguauagugauuuuuaaaaugauuaucuuaggaaucccuucucuccccuaaguaacauuugggucuguuguuugacucuuucuaacgcaaacugauuuacuacaaauacauucuguggaagagucaucuuggucacgagaggcuucacacagcgaugaacuuagcuauuuauguugcccaccccacccccuugcuuucucagccuuacaucuuaucuuuuuaaaugcagucaugauuaaaacacacgaaaaauguagacuuuuagagagcuuugaaagaagagaaggagagaacaucaaagcucugauuauaaaagacccugauuauggaagugaaaauaugucugaaaucccaccacuuugggaggccgaggugggcggaucacuugaagucaggaguuugagaccagccuggccaacauggugaaacccugucuguacuaaaaauacaaaaauuagucaggcauggaggcugaggcaggagaauugcuugaaccugggagacugucugggaggcggagguugcagugugccaagguugcagugcaccugggugacagcgugagacaccgucucaaaaaauaauuaauuaaaaagugaaaauagauggaaaaaggacagaauuggagaacguauaagaaacauucaugaagucaaaaauagugaaaaugccacuuggggccgggcauggcggcucauuccuguaaucccagcaguuugggaggccaagcuggguguaucaccugaggucaggaguucgagaccaaccuggccaacauagcgaaacccugucucugcuuaaaaaaaaaaaaaaaaagauucaaaaauuaggcuugguggcgugcgccuguaaucccagcuacuugggaagcugaggcgggagaauugcuugaaccugggagguggagguugcagcgagccgagauugugccacugcacuccagucugggcaacagaguaagacuccaucucaaaaaaaaaaaaaaaaaaaaaaaaaaagaaagaaaauaccacuuggaauggggagaaaugguaaagacuaauuuguaauaaagggggguaacaagcaaaugaagucuuguuuuugaaguauaaauaaaaugcuguaguagcauuuaguccauuuaaaggauauaucagugucugaauaaaauaggauaaaauguuagcaucuacaguaauuucaugggacaagaaugcuuccucuuucucuuugaguggaacaauauugagcagauuggcagcccagugguaucauccaagauccaugugcuuucuaccacuuggaggaucuuccagguccucauacuuuucaccuuauuuguccucccguagaauucaagaagaagguauuuucacccuuguaaauuuuuuggauaauuuaagcuccuuuaagccuuaggauaguuuuuauuuuaaccacuuugugaaguuuuuauuuuuaaauucaaaauaaaucaugaauuuauucuuuuuacuauuuuuauauaguacaaaauuuuaagauacuuauaucuccagaauaaaaaguaaaauuaagcucacuuauugcagguuuuuccucucccuguaacugauuuuacuaguuuuuucagaucuuuauccauugccaguauauaaguauauuacauguauuuguuuguguggagguguauuagccagaaaucucuggguaaagauguagguggucuguuuuuacaaacaaugcugcaaugaauaucuuguaaaauaccuuugugcacuuauauagguaauaagagauggaaguuuuucuggucugguuuuuuuuuuuauuuuagacggaguuuugcuguuguuucccaggcauggaguacaauggugccaucucggcucaccgcaaccuccgcccaccggguucaagcgauucuccugccucagucucccgaguagcugggauuauaggcaugugccaccaugccuggcuaauuuuguauuuuuaguagagaugggguuucuccauguuggucaggcuggucuugaacuccugaccucaggugauccgcccaccucggccucccaaagugcugggauuacaggcgugagccacugcgcccggccuggucuguuuuaaucaguauuugcucuuacugucucauaaaguacccuccaaaugugauuuaaccuuuucuuuguguuuugauaucuggugauugcacugugagugaaaccuucagacugugugcagcuuuguguuuggucuuacaugagcugaaccagaaugccacagccuucccaccucccauccccgccucuuuuuuaaagauguuuaaucugcauucugacugucauaucaugcuggcagugugcgugucuuuagcaaccuugcuuuucuaauuuggggaaccagauaccaaauuuguuauaauuguguugagagaauaagugaguucuuacagccaugaagcacgguucacgguuuuugaguccucucaugaccagagaggguucccaucuggucagcugauuuuugccuaguuggacuugucugacaaguggccuucaggugagguuauauuuugacugaguacuaauuaguuacuacuuugcuauagaaaagaagcaaaacagugcuugagaaucuagaaugaugaaaaugcuuauuuuuaaaauauuuuauuucacagcucaaaguuaugaaguuucaggaugaauuggaaucugggaaaagaccuaaaaaaccaggccagaguuuucaggagcaaguagaacacuacagagauaaacuucuucaacgaguaaggaauaaguauacccaauaauacacauauuuugaaguuauuuauuugacuuccuagaauacugguauaccuaaagaugauuucaaauuauauccuuuguauaaauuuugaauacuaguagggcaaucagaaacauuugaaauuugauauuuuaaaaguauuuugauuggaaaggagcuuaaaggcagcagcacacuauuuuauucugaguauuaccuguggacaagaagauuaauucugcuaagagcaugcuuucaaaacuggaaaacccuucaggacaagucacauuuugugacagugagacgccaacaacccugagagguaguacagaaagaaaaagauggaggcaggguuugggaaguucugguguugagaaguuuauuuucauuucucaugguuuccagggagggacagcaagugguagaauaccucauuggugagcucugaguguuugagggacuuuauauucucgugcaucacaaaauuuauaggcaugugcagagaauuuuagaaccaggaaccucaggaauuuuguugagacugucguugcaaaaaaaaaaaaaaaaaaagaaaaaccaauaauaaugagauuauauagaaagugaaauaggaaagagccauaaaaagggaacuuacaaucacuauaaagcuguuaauguacaaaacguguuggggagcagucugguaaagcaacuguggugcugcucagaccuguggaaugcuaguacugcucucugcuguguacuccuaggcaagucacugcagccugcuuuuucucugaaacuggguugauacucccaauuuuguaagauuaugaguuagauaauagcuaauauuauuacuguuacucuucauuauaaguauuuuagcuauacgguuccuauaaaauaggcaucucaauuaggagaucauuuucauuuucauuaucaaucaggagaaugcauccuacagaucaccagagggagucagucugcuuagcaccacuguuuaaaaguugcccucuauauauuuggaaaaaagauaaaugagauuuuguaaaagaugcuacuuauggcugggcgcaguugcucacgccuguaaucccagcacuucgggaggccgggcaaucaccucaggcaaaucaccugaggucaggaguucaagaccagccugaccagcauggauaaaccccgucucuacuaaaaauacaaaauuaucugggugugguggcacaugccuguaauccuagcuacucaggaggcugaggcaggagaaucacuugaaccugggaggcggagguugucgugagcugagaucgugcuauuacacucuagccugggcaacaagaguggaaaacucugucuaaaaaaauaauaauaagaugcuacuuaccuauaccccauaggagauuacaccuugagaugcucacuguucugaugguagcaagcacaaaauacauaauauuuguguuaccacuuuagucuccuuugauuauaauuggagagaaggaauaugguccuugccugauucuguaaauaguuguauuagaacacagccaugcaccuugacuuagguauuuuguaggguggcuuucacucugcuguggcagaguugaguaguuguggcagagacuguauguggcccacaaagcagagagcauuuacugucuggcucuguacaaaaaguguuugccaacaucugguauagguucuuuucaccuuuuagaaaucagaagaaucagcuaucacauagcuugcuugaugcauaugaaucguagagaaauuaaauuccauuuagugaagaacuaaguuaguuguguggauuuauugucuguagccacuccuuuaauuauauaccaaaaucagaauuucaaaugagaaguggcaguuguagcaucuggggauaagcaaauguguugguuuuuuuuuuuuuuuuugguugauuguagagucauguagucaguuuguauuuaggauuuaaaauuugcaguguaauugguacuuguuucccacuaauaaaacuucgauggaagauuauugugaauaaccauuuuccuuuucuagccuuuuuucuuugguaagagcucuuuuugauuaaaucaauuuguuuauaguuagagggaucacuuuuacugacuauuuuauuguaacuuauggaaagggcaguacauuguuagcuuuuucugauuggaauuuuucggcaggugggacagugggggaagagcucugacucuagagcuuggucucaaauucugaccugacucuccugugugaccaugcacaugguacuuaaucuuucugagucucaauuuucaucucuagaaugaggauaauaguaauuuucuuagggaugcuuuaaaugauuacaugaaauggucuguggaaagcuguuuaguauauuguuuggccugugguaagcacucaguaaauguauagcugcuguugcuaggauuaguuuuauucaguauaagcaaaagaaaugacuaguuucccugaagggguagauuuuuuuuuuuuuaauaguauuguaccuuaaguaguaauuuaaaaaauuauuuccuguaagagaagauauuguucuauaaaugagauuaacccacauugauauuuuuaaacaacuuaauauuuucuauaaaaaauaacaggagaaagagaaagaguuagaaagagaacgagaaagagacaagaaagauaaagaaaaauuggaaucucgcuccaaagacaagaaggaaaaagaugaguguacuccgacaaggaaggaaagguauaacauuucucauauuuaauugcauauacugguuucaagauuugcagugguguuuuauaauacuuucaucauugaugcccgcaaacuggaaguguuuguucaugauaaacuuguuuggguccugcuugcagaaggcagaaauagcggagaaauggggcauuuaguuggcacuugacuuaguuaaccagggcaucaucccuucacaugguuuauaugguauccuuagccuuaguucagugcaaggauucaauuacaguauuagauaucaaaccugagguuuaaguaacaaaacaacuugcuagauuuuccuuguugcauccaauuuaagcauauuuuccaguaucugugcugaggcugcuacuuguaaacuugagucuuagucuuaucuugaaaggagguuguauacauaggccaaagcucaccuuaagucuucauucuaaucaaaagcauuucucuuucaguuuuuaugucuuacucucacgguuccuaaaucucugauugaguaaagaaaauuguuucccuuaacugaacugagguuuuccuaauaaaaagaccaagccauugcaaauaaaagucuagcuuagucacgcuacagauaguuacaaauaacaaguuaugccaauugguuaaaagucugucacuuuuuugacuuuuauuacuauuuugacauaguuuuagauuuauaggaaaguugcaagaauaguauaauugauaguuacccuucacccacauuacccaaauguuaaaguauuucuacuuuugcuuuauucuuccucuucugucccaccuccaaccauuuaagaauaauuugccaacaugaugccccauucucuuaaccacauucaacauuuuaaaaaacugauauuuaauccagagaccuuaauuagauuuugccaguuguuucaauaaccucuuauugcaaagagaaaauccaauuuaguugaauucaguuguugucucuugacaaccuaucuuuaacacuuauuuguucuuguuacaaaggacuuugaguauuguuaaaaguaacauuacaugguuagaauaaaagaguaagcugguagcaauuaauagcuaauuuaguaaaggaaaaugaauacccgauccuuugcucauuuauggaauguuuugggggcuuuguuccauaggaagaggcgacacaguacaucccccagcccaucucgcaguagcagugguagacgagugaaauccccaucaccaaaaucggagcgaucagagcguucagaaagaucucauaaagagagcucacgguccaggucaucucacaaagauucuccuagagauguuagcaaaaaagccaaaagguaaaugcaagucauuuuugcuaauauuucagauaccaguuuccuugucauuucaucagcuuuugaaaauaauuugguuggcauacauuuuuuuuuuuuuuuaaggauuuuagaaaaccaaagagauacacuuucauuuuugguuauuccuccccaccuccucaucccaaucucuuucaugacugaagugaaggcuuccaacaagugaggaccagccaagaauuuuaaacaucauauccaauguuuucuguggaauaggguuagcugcuuuacuuuucguucuguucuuuaguuucuauagaauauuauuugauuuuugucaaagcugaaagaaacacacauuuuucccccauagcaauauuauuagcaaguucuuggguagauauuuuuggaaauacauaucaugaauaccauuuuuucaguauguauuuuaguauuuuguauacuuuuuuuuccuuuaguuccagaaaaaugguucagaaauguuuuauuuaucuggugauacauagaggaauuuuccugagagcuaaaacugcuuuguaugcuaauacuuuauuauuguaacuauuuuuaguaaaaucuuuacagaauagauaccuuucuccuuuucuaaauggcaccuguauauauauguauguauguguuauauauguauguauauguacauguaucuuuauugguuuaaguaauccuucaugaacagcacuuacaaaauuaugucuuaaaugaugcccuugaaugauacugcaguaguuguuugcuucaggaugauaaacuucaaagcugcuguguuuuuuaaauuuugugcaugaucuuaggugcaacuuugaacuuuaucuuguagauuaaagguucaaauuuggggguuaucagucacuuauggagcuuguuaaaaaugcaaauucuuaguuccauccuccagagauuuugauucaguagagcagugauaaggcacagaaaucugucuuuauaaacaagcgcucuacugaugaucauugaugcagugcauaguaaguacaaaauaaucuguguguguguguguacaauagaguuuaaauuuuagaaguucauagucuuauugcagugauuuuucacugugcccuguuaaagaucauuuucgaucguuuaaggauaaacaguuuugaucacaugaguacuuuaucaauugggauuuuuuuguuuguuuccuuagaucaccaucugguucaaggacaccuaaaaggucuaggcgaucacggucuagaucuccuaaaaaaucaggaaagaaguccagaucccaguccagaucuccacacaggucucauaaaaagucaaagaaaaacaaacacugacguaaauuuuuaagaugcugucacuuauuggaaaugcgauuuguuuugugccugaacggucuguuuuuuaaaaaaacaaaaaaucaaaugaaagagcauuccugggguuuuuuguuuguuuguguaugcauguguaaacucaugagcaacugcaucuguagaucugucauuguuuuauauuguguaaauuacuuucauuguggcuauuucucaagaugaaauuuuuauuguucuaauggauuucaucagaaauguguauaauggaucugcugacaguaguaguauuuuguuuuaggauguugugacuuagcaaaaauaauacagaugucuuccccccuuuuguagcuuugacaauuugaauuagauuucaaauaaaaucugaacagaaaacuauaauguuguuuuuuugccccaccggugauauuaagucccuuaaaguccuacugaguuucacacuacuguugugcuucuuauaccugaugcacuuuauaagccccaguguucaaguagcuuaaguuuuauauuuacuaagaugacuauccaaauuaagggaccugagacuccuauuuggugguuugcuaaccauuugcuuuugauaaguuucucuuggguaauacuaauacccagauaucaaagacuagguagauauggcauggcguuuuguuaguggaaugccuggcuaaaacauuuuuuucacagaagcaauaugauuuccauacauccaacccauguucugagcaacuacuuacuuuuagggggaaauuaaauaucuuuucauuuccucuucuauuaugaaagaaguuuauuuguaaaacaaauuuucuaacaagguuuggccauagaauucucuuguaugaucguugaccuuuuauaaucuucuguaggcuaucuuucaaacacuggcaucagaauauuuuuuauaaguuuguguuuaaacagcuuaguugguccccccccacucccaagagacuuggguuuaguuauagcuuuaaguaaaauuuaaaaauaaaauguuuuucaggaaacuucguaucuaaugguuuguaaauucaaggugcaaaaaguugauuuaaaccauuugcagaguugaacucuauuaugaaaauaaauuugcuacgguaugaggaagaaauaaaacuuguguaauguuggucauaauacugcuauaaauauaauaaaggguuauguagaauugaacugacacuauuauuugugaaucuugauuucaguuuuuuauguaggcacuucauacacugguuugauggguuuuuuuuuuccucccuaaaagagaaaguagaaaacuauucuaacaauggauuauuuugauuuagcuugcuuuuuaaaaaaaucuuuucaacuuguuuuacuuaaucuugccuagucacaaaauaagaugugcacccaugguuuggagaguuccuauauuagcugagcagugagauacacuauuuccaaacggugcacaccuacaguagcuuuggaaaugagccaaucacuguuuuacuuaaugguucuuaucagcaugcaaauauugcuugaaaguuauuuccuuauucacuguuuuguuaguccauuuuguuaggaaacauuaauuccuaaaaauuuguucagaauaauuaaaagugaacauuuggugcugauacucaaaaaccuacaaauguagccauuuaaaaaguaacauguuuuucuccccugcucauugccugggagaauggaauuuuauauaacuaccuuucuuugcaaaaauaacggucgugucgaguugguggugauuuuggcauuccaucuugcacugguuucuaguauaggcuuagaaauaauuggucagguaauaaucuuuccagucaaguugcaagggaugcuuauuucucuucaaaaaaagacauccugcgggauugaguagaaaauuuuaggucaguuuugggugcuuauuuguaauauuuuuccuacuacauuggaguuuagcaguucuuuuuuucuggauccagauacaagugucaugguuuaucuuacagugggugaaacugacuuucuuuugguugggugggugaggauuucuuaggccugauagaauauauauucugugaaguuuguuaauguacauauuagauuguauuggauuuuuuuuucuugaauugcaaaugguauuauuagauagguuauuuccaguuuuacuucaugacaaauuaccuagaguaaaccuacuuaauacucccauggauucuaugaaaguuuaaugggaucagaaauuggugacuuauaagggggaagauauucuaccauauuuuuauaauagcuuauuauucauguuucuugucugaaggacacucaaguuacagagcaaaauuucuauagguugacuagaauguucauaagcauggucuuccaguugcaggaaagaucauguucuaucuguggacacuuacuguccucuaccacagcuacgugccagaguuguuuuccacaguucuuauaaagggcaugacuuaggcucuuuacccuccaacuuaauguuuauacacagggauuguuuacuagguuaaugacauuuaacuccccucucuucuguaggugagagaaaauaaguaagucuugaucuguuucuuaccaaagagagacagaccuaugauggaaaaugaucacgucucugaauuuuuucuuuaacguuauaguuccuuauuacagauaguaagcauaugggaauuucugagcuauaacauguugagaaguuagaaauuaaaacuaacacaacaaaaggcgcugaaucaaaagaucuuugcuuuuauuuggcucagaauguuuuuggcuuuucugcuaaagauggcagaaauuacucuacacagaccugauuuuucuuuauugcagaccauucuugugggcuuacccugagacuuuuaucccaauuagugaaucuuggagggaauacuugcuuauuuaugacuuagguauuuccccccaaacuuuaauauucuugagcacuugaaaauacuuuugagaaauuuuaacugugauuaaauuuagguuuauuagaaauauucuguacacauuugccuccaugguggcguaaguucugaaaaauuauaugaccgugacaauaguuuaucaucaucauuauuguuauucaaaauaaggguaaauaaaucucuguauugccaaagugacuuaaacuguucugaugaccacacagugugauuucuuuagcagagaaaguugguuuuaaaaauaaauaguaccacuuuucuaagacuguacaguuuacaaauaagguuuuuuucuuuguuguuuuccucuucuauuaaguuuuagugaaaagccuaauuacagaaaauugugcagauacuagugaagauacuaguauaaguuuaaaggaacacgugacuguaaaaucucacauuuacaaagugcuugaucucuucauauuucacacgcauguuuuagaauagauuuuagggaguguuuaauucauuauccuuuugacuuaaaauuuuuguuaccaacuuccuaggacuuagauaauauauaaauaaguacaaaucccaggggaaguguugugaugcuagacuaaaaggugggaaugugcugcuguuccgugagccuuguuccauuguugaaaauuugaugccucaguguuuauucaguaccaccucauggagcuucaauguaaauggauuauauguauaauugguaauuuguauaguuuuguagauuguagauuaaaugcacucaucaugucacauguaauugugcuuggaguauuuguguuuuauucuuuuacuucaacggguucuugucuguuacaucucuggugauuugaaauaucaggaaagacaguuugucagaaaugagaauaauauaguugaaaucaguugggcuaaaauauucuacagcaagacaauuucuuuugggugaacugauucuauaauuuacuuacuuuuaauguaaggauuagauuuauuguugagcugcuuuccagaucagacugucacuuuauaguuuuucuacauaaagauuauauaguugcaaacaaagguugugaaauuucccuuuuguuguuuuugacuuuuaauuaauaaaaguacauuguuuucauagcaaacuuagacuguccauguaauuuucuccauauuguuuuuccgaugcaagcccaguuaauaauuaguuuuuuagcagcuuucucucaagugaaauaagugaugugacauguuuaucaguuauggcuaaaauguuacacuuuacauguuuaaacuauaaucauauguuuucaugcuagauggu

SEQ ID NO: 192085 - RNA, 117277 nt, Homo sapiens
augcgcaguggcgcgagcgcagcggcuacgcgggcgcggagagguagccgcagaguggaccugcagguacuuggaucuccagugggagcugcccucucgaaggcaggacagcgguggcggcagguacgcggggguggggauagggcccaaaaggaaggcuggacagacagauggaaagcgaagcguuacuccuuugggggcgcgcggcggcucgggggcaguaucuccggguccccucgcucgcgucucgucuccuggcugugcaguguggcgcccgccguccucugggcacgcuucugcccagucccggcaggcagugcccgcagguguuaaaucgcguauuuacacugcuuaaacaauaagccuguuaacugaauugugauucuaugcaaugaaauaagguauuucauuaaguuuucuucuuucaacuuuggguggcugccggugaggcuuucugaaccagccuguuuuguuuuaauucugggacugguuuauuugccuuuggccuuuuggugcauaggaucaauagggcuguagugaaaucccauccgugcuguuuuugguaccuuuccuggagcauagggaccucuggaugcggcauaaaaaugucaguuuucagcgaauuucacugccaaaaaacuuuccguguuucagcugcauuuucaaguggagacuuaaaaaaauuuaagauuucucccuaacuuuucaauuauuacuguauuucggucuucauuugguacuauuaaaaggaagcggucguuuagaugaguaacagaauucucacuuuuccuccuuuacuuacuuacuaugucacauuuuauggcuuauaccgugauaucuuucccuccagccacgguguuggauacacuuguaugaggcuucagcugugcugcauaaauuucuugaagaaccugugagccagaagcaaaauuucaggacagggggcacacacugaacuugaagcaaguacuuuuacaccccccaccaccuuuguaaucagcuuuccuuuaaguugaauuauguaaugaaauucuauaguaaaguguuaauguguaauguggaggcauauauauauauagagagagagguaguaaguuuaggaagaggaaauuuuaaguucaggaagagaaaccuauauggaaagggaauacagguauccugccccccuucauuccucccaugauaaauguuuuaauggcagaaauaauauacagcuggucuaguuuuggcuguagagaccuuugaggucagccaguucagcugcuucaguuuacaaaugagaaaacugagaccagcgagguuagaugacuugcuguggccacccaagccccucauuggcaaagcuaggccugggauccagguuuucucauuuucuggggucuuuuuaccacucccugcagauacucuucuuuaccuccauuauuaaacuuccuuuuucucuucuacuuauaccaugaagucuggcuuaagcagaaaauuaguuguuucucuuacuaagcuuccuaguaccucauaaauuccuuucaaaaagugcccuuucacugaagccccaccuaacaauuugcugguccugaaaacgcccuccuuccuucccucagucaccugggcccuuugcccaaaaugccuguuugccucccucuuuccguauugaaguccugcucaugcugcaagguguagcucaggugugaccucuuuuuggaagccuuccuugauugccuuagcaugaaguagcucucccucuucugaacccuauagcacuuacuacuguuguuugugcuguuaguauccccauuguauauaguauccugaguauuuuagcaccucccaacuucccgaccaggaaguuggcagguuguguaagcucuuggagguuaaagccuaugacuuaaacaucccacccagcacuaagcacaaaguauauucuuagccccuguuugugggagggagugggggaaggaagugcaguauguauaguuuuguaaagagauuucauguguguucuauaauauggggaaggccauguuagagcuguaucaagacagcagccaaguccauuucugauuccucauauuuugauaacagaucacagauuaguuagggggauuacaggagacaggcguaaaaacacgggucaguugguccaggcccuggauuaagccugugacucaaaguggagaaaagagggcacagaauuaagaaauguaaaggaagaagcauguggugaaagacuaaaugcagagaaggaaagacauguugaaaaugaauuucaggguugggguguuaguaauggguuuauaauguucuuuuuaucuuaaaaguaccuccaauuggcugggugugguggcucacgccuguaaucccagcacuuugggaggccgagguggguggaucacaaggucaggagauugagaccauccuggcuaacacggugaaaccccaucucuacuaaaaauacaaaaaauuagcugggggggcaugguggugggcgccuguagucccagcuacuugggaggcugaggcaggagaaucgcaugaacccgggaggcggagcuugcagugagccaagauugugccacugcacuccagcaugggcgacagugcaagacugcaucugaaaaaaaaaaaaaguaccucgaauugugacauugucucuguuucuuaguuagugauguaauugucuuauuucccguucuagaugauaagcucucugaaggaugaccuuuaacccuucacaauaccuggcacauugcuuugcaguaucagacacucaauaguuauuacaugaaugaaugaauaaauaaauaaauaaauaaauaaauaaauaaauaaaaagugcauuuugccauggggagggugggcauuuaggaucuuagagcuauaugguagcgcuuuauccagacuauccccuaauuguauagaggagggacucagauauucuuuuuuuuuuuuuuuuuuuuuuuugagauggagucucgcucugucgcccaggcuggagugcaguggcgcaaucucggcucacugcaagcuccgcuucccagguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccagauauucuuaacuaagcuaguuagugggauagccagaagcucuguucaaauuuccucauuacuagacccaagcucuuuucauuaacuauuacuuuuugagguuguuggccccacgauuauuuuuauuuauuuauuuauuuuuugagacagggucccacucugucacccaggcuggagugcaguggcacgaucacugcucacugcagccuugaccuccccgggcucaagugauccuucccaccucagccucccaaguagcuguggccacaggcacgugccaccaugcguggcuaauuuuguauuuuuuuguguuuagagauggggucucacuauuuuucccaggcuggucuugaauucuuuggccugccucagccucccaauguguuaggauuacaggccugagccaccaugcucagccucccaagauuaauuugaguugguagcaagacacuccaguucaagauguucuguggacugaaagcccucagaaaccaaucuaagggggaaauuugguggucgaugagagaaugugugugucaucggaagaggugaaacacaaggcugcuggccaguucaagguugaguguacacagugaggagggagugaggcugggguccuaggaaucuucacacuggggaguugaagucuggaaaggucaugguagcuuagcuugucagaggcagacacaaauggguuggcccaaaguccuugggacugagagucuauuuccuagauauauuguacacuaccaggagguggugagcaauggcuuuggagaggguaggccaggugcagugaggguaggccaggaggguggcaccaaagggugguguuuaugacccaagaacaugggggugagguaaggcugagagagagacaauugugaucagauucuaccuggaaaaacaagacagaaagcagugcugcugaauccaaacuuccaguucaagaggugguuuggaauauuuguuuacuuggaacagauguugcauuuugcaaaucauagccauuuugcaaaucaaaacacagccuuuccauugagcugcacacagcgaugagggagcuguuggaugccacauccuugccauugacuugcacacugugguugaccaccaucuucauauuuccacaggcaacgaugguccauuaaaaaugucaaggagagagagagcaguugagaggagagacagaacaaaugagcuugagaaauggcuagcaguggggaagggaaggguuggccugguuucauauauauauauauauauauauauauauauauauauauauuuuuuuuuuuuuuuuuuuuuuuuugagacggagucucgcucuguggcccaggcgggagugcaguggcgcaaucucggcucacugcaagcuccgccucccggguucacgccauucuccugccucagccucccgaguagcugggacuacaggcacccgccaccacgcccggcuaauuuuuuuuuuauuuuuaguagagacgggguuucacuguguuagccaggauggucucgaucuccugaccucgugauccgcccgccuuggccucccaaagugcugggauuacaagcaugagccaccgcgcccggccuauauuuuuuauauauauauguuuuucaugaugacguuagugaaaauugauuaggcagaugcaaaaucagguaguauguugaaguuaaugucucauacacuuaaauguccaaauauuaaauccuagaauuuaccauggcccuuuguaaaaugacaaauaucuuucuuaaaauaauaauaguaauauuaguaacuaguauuacagaauaucuuccaugaaccaggcacuauacuaaauacaaguaauauaucauuucaucuuuauaaaccauccugugagauaggugcaacaauuacucauuuauuuuuaauuuuuauuuuuuaaaaacaggguuucagucugucacccaaucuggaguggaauggcacagucauaacucacuguaaccuugaacuccugggcucaagcaguccucccgccucagccucccagguguggaccaacgugcccggcuuauuaaaaaaaauuuuuuuauagugauaaggucuugcuauguugucuaggcugaucucaaacuuuuagccucaagcaauccucccaccucagcuucccgaagcccugagauuacaggcaugaaccacugcaccugaccuacccucauuuucuagaugagaaaauugaggcuuagagagauagauaaaagcauuuaucugaggucauauaguuuacaaguggcugagcugagauuugaccccaggccuaucugacuuuauacacugagcgcucaaauaacuuaaucaaauaucuuaacaaaaaugcaaagcucuuucugagguaacucuaacagaugcuuagaauagccacagguuucagcugguggaaccaccaacauucuuugagccacauuuaaaaaaaccaaaacaacagugguaaaucguuccgguuuuuuuuuuuuuucauuccacuuagucuuuaucuccuuuucucuugaagcauuccuagagaaagggacagcagcuuuuucucuggguacaccauuaaagccacuucugaucugcucccacccucuuuugggguggagcugugauuggggagugaguugguggucauccagggcgugucuguggaguuggcaaugggaaacugggaagcucaccuuguguaggagccuaagaacucuggagugaccagguauaaggauuucuuucccuggggugucaggauccacugcuggaagcuccuggaauaucuauggaucaugacucuaaucuuaggccuuugaacuauggccauaaacccccaggaagaauccaggugugaacacauucucccccaauuuuuaagauuggggaguugugaagucccuguggacuaauuggagguggguguggauaccucaggaaaggccccaggucaaagacaaauaauuuaaaggccccccccaccccauaggccccagcuuugaccugugagaaaaugugcuccucucccuccucuugaugaaccuaauuacauagagaacuuacucuccugggagucucaaaauggaacucagcugagagcgugcuucccucccuugcugccugagcucucuuuccauuuccugguucugcuuuaccuuccccugagugguucuguguucccaggauaugaaaggcagggccgcagcuucuggcuucaccgggcuaauuuuuguauuuuuaguagagucgggguuucaccauguuggccaggcuggucgccaacuccugaccucaagugacucgcccgccucagccucccaaaguguugaggcugaggccaccucuggcccucauucucucaacauucaaaagcuugucacuucauccaguuccgaauuaacauuuuacucuggcugaugaugaacgucggggagaaagagacauuugugcugcauacggguuuauugguuauaaaaugguuauacaauuuugauugcuggaaacuuugcugacauguaaggucacaugagaugugaggcuguucaacuuugaucaucugauuucuuuuuagcacugugucugaaagugccuaugugccguuuuuggugagacauauguagcauggcuucuguaaaggcacguugcuuuuuauuauaguaauauugugggcacagaaagggugaggaguuagaugauugggagaguuuuuucuuacuuaaaacacuuguuucaucagaaaauauuuccuagcagaguuagacauagcuuuguucauaaaguccaguggugaagggacuucagacuuuacgauaaacuaaauuuuaugauugacuuuugugagcaauucacagcuauaaaacuacgagacuggcugggcaugguggcucacgccuauaaucccagcacuuugggaggcugaggcagguggaucgcuugagcucaagaguucaacaccagccugggcaacauggcaaaacaucgucucuacaaaaaaauuaucugggcaugguggcgcgugccuguagucccaguuacuuaggcugaggugggaggaucauuuugagcccaggagauugaggcugcagugaccugagauugugccacugcacuuuagccugggugacaaagugaaacccugccucaaaaaaaaaaaaaaauaccuacaagaacaucugggugauaacucacugcacacagacaugccuccuucaaaagauccaagcugaccacaaaaaaaaaggagaaacugucuuuucuugauaguaaauuggauggagacauuaguaagguagaaggugucugaggggcuucuucaugauaaaaagcaaaagguuuuggggugucacugacccaaaauauuagcagaaaucagauuuacucuauuauugaggaacacaauacauuaaauuguuuauagauccaguuucaagaaagaagauguuuauauuaaaaaaaugacaaaagcuccuucaauuuuuuugagaacuaagaaauaagagauuuuagcaguacugccaaaauagaauuuggauuugaauuuaagacacugguaaauguguguggaaggaucggucuuguuaauuacaccuuggaccaagggcugcuuggaaugaauaaaagagggggaaagguuuagacaaguagaaucucuagguugauaucaaguuaguauuuauaaucuuuguaaauaaaccaaaaccucucaaagacuccugcugucucuuccuggagagcacucugaauucuuuccuggcggucucccuuuuccuuccccucuccccagguuuaagaucauugggacauccuuuuggucaaggaaauguuucuaagagugaccuaguuauuggaauuuuaaguguuaaucaggucagugaggugccaucugugaaacacagcucaccaaaacccaauguuuuucaucagaaguugucauggaagugaguugauuuuggaaaaacaacaauaauagcaauuugcuugaucccuuucuuauccucaaauagccaaauuaaauucaagauuauuggccaggugcaguggcucacgccuguaaucccagcacuuugggaggccgaggcaggcggaucacgaggucaggauauugagaccauccuggcuaacauggugaaaccccgucucuacuaaaaaauacaaauaauuagccaggcgugguggugggugccuguagucccagcuacucaggagacugaggcaggagaauggcgugaacccgggaggcagagcuugcagugagcugagaucacggcacugcaucuccagccugggcagcagagcaagacuccgucucaaaaaaaaaaaaaaauucaagauuauuaucaguggaaaaaggaaaucugaaaaucucugaauguuuaguggucaauuaaaaugagucuuagggcaauuuaaaguuuagauaccugaaaccaguuggccuaugaucagaaccauggaugagaagucaaagucugugauucuguuucugaccccaugagaaggaaggccuucucuucagcuguagguuugauaauuaaacaagauaguggaugugaaaguaacuagucaacuacaagauagaggaaaggcauuuauugauguuuaaaaaagcuuucugauuuuacuuccuuucacugauaaguggccaagacuuagagaaugacuugccugcuggagguugccugauuugaaacugccagaaauuaaacucauaacugugucuuauaauuucaacauuugaaaaaaugucaggguuaauuuuuuugagacagagucuugcuccguugcucaggcuggagugaggggcacaaucuuggcucacugcaaccuuucgccucccggguucaagugauucuccugcuucauccuccccaguagcugggguuacaggcaugugccaccaugcccagcuaauuuuuguauuucuaguagagacaugguuucuccauguuguccaggcugaucucgaacuccugaccucaugggacuucagucuagcuccaaaucuagugcucuugcagucaauucauauuuucuucuguuacugaccauaugaaauaauuccucuaugaaauuuaugugcaauuuuuauaaaagucuaaauguauuuuauggcuaacccucaacuauggagcauauuaacauuaaaaugaguucuugaaauaagaguugauuaacaugggaaaauauccaucucuuucaucuugaacaaaguaguuuuguuuuaaaacuuauacuuccugcuaauguacaucuggaauguguaggauaaaagauuaaacuuucuaaauauuuuacaaaguuauauucucccuaugugauauauauuguucugugggagacuaagccuuaauugaaguauuucugcaagguuacuauaagcauuucucauaccacuaggacaauaaauaaugggagaacccaaaacauuguaauuuucuaguaauucagaggaaauaacugaauccugaaacauuguacaaaaggguacacaaugauacccauuuuugcauguuaauguauuauuaaauaucagugggaauagucugcaugcuauuucacaucucaggcacacuuaaggaagaccuugugaugugcauguugcucauuuaaucuagaaaggauaccaagauucauuuagaacuucuuuaugcacaguuuuuuuuugaguauguuauguccugaggcauuaaggguauuacuaaagcaagcagcgggacuucucagagaaauuaaagguuucauaucaaccacacguugucaaaaucuucacuuugaauaggauuaaaugauguuucaucaguauucuuggcacacaugacauuguuuuuaaaauaacaguuuuauuacucuuggcugugacaguuucucagacuuuccuuaauaucauacaauucuccaauuuaaacuguauagucaguuuuacaauauuuuaauuacccuguauucauuagcacuuuccucauuuucuacuaccuccuccccagcugccccuacccuaggcaaugccaaaucuacuuucugucuauauauuugccuauucuugaaauuucaaauaaauggaaucguauaauauguggccuuuugcgucuggcuuauuucacuuagcacaaugaugucaagguucauucauguuguagcacauaucaagacuucuuuucauaggugugcauaauaugccauuguguggacauaucacauuuuauguauucauccuucaguucauagacauugggguuguuucuucuuuugggcuauuaugaauauuguugcugugaacuuaugugcacugguuuauuaggggcauuuauuuucauuucucugggcauauaccuagaaguggaauugcugggucauaucacuuagcauuucgaggaacugccaaaccguuuucuggagcagcugcaccauuuuacauuccuaccggcaaugaauggaaguuccuguuuguccacauccucaccagcacuuuauuaucugucuuuuaaauuauggccguuuuaauacaugugaaguaaguaucacauuguagugacuuaaaaaaaaaccaauagacuuuaucuuuuagaacuguuucaaauuuacaaagaaaugaagcagaugaaacagugcucccauauacucccacacugacauacuguuacccuauuauuaacauauauauauauauuuuuugagacggagucucgcuuugucaccaggcuggagugcaguggugcgaucucggcucacugcaaccucugccuccuggguucaagcgauucuccugccucagccuccugaguggcugguacaggcaugugccaccacgcccagcuaauuuuuguauuuuuaguagagacggguuucaccauguuggcuaggaugaucuugaucucuggaccucaugauccacccgccucggccucccagagugcugggauuacaggcgugagccacugcucccggccguauuauuaacaucuuacauuaauuaguaugacauguuuguuauaauuaaugaacugaucuuguuauauuauuauuaacuaaaguccuuagcuuauucauauuuccuuuguuuuuagccaaaaucccuuuucuguuccaggaucccauccaggauaccacaugacauuuaguuacugugucuccuuaggcuccccuuggcugugacaguuucucagacuuuccuuguuuuuugaugaucuugagaguuuugaggaauagcaaucagguacauuguggaaugccucuauguuggaauuugucugaauuuuuuuuuuuuuaucauuagccuguggugacauugauuuuuaguauucagggcaacuugaucagaauuggaaaucagcagaaugugguuggugggaaauuauuuuaauuuauuuuuauuuuuaaaauuuauccuauuuuauuuauuuuuagagacagggucugccauguugcccaugcuggucucaaacuccugggcucaggcaguucuccugcuuuggccucccaaacugcugggauuauuauaggcaugagccacccacuaugccuggcugggaaacucuuaggaauuuuaaaaauucaguugccucuggaagaugagcagacauuuaacuuaagauauguuuuccuaacaagagcuugaucacauuggaagaugaucaaauucgguaguggaguuuaucuucaugacuguuaugagacagcaucuaaccuaaagguaaagccaaagauacauuuuucacugcuuuaagagaauguuguuuugcuuguaauaaaacauaaaguuaauagaaauucacauuaacuuuuagaauuccauaguacuauggcagcaagcauccaauguauauugaguacuuccaccuacaucaaucccaguaauucucaaaaugcuuugugaagggaguaggaacugaggcucaaagaggcugugucauuuggucugagacucacauagcuugucaguagaagagaugagauuugaacucagggcuguggaagccuauacucugcugccugccagacuccagaguuuccagugguuuuaaaucaugaauguaucaaaggacacaggcuugaguccuuaucuuacuggauauuuuuacugccagccaaaggagauaguaugucucuguguuuaaggccccacugaaauugguugguccgguuaacagcauaccuguugacugcuaacaaagggaaacuaagccagcuuugccuggggcacuaauuccugccacaugucuucugaaaaugcagccugagggucauaaagcaggcaaugagcuaugugggagaacaacauuagcugaguauguuugccagcaguuacauugcucaauguaugucuuaguuacuucucaaguuuuuucaauaagugagugucagagaggauuuaauuuuaaauauuuaucuuuaaauuggaguagaugugguaauacugugugaaugcacuugaaauggaauaauaaaguugcauagauaguugucugaggaagguuuggaaaauuucccugcuuauucagcuaauuuuuguaaacugcccaagaugauugaucacagauuaauacaaaguuucuuucuauacuaccaaaauaucagacuuuauguauuagucaggauagaguagucugugcugcaguaacaaauuaacugugacaucuccauuacugucuugcucauguaaaugucaguguuuauuggcuguucuccagggcagcucaccuauaugcaaugacucagaaauccaggcugcugugauuuuugugacuuugcuuuccuaacauggggcuuucaaguggucccaccagaggaaggggaacuggaugaucacguacagcucugaaaugcuuuggccuagagugacaaauaucacuuugacucacagccuguuggcuagaacuaagcucaucacccugcuuaauagcaagggccuagaaauaagagggagcacauagguauucagugaacaauaaaugucuuuugcaucccugguuuuagagcaacagaagcaguuaaaucguuugccaaagucucuucuguagagauagaaaaguggacugaauauuuagugauaauuacuugauaaaaaauuguaagugaauuuugccguaaacuauuaacauuugcaauaauuuauguauagcugauuuagcaaccugauuuccauuuguggauaugguuauaccuucuaaggguauaacaauaaaguuagcuucuuuuacauuauaauacuucagcugauggugcugaugaucaaagcuuguauguauguauguauuuauuuugagauggagucuugcucuuucgcgcaggcuggagugcaguggugccaucuugucucacugcaaucuccaccucccugguucaaacgauucuccugccucagccucgcgaguagcugggauuacaggcacaggccaccauacccagcuaauuuuuguauuuuuaguagagcugggguuucaccauguuggccaagcugaucucgaauuccugaccucaguugauccauccgccucggccucccacaaagcuuguauuuauuaaguaucuccuaugugccagguacucuaaguguuuuauaugaauuacguuaauuuagauugggcagugcaguuucaucucuaugguaaauauucuccaguuccaucaacuugccuuguuugaauggugccuagauuagacccaucaccgugcagauagcuccccucuagaaaccagauugucacuaaauuaccuuaaaaauaaugcuccguagguugaaugugacacuguggauauugucuaacuagcacagaguacaguaagaucuaacauuuacugugauucggaucauacuuaaauauagcagcuuaagacuuuguaaaccuuuuaagcagccauaucuaaaaauaagcuuaaggugaacuaagcccauaggauguuuuuuuaauauaauuuuuucccaaaugaauuuuccuguguuuuugugauucuaauauugucuuaaaauggauauauuugaugaauguagaauucucuuguuaguuuguccuuuugauguccccuuucccuacucucuucaguguggccucaaauuccaccauuagaaugauaggaugacaaagacucucgcugggccacacagacuggggcaguccucucuuacucaguuuucaaaaaggcucuugguuguuugagcacaacuaucuuuaccacauaugaggagccccaucucaggcuuuucauguugauuccacauucauucaucaaaaagcugaacacaauuuugggcccaggcacugagcuaggccucaucugucucuaccauuguagagcuaacagucuagaccagaaguuggcaaacuuuuucuguaaggggccaaguaauaaauauuuuaggcuuuguguuucauguggucucugucucugcuaccuaacucugcccuuguagcaugaaggcugcuauagacaauauguucacgaauaagcauagcugucuuccaauaaacuuuauuugugggcacugaaauguuaauuucuuguaauuuucccuugucacaaacuauuauucuuuugauuuuucucuuagcuguuuaagaauguaaaaacuguuuuuaguucacagguuauaugcaagcaggcaguggaccagauuuggccuucaggcugaguuugucaaccccuggucuagaaugagcucuguguuauuuuauucucacaaauacauagugaacugccuuaauaauuacuuaaauuggucaagcaugguggcucaugucuguaaucccaacacuuugagaggccgaggugggaggaucaucugaggccaagaauucaagaccagccugggcuacauagugagaucuugucucuacaaaaaauuuaaaaauuagccagauauuguggcaugugccuguagucuuagcuacucaggaggcugagacaggaaggccacuugagcccaggaguuugaggcugcaguuagccaugauuguaccacuguacugcaaccuuggcaacagagcaauaccuugucuccccaaaauuuuuuaaaaauaguacguauauaguauuauauauaguauguauguaguguuauauaguauguacauacuauauacauaagcgcacacacauauugcuuuugaggaccauugauuuuaugauaaucaugaaucaccaauauugaaaauaauaccuaauaucuauugggcauuuacuauuacauauauuaggccuuuuucuaagccuuuugcuauuuguuuuaauuaagccucccugaaacuguaugaaguugguauuauuaucuucuuaacuuuuuagcugugaaaccaagacucagaaagguuaaaugacuuguuuaaggugauauaguuaguagaagcagacauucucaagaauucuaacucuaaaaccagcgcucucaaugacauauuaugcuucucuagguacugaaauauaugugcaaaagucauuaggccauuuuuuuauuacgauguaagaaaauagaaguaaagauuaaaaaauuauuuuuccuaagaaacaaguacaucauugaaagaggaauuuagcaaauaagugcuuuaauaguucucacugguuuaacuuuaacuuguuucuguccaugagaaaagaugaucaacuccaacucuaacucaggauaaacagcaugcugggauguuucccuuuucugaacuuaauuaacacugauaaucggggcagggcuggauuuacaguguaaugauguguccagugccaaaauuguaauacagguacauuguauuuguauauaagguuuagagaaugcucuguuauaugugauaagugaugugaaagugcuuugugaccugcaaaucauauuccaaagggaucauuguucaucaucccgguggcucauuccacuguagauauagccuuaguccuaccuucauguuacuuuaguuggaucaguagaaaagguuagaucucaaguaaacacaacugaaagauuccuaguggacuauuuaaaauuucccuucaccagccaguugugguguugugcaccuauacuccuagcuacugaagaggcugaggugggaggaucaguuggagcccaggagcuggagucuagccuggucaauacagcaagacccugucucaaaaaaagaaaaaaaaaaucccuuauuuaacuuugagccuguuuuauauuuaauuuuuauuuuuuuuugagacagaguaucagucugucacccaggccggagugugguggcacaaucuuggcucacuccaacuucugccuccuggauguucuccugccucagccuccugaguagccgggauuacaggcauguaccaccacaccuaacuaauuuuuguauuuucaguagagaugggguuucacccauguugacaaggcuggucucgaacucccaaccucaggugaucugccugccuccgccucccaaagugcugggauuacaggcgugagccaccgugcccggccaauuuucagucuguuuuauguugaaccaggagaaaaggacuaaagaaucuauucucauccuggaaagucugagaagaaagagaaguaggaucagauacaguuuacuuucccauuuaaguucugggcuuagggcugggcgccgugguucacgccuguaaucccagcacuuugagaugccaaggagggcagaucacuuguggccaggaguugaagaccagccuggccaacgugguggaacccugccucuaccaaaaaaauacaaaaauuagccagcugugguggcucaagccuguaaccccagcuacucaggaggcugaggcaggaaaacuugaaccugggagguggagguugcagugaacugagaucaugccauuguacuccagccugggugacagagcaagacucugucucaaaagaaaaaaaaaguuuucaacuuaaaaaaagaaaagaaaaaagcuaaguucuggucuuagaaggaaagagguaugaaggagaaggaaggauuuugaaaagaaaauauuauuuaccuugaugcugacucacuaaucuaaucuugugggcaaagaccaagaauucaaaagauacccacacuugugccacccuggggugcgucucuugcuguaacacugaggucauaggauggcauaguaguaucuucaaccagcucauuguacaugcaaauaacagaugauucaagacaagaaaagaucuuuguacacuuuuauugcacugugauuguuuccuguuacauaaaaauucuccucuaagcuacucuguaguagagcuuauugcuaaaugaagaggacuaccaggugacagggucuuuccaaaaacaacauacuuuuauuugcuuuauguauaauuaaaaauuaguugcaccauaaaauucuauauuugguaccuucugauuauggaauugcuguccuguaacaauacaggauauggcuacuuuuucuuucauuaguccagaucuuuuaaggaacuagaaauguuaaaaagaggauugccuuuuuauuuugagucccuuuaccaucucucuccucacccucugugagucaggccacuuugggauuugcuauucguucaugaucuguacaauuacagcuucaugacugaagauggaagcaaccaccagcugaggaggaaaaagaauacauauguucuuucucucaacagcaccauaccauauaauuucagcucagggauagcucaggaaauuagcagcggcaggcaguagagcuuacacuuaacuaccaaggauagaaggauguguagaaggggguggucauucagguaugcucuguggaagaaggcagugaaagaaugaggauggcagggaaucacaaggccugugccagacuucaagguucacauguuaucuagaggguacagcaacccuggcuuagcccaguguuaccauacaggaaugugggugcaguauugccagacauucugauuuuaaaugaaaaaacagaaaucugaauuuuaugcuaaucuccuaauuuuuauauauuugcuccaaaauuaaaaaaagaauccaacacucaaugagccacagaggacauguguccaggcaguguuuggcccaugggugccauuuugucccuuuggcagccaggagaggcucuuaguuuggugaaggaggaguuauaagagccugugaugggugcuucaggaguauggcggcuauagagugugagaccuggccugggcuccaucugcugcuuucuuuuucuguuuuauggaggaggguguguuuuaauucugcuuaaggaaaaucuuucgcucucuagauuuccuuccuggagaaagaggggcuggaaguguugaaugcuguuggggacuucaacagcuggguggggcugggcaguggugaggcaagccuggcuauacuacgggucucaaggcagggugucauuugaaaauugagacagagaagcauccaucugcaggaucuggguagggugggcagaacacggaacagaaacagagcuuccagacccaaggauggaaaaggaggguagaguggggguaguuaagaggugcccaaggcacugaagaauagccccaggucuuggcuuaguugugggugggaaggaagcuguugaggcagccaacauggucuggacaauuguugaugauugacccagagaagugauguaggcugaauuucuugaagaccguauaucuucucuccauuuacauuacuuuggugguaaaagcauguuccacaggagcaagaacauuauucaguguauacagaugauaucaucuggcuucagcauuauggcugagacaaggcagggugacugugcuuccagagugaggucacagacuuuggaauuccuaguuauauucccgaucauuccacaaucaugaucaugauggaugcucuugaggggccuguuaauucagacucuucuuccuuuuauuuuuugaaccaacugagaaauagauacaggucucucaaauggaguuugaaaugucaacuuuauucuugguggagguggaccaggauugcagccugggcccguguccaaauggccuuccuaauauccuucuucccaggagcuuaaugucuacucaccacaucccagggaaaccuagugaacaauugccucugggucuguuaucaugugaaggaagaggagagcuuguguccugagggcaagcagauguugaagagggaaggggcaaaccauguaaggacagugauguuuaacacuuuaccccaccccacucuguaaaaaccacuuuagcuccauugaguauagcagugguuuuucaaaagugugguccccagacaagcagcauuagcauuauguugaagcuuacuagacaugcagacuuuucgucuccauuccagacaaacugaaucaaagauuguggaggauggacccaggagacuauguuuuaacaagcccguuuggugauucuauugcauuuaaagucugagaacuauugcaguagaggaaugagggucagugggcccaagacacuuacugucucuccagugagguaaaucauuucccauuuuauggaggagagugagaaagaagugcaaagaggccaaagcuucugcuuugacaauagguccucauggaaacauaaagauaaagguuucccucaacagauaauccugcccuguagucuggaagaugauaguuugaggaaaaaaugcaagagcaaacaugaagacuuucuucagaugcuccuuuucucauuuguuaauguuuucuaccuuuucuauaaaggauaagguagagaaaaaagaaugauggaggaaggcacacuagcaggaagagaaagaacacuaaaugauauagaaaauaauagguauuguauuucuuccuuuacaauuaaucacuuauuuuacuauauuauugauuagauuuuuagucucugauuuguuuuucuaguugugaccccaacaacaggccauuugacugugaucaugucagcauggacugcaguacuauuugcuuuuuguaucuauucauuuucauguugaauuguguguguuguuuagugacacaauuauuauuauuauuauuauugauggagucucacucggccacccaggcugaaguacaguggcacgaucucagcucacugcaaccacugucucccggguucuagcgauucuccugucucagccucccaaguagcugggauuacaggcacccgccgucaugccuggccaauuuuuauauuuuaguagagaugggguuucaccauguuggccaggcuguucuugaacuccugaccucaggugauccaucagcccaggccucccaaggugcuaggauuacaggugugagccaccgcacccggccagugacacaauuauuuauguccuucauauucaucuggaguucagauuauucaaauugcuuuguaaccuugaguaggucauuuaauugcaguuucaacagucuucaaaucacaauggaccauugcccaguuagccacuaaaauagccagugauggcagaugcuugucacaauaauccauauaguuggcauuucauauuuuaagguuaaaaaagggauacauuucuaaaauguugugauuaggaagauuuuuuuuuuuuuuugcuuuagccaaccuuuuuagagguuuggaauaaaauuaugcccccuuggguacauacagccuuaacuagacauggaugccagccucuuguaaacacgcucaaguccuugcaguccagaauggaagcuuguuuccauuaaauguuuagucuuuccagauacuguuacaggaauaaaaaaugcuaaagaauucaagcugccucugauuucaucugaaaauggaauuauggugauagugaucaucauaguaacugaauaguuacuguguugcaagaacugugcuuaaucugcacuuggggccuugaucagcauagcagaggucucagguaguuggugggagaaauggggagugcuucagcuguauuaaucguuuguucaaggaaaaaauucagaaauccuuauuuuagaucucauucagauuccuaggccccauccuaaaacuucugaaugagacucuuuggguugagacccaggaaucugcauucaaaauaagauccacauguugauuuuaugauuaaugaaaaacuacuacaccuggccgggcauaauggcucaguccuauaauccuagcacuuugggaggcugaggcagguggaucacuugaggucgggaguuuaagacaagccgauucaauauggugaaaccccaucucuacuaaaaauacaaaaauuagcccggcuugguggcaugugucuguaaucccagcuacucaggaagcugaggcaggagaauagcuugaacccaggaggcagacguugcagugagcugagaucgugccacugcacuccagccugggcaacagagcgagacucugucucaaaaaagaaaagacaacuacugcaccuaauugcuaggcaucauuucaugucuauuucaguaaucucuggggcccagucucucaggaaggguuaagacaaagguaucccugcucaucauuauuggcagaaucuucaguauuuuuauuuuuguaguguuuuucuuuuuaagcuccuacacuaaauauuugacuaacaucuaauauguauauguuauuggagggaaaauuuauuuaaggagaacuguaaaaucaacauugaucucuccccucaaacaaacucugccuaccccccacccugcugcaucucccaagugauagcuguucucucguggacaauccaaggccaaggugauaagaacaucccauucugaauaaaacuaucugagccuguauuagcuuucuguugcucccauaacaaaccaccacaaguuuagcaacuuaaacaauacaaauuuauuaucuuacaguucuguaggucagaaguuugauacaggucuugccaggcuaaagucaacacagcaggacugcguuccuuucuggaggcucuaggggagaaucguuuucauggcucauuuggguugcuggcagaauucgguuucuuuugaugguagaccugagaucucuguuuucuucuuggauguaaauggaaggccauccccagcuucuagaggccaccugcauuccuuggcucaugguuccuuuccuucaucuucauagccagcgacagucgguaaagccccucucauacuuugaaucuuuccuccuccuccuucuguuucaucucucugagccagcagagaaagguucucugcuuuuaaagacucaugugauuagauugguccugcccaaauaaccuaagacaaucugccucaucucaaggcccauacccuuaaugaacaucugcaaaaaucuguuuugccauguaagguaccauaccauauucacagguucuggggauuaggaugcagacaucuuugggggacaggguauuauccugccugccacagauguguugucugccucuguugacaaauaagauagcggugguuaucgcuaccagcagggcuccaagcauucauguugauguacaugagaaaaugugacuuaacuggauaucuuucuaaauagaaaacauuucagggccagauuacaaaacaaauaguuuugaaaaggauguuucagggcuuuuguguagucaagcagagcugccacaacauuuaucucugugaguaggaaaggaaggcaauucacauuaagccugcuucucugguagcuuggauucagaaaaaaauucugauaugagagaggcacacccauucagccagaauauuugcuuuuugugacucauugccugccauaugcuccccugcuuccgcaccuuuguucaugcacuuccagcugcuuggugugcccuuaugucuaccaauuuaucuaugauacauauuuaugacaaguuuugacaccuacuuauucuaggaaacauuuuccaagaugcuaaaaguauggcuucuacucauuuuucccaaaaacugaaguaaaaugcuaaaaagaauccaugucaucugccagauuuccaaaggcuguuuuugaguucuucucuaagauguuuuccuccauaaauguguacagcauuaaagaagccccugcagcaucuuggagauaguaaguacuuuguaacuacuuagugauuugaaguacuaaaucuaaguaauugauuguauuaucuuuauaccaaaagucugcaagauguguguauguauuguguccuuagaauauucuaaacaaaagaacauugcuaauaaugucucauauaagcaaguaaaacugggauuuuuagaggugagguuuccaauucaucuuuuucuaaauauguuaauucauauucugucagauuacucagagguauaaugggcaagggaguggacuuuuuucuucuauuuuuuaaugugauguauauaugcagaaaaacauaaaaauuauguauauagcuugaugaauuuucacaaauggcuacucccacaaucagcacccuaucgagaaaccagaauuacuccuggcugcccagaaacucucugguugcuuuccaguugcugucauucucaggggucaucacuacccugaugcuucagaaguuugagaaguagacuuuuuuuuuuuuuucuuuuugaggcagagucuugcucugucacccaggcugaagugcaguggcacgaucucggcucacugcaaucuccgccucccagguucaagugauucuucugccucagccuuccaaguagcugggauuacaggcaccugccaccaugccuggcuaauuuuuuuguauuuguaguacagacgggguuucaccauguuggccaggcuggucucaaacuccugaccucagguuauccacccgucucagccucccaaaguguugggguuacaggcgugagccaccgugccaagccugagaaguagacuguuuuuaagaugcagaaagauauucucacagaugauaugacaaucuuagaaacaaaucucuaagcaaauguuuauggguuuauagagauuuuuuuaaaaacgugacucuugccccgaaggugcauuuaaacauggaauaguaaauucuuuucuaaauguucuugcuuuaucaaauaguuugaguuacagauacaacuuugauucaguuuauuauuuucuaguauuuauugaguacuugugaugguucaaaauacuuacgccucaaauauucauaggcuguuaaaacugcaccauacaggccaugugcaguggcucaugccuguaaucacagcacuuugggaggccaaggcgggcagaucacuugaggucaggaguucaagaccagcuggccaacauagugaaaaucugucucuucuaaaaauacaaaaauuagcugggcgcgguggcaggugccuguaaucacagcuacuagagaggcugaggcagaagaaugcuuguacuugggaggggcagauguugcagugagcugagauugcaccccugcacuccagccugggugacagagugagacucugucucaaaaaaauaaaauaaaauaaaagagcaaacaagaacugcaccauacacuuggcccugaucaguggcuuggcaccauaucuuuuucuacauaguuguuacugagaucaaauuaaaaauuuuuucaguauuuuuuuccuggaauuuugguuuaggcucauaguagauacuaaagaagaauauauugucagcaaaagugacagucuccauacuguacauuuuaacugucuacugugacauuucccaacaaaguggaaauugaaauuacuuguaacagaauggaauggguaaacucuuagagcaauuggauucacggcuauaaugucccucauaauaccacagaggguaauguccccaucuacccucuguguucaaggauguuugcugaagcauuauuucuaaaaguaaaacauaggaaaccaccuuaguuagcaauaugaaugcuuaaauaaaucaugguauagucauacauggacuauuaugaagcaugaaaggcauacuuucaaaaacugaaaacuuuaaauaauauuaaguaaaacuauauauagcaaauaucaauuuuguuuggaaaauuguauauucauacacaugugcauagaagaaagauugaaaauuuauaacauuuuggccuugguuauuucugaauggugugcuugagagcaauuuagauuuuauuauuuuccaaauacuuuuaaugcugcauauugcuuuucaacaaucagaaaauaaccacacaggauccauuuuuuaaaaggacacauagggcagauaauugguuuuuccugugaagugaaguccugggggaaaucagagcaaauauauguuuuagucaagagguuagcagaacuccaugcaacagcagcaggacuacagccauccguaaguggucuccuugaaauaauggaauuuucaaugcaaaaaacauuaaugccaccgcauccaacuuucuauguaggaauucccaaagacaacagccugugugccuccaaaauugacucugagcuuuuggacacacagguccaguguuccagguguagaaccucacuguugcaguccggguugucucuggaccacguggacagaauauuuccuuacauucgugcagaauuugucuccugguauuucuucugccagugguccuaauucuaccagcuuguggccauaaagagcaagaauaagccuucuucaauacagauguccuuuaaaauauuuaaaugugaguguguauuuuuaacauucauugagguauaauuuagauaugcuagacuguacccauuuaaaguggacagccggcaguguuuugacagguauauacauccacaaaaucaccaccacaaucaagacguagaacacuuuuuuccuccaaagccuccucauguauuuugcuuuccaucccuccuuucacccuguuccaagcaaccuuuguucugcugucacuauagguuaguuuuuauuuucuagaauuuccauaaaugggaucauacaguacuguauguacuuaaaaaaaaaacuggcuuauaaaaguccuuaacuuuuucuuucacuuuaugaagcaguuuuauaacaucuauucuuuaccuuuauggagccaucauaaaagauguuuuagacuuucccuucagauaauuaaccagacagugaaaaugcauuauacauuuuauaagugaaacuguucuugccucacuuaaaugguaguauuggacuauaacccguggggcaucuucugguuuuaacgcuguauaauacuauaacauguuuucaguuacuauucaaagauaauuuuggauauuugcuugaaauuaguccagugacucuaauugaaauucaguaagauguuaggguuuguuuguuuguuuuugguuuuacaauuuccuaauuauuucugggaauuaauucuucaugauuuuuuacaugaugaaaacaauauugccguuuucuuuucuuuuuuaagagauagggucuugcuguauugcccagacuggagugcaguggcuauucacaggaguuaucauagcacgcuacagccuuguacuccugggcucaggugguccuccugccucagccuuccaaguagcugagauuauaagcacauaccacugugcccagcucaacauugccauuuuaaaauuaaaguggcaaaggaacauuuaugaaaagaauauggaagcucauaggguagucccauuccauaggaagaaaaccugcuuggguaaaaucuaagggguaaggugaauaccacaauguauuuuaagcuccccagcuauaaucaaauagaaugaugaugacauccacauuuuugccucuugauuuuuuuaugguucugaaccacacccauguugcagauuggccuuucuacugagaguaaguuccaucaagauuaauaucuguaguaauaggcagaacacuucaguguggaauugcuucuuuucuuuggucaaacacuaacuuuggcagaggauagacacagcuuaggaagacugaauuuuaagucuucugaauuguuuuucuggacuuccaaaucucaagugauaagaccagcagaagcagguauacaaaaauuuaucucugucaauagcaguaagacagccucggauuccaggcugcuuuuucauauaauuguuaaauugagauaaacacccucauaguauuucuuuuuuaaaugcauucuugcuuugggacucuagauggcuuugcauaaucaauguaaauaggaaccuuggugugaagauaauauaauucuuaauuaucucuucauuuuucuguuugaaaacuuucuucuguaagcaccacugguuagagaagaaaggacuguuuugguuuauucaggguuggauaaaaauauuagacucauaauucuugauugggcuuugauuuuccuuucagaaauggauauaaauuauuaggaaaaugcugaagugacugaaugcacucuuucugugccaucuagaauguguguguauuauugcuuggaaacuugaugcuuucagucugauggaaacagcucuuccagucuauaguuuaauuguggauaagcaaaacucugcuuuuuuucuagagaaauuucacagauaagacauaguaauacagaauaucuccaguacuaggaauguguaagauucuguuuaagcaucuggagucugaagaaaauaucuaaauggaaauaaauucuuuaucauuauauuuguucuucagcauuuccaaguaccaaaauguacuuggggauagcagcuuugcuuaaaagcuuuucacuguuucauugaauuugggaagggccugaaagcuuucagaaagauaauuuucuuauaaauaguguacaagugagcaaguugcucuuuagugagcauuuuuaaugguuucugaggcuggccaaaaaacucuauaucuuuacccuaugcagcccuagaagcuguagcagccuuaccuuaaguucuuuucuuaguaaagcagaaaaugagcaguucccacccuguguaaagcugagaagaucuugaaugaugcauguugaggaaacuuggauacugauacugcuggcaguuuacauagaccccagugccaaagaauuaaagagucuugaguuuucuuaaaagaggccagcuuuuaaaaaguuaaguauguuuucuuuuugcagugaccugagcucuuaaaccuaaguagagaauuaagacuugcucagcuuugugaagcagucaacuuacuuguacgcaccauagaauacucuuguuagagaagugaacacauuaugaccaauuaaccauggaaagugagugcccugggaaaauuuuacauaguuaaaacaaaacacauagcuuucuuaggaacuggaauugccuuuccucuauuauaccuggaguccaacaaaggcuaugccuuugugccaguccuuuuacaaugaaucaaccaauugcucaauuguauucuuguggaggaggaggauaacauucuuuuaugaucccaguuuagaucaguuuaccacccaaagcaugauauuugauuacccuuauuagguuucuuugcauagcuacaaauguuacuaaugguuuggccuugucuagccauuaaaaaaaagucugccucugugaugacuuaacagucagugcuguaaaaggcacuauugcuuggaacucuggaaauacgagcucaaagagaauagagcaguacuuugggguuagggauaaacugcagaaacaaaccucuuaaacucccgaauaugucacugagugccugacugccuauuuuuucuucuaagugcugauuuuaaggcacucccugggucugggccucaauugcuuuaagaauuauaaaaguuuagcuaccauuucugacuauguucuucuauuagaauugagguuucuaggguucccucuuucucuuuccuuccaaauguuuccaacucaguucucgguauuacaggaaaaacaaggugcugucagaagccgcuaaauucuuaucccuauaccugcuccagcugaggugggaggucgagaugcuucuccuuuucaaauguuggagcggugguccccaggcuccugaaauuuuuagcucaucaguaacaacauguugugcacauacuacuugcaaggucuauauuuuuaauuuuuauauacuaaauguauauguuauacauguucuacuuaauguguagguuauauauacuaggguauauaugaaaauaaaugcugcuggauaugguggcucauuccuauaaucccagcacuuugggagcugaggcggguggauugcuugagcccaggaguucaaaaccauccugggcaacauggcaaaaccccgucucuacugaaaauacaaaaauuagcuggguguuguggcauacgccuguagucccagcuacuugggaggcugaggcaggaggauugauugagcccaggaguucgaggcagcagugugcuguaauugugccacugcacuccagccuggaugacagaacaagacccugucucaaaaaaugaaugaaugaaugaauaaaugaauucaugcaugcaugcuacucaggaggcugugucuugcuauguugcccaggcugggauuacaggcaugagccacuaaaacuaaacuuaagaggauaagaaggggagcucauagagauugugguggaccccuuuugcuaggaacugcuacuuccucccaaguagagcacagacagaucaggaguaaauaaggcaugggacauaguuuuagcaacaagaagagugaggacgauggaaaaucaggaagcgagcaucuuagcaaacacaauauguuaauaagcaaugagacauggauuuguuagggaggauggaggggcaggagucuagagcaaacucccucgcugcugcuguuugagugcugucuacaucacuaacauugugcugggugcuuuuuguacauuaucauuucauccuggcagccaaacauaaagugggguuuaagaugagaagacuaaggcagacaggaguuaaaugaaaaaaagauaaaauaagacgauuuuuuaaaucuauuguuaacuggaaagacuuuaucauaucauuaacuaauaucucauaguacaauauguaugcaagauacuguuuauuauuaaugagugaguauaaaguuguauuuuauauaaucucgauaauugugacuuuuuugcccaacaugugaucacacugcuccucuuuuguuuucugauguagcugguaaagacuccuacuaagauuagagguguguguucuacuguuuucuuaugcuuauaugauuuguauuuuuuacagucuccaauugcuuugaagacauauuuuuaaagcuacuugcuuauuuagugaguguagcuuugguaucaacuggguuauauaaucuguuaauccacucaaccaggcauguacaaacuguagaacaucacaaaugcuggaagugaaaaaaggaaugacagucacuguccaggcucuucuuuguagaacgucuacuccucucuugugauaucccuugaacuguuugugucaugggaucuugucauaaggaccaaguuaggauucuacugaaaauauacacauuaaauauuuguaaagcuaauuuuguuuccuuuuaguuuuaaaaauaaacauaguucuaauauuuacuuccuacacucugguagagaucauuguuuuuggugacucuugucuucugaguagacaagggugugaccucaguuuucuuaucuguuaaacagggaguuggacuagaugacuuuuuagguguuugggaaggggauuuuuuuuuuaaccacauuuaguuuuguaccuacuuuuuuguacugacauaugccuguuaacucauccuucuaaguaauacucacugguuggaaguuucuguaaggaauaauguucagaaauaggagugacauauuaagguuugcuuuuuaagucaagauuuuggaaauaucuguuacauccaaaauggaacuugaaaagcuuucuuacucuucaaggcccauccaguuuaaacucuacccucucaggaaaauuuuugucagacccauguuugaaguaucugcuaucuguuuuuuuucuucuauagaauucuacuucuacauuaaucaguagacuugaauuaugguuauauguguacauguuugcuuuuuaugaggcacagcuguuuauuguuuguuuugcuuuugagacagugucucgcucugucacccaggcuggagugcaguguugcuaucagggcucacugcagccucgaccucccaggcucaagagauccuccugaggagcugggaacacaggcauguaccaccauguccaguuauuuuuuuucagacuuuuuuuuuuuuuuaauagagacagagucucccuguguugcccaggcuggucuugaacuccuggccucaagcaauccaccugccuuggccucccaaagugcugcaauuacagguaugagccaccaugcugggccaaucauauuuuaauuuuuagaaaaaaaugaggauuuggaguuguuagaauugagaaacuaaaaagaaccauguacagaaagaauuguuuuguaaaccucuauacugagucaucuaauuucaaugucuacauaaaagaagcucagagcucuuucuugaauaucauguagaaagaugauaccuugguucccuugagaaccugauucaugacaucauugcuuuuggccauucaggagucaguucgguuuuuugaaaggaacauggaacugggacucgggcacacugaaaauacuaccagcuuugacacuuacuaguggaugaucuaggcuguuuagcuugaucucucugaaucuguuuccuuauauguggaaaugggaauaaagaugggucccagaauauagugugugugugugcgcgcacaugugcaugcagugugcaugugugcgcgcacaugugcaugcagugugcaugugugcaugcauauguguauguguauaaauuuauguaguguaauaauauuauuuuuauucucauuuuacauauuaggaaacagcuaauaauucuauaauauguaauauucaguccuguuccuuagcucacugggcugaugugaaagucagaugugauaauacaucugaaagugcuuuauaaauuagaaaacacuuaaaugugaaauguaauuuaccuugauaauggcaccuguuacuuauaauaucaugguggucuuccuuagucuuugguuuuaggccaccaugaagaaucacuuucaaacuuauuucuuucuuucacaacauuugucauuguuauuagcugagaaugaaaucucuagugaauuuguccugagacauucauacuaccuuaugacuuaaugaaaaaacccaucacuuugaaacagacaaacaaaaaacacugggucagccaauuaaugcuauuuuaaguaaugaaguuaacugaaguaaaauauucuaagguuucaaaagcuguauagagucagauuaacucuguaagcagaaugacgaaauucucuuauggcagguccagaggggaagcuuccuggacccagccuuagauugaauagugaucauguggacuuguuccucacacuuguuucaaguuuguuucaauaugacuguaguuguuuugauacuaauaugugccuacuagcugagugcuacugggcaaguuaguuaaccuuagugagcuugauuuuauaaguaaaaauagagauaacaacugcuacuuuugguggcuguuuuaaggauuggaaauaauuuuuuuuuuuuuuugagacauagucucacucugucacccaggcuggagugcaauggcgcgaucuuggcuuacugcaacuucugccuccuagguucaagcaagucuucugccucagccuccuaagccugaguagcugggauuacaggugcacaccaccaugcccggcuaauuuuuguauuuuuaguagagacgggguuucaccauguuggccaggcuggucucgaacuccugaccucaugauccacccgccucggccucccaaagugcuggguuuacaggcgugagccacugugccuggccggauuagaaauaauuuauauaaaguuccuggcacauauucaucagaauucugauuagcacacauggguaugaggaaacuaacuggagaccugggaaagaacugucgggaaggauuagaaggaauagugcuuagcacucacacagaccaggaacagugccaguucuuaccagccacacgguaaaaaaccauguaguaauguacagcuuauuggguacucagaggccucuugccucaauaauggggaauaauuagcccacagacagugugguuucucaaccucagcacuauaggaauguuagacuugauaauucuuuguuuuaaggggaucuccuguguauuauaugauguuuagcaacgucccuggccucaacacacuagaugccagugaugccuccuuuugugaaaguaaaaaaugucuccagacauugccagauguccucuggggaucauagucaucuccuguugagaaucagagcccuaaacucacuucugugcugguccugccuaaugaagcuuaaaagcaagaccuaagggucaaacucuuuccaaguaauuuaacugcauccaagaauaaagaucaagaaugguuauaggguuuccccccaccuacagaaacagaaaaaaaaauuuaaaauuuuggccuggcaagguggcucacaccuguaaucccagcacuuugggaggccgaggcagguagaucacuugaggccaggauuuugagaccauccuggucucauggugaaaccccaucucuacuaaaaagacaaaaacuaucggggcgugguggcaggugccuguaauaccagcugcucagggggcugaggcgggaggauugcuugagcccaggagguggagguuguaguaagcugagauugcaccagugcacuccagccugggcaacacagugagacccugccucaaaaaaaaaaaaaaaaaaaacaaacaaaacacucugaaauauaaaauccuggcugggugcaguggcucaugccuguaaucccagcacuuugggaggccgaggugggcagaucaugaugucaggaguucgagaccagccuggccaacauggugaaacuccaucucuacuaaaauuacaaaaauuagccggucaugguggugagugucuguaaucccagcuacucaggaggcugaggugggagaauugcuugaaaccagaagguggagguugcagugagccaagaucaugccacugcucuccagucugggcaacaacagcaaaacucugucucaaaaaagaaaaaaaagaaaaucucaagcaaccuugaauauccaaagcaaucuugaaaaaaauagagaguguacaguuccugcuuucaaaauauacuacaaagcagcagucugauaucaagaugguauaguacuggcauaaagacauauauauagaccaauggaacagaauagagagcauguaaauaaacacacacacacacacacacacacacacacacacauagagggagagucaaaugauuuuugacaagggucccaagacuuauacgauggggcagagacagucuguucaacagaugguguuggaaaauuggauauccauaugcaaaagaaugaaauugagacugggcaugguggcucaugucuguaaucccaacacuuugggaagccgaggcagguggaucaccugagcucaguaguuugagaccagccuuagcaacauggcaaaauccugucucuauaaaaaauacaaaaaaaaaaggccagcaugguggcucacgccuguaaucccagcacuuugggaggccacggugggcggaucacuggaggucaggaguuggagaucagucuggccaacauggugaaaccccguuucuacuaaaaauacaaaaauuagccagcuacuugggaggcugagguaggaaaaucguuugaaccugggagguggagguugcagugagccaagaucaugccacugcacuccagccugggugacagagugagacuccaucucaaaaaaacaaaaacaaccaaaaaucccaaagcuggcgugguggugugugccuguggucccagcuacucgggagacugagguggaagaauuacuugagccugggaggucgagggugcagugcgccaagaucaugccacugcaguccagccuagacaacagaguugagacccugucucuagaaaaaaaaaaaaaaaaaaaaaaaaaagaaguugaaccuuauaccauaugcaaaaauuaacucaaaaugaauuaaagaccuaaauguaaaaccugaaacucuuagaagaaaacauugggugaaagcuucaggacacugaauuuggcaaugauuucuuggauauggcaucaaaaacacaagcaacaaaagcacauauagacacaugggacuucaucaaaccaaaaaacuucugcacaucaaaggaaauaaucgguagagugaaaaggcaaccuuagguguggaagaagauauuaguaaaucauaugacugauaagaggauaauauccagaauauauaaagaagaucuguaauucaguaacuaaaaacaaccuaauuaaaaagugggcaaaagauuggaguagaugacauuccaaagaugacauacaaaugguccauaagcauauaaaaagauguucaauaucacuacaaaugguccuugacuuacagugguucgacuuacaauuuuuuaacuuuaugauaaugcaaaaauuauacacauucaguacacuccuccacuuaugaugggguuauauacaaauaaccccaucacaauuugaaguaagucaaaagcgaguuuucuaugcacuuucaucaucaggauauaacaugacuguaaguugaagaacaucuguauucauaagagaaaacaaauaugcaucaaaaucauaaugacauaucaccuuaugcccauuaggaugaccaacagcaaacaaauagaaaauuuaaaaaguguugcugaggggaugcagagugauuggaccccuuuugagaauguaaaauagugcagccauuauagaaagcaguauggagggcccucaaaaaauuaaaaauagaauuaacauaugauccagcaauuccaccucuagguauauauuugaaaaaauuuagagcaggauuuuuuuuuuuuuuccccugagacggggucuuguucugucacccaggcuggagugcuguggcaugaucccaacucaauauaacaucuaccuccuggguuccagcgauucuccugucuuggcuuccugaguagcuuggauuacagguacaugccaccauacccggcuaauuuuuauauuuuuaguagaaaugggguuuuaccauguuggccgggcuggucucaaacuccugaccucaggugauccacuugccuuggccuuccaaagugcugggauuacaggcaugagccaccgugcccagccuagagcaggaucuuaaacagauauuugcauauccauguucauugcaucauuagucacaacaguaagacguggaagcaaacuacauguccacuugcaagugacuauaugaaggaaaugugguauagaaauacaauggaauaucaggcagccuuuaaaagaaggaaaucuugucauaugcuacaacauggacgaaccucaaggacguuuuacuaagcaaaauaaaccagugacaaaaguacaaagacuguaugauuccacucaugugaaccauguagaguagucgaaaucacagaaacaaauuagaagggauugccagaggcugggagaggagagaggggaaauuaguguuuaauggguauagaguuucagauuggcaagaugacaaaguuauagagaacuguugcaugacaaugcaauauaaucaacacuacugaaauguauacuuaaaaaugguuaagaaggcugggagcaguaguucacaccuguaaucuaguuucacaacuguaaagcacuuugggaggccgagacagauggaucaccugaggucaggaguucgagaucagccuggccaauauggugaaacucugucucuacuaaaaauacaaaaauuagcugggagugguggcaggcaccuguaaucccagcuacucggggggcugaggcaagagaaucacuugaaccugggagguggagguugcagugagcugagauugcgccauugcacuccagccugggcgagaagagcgaaacuccaucucaaacaaacaaacaaaacaaaacaaaacaaaaaacaugguuaagaugguaaauuuaauguuauguguuuuuuaccacaauaaaaaaaguuauaggaauauaaaacuguuacccaacaaaguaaacuuuacagugucuuucauccaguaaaaaauuaccaggcaugcaaugaagcaggaaaauauuacccauaacuagaagagaaaaucugucaaucaaaacugacccagaacuaacacaguuauuagacuuuucagacaauggcauuaaaauguaauuagagccauauuacauaugcuuaagagaguuaaguggagacauagaaaauauuuuaagagaccgaauucaaacgucuagagauaaaaccuacagcacuugagaugaaaauacaauggacaggauuaagggcagauuagacauugcagaagaaaagauuagagaccucggagacauaacaauggaagcugucuaaaaugcagcaaaaaggaaagaacuacaaaaauacuuaaaauagcaguaauuugcaugauaacuuuaaguggucuaauauuuguguacuuauguucccugaaggaggagggaggaacagaagaaauauuugaagagaucauggcugaaaaaauuuuccaaauuugaugaaaccuauaaacccaaagauccaagaugcucagugaaccccaaacaaaagcuauaugaggaaaacuacaucaaagcauaauuguuuuguuuaaauccacugauaaggauaaaauucuaaaagaacccaaagaaaaaauacacauuacauaggaagaaagguaaaaaugauguagaugucuuuugcuuguauucaauugaagucuucaacuguacuuguggauuugucuauuucucacugcagugcuguugaguuuugcccgcgaugguguaguauagauaagauaguggaggaacauuauuaagguaguaaaagaaaaacagucaaccuagaauucuacacccaacaaaaauauacuucaaaaaaaaagaugaaauuaaggacuuuuuagacaugugaaaacugaaagaacucaccagcagccuugccugacaaauguuaaacgaaguccucaaggcagaaggaaauacaggucuguacaaagaagagcaucagaaauggugcuacaugaguaaacagauaagauuucuuauuguuuaagucauuuuaaaagccaguuguuuuaaauaaaaauaauaaaacauaugggguuugagcggaaaaauggaagcauaccauuguaacuuuuuuuuuuuuuuugucuuuuagagacaguuucucacucugucacccaggcuggagugcaguggugcaaucauggcucacuguagccucugaacuccugggcucaugugauccucccaaccuuagccucccaaguagcuggaacuucaggcacauaccaccacacuguaauauucuuaugcuauauuugaaauuguguaauagugcuugaagauaagcuguaguaaguuaaaaauguguaugcuauaaauccuaaagcaaucgcuaaaaaugacagagaauuauaacaagagaagaaaggagauaaaauggaauuauaaaucauauuuggguaauccaaaagaagaaaaaagaggaaaaaagaaaacaaagaacaaaugggacaaauagaaaacaaauagcaggagaaaaaacuuaaccuuaucgauaaucacauuaaagauuaauugucuacauaucucaauuaaaaaguagagauucacuggcuaacauggugaagucuugucucuacuaaaaauacaaaaaaaaaaaaaaaaaauuagcugggcauggugacgcgagucugcagucccagcuacucaggaggcugaggcagaagaauugcuugaaccugggaggcgaagguugcagugagcugaguucgugccacuacacgccagccugagugagugacagagugagacuuugucucaaaaaaaauguuugaauagagauauaacauggugaugaacucucaguauuguucagacaucaguuccccaaaaucaauccuuagguuuacuggaauuccaggcuaaaucacagaaggcuauuuuaguagaaauggacacccugauucuaaaauucauauggaaaugugaaugaccuagaauggcccaaacuauuuuggacaaaaauaacagaacuggagaacuagugcuaccugauuucuagagcuuuuuguuuguuugugugugugcguguguuuuguuuguuucuuuguuuguuuuuaagagacaggguuuuguucuggugcccaggcuaaagugcaguggcaucaucauagcucacugcagccuugaccuccugggcucaagagagccuuucaccucagccuuucaaguagcuaggguaacaagagcaugccaucacaccugcuaauuuuuuuuuuuuuccuguggcaauaggguucucacuguguugcccaaguuggucccaaacuccuggccucaagcuguccucccacuucagcuacccaaaguguugugacuguaggugugagccaccacacccagccccucuagacauuuuauaaaguuacaguaauuaacaguguuguauuugcauaaagauagacaugugaauggaauagaauagaaaguccauaaauaggcucacacauauggacaacugaauuucaacaaagaugcaaaugcaauucaguggagaaacaauaauugcccacaaauggugcuggaaaaauuggauacccagaugcaaaaaaaagaacauugauucauaccuuguauuauaaacaaacccaaaauagauuguagaccugaauaucacucccagaaaauacaaaacuucugaaagaaaaaauacugugaccuuggguuugguaaaaauuucaaagauacaacgccaaaagcauggucuaugauagaaaggguggauaaguuggacuucaucaaaauguaaaaguucuagcauuucaaauaagcuauuaagagaaugaaaugacaauucucagacugggagaaaacauuugcaaaguauauaucuaauaaagcaccuauauccauaauaugcaaacaacccucaacucacuaagaaaacaaaaugcacaauaaaauaaugggcaaaagauuuggacacuuaaccgaagaagauauauggauggguagauaagcucaugaaaagaugcucaucaucauuagucaucagagaaguguaaauaucauaccauagugagauagcacuauuugaauggccaaaauuagaaagaucgaucauaccacguguuggugaauauguggaggaacgcgaaaucucauacacuauugaugggacugcaaaaugguauaauuauuuuggaaaguaacuugauagcaucuuaaaaagucaaauauacauuuaccacgauuuccagccauucuacuauaggcauuuacugaagaaaaaugaauguguuuguccacacacagacuugcacacaauaguucauagcagcuuuuuuguaauaaccaaaaucugugaacaaccuaagugucuucaugauuuauccauucaaaagaacacuacucagaaauauaaaggaaugaacuauuaaaauacacaacauagaucucaaaauauuuaugcugacugaaagaagccagaagaaaagaguauguacacaugauucuguuuauauaaaacucucaaaaaugcaaacuaaucuauagugacauuaaacacaucagugguugucuaggaacagaggaggacgggaaggagggauuaccaaggagcaugaggaauauuauaggaaucauagacauguucacuuucuuaauagugacaguuucaaauauguucuaauaugucaaaacuucacauuuuauacauuaaauaugugcagcuuagcguaugucaauuauaccuuaaagcuauuaaaaaucaauuuauaguuuagaaaaaugaucaugaaaagcuuuaacaucaugggaaaauacuuacaauguaauauucaaagguggauaguuuuguguaaauuauguuuuaagaaaaagccugugaaaagccugugaaggaacaguccaaaaaauugaguguaguuuucuccuguguauauguguauguguauucaggauauguaauuaaauauggaaaagaaaguagaaaguuaaagguuaucccagauuccaucauccugauuaauacuuuuuaucuguagauaaacaacaugccaggcccccccgcccccucucucucucuauauauauaugagauuuagagcugcuuuaauggccaagaacucuuucuccauucuuuauuccucuacucauccuccugcugucacugcucucgaagaagcuagccagcgccaucggaaaaggugauaguugcaauccgugugugagaugugaguguaggggcccaggggaucccuuuuccccaacauaccugucuaucugcucgcuuaaccugagauuccaaaauuccuagagaauaaaacuuuuuuauucuauaauuaagucguuuuaagcaugcaaucuccugaaagaggcaauaaaauagugccuggccuuucacaugugcuuucucauuugauccugacaacgcuaugagauagguauuauuucuuccacucuaaaaagugagauccagagaggucagauaccccagauugcacagcugguaagauguaaagccagcauggcauccuggaucugccacguuucaaagcucaguugaaggcaagaaaggauaggguguugagaaggcagaagugcugucaugaaggguugacaccuguaguaacuguggcccccuuaauuggucugucucugaacacagggacaacagugacacuucaguguuggcggaaacaugccugcuuuugagugcucuaaaaaggaugccugggaaugguguuuagcaugugucuuuaaacucuuucuagccauaccaucuguuucucugaggcacauuuucucaauauucauuuuggaauguaaugauguacuagcuuguauuauauuugauuuauaacucuguaacaaggaugaauucccaggccucaaaauuuagguguguaagaaacacuuaucuucauuuuauuuuauuuuauuuuauuuuauuuuauuuuauuuuauuuuugagauggaguuuugcucuuguugcacaggcuagaguguaauggugcgaucucagcucacugcaaccucugccaccccgguucaagugauucuccugccucagccuccugaguaggugggauuauaggcauccaccgccacgccuggcuaauuuuguauuuuuaguagagacggaguuucuccauguuggucaggcuggucuccaacucccgaccucaggugaucugcccuccuuggccucccaaagugcugggauuacaggugugagccaccacagcuggccuaucuuuauguuuauuauaacguaauuucuaucaucaguacuuauauaauagaagacuuccuuaggguaaaacauacaaguaaaacucagucauuuaaggcugagcucaguugucaucccugugugguagcaguacguuuucagaaacuucgucguaucauagcauggauaggagggugaggaguucagggcugucauuucucuuaaaccagcuucugcugagacuuuguguagucccugggugugguugucccucccugcugacaucugaagugucugaauuuccccuuagucuguaauaaugagguccuuguggggucccuucauuaagacccugaauccccuucaaauccacuugguuuuaguaguggaauggaagagggaauggguucggauugucaaagaguaaguuauaauuuagcuguuuuaccccauuacacuugagauaacauugcuuuucuccaauuccuacuucuccuuugaauacuuucuguaucauuugaauauacggacaccucuucuucaucucaccuccuuaauucucugugucuagacuguaccagauggugaauuuuauugauuacacuuauacuaacauugcuguuuagcuuacuaauuuguuuuucuuacaucccccaacuaguuugaaagcucguggaaucucuagaccagaaauuaaacuucuugaugcccuucgcagugcuuagcauaugacugagugcacaggcaguucuuaguaaguguuggcuggaugaauaaaugaaugaauuuaaacuuucuaaguguagagaauaaaucuaauauuuuuuucuauauccccuaugauguuugacauaguguuaaacacuaagcagucauaaacuauuuacuuaauugaauugaauugagagccauuuuauauuacuaguucuacauguauuucaagugucuaacgaagccucgaaaaaccaagucugcugcagacugcucauuggaaaauauuuuaagcuauugauuaaaauugacugggagaauuuuauacaauagaggaaauaagugugauuacauacauggcaugucagagacaggaaacaauacaagaccagaagaauuuaaaauccugcuaauauuauuugaaauguauauuguuuaaguggauauaagcaaacaguaggcagaugaaucuacuucacuucucugaagguaugggagaaaaaaugaacuaagaagaugauuuucuugaauuuaucuuuugguaggguuuuagugacuuucuguacuuggguucauacaacaaauuuuuaucaagcaacaacuauggauaaauaaugcuuucgacaguuuucagagauaacuugaaaaaagaugucucuuauuuccaagaauguguaguccuugaugaaggcaggaugaacagaaaguacugugugcaaaauggcauuaaucagaaggcucagugaguuccuuugacaucacugaguaauaugauugcuuauucaggcugaaggauuugaggaagacuacacaagagaaaugguauuucauuggaucuggaaugauuaccaagacuuuaaagggugaagaaaggaugaagagaauuucaggaaaagggcauguauagaggguuaauauuuaaaaauaacauguaugggaucugcugaugugcucaguuugauugcagcaugugguacggagugugugguuggguggugucugauguggauuuggcuagguuguaggggcauucauuuagaggccaguuuggauuuauuguaguaguuuaucaagguuuaugcccuucauuucucaaaaauucuuuuuagccaucauaugggaauaguuaagugugaaucuucacuuuuuuucuuccucucuugucuguuauaaaaguaauauuugagcugggccuggugacagcccaugccuacagagaccagccugguuaaaagagugagaccuggucucuacaaaaaacaaaaacaaaacaaaacauuuagccagguaugguagugcaugccuguaguccuagcuuugagaggcugaggugggagaauggcuugagcccagguguuugaaguugcaaugagcuaaugauuguaccacuguacuccagccugggugacagagacccagagugauuauauauauauauauauuauauauauauauaaucugucuauauuauaucuauauuauauauagauauauauaauaucuauauaucuauauaucucucuauauauuauauguauuaucuauauaucuauauuauauauagauaaauaauauauauauuuauguuaaguaauauuuggucauuguuggaaauauacaaguauauagaaaaaaauuaaggcauucauaaucucaccacccucauccccaaaauagcuccuauuaucauuuauauauauguaugaauauauauauccuguucuuuuuaaaagauauguaauuuucuuuuuaaacauuuucuguuuuuaugaauuccuuuuuguuuuaaucucugaagaauuuagacauauuuauuacaaaguccuuuuugugauucccaguuuggaagucucuuacuuucaugcugauggauucuuacaguucguaauuuuugucuguguaaguuuugucuuaagagcacuaucuucagcuggaguccaguguguacucugggugguggcggucuuccuacagagcacuucugcuuuugccuuugugagauccuuaugguuucguugguuucuuggguucuggguuucuuuaggggagauggugugaauucaggcucccccugacaccuagggcagcuuugggguucagauuucuccugggugccuuuuuguuuuuuucuaucuguaguauguguuaaguauaccacuuuacagacaggacugccucuucccaguuuuggccuuucuuuucuacuucuaacuuucugcuguguucaggaucugagggucucacucccuugaguugugaguguugcccuacucuuaugcagcuucccacuucauaucuggcucuggagguuucuuuugcuugcucuagaucauguaucuauugaaaauauuuaaagauuuguauuuuauuaaacauuucuacauguuucccuugucaccucugucuaaccugucuuuuuuucuuugcacagguguauacuuuaaacaaaguugggaauauacuauacuuacugauaaucuccuuuuuggaaaccugauaguauauggugaauuuuuuuccauauucuuugagaacaugauuuuuaauuacuaucugauauuccuuuuauugggagauuuaccauauauuauuaaauaaauucucuauuuuuuagaaguuuagguuguuuucauuuuccauuauuuuaaguaaaaaugaaguaaagaucuauaccaaaauuucucugcucauuuuggaauacuucuguagaauaauuccuacaaauggaauuguuucaucaacauuuuugaagaaagccuuguuaauuugaggcuuuugaauccauugcugcuaaauugugcuacaaaguuuguuccaguuuucaccccaucaguguggucugucagucugugccccauauggcagggucucuguuucccagaacauauuauccgauuauuaucccuuuaaaaguaugguuaauuuucugagcaaaacaaugguauuaauauuucauuguuauuuuaauuuucauuuagcuuaauggccauuuaaaaauauaguuugaauagaucugugauauuuucagcuuugcagccucgaccuccugggagcucaagugauccucccaccucaccccuccaaguagcugagacuacagggaagcaccaucacacugggcuaauuuuaguauuuuuuguagagacaggguuuugccagguugcccaggcuggucuugaacuccugggcucaggugaucugccuaccccaccaccauccuucacccaguccauuucccacccaggauuauaggcaugagccuguucccagccuucuuuuguuauuugcugucuuccuauugccucccaaaagaguuggaucuuuagguggaaguuguauuuguuaagggcaaugaugggugagagagguugcaaauuguagaagcugaggaaagaauuaaauuccuuaacauaagaaaagcuguugagauggagguugagggaacaaggccuuggagaaggggagacuggagcccagaaaggaagggccaggaguugugucaggguagagaguuuuagagugaucagagaggagguggcucucuugcagagaagagcuuuggagaaagauagaacaguuaaaggaaauuuugcaguuuugcccagugguguguaaaguaaauuuuucuucuugauuucuccacaaagucuuaagcaagauauuucuuguuaaaugcauugccagguuggcuguauuugauaggaaugcauugaagcugugguuauggccuaugaugggcaucagauaagagccaaauacuggauggagaaaggucgagcagaaauguaccuccugaaguagcccugguaagacugaagcaaggcuacgcucacugaugacaaaaggaguccaguuuuuccucuuauauaaguucugggguccuaguauacaucaaagaauggagagggaucuacauaacaacuagcauuggucuucuaauacugaguaugcguagagcuaacuuugauuuaguuuaggaaaauaaggaacauaaucugggaguuauagaauauauuaguugaauucucuuuaaaacuaucaacagcuaagaucuccuacaguaguucugcucuuguuaauuucuucauuucauuuuuuuuuuuuuuuuuuuuugaaauggaguuucgcucuugucacccaggcuggagugcaguggcaugauuuuggcucacugcaaccuccaccugcuggguucaagcgauucuccugccucagccucccaaguugcugggauuacagguauguaccaccacgcccagcuaauuuuguauucuaguagagaugggauuucaccauguuggccaggcuggucucgaacuccugaccuuaggugauccucccgccucagucucccaaaguguugggauuacaggugugagccacugcaucugaccucuucuuuuauuucuaaaguuauacaacccauggcauauaaacauuaaugccuauuaugucuuaauuuuggcuugaaccucuuaggccuguaaaaugacagugguuuucuuugguagguuuuuuguuuuuuguuuuuuuuugagacagggucucacucugucgcccaagcuggagugcagugauaugaucauggcucacugcagccucgacuucccaggcucaagggauucuccuaccucagccuccugaguaacuaagaccacaggugcaugucaccacgccuggcuaauuuauuuuuauuuuucauagagauggggucucucuguguuguccaggcucgucucaaacuccugggcucaagcgauacuccugccuuggccucccaaagugcugggauuauaggcgugagccacggugccugacuucuuuaguaguuuuuuauuuaaaguccucuuuugaugcgcauacucuuacucagcauugucaaugacuuguucuggaaugugaagcauauaauuuuaccccucaaucuaaaugcuguuuuucuuaauuguggagugaggaguguugacgggacuuuauaacuguuagaaaucauuaaacuugagugucgugauucauuuaugaggguaacgucaucuaauaaugagguaauggauguggaacugcuuuggaaaguauaaaaugcuugaugaagugcaguuaucaauuuuucuaaugccaagauacuagugagaaacaauuuccagaguugguagugggcaccacuuuacuccuccagaagcaaaagguauaauuacuucauaguucucuggcaaauaucugguuucccuaaggggcauucaucuuuugcgaguaggaaaaacucuaaccuauuugguggaauccuuccaaacucuaacccguuugauagaaucauucagugguggcauucagacuauuaaaauaauuauaaaacauagauuuauuaauuaguuguauucuuuaaguaaauuguguuaauaauuugauaguuaauuauuuguuauggcauucuuugugauugauauuuuucaguaccuuuucaaauccauaaacuaucaaaacuuaggauuuuaggaaauacuucuaugaauccuugaaaaaacaugcauguauaagacaauuccuucuuuugucuuuuaauagggaaggccagcguuggauuguguagguugcaaaaugcaguaccucagacuugcaacucugaaaagcacuguuugaaaucucuguaaagagugaaaaacuucaaguuuuaaccaaugaguguuuuagagguuaaaguuuaaacucugacuuggaagcacgcuggguaggacuccucugcucacucagacucaaguuggaucaucagaaucucucuuguguugcugugaaugauuugcauugaaauucccagcuagaacuggaggaaagaggauuacaaaccaggagguaauaccuggguuauuccagagcacuuggaaaugacucacagcuuccugcucucugacaguucuuuaguguuggucuugaggcauucauucugaaugagauauuugucauuauggggaguuacagucugagcauaaucucuaauguauaauuuccuguuacuaaauaauacauagaaaauaggaacaagguacuuuuucagaggaaaaaaauaugauuuaaaaauuugugucauuuucacaaagcuuauuuaaaucuuuuaauccauucccugaguaucauaagacaggucacauucugcccacacuucacccuggcaguucuguaccgacaagucagguucuagggcagcuucuaacaggagaaggucuuaggggguacaacauaagauguaggcauggaaggggcuugauggagaccaccaauaugaagguauuauauaauuaaggaucuggacuuagcagacuccuuggguucagagcccagcucugccacuuaugugaagcuuuuggucucaauuucuuuaauucuaaagugcgaacuguaauaauaucaaccacagagaguugcugugaagauucgaugagucaauacauguaguacuuagaacagugcuuggccuauagugaacgcccaugaaugccuguuauuaaagggguaagggaagucucacuugcuguguguggacugccacuguguaugaggcaugagugcugucuuuuguguuuuuuggauagggagcuagggggagauuuuaugagccauguuuauagaaccuucauguguuuuugauuggaugcaaugaguucaggucaggagaagauucuuaggacggcaugcuugcauuugcuuaggauucagauuuaaaacuucaucuuugcuucaugcaaauaaaaagacuacagaaggcaaaugaguauaggaaaaaguuucuccauagcuuuaggucuugucuuccugauaucccuuuacuacaggcaugggcauguugcugaagcucugccaaucacacaacauccugggaacuagacugucauccucagauagcagcagaggcaucuggagacagugcugcaaagcagcacaucauaguucuuacuguggagcucuguggagcugucuggcgccuguucuuugggagucuauuucuucagcucucucuugauucuuugagucaaugcccugaaucuaguucauuccuuuuuugauaaauguuaccagaaucagguuuguuuguugcuuauagugaaaauaccuuaauugguacaaauagcaaguaggaagauuaaaucuuuccacugucaguagguaaggcaacacagaugaagcuaagaguccuggaagucauagaaaauuccuucuuagaaagcauggcuuggagggagugagaauaucccuucuuuucuaagguacauaagaagaaaugcauuuuugaccuauucggguggaaaaagggagaguccuuaaguuggccaauguuggccugcucuaaauacaagguguagcauguagguguguuuggagaugggaguggugauuuuucaugugccagauaugcaaauuaccaauagucaaaaagacuaacggaaaauuaaaggcuuucagagaagugacauuuuuugaauagaaucaucaccaucauugccacugagaaauuaaaagugauguuguuaacuaaaaucuauauuguauugcaucaacuuaucaccuuaggaguuucuuuaggauaaugguguaucauauuucuucuauacuuaaaaauuacaaggugauaaguugcuauaauacaauauaaauagucaagaacuccauuugucagauuaugaguggucuguugggaagaccaguaagguuuuucucccuuagcugggguuugcaucuuuuguagucugccuguucauuuuucuuuuucuuuuucuuuucuuuuuuuuuuuuuucuugagacggagucucgcacuguugcccuggcuggagugcaacggcacaauguuggcucacugcaaccucugccucccggguucaugcgauucuucugccucagccucccaaguagcugggauuacaggugcacaccaccauacccggcuaauuuuuuguauuuuuaguagagacgggguuucguuauguugaccagacuggucucgaacuccugaccucaugccuguucauuuuucaauucauuuuuucagccaauugguaccuauucuagaaagccuuccuugaaucuucuagucagaugauucuuucuuuccuacuuauuucauucuagacuguacagggguucuaguucauuuugagagcugacucucuaguaggggcuguguggaggacuguguugaaaagggauccugaaccacucaaggcucagugagaaagaacugcaauuggugagggaugucugcaguggauaagggagucauguguuugccauugcugucaucuuugguucauugacucccuuacuaaguuguaaacucuuugagucaggucugugugugagucaccauuugauugccuccaacacuuggcacaacaccuagcaccuuagauguucucaauaaaucuguucugaaaugaaaugagggcaaugaaggaaaaaauucaugguggaauuugagcuuugcuuugaguggggguaaagaacggcugugagagaauagaguuucuagggacaggaaauggcaugaaggaaaguuguagaacaauacggaagaggccucaggagaaagaggaggccuuuuucaggauguagugggaaaucaagauuguugaaagguuuggagucuauagguaaagguuuaacuaaaauuguugcggcugugaucucaugaaggaaauugaaguauaguuuaauggaacaaacuaaaaaagacgagaaaauucaguugcgggaggcaucaguuuuuggaauauuuuccuccuccaggauuugaaaauagagaauugggcagcuugugugauuaugaguagcaauauagugacauuauuauggucaacuggaacuucaaaacaauaauaaaagcaacaaauagauuugauaaagaagcucucauuucuaauguuccuacauaagguuuauuucaggccaauuuuuuugagaagcuguaccuauguuagauaucugaccauauauaaaaaugccuguacaaaaaugaauggagaguuuuuaauuucuucagcuucauucacuccugaauugucugccauacauccuucuuguucccuuugugcuuugaaagcacauuaucaugccacacagcaaacuauagugugggucuuacugagaccugggucaggcaccacuuuggaaaucuaacuaacuuaaagggacuugccacucaguguaccuguuuuugguaggauguuggauaaaucugcaaacaucuuggacauauauauauuuuuuacucucagauacuaaguaaauugcuuuuuucucuuuacaugcaauacuuuagaaguuuccugauuuuaacgauuuauugacuuuguaugucauugcagcuagauugcccugccuugccucaugucagaaagaccugcccauuucucauaauauauuacuacucacuuugucagcuuuagcugaaggugaauuaaaaguuaauagguacacaggcuuggugguacacgccuguagucccagcuacucgggaggcugagguggaucaucugagcccuggaguuccaggcugcagugaaccaugaucaugauacugcacuccaguuuggguaacagagugagacccuaugucaaaaaaaaaaaaaaaaaaggccaggcaugguggcucacgccuguaaucccagcacuuugggaggcugagaaggauggaucaccugaggucaggaguucgagaccagccaugaccaacaugaugaaaccccaucucuacuaaaaauacaaaaaauuagccaggcaugguggcucaugccugaaaucucagcuacuagggaggcuguggcaggagaauugcuugagccugggagauggagcuugcagugagcugagaucgcaccacugaacuccagucugggcaacagagcgagacucugucucaaaaaaaaaaaaagugaauaggaagaauuuuucugaaugaagggaaagggaagaaaagguacaaagcagucauaggucuaggucuagagacccuuaggcuaugaauauaaucuuuaauacugcugaucaaugugggagcaacuauaaacugacuucugugguucacugaugcacugaguuucugggauuaggugagguggugguaaaauacaaauuaugaccaaaguagugccuauuaucuagauauaaacuuacuuggaaaguauaauuauaguuaauuuucuuucccaauucagaaugcccaaauauucuccauccuuugaggaagugacuugccucccauuuucuucauguagauuguuuguuuuugucucuauauauucguuuagacacuuguugcucaaagcaauagaaacccaguuuaaauggcuuuuaauaaauuguuuugaguaaccaccaaaagaaagaaaaaaaccacagugggauucaggacucugaauucaugacuacccugccagaaugugucuugucuuuacuguuuguuuucugcaguguugguuuuggcuucuucuucuuuuuuuuuuuuuuuuuuuuuuuuugagacugagucucgcucugucacccaagcuggagagcaguggugugaucucaccucacugcaaccucugccucucagguucaaaugauucuugugccucagccuccugaguugcugggacuacaggugccuacccccaugcccggcuaaucuuugucugguuuuggcuucuucuuagccuuguguucucucuuuguuggaggcaugauggcugcagcugcucugaccucuacuuccucucugauucaggggaucauguggggauucucauuauauaacgcuuuacaaaagccuuguuacgucuuguuggcuccagcuggauuuuaugccuauucauaaagcaaaaucacuguggcuggggaauaugaugugcugcguggcuuggaccuggaaccucagccaaaaauggcauggauguaucauuacagggggaacaucagaacuaaaguuaggacuguugccagaagaagggaaauaguuucugaaggagaaaauaaaacauguugaggaaauuacacucgaaguguuaauacagacauuauaaugauggggacuuggguaauacucauguguugaauuuucccagagagccagagaaggccuaaaguggcaguagggguaggggacaguagaugggauauaaauacuaaaugagaagaaaaagauccugggaugcuaggcaggcccaguugccugagcugggaaagucucugugguuaauaggcuugugaccugcuggccccucaucuuucagaggaggugacaauuggaaaugccccuuauuggguucaggaauaugaugagugguauaaaacugagguuggguuuugacaaauuuagagagcaaauguuuucuucuggcccucagugagcuaauuugacagaagcauuucuuuuucuuuuuucuuuucucuuuucuuuacuuuuaagagauggagacagggccgggcacaguggcuaacgcauguaaucccagcauuuugggagcccgaggcagguggaucaccugaaguuaggaguucgagaccagccuggccaacaugaugaaaccccgucucuacuaaaaauauacaaaaauuagcugggcauggugaugugcaccuguaaucucagcuucuuuggagacugaggcaggagaaucacaugaacccaggaggcagagguuguagugagccaaaauugugccauugcacuccggccuggaugacaagaaaggaacucugucucaaaaaaaaaaaaaaaaaaaaaaaaacccaaaaaacaaagagauggagacaaggggggucucacugucuugcucaggcuggauucgaacuccuagcuucaagcaauccucccaccucagccuuuugaguagcugggacuccaggcacgugccacugugcccagcugaugggaguguuucuaaagaaacacacagcauuuccaucaaggcucccugggaggccaaugaaugaacagaaucaagaaugugaggaaccaaacuuaauagacugaaggacucaucuggcacacacagugcuuuauaauaauucaaauuguuugccaaagcuuaaaaaucaaauuucacauaaaaauauugaucucugacuuucuuugaaaaaucagaagaucuggcaacccugggccucauuucucuuggcaacaguccacaggaguucagcaguggcugcuccuugucagagcccuuccaauccccuaccaggccugaaucacacuucugacuuccugccuggcccuuguaggcuuagagacauggaugggauuuccaggggguaggcauuauggacacauuaaggaagggguaaagguuggggagucaaauggggaggggccucugucuucauccaggacuucaggaaccagcaagaauguucauggcuguagauuggaagucuugcugagcuuggggccguggggcaucauuguucagcagguccucagaagaacugauucccacuucguagauucuaauuuccucagcuuacagguuaucuauauucacccaauguuggauuuagagaagacuuaaggcuuuaggaaaguacuggggacuaagucauucccuuucuuucaccccuacaaauaguuccagucagucuucuauugcuacuuuuuauugugcauuggucaguaaauccuacuuugcaccuuuuauauauacuuuuaaucuaguuuccuauuuuccagcuaagaaaacuuacuaaccuuggcucuaccaacaaagaggcaaagauuuuugugccccuuggacaagcugcagugagggagcagugccuguguccucggaggcauggcaaauccauuagcgcaucuaucugaguggagccgagggcacagaguaggaggcgggggaaccaaggugaggcacguuucacauugucccucuuugccuaggccaucccuucaauauguacuuccucacugaucacuugaaguguuuggguuucaaaacugaauagcaccuguuugguguuagccauggauaauggggagaacucugggauaaaggccuugugagaagaggcuacguuguuguugguuuuuguuuguuugcuuguuuguuuuuggcaugcugauuuaaccauucaguaagcaagucuaacucugcacgcucauucauucaguugcacaagucaaauaacauuugaaccucuguguuugagugaccaaaucccauguguuaaaaaguaaagucagagcuguggugccagcagcuuugauuucaguauguugucuuuccuugggaaaguuauuucuucuaaguccuucuguacagccaauuuuuggguccgcguccauauuuuucuucaccaaauacuugcugagucauugcauguuuuuacauuguuauucugguaacugccgccccugacuugcacuuagguuuaaugaagaaaggauaauuuugcugcaacgugaaucucucucauaccaaaugcuuuuccaagagcuuguuucuguuuucuucacgucuuuggucuuugucuuucucuuauucuuguuuucuuuuaaacgcaugcacgugaguauguguguacauaugcauauucuuacccaccccuuuuagccuucucacaucaccauucuauaugauacaauugucuugguuacaauuaggucagaaacuuuuuuuuuuuuuuuugagauggucuggcucuguugcccaggcuggagugcaguggugugaucucggcucacugcaacccacaccucccgugcucaagcgauccucccaccucacccuccagaauggcugggacuacaggcucaagccaccacggccggcuaauuuuuguauuuuuuuuaguagagaugggguuucaccauguugcccaagcuggucuccaucuccugagcucaagcgaucugcccaccuugacaucccaaagugcugggauuacacgugugagccaccaugccuggcccuagcucagaaacuucuaacccaaagccauauaugauauaugcugaauaacuccuauaauacguguauauaguauaaaaagagaccccuuuauauccagauuuaaacagaaagugaauuagaagaugauucuaauuuguucaucaaagagcaauaaucauaagauuguacuauuuacaaaaaaucaguuuaaauuaaacuuuucaggcauuaacaguugaaccugauaagcacuauauuguaugaguauaguuuuaggagaaacugauucuuacccaucuuuauaucuucauuuagcccagccaaauaggauuuauuuguugaauacaugaaugaaugaauuuaaacucccuuacuaggggccacauguuggggcuuuuaaguaaauaguagaaaagucuugguggcaagucugacagccacugaaggccaucccaaauugcaaaugcaugggaauauaaugaccguggcuggucauggagaugaccaugguggcggcccguguggugaggcaguagggaggggauguagguaagcccugucuguucucugcuuugcuagaagauuucuuuguuuauauaucuaguguuugcacaagaggaucagaacuuaaaagcuucaccuagggaagaaugaaggcuauaucauuaacuccuuuguaaaaugauuaggaaaaaguuuacaaauacuauuauuuuuuugagacagaaucuugcucugucgcccaggcuggaaugcaauggcacaaucauagcucacuauagccucaaacuccuaggcucaagugaugcucccaucucagccucccaaguaguaggacuauaggugcguaccaccaugccuggcuaacuuaaaauuuuuuuucuuuuuuuguagagacaaagucucacuauguugcccaggcuggucuugaacuccugaccucaagcaauccucuggccuuggccucccaaaguguggggauuacagcaugaaccacugccccuggcccaacaaaaauuauuuugauagauuuagaagaaacaccauguauaaacauguggauuaaaaaauuugaaugcugucaaauuagucuuugugcuuccaauacacagcacaguaaagagguacagcaaacaagugcucaauaaguuguuguugaauaaauaaauggguaagugaaugaagagaacugguuauugacguauagaaacucuucaucuccucuugucaguugguggcacauuucccauaaacuguuguuuuauuuggcccuuuguuaucuaguacuccuuaugcucugugaagagaaauauuagagaaauauuaccuuuaaugaauuuuacuaaccuuuccccacauauacaacacaaggccagugggaauauaaaaauauaaaauauccuuuaccugcaaggagcaaacaaugauaggaaggugggaugaaaauaaaauagcaaaauaagaccauuacaacacaacacauaaccaagaauaaauuaauguacaugaacggaauaauacauaagaaaugaagacacugagcaaaggaaaagacagaggugaugaagucuuaugccaaugggaaggcguuaaggauaugggggaaucggccuuccaagcugucaaguugagaguggagaacagagaccgcauuaauuuggcaaugugggguauaaugaaaugguaaauacuugggaagacugaagcagaaaaaagucccaauguuaaaauaacaguguauuguuauuuuuuguuuuuguaggagauugucaggccucccuuuaagagaucacaagccgggcaccguggcucaugccuguaaucccagcacuuugggaggcugagguggguggaucggcugaggucaggaguucgagaccagccuggccaacauagugaaacuccgucucuacuaaaaauacaaaaaauuagcugggcgugguggcgggcgccugcaaucccagcuaccagggaggcugaggcaggaaaaucgcuugaaccugggagguggagguugcagugagcugagaucaugccauugcacuccagccugggcaacaagaacaaaauuccgucucaaaaaaaaaaaaaaaaaaaagaucacaaaagaguuagucaguuuggaaccagugucacuuuacccccggugcgcuguuccuggcuuaacacuucauaauggugcauaauugaaguucucgaggucucuaggauugucuaagcaugugggaaauuauuuuauguguuugaaaauaaaauugucuuuuuaaaauagcccaggauuuggcaaauccaggcuguuggcaaucaaauuaauuacuuuuuuuuguuuguuuuugagauagagucucacuccgucacccaggcuggagugcaguggugcaaucucaguucacugcaaccuccaccucccugguucaagcaauacuugugccucaaccccccaaguagcugggauuauaggugcaugccaucaggccuggcuaauuuuugcauuuuuaguagagacaggauuucaccauguuggccaggcuggucucgaacuccugaccucaagugaucugccugccuuggccucccaaaaugcugggauuacaggcaugagccacugcacucgaccaauuuuuaagaaaaguuuucuaucauagcugucccuugugaaugaaugaaaaaguugagcucaguuauuuuagugcugaaggaugcucaggaaaucuuugaauuauauugcaccauuuucauauauuuuacccuuuguccaaaggacagucaaggcuguuauguagaguaggagacuaauauuuaacaaaauaaaugauaucccaauucauacuuauauucaacagucaguagacauuccaguuaaagaaaaucugauaaaaaauggacagguugauauggaauaugaauacuuacuuuuuccaaaaugaaugauacagcucccuguugugaaauguuguugaauaaggagauugcuagacauauagaugaaaauauuuuccagguuuuccuuuaaacuagaaggaaaauucuucaacuauuucauagcuguuuuuuuucacauagugauuuauuucagugaccuugugaucuguaaacuuguaauggagggcugaaaaugggaaguaacauaggaaaagggaagggcuguggugagagagacaauaauuugcaaagaagaagaggacaugggguaccaguagaacuucuacucaccagagauacugaaauauucuagaaccucugaucucagucaauucuccauaggaacacuaucaagucuuuuuccauaaaagucagauaaaagaaagaucacauuucuugauauucuuugaagcaacuuuauuuuuauugucaugcuucauccugcccgaauacugccaagucuuucucaggcaccuggaaucugcuccucagccucuguuguccugggucuaauguagagcaaaaggcugagaggaagcucuucuauucuccaucaucggucuucaguggcuaccugggaaacaccccuuggcuuagucggcagauucucuccggugagguucuguugcaccugccacuccuagggcagcaagcagcagucuuacuugcuggcaccuagagauuucccuuccucccugugggggcaaucuuucccucucacugccuuccucaucuagugguuucucagagguggccucuucccccugauccgauugccaggacauccaaccuaaguaagcccucuaggagguucaugcuucuucccaaagacugagggaaccacagauucuagccugguuuugccuucugugcugccagagucccucagauaagaaaguguuauaguguuauugcuguuuuguuuuguuuuguuuguuugagacggagucucacauugucacccgagcugguguacaguggcgcgaucucugcuugcugcaaccuccccaccuccuggguucaagcaauucuccugccucaaccucccaaguagcugggacuauaggcgugugccaccacaccuggcuaauuuuuguauuuuuaguagagacgggguuucacuguguuggccaggcuggucucaaacuccugaccucaugauccgcccaccucgcccucccaaagugcugggauuucaggcgugagccaccacgcccaguguguuauugcuuuaauugaggaggaaaaagaauaaacacaauuuaacauuucaauaaauuauucucccacaauaauauuaauuauuuuaauuucucaagauugaaguaguuaaguuuccuaaagccuugguaaaauuuccccuguucaaaaacauauucuuggucaucuuuauuuuuuauuauuuuuauggcuugauuuuccuuuauuaguggcuuguggcuuuggauuaagaagcauccuuuuuucucuuuaagaauaauuuuuuauaauaugaauuauuuaaagcaaaagacuaaaauacagaaucaauauaaccuauguccauguacucacuuccuagauugagcagacauuagcauuuugccauaacugcuucaacuguaucuuuaaaaaauauguaacaggcugaggacauuggcucaugccuguaaucugagcacuuugagaggcugaggcaggcagaucacuugaggucaggaguuagagaccagccuggccaacauggugaaacccugucucugcuaaaaauacaaaaaaaauuagccagauguggugaugggugccuguagucccagcuacucgggaggcugagguaggaaaauugcuuaaaccugggaggcagaggcugcggugagcugagaucaugccacugcacuccagccugggcaacaaagugagacuuugucuccaaaaaaaaaaaaaaaagauguaacagauucagcccuacccugcaagcccugcuccuugccucccucuacauagaccaccacuauucugaauuuguuguguuauucucauguauguuuaaguuuuacuacauagguaugggaucauaagcaacauauauaguauuuuguguuuuuauaauuuauaauaaauaguauauuguauguauacuucagcaguuugcuuuuuucauuuaguaugauuuugagaaacagaugugauucauuuguuuuacugauguauacauauugauuaaauaguaauguaaauauaguuggaagaauuaacacuuuacaggcuugguuuacugguuauucacauuuuaguguuaaguagucaucauuccuuucuuuaaaacuaguuaugaugcuugccgugagagaguaggaaugcuaauugaacuacauguagaacuuaagaacuugggcacuagaaaaacauuugcuuuugaaucucuuauuuugucuaccuuccuugggcaggucacuuaaucucuguaggccucaaauauacauuuuuaagggaugaugcuuguaccaucaguagagcagauaaaugcguagugagcucaugcaugugaggagguuagcacaguuccagacccauugaaagcccucaauaaauauuugccauuauauuucauauuucuagacgaggaagaauaaaggaaaaaggaaauuuuggaggauggauaaggggaaaagcuggcugacccgagucaggggcuagcuugagaagucagaauuucaagugaccugugacagggccacuguggaagaugggaaaauagaauagcugggaaaugaaaaggugccuuuguggaaagcuauaaauuauuucacuauuuuaaucauagauuuugcuuuguaaagaaacauaggugcucuuauuuaaaauggucacuauagguacuguauauauaauuuuaucauuaucaguauucaguaauguguaucuuuagaccacuaguauuuguuucauuuuuuuuaaauguuuuaccaaaauugccuuugcuuuucaguuauuuguuuguuuugguaggcugauagucuaaaaaacugaauacaaaaagcauauaaugaagaguaagccucuuccuagucugccucagucuccauuucuccuagaggaucaguuccucuuccacuuuucuuuuuucuuuuuuuuuuuuuguuguuguuuuguuuuguuuuguuuuuugagauggaguuuugcucuuguugcccagacuggagugcaauggcgugaucuuggcucacuguaaccuccgccucuuggguugaagcaauuuuccugccucagccuccugaauagcugggauuacaggugugugccaccacgccuggcuaauuuacuuccacuuuaagcacgaaucauuuuaaguggaaccuucuuucaucaauuaaagccucuuuuuuccuugccuaauccucaaguauaccgugacacaaccaaauauauauuuggaaaguuaaagaagcacauucuaaaagagacuuuugaaaauuuagauaaaauuggauuugaucuuuuauccucccucagauuucuuccuugagccuuuuaaaaguuuaccaaaguuaguccgagcaguuguuuaugauuggcagaaucuaaaacccuucuuagaacaguuucaggaaaaaaaaggcaauagaaacaacccugaauugccaugagacuaacaacguaaaaaucacaacuguuaccauuuuuuuguacccuuccagaaaauguuguauaaacauacagcugauaccaucacucucccugccacacuuacuuuucuguaucuuguuuuguuuuuuugagaguacagaugcuccuuaacuuagaggagucccauuccaauaaacccguccuaaguaaaaaauauauuuuguauaccuaaucuagugaacgucauagcuuagccuugcauaccuuaaacaugcuuagaaugcuuacaguauccuaaaguugggcaaaacuuucugacaacgugguaaauguagaguauugguuguucacccuuguaaucguauggcugaacguggcucaccaccucugcccagcauggugagaguaucauaccgcucucugcugacuguguguaacuuccacaccauugugaaguugaaaaauucuaagucaaaucaucguaaguuaggagcugucuguauacaaucuugaagauccuuuuauauuuuucuguuuguuucauuucaaugccaaaggauucaaagcaacaucuuuacacuuauuagcuauaaaaacaaagcuuuaaagauaggaaacaacguuguauggguaaauugcuuuuuugauaaguuuacauggugcuuuugccugguuauaggagacuaaaaacauuuuauguaauuaacaaauuauauaaauuugaauaggcaugagcaaagaauauaaccccaguuuuauuuuuaucauuucaaaugcaaggucaacacaaacacuguuaauuugcagccuuucuguggagugcaaaugcuaaaauugggccccuauuuuuaaaacuugaggcaagggauagaaagcauuuugaauacaggaaaggauaugcaggaugacugaaaccacagagauucaaagccagccacaccacaaguagcauuuugcagacccagggaauuaugcuuaacaauccuaaaaaaacuauuuaaucucuuugaacacaaaauaagaaugucuguaaauaguuuuaaauauaguaaagcuuucuaaaggugagaauccaaugaaaugaguauuuaaugcuaagauguaagaaacugcaucuggggaguaagaugacuucuauuuacuccuuuuucuacugacuugagcucuuuagaauuuuuuaaaaaacaauguagaauuaaauagcggacaauaguauauuuaaaauaagaccaaaagauuaauugcacauuuaauuagaaccaggccccagaaaaauuguaagagauagaaaucugugauuuugaaagaacaccaaaauuccugaauaaauuuguguacagaucacaaaugagccauacucuuagagggcuucacacaauuuaauuuuucaaugaucaaugaaauuucagugaauaaauuauuuugaaaauugaugugcuucacugaaaaauuagggaugauauugaaccuucuauauaaauacaaguuuauaaaaguguauaaaaaagaggauuuuccacuuagcuucaauuccuauuguuuuauaaagcacuuguuuucacuuauuuucugaggcacauauuaacugucugauagaacuaaguguuuaugagaaauacaauauaauucguauucaucuuuagcuuuacacugaauagaaaagccacuaagucauuuuaaaaauaagaguuguggcuacucugucuauggaguagccauucuuuuauuccuuuacuuucuuaauaaacuugcuuucacuuaaaaaaaauaggaacacucuuacacuguuggugggaguguaaauuaguucaaccguuguggaagacaguguggcaauuccuuaaggaucuagaaccagaaauaccauuugacccagcaauccaauuacuggguauauacccaaaggauuauaaaucauucuacuauaaagacacaugcacacguauguuuauugcggcacuguucacaauagcaaagacuuggaaccagcccaaaugccuaucaaugauagacuggguaaagaaaauguggcauauauacaccauggaauacuaugcagccauaaaaaaggaugaguucauguccuugcagggacguggaugaagcuggaaaccaucauucucagcaaacuaacacaagaacggaaaaccauucucacucuguauguucucacucauaagugggaguugaacaaugagaacacauggacacaaggaggggaacaucacacaccagggucuauugggggguaggggcuaggggagggauagcauuaggagaaauaccuaauguagaugguggguugaugggugcagcaaaccaccauggcacauguauacuuaugugacaaaccugcauguucucugcacauguaucccagaacuuaaaguauaauaaaaauaaauaagaguugcauugcuagauaucagaagucuuaaaaauguaaguaauucuacuuuuagauauuuaucacacagaauaaacauggagaagaacaaagauuuaucugcaaggauguucauugaagcauuauuuguaaugaaaaauuagaagcaguacaaauacucugaaagaggggauuuaccaaauaaguuaugauauaguaauauguagccauuaaguauuauguugaugaacaacaugaaaacauagugacaauguguuaguaccaacaaaaagguuauaauauuguauggucacauuguucucacccccaaaaagguacacauguguuuugaaaguaggucagaagggggccgggcucaguggcucagcgucuguaaucccagcacguugggcggcugagguggguagaucacuugaggucaggaguucgagaccagccuggccaacauggugaaaccacgucucuacuaaaaauacaaaaauuagcugggcauaguggcacaugacaugacuguaauuccagcuacugggguggcugaggcaggagaaucgcuucaaccugggaggcugagguugcagugagcugagaucgugccauugcacuccagccugggugaagaagugagacucugucgcagaaaaaauaaaaaaagaaaguaggucagaaggauaaagacaacaaaauuauauuuguugauauuucuggauagaaggauuaugaguaauguuaauuuucuguuugggacauucauuaucaauuauuuucugcagugaacacacaccaccuugugacuuuuccuauagcccaguuuuacauaauuuuuuccucuuuaguuugucuuacucagaauacaaaagcccccuugcccccaacuuucgaaggccaagacaggaggacugcuuaaggcuaggaguucaagaccagccuggacaacauagugagauccugucucuacaaaaaacuuaaaaaauuagcuggguacaguggcacaugccuguaguccuaccuauucaggaggcugaggugggaggaucacuuaagccuaggaguucgggacugcagugagccacaaucaugccauaaaaaagaagagccccacagacccucagagacuucacaugggguaggggaaagaauguggcagugguuggauauuguaaagcugaauguuaaaaccacaaaucccauuauaagauaagcagaugcugaauucaccuuuuuuguagacauuauucgugucuuaaaaaauuuuacuuucugaccuuaugcuguacauuuauaaaugcuauacuuuucucaaacuugaaaugcaaugcuuauuuucuugaaaucgugggguaaaaugcaaauagaaauuauuaauucauuaggcuauugagaaauaucuguguaaaagcacaaggugagaaaaauagguguuucuuccccuuacugagucucaguuauaguuuggcuggccuaugcugagagauuguuaccaggggaccuacucauauuuguucuuugucagccagaucucauagauaauuccuccuagagaauguacuuccucuguaccuuauauugcuuaguuaaauguuuccaaaggcuucaugcuuuuuuuauaauauugcuuuuucuagauauaaagaccugaagauagucuuuucuguccaaagauggaaaacaguacuacuaccauuucucgggaggagcuugaagaacuacaagaggcauuuaauaaaauagguaugcuugagaaaaaguaaauaugauauuacuggucugcuugaugucagacuucaggaauggaaaaauaccuuuuauuucaucuaccaccacccaauuaccuccagauuuauuccuuuuuuucuaucuagguuucacuggauucuuucuuucugaaagauaagcuacgacuagcuugaauuucuaggugaauuggacuuugaauucuuugaucauuucuuugcagagaguaauccagguuaaugaaugacaauguaacugaauacacuuuacacgguauccuuauuacagagaaaaaaauauaaaaauacuuccuuguguauaaacugaacucuggccuucacaucuuugcacuaacaauaacacuuucugacuucaugcagaauauuuuuaaaaucucaguauuguuuuuaaaugccauaugucuuauuuuccuucucccacaugcauaauuuagaaagucuuaguauuguuuuuaaaggccguaugccuuauuuuucuucuuucacuuuuuauagccauuuaguguuuugucuuuaugacauuaucauuuugacaguuuuguauuuuucuuccaaaaaauuuuccucauacucuguuggaucucaauucuucugcaauuugcucuuaggaaacccaugguaaacaggagaauauaaauaccuuuuuuuuuuuuugcuuuaguuugcaaaugcaugcaagugaaaggugaacccagugaaaggugagcacagugaauagacauugggauaaugacaccacuauguuugccccuuacucaucaagcucauucucuaguguaauagagcccuccaugaaaaacagucauaugguagaucagggaggagaaaaugaucaccgcuggucuugugcuuagauuucucacaaaccuaauaacgacuaaaauuaaugugaguaaaauaucaugcaacaugaguuuuauugaccaauacaaagaaaaacgauauguuuaaaaaaaaaaagcacuccaaaaaaaaaaaaaaccaaaaaacugugaaacucaggaagcucauguuuuacaaaucauuacugugaaauaaaguaaacuaaauucuacaaaucucugggcucuuccauuucucccugggaauggcauauuugucauuagagcauuguaugaauaugguaugauuuucagaaaacaaucauacauuuuauagagaauuguauguaguguccagaaucuuuucaaaacaaaaacugggcaauuguugaaauguucugcucauucugagcauugaaacagaggaaguaauaaaaauguaucucguaguuugauauuucuguuauuuuauagaugcaguuuuguagcuugaauaaaaguucuacccaggucuugguaaaauaaaugaauuaguaauauauuugcuuuguuuagcacaacaacuuuaaucuuugacucaugaacauauuaauauaaucuugcaauauuuauuuaaugauauauugaauaaacaauucacugauggaacaauuuuuuuuuuuuuaacaaaaccuuguguugagggcugacuuucaauagauuguagugagggagcugcucugcuagguacaaaaccccaacccagaagcagguccuugauggaacaauuuugagagcaagauaauuuguucuguuugagcaaagcaguaacacuagcagaauagguacuugcugacuuuauuuaggagguaaacugcuacucugugaacucagaaaccucucugcuaauuuguagcacacuuuucucaaggauagaggaacacggccauccaauguuauuagauggaguauuugggggccacuggggagaagggggaaguugaaauauuucucuguauuguuucuuuuugaaauugugguaaaauauacauaacagaauuuaccauuuuaaccauuuuuaaguguauaguucauuagcauuuaguacauucacauuguucuacauucaucaccaccaucccuuucccaaacugaaacuccauauccauuaaacaauaacucccaagccccaggugaccaucauccuacuuucuauaugagugugacuacccuagguaccucacauaaguggaaucacauaauauuugucuucuugugacuggcuuauuucacuuagcacaauguccucaucaacagcuucauccauguuguagccugugucagaauuuccucccuuuuuaagguugaauaauauuuuauuguauguauaugccacauuuugcuuauccauucauccacugauggccauuuggguugcuuccaccuuuuggcuauugugaauaaugcuaugaacaugggucuacaaauaccuguugaagucccugcuuucaauuauuuugaguguaaacauaguagcggaauugcuacaucaugugauaauuccauauguaauuuuuggagaaacuaccauacuguuuuccauaguggaggcaccauuuuacauucccaccagugguguaccaggguuccauuuucuucacauccucaccaacacuuguuuucuguucuuuuggauaauaagcauucuccuaggugugaaguaguaucucauuuuauuugcauuuuccuuaugacuagugauguuuagcaucuaaugugcuuauuggccaauuguauaucuucucuggagaaaugucauuucaagcccuuugccuauuuuugaaucacguuguuuuguuguuguugucgaguuguaagaaaguccuguuuucuuuucaaacugugaucuuuaugguuauuuaacuuaagccuuuauuuccucaccuuuaaaaugggaaugacauuaguaaccaccucaaaguuguuguaagaauuucaugagauggccgggugcgguggcucacgccuguaaucccagcccuuugggaggccgaggcaggcggaucacaaggucaagagauugagaccauccuggccaacaugguaaaaccccaucuguacuaaaaauacaaaaguuagcugggcgugguggcauguaccuguagucccagcuacuugggaggcugaggcaggagaaucgcuugaaccugggaggcagagguuguagugagcugagauugcaccacugcacuccagccuggcgacauagcgagacuccgacucaaaaaaagaauuucaugagauaagucaaguucuuaucgcuccacugcacuucagccuggcgacagagcaagacucugucucgaagaaaaaaagaaaaaaacaauuucaugagauaagucaaguucuuaacaagucacuuggcuaagcauauaugugcauuagaugguuucuauuaguucuugucaugucacaccaaaaccacagagggccuagggauggagccugggagcuuaagcccccauaucugucuucagaauccuagcucuuaacuaauccuguuaguuuaacaugaucguuauuaggcaaauaacuuccucagucuuguuuauuuuaaaauauuuccugcuauuaugcugguuuagaaauaagccagccuaaucuauguguguauuucagaauuaugggaaacaguucugaacuggucauguaaugagauuuuucucuaaauucaaagaaagcaauauuauugcaauaucaagcaacuuagcuuccuagcugaauuuugcaauuauaccaauauuuugguuauuggugguucuaguuuagaaauauucuaucauucugaacaguauuaauucuaaaacuuucauaugagaguuccaaagaaaaguuucuauccuaaccauuaauucaguuaguauagcagcucuuuuauuaagaagaacaagaaauauaggaaacaaagcagcuauuagcagaugagcaaagagagccuauacaagguggauccaggcaacaaaacagugcaaagcucugcugucaacucugggcagaagcguuuuguguugccuuuguucugagucaagaagugauacccggccucuagggaaaaccuagggaagggcaucucucaaugaugccaugacaugaaaacaccuggaaaccuguuucccaaaguccaaauauaggugugaauuucuugaacaccuaaucucaaaugacaucaagcaugauucagcauacguaaugguaucaugaauacauaaugaagaagcaaugaauuauugacagaugaaacagaacugccaccaaaugaaacguagaacacaaaugccuuaugcguauuuuacacagcgcauguauuuuauauggaauguggggucagcagauuuauuuucuaaauucccucaagaaguuaaagucugagugggugcucccuuuuuagcuaucugugacuuccccaugcuuauuccuuuuuuuuuuuuugagauggagucucgcuuuguugcccaggguggaguacaguggcgcaaucucggcucacugcaacuucugccuccuagguucaagugauucucuuaccucagccuccugaguagcuuugauuacaggugcccgccacuaugcccagcuaauuuuuccauuuuuaguagagaugggguuucaccauguugaccaggccgaucucaaacuccugaccucaggugaucugccuaccucggccucccaaagugcugggauuauaagugugagccacugcgccuggccccccccaugcuuauuucuuugaugcuuagucaugugcuaaaacuggguuuucuaucagagcaacaauacccuuaaaauauauaugguggcccuaaaucuauggggauaaacucgauuuaaauauauacaaaguuuuuguuuuguuuuuguuuucguuuuuuaagagauggggucucacucuauugccuaaguugaggggcaguggugcgaucauagcucacuacagccucgaacuccugggcucaggcaguccccucaccuuagucucccaaauagcuggaacuaccaagccuggcuuaaauacgaguuuuuaaaauaaagcauauagcauauucuguacaguucagguacaggaaaaaagguuacugccaccugugaaacaaaugugaaaggcucugucugcacaucuaugaauccucccaaaaggcauccuuauuguacaccuucaacaaagauuacaaaauauauuuuauaauauaucuuuacagauauugacaauaguggguaugucagugacuaugaacuucaagaccuguuuaaggaagcaagccuuccucugccuggcuacaaggugcgcgagauuguggagaaaauucuaucaguugcugacagcaacaaagauggcaaaaucaguuuugaagaguuugugucaguaaguaaucuaauccuuucgggcuacugauaaucuugcuuagagcagaauuguaguaaugucaucacuagcuuugguuaaauccagcuucagagaccagaaaaaggacugcuuuaaaaugaugaugaugaugaugacaauaacuauuauuaucgaaauaauuuccacaacuaauucauaaaacaaaggaaaaaauuauucucaaauuguuggaauggaaaucagguuuagauaauaguaauucauucccuagaauaacuaggugaguucaaugcuuauugaccauuaauauaauugaauaaauauuuaugaaauauaaauugucugguuuugcauucuuuauugauuaagcagguauuuuagcucuucucuuccuagaaauuuugcuaggcacugugaguaaugugaugaguaaaaagaaacgugauuccugucuucauggaguuuauauguguggagaagacugcauugcacaaauugauaaaagauaauuggagaauugcuaugacagagugguacagguccugugagaguuugugguagaaggaauugaauuuggaggcaaggcuggauaacccagggacucagggaagguaucccuacagugugaagacugugauguguucugaagaaagauguuaaacagauaaaaguggguugugggaaaaugaauaauguaggaggcagguagacaugacagcauguguagagucccuguggcuuuagagauggugaauauucucaagcaacugaaagaagguuugugugacuggagcugagaugguaaggguaaggaauguagcuggagaaguaacucagaaucaggucacacagggccaugucgaauuuuuguuuuuauccuaaaagcaauaggaagacaaugaagugggaagaauagaaugugaagugacaagaucagauuugcauuuaaaaaaaaacccaaucacuuugcugcaagcagaacugauugaauugagucuugccaaucucuggugaguccagugagagagugauugggaaagggaguuucuguaagccuauguuauuuccucuaagagcugacuuauuuuaucaugaaugcauuugagauguucaggcaggaaaauaucuucauuaaggcauucuucuaucuuuagcauguaguuaguuauuucuuagguuuucaguacaaaagauuauggcaagccaagaagaauaauuucaguguguucaauuuaagcuuaguuauaaaaaauuuauuccaccguuugggguucaaguauuugucuauuuuguguuauugguaaaaugaugaaaguuaucuguguauacaagcaauaaguacaacugacuaguauuuaauuuggugucauuucaaauaaagaaguguaaauaaauauccauuuugucagguuuuuauugauuaucugauucucaauuuuacuuauguuccauuccagcuaaugcaagaauuaaaaagcaaagauaucagcaaaacauuccgaaaaauaauuaacaagagggaagggauuacugcuauuggaggaacuucaacuauuuccagugagggcacacagcauucuuauucagguaacugacuucuccaaauuugaucuuuuagucacugauucauugauuaagugacauauuuaaucaguucuaagaugccacucauugugauucauaccguuauuuuaugugccacugaggagaaaaaaauacugcagaccacaguauaacaugccauugaauuugaaauacaucucaguuucacagaugucaaaaugaaaaauccuagaaucauugaaaucaaugaguuccugcuguguaucaggcucagucuacagaaacaagauuauaaacaacaaaguggaaguuguuuauacuccagcauuagauguauuuaaaaguggcuuuucaauggcuuuucauccugacugaugagguggcuuuacuuuuagaccugagcuaggaaugggggagaggcuucuaucacaaggauuuuucucuuccauuuucugagaucugagauacccgauucaccuuuuaucuaguaaccaagugacuagagagcauagcaccugauuugcuugaucugauuaaaccacuggaccauugcccagugggaaaugcagaagcauaucaacuuuuaagaugaggugucuuccccguguuaaguuaucuaagaugucuaagaaccuuuggccaaguucuuuuuauuuauaugaacauaacuagaacuaugcuuuuuggccuuuugacaaaauuaccuguaaccuuuuccccucuuucuucauuucagaucugaaucuguuaauuauccucuugauucugucccuuccuaauuggauuuuccucuagcgauacacucaaauuucucucaucuauuauauguuuuuccuaacuuuuucccacuagggaagcagccauaaaggcaaagguccauaacuguuaccuucacuuuuugaaagguauucaccccuuaacccaguuucugccugucaauucuacugaaguggcuucuuuuuaaagacaaaaaaaaauuauuaagguauaauacacauucagcaaagugcuauaaucuuaaguauauggcucaaugaauuuuuccauguguauauacauucauguagcugccaaccagaacaagacauggaaucuuuucaucaccugaagacucccucauuccccugauaguaacuauucuucccuagagguaaccucuuuucugauauuugucaccauaaauuuuuguuuacuuauuuuuugagguauaagauacuuguaguaaagugcaugaaguguacuuuuuuuuuuuuuuuuuuuuugagauggcgucucgcucugucguccaggcuggagugcaguggugcgaucucggcucacugcaagcuccacuucccagguucacgucauucucuugccucagccuccugaguagcugggacuacaggugcccgccaacacgcccagcuaauguuuuuguauuuuuaguagagucaggguuucaccguguuagccaggauggucucgaucuccugaccucaugauccacccgccuuggccucccaaagugcugggauuacaggcaugagccaccacaccaggcugaaguguacuauucuuaaguauauggcuugaugauuucuuuuaaccuaugaauacaccuauauaacuauucucuagaaaaauauauggaauauuuaauggcuuuuauaaaaaauagcagcuuuauugagauauaauugacauaccauggaauacauuuuuaaaguauacaguucaguaguuuuuaguguauucauaguugugcaauugucaucacuauuuaauuucagaacacuuucauuacaccaaagaagaacacuauauucauuaucagucacuccccauuucccucuucccgaaggcucugcaaccauuaaacugcuuucuauuucuacaaauuugccuauucuggaaguuucauauaaaugguaucauacuguaguggccuuucauuugacaggcuucuucacugguguaauauuuucaaggcuuauccauguugucacauauaucauacuucauuccuuuuuuucugacugcagccucgaccuccagaguucaagggauccucccaccucagccucccaagugcauaaccaugccucccaaauguguaccaccaugcccagcuaauuuuucuaucuuuuguagagaugggguuuugcuaugucacccagguugaucuugaacuccuggguucgagcgaucugccugccuugggauuacaggugugagccaugguaccuggccccuucauuccuuuuuauugcugaauauuccauucuaugggcaauaccacauuuuguuuauccuuucaucaggugauggacauuuggguuguuucuaguguuuggcuauuauaaauaaugcuauaugaacacucaugaaugcauuuguguguggacauauacuuugaauucucguaggcauauacuuaggaguagaauugcuugaauuuuuguuaacucuauguuuaucauuuuuaaagaacugccaaauuguuuuccaaaguggcugcacuugugagggcgaucuggcugcgacaucugucaccccauugauugccaggguugauuuggcugaucuggcuggcuaggcagguguccccuuccucccucagugcuccaugugaguccuucccgaagcugcgugcucgguugaagaggacaaccaucccaauagaagaggacuggucuuuggucaaggguauacgaguagcugcacuccccugcuagaacuuccaaacaagcucucaagguccaaaguggcugcaccaucuuacauucccaccagcaauguaugagggcuccaguuucuucaauucucaccaacacuuguuuuuguccauuuaaaaaauuacagccauccuagugguugugaugugguaucucauuccugguuccuauaccugaaacauccuuucuuuccuugccuauauucaccuauugaaaaacuauauuucaaauaguaccuccucuaugaagccuuuucuugaucacccuaacuaaaagugauugcuucuuuuuuuaaauucugcaaacauugcauauauauuucuggugguguguguauuucccuuauaucacauuucuuuguauauuuguuuuacaauuacacuaaaaaauuccucaauggcagauacaguauuuuagugaucucugaauuccuagacuccaaauccuucuaaggagguguguaugaggaggcgagaagauaaggcagauuaugauauguacaaagaggaaauauuaguacauauuuguguuuuuguugacuuguguguguauguaugugugguggauuaaauuuuggggguaccugcaaaauauucccuugggaaaauuacuuaauucuaggaacuggggcaacaauggagaaggccaaaucauuaugugcuacccucugauggaaauggggauuauuuacuuuaaggauuuauaaucuuaaaugguuuuuauaucuacagaauaauaauaaaguuguacaauguuuuuacuuuaaguuccuuccuauuuuccccacugcauaacccaacaaaauuuucuacuuaagaucaauguacccauacuagaagccauguguugagaaguuguuggaugaagauggccaaagauagugcugguaucuagauuugugucaauuuuuucuucguuuuuuguuuuuuugagacaagagucuugcucuguugcccaggcuggagugcaguggcgugaucucggcucacugcaaccuccgucucccagauucaagcaauucucccugccucagccuccagaguagcugggauuacaggugccugccaccacaccuggcuaauuuuuguauuuuuuaguagagaugggguuuugccauguuggccaggcuggucucaaacuccugaccucaggugaucugcccaccucagccucccaaagugcagggauuacaggcaugagccaccgcacccagccaauuugugucaauuuuuuaauaguuaaauuccauugaaauugagcuguuuuauucauuugaauaacucuugacugaauucaguauuucuguuguaagcuaaaaaucacagcucucuaaaccuuuuggggaggaugggauuuauugccaugguauuuguuucuuguauuuuuuuccuuauuuaauuaacauauacauauuugaccuccgauggucugcuucugacucauuagcuuucagaagcaauacauauuuggaaauauuuuugaaucaaaccaaauauauauugugcucauuuaagauauauaccuucaucucuccuaauagaucaguuuuuuguuuguuuuuuuguuuguuuuuuguuuuuguuuuugagacagagccuugcucugucaccaggcuggagugcaguggcgcgaucucgguucacugcaagcucugccuccuggguucaugucauucuccugccucagccucccaaguagcugggauuacaggcccacgccaccaugcccagcuaauuuauuuuuguuuauuuaguagagaugagguuuuaacauguuggccaggauggucuugcucucuugaccucgugaucugcccgucucagccucccaaagugcugggauuacaggcgugagccaccgugcuccccguuuuuuuuuuugaaagggucucucuuuguggcuuaggcuaaagugcaguggcaggaucuccacucacugcaaccuccaccccccgguucaagcaauccugaagccucagccucucgaguagcugggacuaugggcaugugccauuaugccuggcuaauuuuuguauuuucaauagagacggggguuucuccauguugcucaggcuggucuugaacuccugaccucaagugaucagcccgccuuggaagugcuuugggaagugcugggauuacaggcgugagccaccacacccagccaccuuucuucuuuucuugaacccuuuuguguuuuaguagauuuguaauaauggucaauuauuaucuuugagcagaaauuaacaaguauguuuuuguagugcaauagcuauguauguuuuuauagugcaauaaaguuugugaaaugagauuugccuaccaagguuuucuccuuucagaggaagaaaaaguggcuuuuguuaacuggauaaacaaagcccuggagaaugacccugacuguaagcaucuuauacccaugaaucccaaugaugauagucuuuucaagucacuugcagauggcauccuucuuuggugaguugaacuucugguuaaggaagcugcguucuugcugauuacauugaugagcauuccaugaaaacuccaauucagcuguccauugucuuuuggagucaguagcuacuuaggucaugaggaauuuauauugcauagaaaaugaacuacuguauaucuauuggaaaauuuccaaaauuuuccuucaaauacaaucccuuguuuuucuguugccuuuuacguguauuacuauaauaauugccaggaaucuuuugaguuauuugucugaugcaguuuuaaauauucgcaggguuucucuuuucuuuuuccaguaagcgaguauugauuauugacuggaaugggacaugaggaaauguaaagggaagauauuccuuauuuguaccuaaaugaaaauaauguuuugauucagccuuguguuauccuuggcucuuugcauucuauuuuuucucacuauguuguaaacucucugagggaaugucuuugucauuguuguguguaccacagucccagcauacuucuuuggacaaagcagaggucuuuucuuuaguuuauaaaaaguacaaaagauuuacaaaguagaaaauaaccaucaaaaauauccuuaccacccauaaaugacuuauuaauauucuaacacauuuccuucagucuuuuuuuuuauguuuuuacuuaaaaaggaaaacaaaaccuuacccauaaguacaggauauuagauuuuaugacauuaaauauaaaauauaccuugaccuccaccuacaauucuuaucuuucuuugacucucagagaaauuccuauuaugaaccaaauggguauuuuccuauucuuguuuuaaaagguaaaauucuaaaauauagagacaaaauuuauauuaauuucucugaaaaugucuaaauuauuggucuuagaugaaaucucuggcuucguaucuuucugcaacaacaguaauuuuaacaguguugauacuacuuuaugaaacuuggcuucuuggagaauuucuuuguuuuaggcugcggaauacugaugaucauuaagugaaauaaagacaaaacuaacauaaagaaaauucagggugaugacugggcgugguggcucaugccuguaaucucagcacuuugagaggcugaggcaggaggaucacuugaggucaggaguuugagaccagccgggccaacauggugaaaccccaucucuacuaaaaauacaaaaauuagcugagagguggcacacaccuguaaucccagcuacucgggaggcugaggcaggaguaucacuugaacccaggagguggagguugcagugagcugagaucacaccacugcauuccagccugggugacagagguagacucccucuuaaaaaaaaaagaaaauucaggaugguuaaaaaaaauuaggagaaaugcuuagauuacuauugcagugagugauggauuuguuuuaggaaugggaauauuucuuggauuuuaagaauuaaguuccggcaugaauuauaguuuaauuaauuauuauuauuauuuuuugagaugaggucucucuguuuuacacaggcuggccucaaacucuugggcucagccucccaaguagcugagauuauaugcaugugccaccaugccuggcuuacuguuuaauauuuuaaaguaaugaauuguuauuuucaaaauuuaucuauuuuggcuguuugcaauaauaaacuaaaaaaauuucuuggaguauuaaacuaaauuauucucauuuucucuuuagcaaaaugaucaacuuaucugaaccagauacaauugaugaaagagccaucaauaagaaaaagcucacgccauucacuauuucuguaaguauuugcccuuugcuuauuaucauguuacuaugcugagaaauauaagaccuuuauuaaugaaugcuuggacccagauaaaaccuuugauuuaauuguaaugcuauucuccuauaaaaacuuuuuuuuuuggaauccuuuuuuuuauuuuuauuuuauuuuauuauuauuauacuuuaaguuuuaggguacaugugcacaaugugcagguuaguuacauauguauacaugugccaugcuggugugcugcacccauuaacucgucauuuagcauuagguauaucuccuaaagcuaucccuccccccuccccccaccccacaacaguccccagagugugauguuccccuuccuguguccauguguucucauuguucaauucccaccuaugcgugagaauaugugguguuugguuuuuuguucuuguaauaguuuacugagacugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauacugcugcaauaaacauacgugugcaugugucuuuauagcagcaugauuuauaguccuuuggauauauacccaguaaugagauggcugggucaaaugguauuucuaguucuagaucccugacgaaucgccacacugacuuccacaaugguugaacuaguuuacagucccaccaacaguguaaaaguguuccuguuucuccacauccucuccagcaccuguuguuuccugacuuuuuaaugaucgccauucuaacugguguaagaugguaucucauugugguuuugauuugcauuucucugauggccagugaugaugagcauuuuuucauguguuuuuuggcugcauaaaugucuucuuuugagaagugucuguucauguccuucacccacuuuuugaugggguuguuuguuuuuuucuuguaaauuuguuugaguucauuguagguucuggauauuagcccuuugucagacgaguagguugcgaaaauuuucucccauuuuguagguugccuuuucacucugaugguaguuucuuuugcugugcagaagcucuuuaguuuaauuagaucccauuugucaauuuugucuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcacuauuuauuaaauagggaauccuuuccccauugcuuguuuuucuccaguuugucaaagaucagauaguuguagauaugcggcguuauuucugagggcucuguucuguuccauugaucuauaucucuguuuugguaccaguaccaugcuguuuugguuacugcagccuuguaguauaguuugaagucagguagcgugaugccuccagcuuuguucuuuuggcuuaggauugacuuggcaaugcgggcucuuuuuugguuccauaugaacuuuaaaguaguuuuuuccaauucugugaaaaaagucauugguagcuugacggggauggcauugaaucuauaaauuaccuugggcaguauggccauuuucaugauauugauucuuccuacccaugagcauggaauguucuuccauuuguuuguauccucuuuuauuucauugagcagugguuuguaguucuccuugaagagguccuucacaucccuuguaaguuggauuccuagguauuuuauucucuuugaagcaauugugaaugggaguucacucaugauuuggcucucuguuugucuguuauaaaaacuguuuuuuaaagagaugagggucuugcuaugccacccaauauagaucacuguaaccucaaacuccugggaucaagugauccuccaaccucagcuuccugaguuguuagggcuauaagcauguaccacuaugcccugcuaauuuuuuaaaguuuuuguggagauggggucuugcuguguugcucagucuggucuugaacuaguggccucaagugaucuuccugcuucagccucccaaagugcuggaauuauaggcaugagccaccaugccuggccaaaacuggauuuuuauuaaauaaaaauucaguuggauuuuguaaugaaugaaaugaagauucaagguacuuuggaugcacuuacuuaagcuguaguauucaguuuauauuauuguaauuguugaauuauuuauuaaugaacaccuguuugaugccagugcucuuauuaggugguugaaaaagaacacugcaguuuuaucauuucacaaaauuuuaaacuaaucuuuuuguacuaaauuguucuguaguuggcuccuccauacagaucuuguauaaguccagguauuuauacuuaccacacuuucccccucaaaaucucuagaacaaugaguggauauuaauauuuacugaguacuuacuggguaucagucacuguucuaaacacauuauguaaauuauccucccagcaacuuuauaauaagguauauacuaugauuuuauagaugaggaaacugaggcacugacagguuauacagaggcagagccaggaugugaucccagucgucuagcgccagagcucauuucuuaaucacuguguuacacugccacucucauguggugguaguaauagcaacuauuuaaggugugguuacaauaguagcuauuaaaauucagcuacuguuaaccuguguccuucauuuggcaagugcaauccuugauuucacuaaaauuguugagucuucuauagaaagcuagucuucuauagacuauuacccccugcauauuuuggaagugugcuaucuaaaaauaaaacugcaugauagccucucagauccacucuguggcuaccgcaaaauacuuauagaauauuuuuucuuuauuuucuuuaaugcacuaaauauaaauauuaaaguaaaaccaagcaauaaauguauacgauaguaagaaaugcuguauuucagauugagugaccaaaaaaaggucauguauauauucuauaaauaagauagauguuaauauuuucaguaaucauggauauuagaugaagaucccaguacaacaugugaacaauaaucuggcaauugcaacuggaaauaggcuucuucaagaaugguaauuucuauuagugauaugcaacauuauugaccuauuagcaagcaggggacaagaaagccauguagucaacauccaauucuuuacuucucaaagauuacaggaaaugagggaaccuguuagacaguccaagccuaaccauguaccacugcccuaagaaggcagggccaccucucuugugucucuuguguugccaccaguuguuugugguucccuacucucccuaucuuuccgcaucaacacgagucuucaggaaggcugggcauucagggcaguuguccaugguaagaauuguauagcaacuucuccaugggguucuccuguuacuucuuguucuuaagauguuuagaaguagcuuaguguggccguuccauucccuacuaacugguagggcaauaauguuguauuuaucaaguagaaacuaccauuuacuugaaagaaacauguugcaacuccuuauuuucuacccauuuuuaaagccaaauuacuuuaagacauuugauaugcuuguaaagcaaacaucuuugauaaaauuaacaucaaaagcgguuuuucuccuguaugaccaacacaacccguugauaagacaaagcugaguuaacuguuuaaugcaguaagagaaaauacuugcaaagcuuuguuagugucuuggugcugggaaagugagggcagcaucugagaauuggaauugugguuuagggcaggucuuucaauaugagagggggcaagagggcaagauugggcaagauucucaauacagcagcccaagauugguggcaauagcaaggggaggauuuuaaggugaggaggucaaagaaucuuagaguauaaacugucauugauguuuuauuugaagaguuaaugggucuuuuagguagcgccugcagugaaaaaucagaccuuuugccuagggucaagacuccuggaagaauaagaucaugguaaugaagacagagaguaaagucaugccagugaagacaagaggauagcacacaaggucauauuaauguaggcaguaagaugugguuuuguuugucauuguccaggcugagaguagugguagguuuugguucuuacuaguauugcaaucaauuuagcgaaauuacacacuucuuuuggcccacaguaccaugcugucaacugcauaugacauggguuauugugagguuaauacuauuauuggcuuaauuuucaguccaguucuuuccccugcugaugcauucuggggaaucacaacuggagcaaacaucauuuaugcucuuggaagcaaagagaaaaauauuaguggucaugccuaaaucagcagaagcugucucuugaaaguugcauagauuugauuuaagguaacuuaaaaaacauuugaagcaggaguguuaauuaaaaacaccugaaguuauuaaaaaucuuagauuuccacaaaguauuuguaauuugcuguuaauuuuuucauguuuauguuuauuuguaguuaauuaugagguuauaaaaauauugaaggcuucucugguucugcugcuucuuucaggagaacuauauuuaaaugaacauugcuuaauacuacuaccaaaauaauucaaaaugcuaauuuuaaucgccccagacgaucccccaaagauacagccauuuauuuacuuggagcucaauaaaucacuucagcacacuguaggaggaagcugcugaaauauucacuaugcuuugagaaccucuaugcuuugcugcuguugugaccagcccauuaaauugucgcuauuacugcuacaauaugagaauggcaguaaugcauggcgauuaagaggaugggcucugggccaggugcgguggcucacgccuguaaucccagcacuuugggaggccgaggcgggcagauuacgaggucaggagaucuagaccauccuggcuaacauggugaaacgccaucucuacuaaaaacacgaaaaacuggccgggcgugguggcgggugccuguagucucagcuacucaggaggcugaggcaggagaauggcgugagcccaggaggcggagcuugcagugagccaagauagugccauugcacuccagcuugggugacagagugagacuccgucucaaaaaaaauaaauaaaaaagaggaugggcucgggagaccgcugggaucagaccccggccuuuccacuguggaaacugucagugcugcaguuuccucaucuguaaaauccaucuuaagaguuacuuuaaaauuaucuuaaaaccuaauuguacaucauuuuuuaaagaagugcuuccaaaugagcacuuuacaaaaauaucauguugaguuugagguauuggcagaacauccagguagacauaaccaaguacauauauagauacacagcuuagaguggagacucagaggaggucuggguggaaauagggauuugaaagucauuggcauauaaaguaacaguuaaaaccauguguuuuuuuuuuugaguagugguauuuucguuguauaaauauuauguuuauaaaucugaaauuuggcaguccauuguuucuuauagauaauuuuuauagauaagaccuuagaaaggacuuccucauguguacuuuuuuuuuuggcaauucaggaaaauuuaaaccuagcucugaauucugccucagccauugguuguacaguggucaacauuggugcaucagaucucaaagaaggaaaaccucacuuggucuugggacuucucuggcagaucaucaaaguuggccuuuuugcugauauugagauuuccaggaaugaagguaagaucauuagaaauauuugcuguucauugacauguacuugcuaugggaagaauuuacauuucgcuguuuugcccucagcucugauugcauuguuaaaugaaggugaggaacuagaggagcugaugaagcuuucucccgaggaauuacugcugcgaugggugaacuaccaucugaccaaugcaggauggcauaccaucagcaacuucagccaagacauuaagguuuauauuuaaauguucaaauuugugacaugaaauaaggaugugcaguguaaaaauaaaagggguucagacuuaaauuugaauuaaauucacaagaacacuugggauagaaaaugaaaauuugcauuacugugugaaguagaucccccaauuauauucacaaaauauauauuuucuaaaaaccagauauauuggcuuuuaauaagaacuacaacugacugugagaggaaagaggugcuagccucaacagauuaaaacacacuuucucauuuuuuaugccugagaucugcuagauuauaaugaggaugucagucuguucauuuggacuaauaauuauaucuguuuacugguuuaacacucuuacucccacuuugccaauaaccagcuaacaggaaaucagauuaucugaggguacagagaaucaguaaauaaaggggaucuuaagguaugugccuuaaccaggguagcuuaaaacacuucccucucuacugggagaaucuugucaaggaaacuauaacaggcauuuuugucuaaugacaacuuucccuugguuacugccuggaugggcauugccaagccgggucgcugugacuuuuuucuucucucuguuucuuuauguccucccccauccugccccccaagaguaaucagugcuggcucuaauucauguuccgucuuuagcuauauaaccuucagucagguuaucuuuuuccauaauggccuacaggacagucucucaauuugaagugacauuuuauuucucugcuuucaucuacuauacacuguuauauuugaaaguuuauuugggagauuucucuuauucugaaaucucugaaaauucagcuaaucaaacauuuauucagcucuuucugaggggcauuaugcccaggcgaugcaaagacucagcucuugagaagcuugccaauucuacucagagacaaacauguaccagagggauauuucaguuaucuauugcuauauagcaaauuaugcaaaauuugcuuaaauaaugauuauuucucaucauuuuguggguugaugcaucuuggcugggugguucuucugcuucacaugguuuuggcugggauuacuaacucgauuacauucagcugucaguugggcucaucuggaaaguacacaaaggccucagucacaugucuggugccucagugcuccuccacaaggccucucuacauggugagcucaggcuuccucacagcaugauagucucagauaguuggacuucuuauguagagguuaacuuuaagagagaggaagcagaagcucuuaagauuugggcguggaagccccagaacaucacuuucacagcauucucuuaguuaacgugaaucauaaggccuguccaaauuaaagaggacaggaaauagcuucugccuuuuggugggaagaguuaauguaugcauggggaagaacuauauauccaucuuuggagacaaugacauuagaugauuuaauagugugaucacuguuuacuuauuaagauaggcaaggggugcugugcacuacagaagagggguucuuaguucauccuagagaauccagggaaggcauacgggagauaauacuugaccugaaucuuaacugauguugaugcuuggguguguaaacagauggaaaaguaagggaggguauccaggugcaggaaacagcauugcuauaaacucugaggugugaaacaggauugcuuugaagcucugaagugugaaacagcaugguacauucaggaaccuacaaguaauucuuuauuuuuaaaguuauuccauucuuugagauagaggcaauuucuucaguuugagcacuuguuuucccuaaauucaaugaugauuuuauucguuuuaaaaaugcuauuucauaucuuuccuugaaggacucgagagccuauuuucaucugcuuaaucagauugccccuaaagguggggaagauggaccugccauugccauugaccuuucaggaauuaaugugagugcaauuuuuaacuuuuaaaauauauugugguaaaacagacguagaaaauuuaccauuuuuaucauuuucaguguucaguucaguggcauucaguacauuugcauuguugugcagcuaucaccauuauccaucucuacaaacuuuucaucauccuguagggaaauucuguacucauuaaacaauaacuccccauuuuccccuucccccaggcccugguaacuacuguucuacuuuuugacuaugaauuugaauuucaguagcagguacagucaaauuuagaguacaguucucuacaagcagcauuccccaguagagcccucagcccuccauuaaaguuuggugcuuugcucuauggaaguuuuuuccaugcccaaggcuccaagccuccaugucaagccaacuggcuaucaugacggaagaaagggaacugcguaauugugaccuggaguauuuguggaaucaauccuacauucauguuucccuggugcaaggcaauuggaacucaccagggugcucuuuugacugucagcauaugccaggaaaggaagcaacaaccuguuguuagauuuuuaagcaaucaauuaucaguuuuaccagcuuauauuuagaaaucuacaaaauaaaaauagauauucaugguguaggaaggacugauacagauucugaccuaccaagcauacuuccuaggaaucucauucuuuuagcauaaguuauaaauaccagggaugguucuaucuaaaucaggauguccagucuuuuggcuucccugggccacauuagaagaagaauugucuugggccacacauaaaauacacuaacacuaacaauagcugaugagcuaaaaaaaaaaaaaaggugcaaaaaaaucuaguguuuuaagaaaguuuacaaauuuguguugggccacauucaaagcuguccugggccgcaugugacccaccggccguggguuggacaaacuugaauucuaaacauuaaaauuuggucagauaauagacuguaugaaaauauaucacguacuuaaagugcggcguccguaacauuugguuuuaaaggcaacuugagucauuacuaauuaauuauaucucacauuauuauaaugacauauuucagaaacacaguauugcaacgcucuguaaaaugugcaaaucauuuuaaguaaaaaaauuaggaacuuaaacuuauggaaaauuuugaauauauucaagagaacagacuuaguauacuaaacuaucagguacucaucccucaguuucaacaucugccaauucauggucaaucuuaucucguuuauucccuauuucucuccucuccuauauuauuuugaagcaaauccuagacauuacuucauggauaaauauuucaauauauauuucuaaaagacaaagacacuuuuaaaauaaaaccacaauaccuuaucauaccuuaaaaaaauuacaacaaucuguaacaucaucaaaauaucuagucaauguugacauuuccacuugccucauaaaugccauuuuuuucauaguuuauuugaauuaggaucuaaaauaagguccacauguugucuuuauuuguuuguuuuuuuuuuuuuuuagauggagucuugcucugucgcccaggcuggagugcagugacacaaucuuggcucauggcaaccuccgccuccugggcucaagugauucuccuaccuccacuuccugaguagcugggauuacaggugcacaccaccacaccugguuaauuuuuguguuuuuaguagagacgggguuucaccauguuggcuaggcugguaucaaacuccugaccucaagugauccgccugccucugccucccaaagugcugggauuacaggcaugagccaccacguccagccacauauugucauuuuuugaugucuacaaugguaacuuuucuuuguuaauuuaauaaucuguugcuuucucugauuucauuuauaugauuaauuauuuugcaacucuggugcacagaauuagguagguuaucuuuggucaugauauacucauaugggucugugcauacccauuuuuaaauuuauuuuugugugugguuguuuguuuugaaauuguaacaagccucaugaacucucaaucuaacaggaaaacuaaaacuuugacgugacauuuucuguacaguucuucccuaucccaccucgguuuucgcccagugugguaaccacagucuugaaucuuguguucauuguuguucugcuuuucuuuuuauguaguuucccuucauccaaauguaucccuuacaaaauuaaauucuucauuuuacuuuuuaacuuccuuuaaaguuuaucauguuauacuuaaauuucuaguacuucuuuuuggccuuguaucucuaagaguuacccauauuggaugucauugugugaauauacaaauucauucaucuacucuccuguuuauagguauuuggguuguuucauuuguuuccaggguuuugcaauugugaaaggugcuuuucccuaugauuuuaauuuuuaaaauauguauuucaacuuguuuuucaucaagaagagccuucuggaaaugucacucaguguacaguggguaugauaacuaugccuguuauccagagggcacucuacuagcuggucuugaauaaguuaucuauagugcaaccaguaggagcuuacugauacaauauuugaggauuuugcugaguauuuuagcaaaaaggguaaaauauaacucaguuaucccagcaaggaaauucagagacuuuuuuccuuuuaacuuaaaaggcacgggggcugggcuuaguggcucacggcuauaaucccagcacuuugggaggccgaggugggcggaucaggaguucgaaaccagccuggccaacauggcaaaacccugucuuuacuaaaaauacaaaaauuagcugggcauaguggcaugugucuguaaucccagcuacucaggggcugagggaggagaaucacuugaaccuaagaggcagagguugcagugagccaagaucacgccacugcacuccagccuggggaacagagcaagacucugucucuaaauacauaaauaaauaaauaaauaaauaaauaaaggaauggguaaguugacuuggaauuacuacacauuuugaucuuauuuugaguuauuauuugauauauuuguggaaaaguaauugcuuauaaacauguauaccaauaaaaauuaugccaauuaaaacuucaauuguaaccauuuuuguuuuauuguuuaggagacaaaugaccugaagcgugcuggacucaugcuucaagaagcagauaaacugggcugcaaacaguuuguuacuccugcagaugugguuucaggcaauccuaaacuuaauuuagcuuuuguagcuaauuuguuuaacacauacccgugccugcacaagccgaauaauaaugacaucgauaugaauuuacuggaaggugcguucuuucugccuuuaauugacuugcuauauuuaucuucuuaugguauugucuuacuucacugucagagauaggggauuguggugggaaaugcaauuuaguguguguagguauguguaucuauugaaaaauuaaaauuauggaaggugguugcugguuuugguuaaaagagaaugcugggguaaaucuuuuauuucuccauaagagguuagugaaaacuaucauacauuuaaaauauucucauaaaugaucacauaacagcucuaccaccaacauggacaaugaauuaucuauuagaauaaaauaauuauuuguagguguuuuucuccuuugaaagguccaguuugacucuaguauuguucucuuuuuaagguuuuuaguguacaugaaaaaaauuacaguguucguuauuugucuuuuguguggucuaucguuaucugucucauaauauauaauacuuuccuguuuugcuucaugaaaugcagauuugaccccuccuaauguagguacuguauuuaguacuuuucuauacucuauaaauauauucauucugaauguucuuuuuauuaguaccauuuauucuuuccaucuggguugauauuuuacuuuuugcauuguucaugcuguguuauuucucucuuaauaugcccauagaaugaaacacaaauaaaacuuaauuagaauagcagaacaaagcuuugauuuuguaaaauuucuaccuaauuugccuucuauaaugaugggauauuguaguuguaaacacauuagaacucaauuuugagaacuggaauucaugauuugauguaaaaucuuuauccuucuccugugacaaaaugucaaguaaucuuugaaaggauucauuuagguucuauaacauauuauuuuguaucaauuagcuauguuauauuuacugaaccucauugaagcuuacaguauaugaaucauaauaacaaaacauucucaauacccaguucuuacucauuuguuucccagccuuucuuuuuuucccacucucauacauaccaacacccacauuaguaucagaacuuaaaguaaaaacaguggcagugguaauggcaguuguugaagggaaaggcaguugucagaggaaggcgccaaucuuaagauuuuucuugcuaauugcccugguuuggagaaagcagggauucuucuugguggggagaguaugaugugcgguauucaugaucucaguguucauucucucacaaaacucacacuuaucccuucuuucccagugagacagaaugagaaaucaauuucaugaucuuuuucugcuugacugccauaaccaaaguuccaguguccuugucaccucauaauuacaguuuugugauuaaugaacgacguuucagauuuaacaaauauauucuucaaagaauaugaguaauucauucuucuugaaggucccguaaaauaaaauaaagauuauauuuucuauguagauacguaacugagagggaaaauagacaaaaaauguagauuuuucagcgaagagaaauuuagggugagagauuagaacuugaaaaaaaauaagcaaaagcaacacuguuagguuuuaucagucuggaaaauuucaaaaucccucugucaguagaaggcauuguuuagaguggcauauuaaaaaugaucugcuuuuuauagucacugaauucuugcuagguaucuuuuccaacuugcucgcuuucuuauuuuucauguuugaauucuuuuugcuaguguucagcaugcuuuuggaauuuuucagugugaauaggauugcuaaauauuuccauuauuauuuacugucuauuaagauaacaugggaaauauuuaucagucaucuuuauuauguauguccucauacaucugccaaaaauguauuugacuuugacugucauuggauuauuuuccucuguaaauuuguguuuuaauauauccuuaugaaauuugaagcuugaucauaucacaucccaaauucauauguuaguauguccucauuggcagagaauuuucucucuagggaauuaaauaaaacacaauuaaauauuaaacgcucacaucaaauugaaccagauaugugggcuacguacagaaagaucaucucagaauucauuuaugauuacagaagguacacaggccauaaacuaucagacuuuguucaaaucauaguuccacuauuuaaucugaaugaccucugugagccuugguuuuuuucauauauaaaacaagacuaauaaacuuaauuugaagaguuacagagcaagcuaaaugugaucaugaauggaagaauacaguauguguuuauuaauggucagggagggaggaggaaagcacuucauaugucacagcacauuugaguguuaaauauauguuaacuccucuuuucccucuuaguaaccuacuucuaagauauuuguuauuuuuauuacuauuuuuuauuauuuguagacgucaaauugagccugcaaaugaaaagaauguuuuauaguucuuucaaucuuguauaucagcaauuaagauuuuacuucuugaaauuguauaucagaucuagggggaaaaaaagguuuuacuucuaagauugcuuuagcugucuauaauccagacaacauuuuccaaucuggaacacauauaucuuuguaaugcuuuaccauggcuguugcacaaaugcauagugccucuagcuuugagcauuuauuuaccaagacacuuugaaauguuauuagauaaauaaaugcucauuuauaaaaucuauuuuacuuuccagguaucaaaaauuaaaauaauuauauaaucaguugagaacaauaggaagaaauaugaacccccgaagauaguuucagaacucaaucaaaaugcaaguuuaguuauuuuaaaauauuauucacugcaucauuagguucaacagaauuuggauauuuuaauuaaaaauuaaaccauuauggcacuauuaaucuucauaauuuuaagacauuuagauuuuccuagauggaaauaauguaaaacuucuguaacuauuagaaacauauauauauauaucuuuaugauagauagagaaacaacugagagguaaauccaaaucaaaggcaucaaguuauugaucauaguauguuuauauuuaugucacuuuggggauaguucauagauuuaauuuguaccuguuuaauaauuccuacaaauaaggcuggcauggauucuagaaauauuuaguuuagcuugguuauucuuaaaaaaagauucucauguagacuguuuauuauaaaguggugguagcagauacaacagacugaucaguuaccuuuuaugcagaccagagggaacaaaauuuaagcaagaaauuauagggcuacauaauagagcaauaauuaaagcagauucugggaaagcuguuagauaauggcauugaaaucacaugaaacuacaguggguagaugauuuccugaacaguuggcacaaauaacagaauccuuuagaucugacaaggcuugcguuccuaucaugggugugcagguuuauacugucuuuggcacucaaugugaagaugacuguugcaaucgcucuauacgaacgagccccuggaacgcagaugauuauagauuuaugugccaaauuguccugugagucucacaugggccaaaaucuagagagugacuugaacuugccuauaacuuagaagugaugacagguguaaauguuucaguuuuucaggagucugcugauaagauguaaacuaggccauuccacugucuaauaacuuugccgaagaacaaauaaucaugauaguuacuuagaacuauuugcagucaggagaugacuagaaggcagacaguggcagagccagcccacaucccugcucacuuugugguauacuaugacccgcauuuuccuuauagaugauguaagcacuguuacaaagggaaugcucagggagguaugguuaaauaacagcaccugaaggaguuaucuccuugaggggaucuuugagguccaggaacuuacuaugaugaaaucugucuuucucuuaucaaccuguauugggucuguguuccuuauguauuuucaguaaugauaaucuaaacuaacucaggaagccuguaaaauaguuauauuccccucauuguguguuuuuauauuuaccuguaauccccucugcccuucauugugugguguaaaguguaggucugugugcugagaaacuuuccuauguaaaaccauaauuuguacaaauuuagaaacacugcaccgagaaagguauaacuuuucuauuuguguuuaaugugcuaauguuacccugacugcgaaaacauuuuguuuuuauuaauguuuagugaaucccuuuugcaucuaaucauaauuauagaccacagaaguguaucuguuauuucuagguagagaaacccauggcucaguacuaguucacagacaucaaagggaaucuagaaggagagauuuagagcaaauggaggcuuccuagauaguaggaaagaagggacuuuggcauuaagagacuuuuuuucucccuuuaaagaaacuguaguaucuaaagaaccauggcaagguagguuugaccaguuuguaccugcuagaaugguuuaacauauaguuccugguuccuuuuguccugagucaucagugugagcuugugucuacucuaggagagagcaaggaagagagaacauuucggaacuggaugaauuccuugggagucaacccauacauuaaucauuuguacagguaaauauuuuauugugcuucagcuuuacugucaggguccaacuuuucaaguuucaaacuguaggcauguuuaaauggaacauuuucucaaguugcaagaauuuuagccaauuuuuagaguuucaggaugcugggaauuggcaauacaauggauuuuaaaagaaagcuacuauucaaaaaaggaauaauaguuauguuuuugaugauauacguaaaucaguaaagauaauccuuuuuuauaguuauugauuguaaaaauaauuucaacuuuaacagauuagaguaacaguaauaacugauaaauuguuguuauaucaguauuuuuauuaugucauuuuucauuuauuuuugccaaaaccuuaauuauuccauaauuuuuguguauauuuuuuucuaauuuguaaaaguaacuuguuuuccuugaauaauuguuauagcuuaucucauucuuucuuguuuaaaaaaugauaacacauuauugacauuaguagggcuaagaaaauauuuuacuaaaucaacuccugggcuaacgaugcaucuuucuaaguguggaugagaggaaaccauucuucucucuuuauuauacaaucuaccagccugccuugauaaagugcaaaauaagccaacuucagcuaguuguauuuuuuuuuagaaaaaaguucuaauuagcuaaauguauuaauaauuuauauacccaagaaacuccuuaaacaagauuaugauuaacuccuuaaagaagauuaaugucacaacaggccaaguucacugguucacugaggauuuaugauguuguaauuucugcuccuugguguuuauucacaauguucuuuaaaauugaaaaccaguguuaccuuauuaugguaacuggcuuugaugugauagacccauauuuguaaagcucuuaaagaguguguaaauuucagcuggaugaggagauauacgucaauuagaccagagcuccuguuacaguagcagggaaguuaaaacacaaauauugaaggugaggagggauucacuuuuuauggacugauuugaaagaaugucuauaauauauagucaagaaaaaagaauaacaggucuaguaugaucccauuuuguuuacaauuugaguguguggauauuuguauucgaauuuuaaaagaaaaucuagagagguacauagcaaacucuauguagccuggguaguaggaguagagaauaguaaggagacuuacuuauuuauuuauuuauuuauuuauuuauuuauuuauuuauuuauuuauuugagauggaguuucacucuuguugcccaggcuggagugcaauggugugaucucggcucaccgcaaccucugccucccugauucaagugauucuccugccucagccucccaaguagcugggauuacaggcaugugccaccacgcccagcuaauuuuguauuuuuaguagagaugggguuucuccauguuggucaggcuggacgcgaacuccugaccucaggugaucugccugccucggccucccaaagugcugggauuacaggcgugggccaccgugcccaagacuuuuacuuuuaaucuuaguaacuuaaacaugauugcauuuuuuuggaccaugagcauguacuuuucuauaauuaaagaguaagcuuaaaaauagcagauuaaaucgauuuguugauacucauguaauuauuucauaaaugucaggaacacuagaguucuaucacugacaguggagaaaagaauugaccaaaccuuuuagcuaaagauaucugaagaauaucuuuauucaagaaauaccagcauagggcuucugagcauauaguauuuuuucuugcaaaaagaacuguuacuuucagaaaauucuuaaaaguaacauaaucuuggagaaccgucagauguagaagaacaauagguggacaucuaguugacacuggaaccauguguccauagaauugugucugcaucauauuccuaaacccacccccaagaauuuuuagguuccugccuauaguauagccagcccauaccaaaacagcuagauuuucacugaaaauucucuucucuaaaauguuauauauuucaagaacuauuaguccuagaguuuuucuaugaccaguucguucuagaacucaucuugaagucucuggaaaucauuuaaacucucuggaccucaguucuauuugcaaaauaauaauaauaauaauaauaauaauaauaauaauaauaccauacuagacaggaaugagaaugaauucauuuaaaguaaaaaagaaaaauacaugaaacauaagauuccagaaccuauagaaauacuucagugauuuuuuuuuauacagaauguuucaugugccuaaagauaaucuauucagaucuuaauuaccuucauaucagacuuucucccucuaucacccaguacugggcccagcucccuucacugccauaugguuugugcucagagaaugcaaaguaauuuaauaugaaccuuagcgaaacauaacuuauuggacaagcuguuggaggagaaaagccauauaauauaucacaaagcuagcaauuuaaaaaaucaauugcuauugcuuuauguccuuagcauacagcauugaaaauagacuaaacagccauacguuaaccuucucaggagaacauauuuuucugaauccaaaguaguaauauuuuuacuuugagaauuccuacuuguucauaaguuccuuccucuuaacccucauucccgaacacaaacagcugccuacugaguagcuauugugauuuuccuguaauuauguuuuaaguuaaaaaauaauguauaaauaauacaggaacuuauucuuacuguacaaguuuuaggaaguauguaaguauauggaauaaaauaaaacauuccacccuuacucucucauacuccccuuuuccugaccucuuucuuuaccuaauagagguaauugcuauuaacuguccuuagcauauauagguacauaaauacauuugacucuaaauuuuuuuaaauaaaugagaucaaauuguaugaaguguucugccauuuucuuuuuaaaauuugauaugucuugcaaagcuuuucauaucaauacauagagaucuaccuuauguccaaugguggccaaggaguuuauaguauaguuuacuuaacagcucccuacugccaggcacuuaaguuguuuccaaauuuauaaauauuguggcaaugaauguccuuggauguauaccuuuguaaauauuuauguaaacauuuuggacagauucuuagacuggaaguucugggucaaaugauauguccugucauucuuuaagaauuaaaugacuuauguucuuaaagauauaagucuaucuccaguguacuuaauaaaauuagguaauacccaacauuuccuccuccuuuaucugcuuuuccuuccugcuucagugaccuugcagaugcuuuagugaucuuucagcucuaugagaugauccgagugccagucaacuggagccaugucaacaaaccuccuuauccugcccuuggagggaacaugaagaaggugaaugaaauaauggccauggauauauuguuauuguucugauaugaaacaaagaauuuagaguuucaugaaguuauacgugcucuguccccacaauucugauucagaccaaaauguguuaagcuuaauagccuuuuuacaaguuugcuuuaauaaauuugaagaugaaggcaaucccucuagucagacacuuuauauaacuauuuucaucuuuaucaagucauaguacuuaauguucuuugagauguccuguaaauguauucuuuuuuuacaauugguauaacguucugaauguuuauugguuauccacucauuuauucaacagauauuuaucaauuaccuaauaccuauacaguguuaugcaggauguaaaaaaaaaaaaaaaguauaaagcauggaguugguccucaggaaagccuaaauaaauuagggaaauaugugugcaaacaacuacaauaugguacaugguaaacaaaagugaauauuaugaguucuagggaagaaaguugaagagcuacugaaauaguaauagcaaaaugggaaagacacaugaaugaacaauucauagaaaaauaaugaugaauaauagaaauaugaaaaacuuuucacccagaauaaagaaaugcaauuuaaaacaagaaacuauugaacugcauccaauguaagaggaaguauucauuuguauaauccuucuaaaaccaguuugucaauacauauuaaucuuccaaaaaaucuuuugaccuaauuucaccuuuuuccaccuauccugaugaaaaaaucagaaagacacaaaguuggguggcaaaaugcuaaucauagcaauguuuauacagcacacaagaaaacaaccuaguuguucaguaaaggguuaauaaaauugauacacccauaagaugaaguaaaaugugccauuaaaaauaguguuugacaggaacagaaaaccaaacacugcauguucucacucauaagugggaguugaacaaugaggacacauggacacagggaggggaacaucacauaccuggaccugucagggguuggggggcaaggggagggagaguauuaggacaaauaccuaaugcaugcagggcuuaaaaccuagaugaugggggccaggugcaguggcucacaccuguaaucccagcauuuugggaggcuaaggcagguggaucaugaggucaggaauucgaggccaggcuggccaacauagugaaagcccaucucuacuaaaaauacaaaaaauuagccaggcguaguggugggugccuguaaucccagcuacucgggaggcugaggcaggagaauggcuugaacccgggaggcagaguuugcagugagccgagaugugccauugcacuccagccugggugagaaagcaaaacucugucucaaaaaacaaaacaaaacaaaacaaaaaccuagaugauggguugaugggugcagaaaaccaccaugacacauguauaccuauguuaacuauccugcauguucugcacauguauaccagaacuuaaaguauaaucaaacaaacaaaaaauaguguuuuaguaauagugguauggaaaugagcaggacacaaaauuauauauauacauaauaugaaucuaauuuguucaaaauacauaacacauacagagauguauucaaaagggacuuuuaguuuuccacaucuauagaaugaaaauguauuuauagacacuaauuuuaaagaaaaaaauuuuaaaagacuuuuaaagggaaauacaucauaauauuaaaguaguuaaaugggugguauaauuauaaagaguuacucguauguuucagcauuucuagucauuggacugccugcauuuuuaauuucauuugauuugcauauaauucuuuucaugggaguagaauucagaaaauuuauugacuaauuucauguaaguuuuuucuccaaaauuuugaaugcaaaauguaacaggaaaacagaaauuaaccauucauuauaccuggaauuuuaaugugaacuacaaauaaauacauaugucacaaaugaaucauaugcagaauacuuuuucaacaaauacagaaugaaacauaaagccugaaauaaauucaagauguuuaaaaaaugaagaagcaguacuuucaugacacaguaucacagggaauuauuuuauggaauuugggcaauaaucaauacaugucacuuuccuucgcuuacaaaguucuuaaagcugcaccauuaaaauagccuuucuucuucauuauuauuauuauuauuuuauuuauuuauuuauuuauuugagauggagucucgcucuguugcccaggcuggagugcaguggcaugaucucggcuaacugcaagcucugccucccagguucaugccauucuccugccucagccuccuaaguagcugggacuacaggcgcccgccaccacgcucggcuaauuuuuuuguauuuuuaguacagacgggguuucaccguguuagccaggauggucuugucuccugaccucgugauccacccgccuuggccuccgaaagugcugggauuacaggcgugagccacugugcccggccuucuuuacuuuuaaguauuucuuuucacuugaacccuugugucccauuauguaacucuucucauugucuaaaugaucuaagcuucauuuuuguccaaagcauuuaaaguacuugguaauugauaugguuuggcuguguccccacccaaaucucaucuugaauuguacucccauauucccauguguugugggagggacccagugggagauaauuugaaucaugggggcaguucccccauacuguucucauuguagugaauaagacuuaagagaucugaugguuuuaucagggguuuccgcuuuugcaucuuccucauuuucucuugcugccaccauguaaauagugccuuuugcuuccugccaugauucuauggccuucccagccauguggaacuauaaguccaauuaaaccucuuuuucuucccagucuuggauaugucuuuaucagcagugugaaaacagacuaauacaguaaucauuucuuccauuaacucugugagacugcacuccaaguuuuucuugcuuucuuugugcucauucuuaccuugcauagguucuucaucuuuuagccugagaacucaguauuuccaaggccugguucuugggccaaaggucuuaacuuuuauauuuacacccucagggagcagaucuguuuuuaguguuuuaauugcagguugaguaucccuuauccaaaaugcuugggaccagacauauuucagauauuggaauauuugcaguauacugguugagcauccuuaagcugaaaaucugaaaugcuccaguuagcuuuucuuuugaguauuguguuggugcucaaaaaguuuuagaguuuggaguauuuuggauuuuuggauuuucagauuagggaugcucaaccuguacuaccauacacauggauuaccucuaggaaccuaauuucucauucuuucucuaguuugguaccucucuagaucucuuagaaguguucugccaaauuuggaaccaaauauugcccauaaaagaauauaugcuuucccuuaugcuagcaccuauuuccaguuucucuuucaaugcugguccuaucaauauauucuuaggccucuauacuagcaacccugaacuccuuucucaccaucaucucccuuaggaacuuugguagaacuguaaagcagauggcucuucauugaaacacauuuuacacaugugauuacugcaguuugcuauaaaauucucccacugaacuggguguccaugguaaauaugcuggcuuuuuacucuccuguacacaguguuaaauaauucaagugcuaauguuauuuuccauaaauuaggaaucuauucuauuuuuuaaagucuacauucuuacagcauauauuucuuuuaagcgggcuaagccuauaauaugauuccaaaaaauguuuuggaauauuaucucugcauuaaaaaauucuuuuaaaaacuuuuuagaaguaggguuucacuauggugcccaggcuggagugcaugcuauucacaggcgugauuauagcacaauacagccuugaacuccugcccuuaagugauccuccugccucagccuaaguagcugggacuacaggcaugugccaccacacccagcuucuccuuggauuuuaaaaaaaugaauauauaucaaacauuuuauucaauuugugaaguuagccaggcagauguuacagcagguuccaaagaucuuccauuuuuauuuguaguaaauugaacuuugggaauuuggauucucuuuuuuaagaacaauaaccauauauuuguacaaauucuuuuauuguauuagcugucucacauuuccugcaaauauuuucuuacuauuggggaaaauguaucuguguaccuuagguuagacuguuuuguaaugguaccuuaacuaacucguggaagaaaauuaagaaaaguaguguucuccuuuuaaguguuuauuccaaaaaguacuuaguguaagcacuuuuguuccuacuggugauauaagauuaugagagcuuauaauuucacuggagcaaaaagacucagauacauaagaauuuauaaguucugauguaagaaacacagcaguagaugaugcagguaaaaaacccuauugacuccaggauagauaaaaaaaauuauuagagaaaggaccuaacuggacuuauaucacuggaaagaaguauugugguuggggaggguaaacaauuuauuagguguuuauguaucagauucuuacuuuaggcagggcauugugcugagaguggggacaguaugauauagauuugugcacguaaaaauuuuuguccuuuagaagaagcuuauacucuaguuguugaaaggaaacacauacaaggcuaaguauaguagaagauggugcauaagcauuacaaaguaagcauucuuaggaguucaagcaaaggauagaucauuauuagcugguacaguuaagguuaagccuuuauugaagaaagugggccaaaagcugaauuucagaggauaaguaagaucuggguaaagaauaucggagaugaaguuagauucuuaauaaaacaauuacuuucuuuucuauuuuuaaauuuuaaaucuacacaaaacaucaucuauuacuucuaugaaaggaaagcaggacaccuagguuuuuaggcacacaugugccauuaauaagcuauuucaucuuggauagucaagaauuuuuuuuuuuuuuuuuuuuuuugagacggaguuuuugcucuguugcccaggcuagagggcaauggcgcgaucuuggcucacugcaaccuccaccucgcagguucaagcgauucuccugccucagccuccugaguagaugggauuacaggcacccgccaccacaccuggcuaacuuuuguauuuuuaguagagaugagguuucaccauguuggccaggcuggucucgaacucuugaccucaggugauccaccugccuuggccucccaaagugcuaggauuacaggcguaagcgaccacgcccggccuggauagucaagauuuuuagaguaggaagggaucuuaaaacuuuccggccaguuguuccucuaucuagguuaacccacucagugcuuuaauaucuucaacuauaaaauggaaauaauuauguccuugcuuucccuggguuauuauuaugaaauuggucauauaaauuuaaggugucaucauaauuguuuuucagauggcugaacuaggcuggccuauucuggagauauguuuuuaaaaaucuuuuuauacccaaacuuuuacuuauuuauagauugaaaacuguaacuaugcaguggaacuugggaagaacaaggccaaauucuccuugguuggcauugcugggcaggaccuaaaugaagggaauucaacacuuacccuggcauugguauggcagcugaugagaagguaaaggcugauauguugguagcaacacugccuguuuccuccaacaaguaaucugaaccaaauuuuuagcuauuuuugaacaauaaugaacacagaagaaauauacaaugcaaaauauuuuaauuuuuaaaggauuuacuguugauuaugguuuuuuuguaaauuauauuuuauuuaaaaaugggucaauauccagaaacacuaucacuuuuauuaaugccucuuaaaaauggcuucauaaggaauugcuuuaaguuuuaaaaauaccauguaguaguuuuuguuucugauuaaugagguuuguaacuuuggaauguaacugggugcaaaugccagacuaaaauuagaaauauuuauuagaacugaacuauuucuuaaguauuuaucuaaacauugauauaaauuaugugaaagcaaauuucacccuuuucagucucaaauauacaucuuuucuguugcagguacacauugaauguguuaucggaucuuggagagggugaaaaaguaaaugaugaaauuauaauuaaaugggucaaucagacucuuaaaagugcaaacaaaaagacuucuauuuccagcuucaagguaaucaagaguccuaaaaaaaauuuuuuuuuguagguauaggaaggaauuuuuuuuuuuuuuuuuuuuuuuuuuuuuuggagauggagucucgcucugucacccaggcuggugugcaguggcgcgaucuuggcucacugcaagcucugccucccagguucacaccauucuccugccucagccuccugaguagcugggacuacaggugcccgccaccacacccggcuaauuuuuuuuuuuuuuuuguauuuuuaguagacaugggguuucaccauguuagccaggauggucucgcucuccugaccucgugauccgcccgccucagccucccaaaguguugggauuacaggcaugagcuaccacgccuggccaggaacgaauuuuuauuggaaauuacauugguuugguuuagaaauauauuaauguuguaugucagaaacaugauuuaugaguuuaggcauacuaauuauuuggccuguguaaacuugaaauauucaguuuuaauuacuaaauuuuugauugguuguccaguuaaguauaaauguagguuaauauuaucugacucugguaaucuaaucuuaaaaaauaaacagaauagagcuaaaaaaaauccaguuaucaaaugaaaaagauaagaagccauuguuuauauaggaccuauaauguuuugugcucccuagcagcagucucagaauuguauugacaucauuuccaaggcauaacagagccagccaaaccgauucaagugggaauugagaaaacugguaggaaaaaaaaaaucuugucaucuggcuucauaauggcacuuaacacucacuuccaagcauuuguggaugauucauaaagcacucaaaauguaaucuguacauacauacccacuaauuuucaugcauuuccauuguguuuugcuuuugcaugcaagccgauguuagcuacaaauaagcaugucugcuuguacacauucauucagugagccuuguguuugugauuuuauuaugugugaaaaacuagcaauaaauuugugguuuuuuuacugaaauaaaguacaaagagaugaaacacuaagcuauccuaagagauuaucuacccauuuuuauuucucucuuugccuucgcucuauaugcuuaacaacauugcaaagugaaagaaaugucagaaauuuaucaguucaaucuucucauguuugccaaaaacuaagacccaaaacgguuuuaacaggacagcuggauauuggcagagacguugccugaguccuaguucaauugauuuccacccccccuuuucuaucuuggaagaaacuaaugacauugaguuuuuguuacugcuuguuuuuuuugaaguaauuuucagugcaugauuugucucucuguguuuuaaacauaaaacacaaaaauauaaaauagcaauggggauuguauuauaaaauucucuaauuggcaguuauucuuuaaaauuguuauguugaaauuauaugcauuugcacauuauagaaaauauuaaacauguauauaguuaauaugagaaaauauuuaggagcaaauuaauauuuauugagcuccuauuaaguaacuuuuauaaguaaagaaaaaggcauaaaguauaggaaauuaauuuggcccucagaguguucaccauuuauuuuaaagacaaagauuguauaacugagaagguaacaauacuacagaguaauaaaauccaaguaaugcaacuaauauuauggaugaaaagucugaucauuuccaauugaauggucagugaagagccgauaaagacagcuggauuugaacaucauagauggugggaggauuugaauuaguggagagaaagggggauaacaaacuuagaaggguccaucuugaauaaaggcaugucucagaaaguuaggagaaauaggacgguuccuaagggauguugcgcaagacauaaauugggucaagauuguagaggauuuuggccuaaauaaaggauauugaguaaaggggguaauaagaaaggcaauuauuuuaggaauaccaaucugaauguagugaacaggauggggagggagaauaguguaacugcaaggacaaugcaaaagaauccaaggcaguacucaaggugugauguaauaagggggcuggggcugggaauggaaaugguaagauuagaaagcuauaaguuauugcaaaagaagaacuaggauuuggcuuccugaucuggggaagaagaagggagggaggagccaaaacucuucauguuuugggcauggguaaccggaaaacagauaacacuaauagaaaugaggaugucaugagguacagcuacuuccuggaaaaggugaugaguucaguuuuaagcuugaauuugagguaauuuuaggaaaauggggguggugaaaggagauacuaaaacuggaaagacagacuuggugaucaguugaauaaaaggguugagaaaugggagugcauaaaccuuuuaagggagagcaacccuagagaacagccgaccugagaguuuggcucuacuuagaacugagguggcagaaacaucgcgaaagugcuuggcauuuugcauaugcuuaaugauaaaaucuuuaaagagagugcaaaugguuaagaaaugaggcagugaaugcuaaaacauaguugaggugagggagguauuuuuccaacuacagaaggcauuauguuugaaggcuauaauaaguggcacuagcagaaaaauuuuaauuauaaacaagguagcacuauaggaauuucagaaaagacaaauuuacccuuuuuagccauaaauuucccuugcuaagaagacagagaaggugguagaucagcaaauaauaaucauaauuaccauuuauugaguccuucgugucacuauguuaagcacuuuacacauuguuuaauuuucuaaauacucugagcaaaaaggugagcauuagagaaguuaaguaacugucuacugucauacagcuuuuaagcagaacagcuggguuucauauccaggucugucuacacacaaggugaaagccaagcuuuggaguuguauggcccuggguugacuuuuggcugagcuacugauuagcuguguagcauacugcucauuuauuccauaaauauucaaagcuugcccugugucaggugccuugcuagucgcuguggcuacauagugcccucaaagagcucacuauucagggaagguggcaaauaagaaaacaagaaucacaguauggggugucagcaauacuauauaaaucagcuaaggggggagugugggaccacaugagaagggcaucuguuuuacagaaaccuuagcgguuuaaacuaacagcagggcuacaucuacugaugaauaaaacagagcuuacuucuggcucagcauuuaguaucugugugaccaugggcaaguuauuaauuucucuauucuuuaguuuccccauaucuaaaauggggaaauuaauaaucccucucuacuaagauuguuguuagacuacauaaguuaacaaaauguaaagagcuuaacaguaccuagcacauauuaagggcucaauaaauggggcuuaccacgcuguuggcauugcuaauauauaaagggcaucauauguggcaggacaggggacucugcugagccucuuagggaagucugguguccacaucacuguuuuuccagauuuauuuguuuauuuuauuuauuuauuuuuuugagacugagucuugcucugucacccagccuggagugcaguggcgcgaucucagcucacuccaaccucugccucccagggucaagcgauucuccugccucagccucccgaguagcugggacuacaggcgcccgccaucacgcccaauuaauuuuuuguacuuuuaguagagaugggguuucaccguguuagccaggauggucucaaucuccugaccuccugaucugccugccuuggccucccaaaguguugggauuacaggcaugagccaccacgcccggccuuuccacuuuuauuuuuuaaaaugacagaaacagcaguggaaugaaauguucuaauacauaucaaauagagggaaaaaucauuaucuugaaaaucaagcuguagguaauucuagauuaagauauugaaauucuuuuugccgaagucauuucuuuaugauuaacuuaaggaaauaaaaggagaaauaauggaaauguauuuauauacuaaccuaaggguuuucacuauaaccccuuucccuuugcaaaaguaaaaugucuuucacugauaauguacaaaucagaggauuuggaagacagggcuauuuucuuggaaacaagaagauaagagaucugauacaaucuuuagaaacuuaaauucuucauuaaacucaguagaagcuuuacgcaagguaacucauaagaaaaugggugggaaaaauacuuguuuccuaaaucuaaaugaaauauuuaaaauaacacaaauauguaaauaaggaaucaaauuauagcacaauuaaauaagucacuuguauuuuaaaaaauaaucauauacauauaugaaagguaagcccauagaaauuaaaaugcauucuagaaugaaauauuguuuuuagaaaguauaauacaguacacauuuagagucaucuagaaagcuuauuaaaaauguagauucccagccucauucauagauaaccugacauuaguuugaguggggcuagauuugcacuuuuaacaaauaccccacaugauuuucauguagguggucugcagacugauuucucagaaacagaaaagauacaaaaagcagauccagauuaccagcaucagauagacuuaaaggaccuaauuauuuuuacccucucucucuuaccccugcccagagaucuguaucauaaaaugaacauuaccccuggccaaagaucuguaucauaaaaugaacauuccugcccaaaaaucuguaucauaacaugaacauaagaauauaaauuuuucuaaaauuaauaaaugaggccgggcacaguggcucaggccuguaaucccaccacggugggaggccgaggcggguggaucacgaggucaggagaucacaaccauccuggcuaacacggcgaaaccccaucucuacuaaaaauacaaaaauaucagccgggugugguggccggcgccuguagucccagcuacucaggaggcugaggcaggagaauggcaugaaccugggaggcagagcuugcagugagccaagauggcaacacugcacgccagccugggcaacagagcgagacucugcgucaaaaaaaaaaaaaaaauuaauaaaugaaguggcucauagauuguggcucaaagaagcuguuacucuucuucacauggcuucagauuguuuuauuagauauugauuaagaacugacauuuggcuagagccuauacuagauguuuucaccuauaccaccucaguauuccuaagaauccuaugacauucuacuuuagagauuaggaaagggugcucuggcuucaaguaacagaaacccaauuucaagugguuuaaaccaaaaggaaagguguugacuacaauaacaguaauccagagguaggguagacuucuggauugguugaaccaauaauugaagaaugucauucaggacucuuuuuuuuuuuuuuuuuucccaucucugcuuugccaucuaaugugccagcuucacccuaaagcugguuuuccuuuuggucauaggauaguugcugcuugugacagagguuucauucucucauucacauccaggaggagggguugcuggcuuuccauaacauaggcccaaauuaaauuacugugguaauagaauagcauuccucuauuuggcuuagaccaguguuuugaaaucuuaaaagaaaauuauccucuaaggaauauuuuuagaccuuuuuuuccguuuuugucucucccaugaaauuuuaaugcagagauacacuguauaccuguuuaugcacuguaugcuuuauacauaaacaagguuaucacccuaccccuauugagaaugcuugaccuagauuaauuuagguucacuccuggaacuaugaaugucagcuuuccuugaagcugaugucugugugaaggagguauggauauagagcaaaaauauggguucuacuuguaugaaagaaguaaagaguguguagauucuggguaggcaagcagugguggccacuauucaagcugagagagaaaacaaauaauuuguucaaguacugauaagugguaaaaaucaguucagaccaggaugucugauuucaucugcagugcgcuauucacuauaauuuaguuguccauuuuuagcuugccuuggugguaacuuaaaaauggagagacucuugggcauuuuagagucagacugucauggguucuguauuuacugguuguguaaacaagucauuugagcuaucuuaacuuuauauucuucaucuuuuuuuaaaaaagaauuccuuuacuaucaagaugcuaggguuuaaaagguggauuaaauaaacuaaaacauguaaaacaacaagacaaugucuuuguaaguguuaguucccuuucacuauuucauuuuucuuucugaaaaauauuaagggaaggcuuuuggauucauggucuaagaaauaugugaguagaauuuauaaaauuguuaauuaaaaauucaucuauucccuuucaaaaguuuuguauuuuuuacagaauggacacuauaguuagcauacuuaggagcuaucauguccacaaaccuuauucagauauggugacaacucuauauuauauauaaagauucaaggaaaaguauauuuuaaaggguuuauuuaugugugcugguugcagaaaagcugaacguuagguuaaguacaaagaauuuguagauugccuucaguuauaugaucagaagagucugaaaauaaugaaaauuaaaggucagauguuuaugaauguucaucuaugcuuuauuuucuaggauaaaucuauaagcacaaguuuaccuguccuagauuuaauagaugccauugcaccaaaugcaguucgucaagaaaugaucaggagagaaaacuuaucugaugaggacaagcugaacaaugcuaaguaagccuuuaugguuuauauuacaauacauggcccuuuaauucucuaaaauccuuauaggaaaaguuacuaugcccuuaaaauucauauuuuuaaauauaacuuauaugugagucuuagauuuaagacucacaaacuuaaccuuuucguaaaacuaaucuugucaaaauauuucacucuuuuguuaaaauauguuaagugaaaacacaguggauaacaccaagauauuuuucuugucucuucaagauacgccauuucaguugcucgaaagaucggugcccggauauaugcauuaccugaugaccucguagaagugaaaccaaagaugguuaugacgguguuugcaugcuuaaugggaaaaggacugaacagaauaaaauaaucauuucauaugauuuucugccacauuaaacauauuguaugccucacaguuuacaggauucugaaauguaguggguguaaaaccagagauuauuuguaugcucaaaauaguuauauauucauuaaugaauucaauauccuguucauacuaguuagagcuggucagccuuuuuggguaacacaguuaauuuaccaacugauacagauaauagaauauauucauaaucaagcugauacuucaugauuaaauuauuuuuguugcuuaaaagucguauuagacaagacuaaaucauucuuuuuuaugguucaaaaaagaugaauacaaacguuuuugcagguucugcugugaaaugugguuugauuuuuuugguguguuaauuuugaucauaaaugcauucauacucauaauccaguuuaauccuuuuauuugcuuccuccaacuauuuaaagugguccaaaaacacuuuucuguaaguuucuauacugucuaaaaccuuauggugaccagaauuguuuauuaauaucaaacuuuuuuauauaugagaacuaauucuugaauaaaccccaaaguucacucucuuguuuaaguagcagcagcuuuuuacuuaaaauuuaauuuuaacuacauugauacuuuacacauccuaguuugguaacacagcuuuaacuaugucaugcaacauauauauguugguaggauguuauuagagagauaugugugcauauauauuuuuuugcaccugaaucacccagcuuuucauaagugguauguuuaauuggucauucagccaaccaucaguauuuuccccccacaacauguguaacacuuuucagucuguggauaucugauacauuaagauuucuuuuuauaaguauucauuuugaaugugcauauaguuauuugaccccuuccaaauacuuguagccaaacauuggcuagaacaucccaagauaugcugacacuguccuguuagcuucauauuauacuugcuaguuuaggucucuauagaagcccuauauaauuuagaauaugcccacugaauaucuuuaauagaaaguaacauaaagcuaguauucaauguagaguauuuucauauguuuuucacagcccguuacaaauuggcaauguuugguuaauguuuguauuacuuggaaaucgcuacagcuuggacuauuuuuuucuaaauuuuuagcauuaguccauuucugcugcuaacaauugaauccagaaaucuacuuucuccaucuuccacuguuagugccagugagcaauacuguugugcaacaaaaaugucacuuuaucucagugugaaugaguagucuaaauucccuuucuaccauugauuuaaauauauauauugguaagagagacugcccauguguuuagaauagaauuuuuuaaaugaaaugaucaacagguggaauuugaaauauauucuucuacaaaagagauuucuuucccuuuuauauuuugaugauuguuuucuuaagauuaagauauguucuugcucuuuuauaagauuauuuaaauuauguuucccucugauuuuuuuucaccauuguauuuacuaaguuauuggauuuacaugaaaucuggcacuuuaggguguucuuuuucucacagaguauauuuaauaaaaaugcuguguauauagaa

SEQ ID NO: 192086 - RNA, 141405 nt, Homo sapiens
cggcggagccccggcggggcguuugguuucgguuuggcccugacugggauuaguguugacgaucgaaaugggaguccccaaguuuuacagauggaucucagagcgguaucccugucucagcgaaguggugaaagagcaucaggugggugagcgaggggcaacggcucagaaagccgaggacccggggcuccgcggcccucuccaccuuagagcuggggcuuucgagccaccucuuuccccucgucgucuggacgauuaguggcauuagggagggggacggaagguuugaggacgcccggaugagccgaaaggggcuaaggacgcagguugccuguguguggacagagccgcuggguucacggcuucucugacagcucuugcuucugcugguccuuccgcgacuccgaaaugaaguccugggaaagaacgcuuuuacuguucuccgguuuccucccggggagcugcaaguugccuuuuuccuuacagaggcugcgaagcuggaguggguguccucguagguucccccaucccacccagagcggcagacccacuuacagacgauaacagccgcuuccgcacgcagucaccuuguuuacuuucccugaucuagagcgcggcccacccggcccccggagccuagacuuuccgacguggcugauggucauauuggugaugccuuuuguuacuuucuguuauuucaaaagcagcaccaauccccuguugccaaaacaaaaaacucuugggccagcuggggaguggggcguaggaccuuuuauuuggaggccucacugugugacagaggggguugggaaacgaauugauagaacauuaauacuacuaauaauauuuggcauguacugaccccaggacaacguuaauguguagauuccgaaaacguaguuuauauauuggaacuguggaaagagaggagaaagcagucgucuauuagguaaacuagacuuugggugauacuuugguguuugucacauuuaaugaauuugaucucuuuucugaugcuuuacagaaaaaaagcuugaaauuuguguagcugauugaaucaguugugauggguaguauuguaaauagccuauuaaauuaugguuuaaucggcauuuacgaacaugaagguaguuuacuucuggaaaggaguuuuuguugcuggauuccaaucagauuugguagaugagaaauagacuacaaaaaguuuccaagguuagcuuaucuugaauuuauuugaaacauagauugaguuagguuuagagagguauuuuuuucccccggggagggcuaaaaaggaaaccaguacauugcagaaauggagacaaccaacuuuggcuuuucuugcauccuucagucaguaccugcuauauaucagucacuuuaucucuaaagugcaaaaauaaugcgauuguuauucgugaugauuuaauacauaauuuguucaguaauauuuuuauucuguagucuguggcacagaauuugguuuggugaaaauaucuuagauucucuccauccugaggaauuuuguuacugaagaaugaaaaucucuuuaaugcaguuuuaugacauggacacuaaggauagguuuugugaaagcuuuauauagaaacugggaggagaauuauuuuuaaauuucacuguaaauaaauuuuaaaauuugguucauuguugugauaccuuucaaaaauguuugauuaaaaagagaccaaagguuaucagcuucucuguuaaguagaacuuaaagaugguaaugccuaaauaagucacaggcauucaaaagcuaguccugggcgggaaggauagggagaagaaguaaguuacgggaagucagugguguggccucaguagcauagguuuucaguuucucugaaucaucuuguaaaaacagaaagagaaacuagaaaccaaaguuuaaaauccauaaaacaauuacaacaaaccaugugacaugcuauccccaugaaacucaaaacauaacuaggugaggcaaacuaucaauagucucuagacaccguugauauugccaucugugcaaaagcgagaaggaagcaauggggcaacaucugaugaaccuuagaacagaauuccagaauagccagcgguauccacuaaaagacugugcuggccaauuagauagcgguagcugaaacagaggaguuuuauucacuccauuauugacugggugaaggucuaccauaagaaagaccaaacaggcaggaguagucuaccuccugugaacacucaaaacugacuugccaaggugccauucuagaccagagcccuaaggaaaagggaguggaauaaagucuuacggaaauguuaugcuggaaguggaauaaaauuuuaugaaagggacaauagagacaagaagagaaggagauagaccauauaaaagugaggcaaagucauagaaucaagaaaucuuagaaaacaaaccacaaagcaaaccacuguauuuuuuaacacuacccagaaacagcuuugugaacuuauauucccugaaccucuacucauucuaaaaguucaagaaaauuaaauucacauaaaaaugagcuacagaaagguauugagaucaaauuacauacaaaguuauuauacgagaaaaagggacagaguaucucuccagacauaaaaacuugcaaugaaaaaaaugcacacaaaauagaccaaaauuauaaccaaaacuauuaucuauuucacaaugaguuaaaaggcauuaagaaaaugagguaagacaugaaagaacaacguguaucaauuaugaaaaugugagaaugagaugacagagaaaguuagaaguaaaugaaaaaaaaaugcagagcugagccucaaauagaagcaagacgagcaaaugauaccauuugagaaaacaaucggcaguggaaagaugaaauuuuaaaaaauaaaauagauuuaaaagauucaagaaaaaguaacgauaagaaagauaggcaaagaagacaaauaguagaggugccugaaaaagaaaaaaccaaagcagcauaacagaauggguacucaguaaauauuuuuugagugaauuaauuuauuagcuauagcauauagcauauagaaaugcauauuaaaauagacaugguauauuaguauguuguaaaacaguauuuuuuaaaaaagugaaaugaagccugggauuauuaugauuauuuuuuuuuaugaaacauaguguauauacuuaugggguucaugagauguuuucguacaggcaugcaguguguaauaaucauaucauggagaauggaguauccauccacucaaguauuuauccuuuguguuaaaaucuaauuacacucuuuuaguuguuuuuaaauuauugccuaucgucacccuguugugcuaucacauaguaggucuuauucauucuuuuuuuuuauuuuuuauuuuggauacaaggucgcgcucugucaccccggcuggaguacagugacgcaaucucggcucacugcaaccccugccuccccgguucaagcaagucuugugccuuagccacccaaguagcugggauuaggcgugugccacuacgccuagcuaauuuuuguguucuuaguagacauggaguuuugccguguuggccaggcucuucuccaacuccugguggccucaagugauccgcccaccucagccucccaaaguccuuggauuauaggcaugagccaccgugccuggccuguguuuuuuuguucuguuuguuuuaauuuaaaucuuuuuaaaaauagagauggguuuuugccauguugcccacucugaucuugaacuacugggcucaagugaucugcccgccucggccucccaaagugcugggauuacaggcgugagcccccgugcccagacuaggucuuauucguucuuucaguuuuucuuuuauacccauuaaccuuucccaccucuccccugacuccccgacuacccuucccagccucuaggaaccaucuuucuauuuucuauguccaugaguucuauuguuuugauuuuuagauuccauaaauaagugagaacaugcaauguuugucuuucugugcuggacuuauuuuacuugacauaaugaacugcauuuccacccaugugguugcagauggcaggaucucauuccuucuuguggcugaauaguacuccauuguguauauaccacauuuucuuuauccauucauuuguugauggacgcuuagguugcuuccaaaucuuggcuauugugaacaguacagcaacaaacaaaggagugcagauaucugcgauauacugauuuccucucuuuggguuauauuaacacagauagcagugggguugcugggaucauaugguagcucuauuuuuaguuuguuuuuguuuguuuguuuguuuuugcaguugcaagauuuaauagagugacauagagugaaaacagagcucccauacaaaaggaggggacccgaaggggguugcuguugccggcuugaaugcguggguuuacaucccgauccuugucccucccacugugcugucaggcaguagaugauuggcuauuucuuuaccuccuguuuugccuaauuagcauuuuagugagcucucugauugaucaggugugagcuaaguugcaagccccguguuuaaagguggaugcggucaccuucccagcuaggcuuagggauucuuagucggccuaggaaauguagcuaguccugucucucaguccccacucucagcaggaaaaccuaagugcuguuggggagguuggccgaugacugcucuaacugcuuccugcugaauuggcacguaguagggguggugcaguugagauuuccucgggaggggugccuuugaugucauuaacaucagcgcaugggcuaacaggccgguccagggguccgcgguagaucuuagucauggacugcaucuggggcuccauuugaagaacgauuuguaguuuuacagcuucgauucuggaagagacaaacuuaacaaggagguuaaagauacagggauugggccgggcgcgguggcucacgccuguaaucccagcacuuugggaggccgaggcggguggaucacgaggucaggagauugagaccauccuggcuaacacggugaaaccccgucucuacuaaaaauacaaaaaauuagccgggcgucguguugggcgcccguagucccagcuacucaggaggcugaggcaggagaauggcgugaacccaggaggcggagcuugcagugaggugagaucgcgccacugcacuccagccugggcaacagagcgagauuccaucucaaaauaaaaauaaaaauaaaaagauacagggauugaaauguauggccugcagugcagauuauuucuuuggcacacuuuacaggcccuaacuaucugcuugauaguuuugaaaaggccugguccaguaaauaauaauuuggccaucugaugggugcuaucaaugccuaagugaaagguuuggugaaggguuuuaaguaauuuccauugguuagcugcaggcaaaaguauuuuucuuucuucgguggcuagccauccugaggggaggaaacuauguccucgugagcuuccccauucuauuucuucuucugaguacuggggcuugguuuccuggaggggauuaccccauacuagggguccuucuauaagcauuucuaauggaggguccugccuugcggcucuuuuggcuucaauauccucuuggcgguuccuuucuauuucccguuccuuucugaugaccccggcaguguaagacugccaccucuuuagguuucuguacagccaauaauaauuuccuaauggcuuccugauguuugauagguguucccuccaaaguuaggaauucccuuucucuccauauugcugcaugggcauggaggacuagguaagcauauuuagagucuguauauauauuuacccuuuuuccuucuccuaauucuagugcccaagugagggcuauuaguuuugccagcugagcacuaguuccuggaaugaggggauuauuuucaaguauuccauuaucacugaccacugcauacccugcuuuucaaaguccuuuuucuaugaaggacuuuuuguauacgaauucauuguauguauaugaauacgaaugaauuguauacgaauuguaugcgaauucaguauacaaauugaggucaggauccgucaagggaaccucugaaagguccccucgagcggcuuagguuugagcaauuacuuguugacaguuauguucuaucuuuucuucauugucuggaagaaauguggcuggguuaagaguugcacaagugcacagucgcaacacuggcccuucaaguaauagagccugauauuuaaguaaaugguugucugagagccacaagucuccuuuagcagugaguauaccauucacaucaugagguguccacacaguaagaucucuucccuguauuauuuuaacugcuucagauacuaagacugcaacugcagccacuaccuauaaacaaugaagccaacccuuugccacuacaucaguuuucuuacucagguaugccacgguugcaagcucgucccucggaccuguguaaggacuccuagagcuauuccuguuuuuuugugauauauaaagaaaagucuugcccuauuggcaagcuuaacacuggggcuuggguuagggccuucuuuagggccuggaaagccacuucugcuucagguguccaucuuacuaaauggguauuggcuuucugaguuuccuuaauuaguguauauaauggucuggcuauuuugccguaccugggaauccauauucggcagaaaccuguuaugccaaggaacccucuuaguugcuuuaggguuuggggaugaggauaagcaguauaggcuggauacauuccccacugagggcccuggugccuuuggauaauuuuagcccuaaguauuuaaacugcugugagcagagcugagccuuugguuuggaaaccuuguagccacagguggcgaggaaauuuaagagcgcuuggguggcuugguggcacaagguuucugaaugggcggccaaaaguaaaucauccgcguaccgaaggacaagaguguccagguaugaaaauuggcucaagucuugggcuaauuccuagccaaauaguuggggcuaucccugaacccuugggguaaaacaguccaggugaguuaagacguuggguucgaaggcucuucaaaggcaaacaagaauugagagucaggauguacaggguugcagaaaaaggcauccuuaagguccaggacuguaaaccgcucugcuuccucugguauuugggaaagcagaguauaaggguuagguacagcuggguauagaggaacaacagccucauucauaauccugagaucuugcacuaaccuccacugucuguuggguuucuguacuccuaaauuuggaguauugcaggagcuauugcaugguuuuacuaggccuugggcuuuuagguccuuaacaaucuuuuggaguccuuguugggccucgggucuaaggggguacugccuuugguagggaaaggagguggaauccuuuaguuuaacuugaccaggaugggcauucuuugcucguccauguugucuuucuguugcccagacuucaggauuaauuccuuccucaagcaggggacaacaaacggguguuccuucuccuauguucagguguauaaugaccccuacuuuugcuagaaugucucuccuuaacaagggaguggggcuuucaggcguaauuagaaaagcaugugaaaagaguaaaguuccccagucacaacuuaguggcugggagaaguaucuagugacuggcuguccuaggaccccucggauagugacagaucuggaggacaguuguccaggacaggagaguaagacugagaaggccgugccaguguccaggagacaguuaaccuccuggcccucagugguaaagcauacccagggcucugugagggugauggcaugggcuggcgcuuuccccgggcacccucaguccugcugcuggaucaucugguucagcaggaccuucgucuccugagaccuucgucucagaggaccuucgucuccugagguagugggccuuccagugauucccuugacauaaggggcauggacaagggggcggcuuauuucuacuuggacaaucuuuuuuaaaguguccuugcggaccgcacuggaagcaagcccuuuuaggcauucgauuugcccagcuuuucccuuuuccagagccuccaaaguccacuugccuaagggccaugacuaaagcgguggccuuuuuuuuuuuaaucccguuuguccuguuccgccugcuccuccugaucucuauuauaaaaaaacaagguugccaaguucaguagaguuucuaaguuuugcucugggccuaaggcggacuuuugaaguuuuuuccuaaugucugcagcugacugauaaacuuguccuuuaagauuaguuggccuucaauggagucaggugacagggagguaugcuuccuuaauuccucucuuagucuauccagaaaggcaguaggauuuucuuccuuucccuguguuacaguggacaucauugaauaauucauaggcuucuuccuaguuuuccuuaguccuucuagcacgcaaguuagcagaugucugcggcaccaaucuccauguucugauucugugucccagugagagucuacacugggaacugccugcuggccuguggggaaucguucucuuuccucuguugucauccuaucauugaccuaacugagauaccagagauugccaaacucucgggcugcaguuauggcggcacuucucucauuugggguuagugucugaucuagcaguaacauuauaucucuccaugucagaucaaaggauuguccuaacccuuguaaaacgucaauauagccaucaggguuaucugagaauuuaccuagaucuauuuuaauuugcuuuaagucugagacagaaaaagguacaugcacucuggcugggccgaauucuccuccucccacugcuuggagggggcauaaucggggaauauuggcacucugguucauuguuuaccccuuugucugucuccuuuggaccguuuggguuaaagggggguccuuguuaguuggggaaggagucggggggacacuggaauagggagguagacucugagggcuuccuguagggcauaaaccacacuuuuuacauaauugcgaguugucucuuaaugaaaagaaaguuugcacauauggcacuucacuccauuugcccuccuuucuacagaagaggucuagcuguaggaugguguuauaaucuauacuucccucacgaggccagguuucucccccuugaagaggauaucguggccaggcgguacugcagaagaguauaagucauuucuuucuuagugucugagggucagauuggucccauucuccagaauacaucuuaggggcguuuuugccuugugggggagaacguuucccaucugaaaaaagaacagagggaugccagcaccccuagucauuuuccaaugagcauuaguccuagagcguccuguaagggccuaaugcuuauucuuuuccagggugcguaaccacccauggaccucugcuuaucggauuaguuacgcuuaccgauguagcaguccugcaccuguuuucccgccucucuugaccacaaagaaaagggucuggacugcuggauucuagugguccuuuaccagcgugcccaaaauugccuuugugcucaggggugaguuccuuuccagggugcguaacuccccacggaccucugccuaucggauuaguuacgcuccccaauguagcaguccugcaccuguuuucccgccuuucuugaccacaaagaaaggggucugggcugcuggauucuaguuauuuuuaguuuuuugaagaaccuucaaacuguucuucauagugguuguacuaauuuacauuccugccaacaguguaugaggguucccuuuucucuacauccuugcuagcauuuguuguagccugucuuuuggauaaaggccauuuuaacugggguaagaugauaucucauuguaguuuugauuugcguuucucugaugaucagugauguugagcaccuugucauguuccuauuugccauuuguguguccuuuuuugagaaaugucuguucagaucuuuugcccauuuuugauuggauuauuagauuucauccuauagaguuguuugagcucguuguauauucugauuauuaaucccuugucaggugaguaguuugcaaauacauuucuuccauucuauggguugucucuucacuuugcugauuguuuccuaugcugugcagaagcuuuuuaacuugaugugaucccauuucuccauuuuugcuuuaguuuccuaugcuugugggauauuacuuaagacauuuuugcccagaccaauguccuagagauuuuccucaauguuuucuuguaguagcuuguaaagauauguagaaagaggaaagaauauaggauugguggggaaaauagcagccaaaucaugcaggaccuuuuaugcuauuaaggauuuguaguauccuauggguuuagguaaggaagcaaugugaucagauuauguuuuagaaaaauagcuaaacuguggugagagagaaaacuggaagcaagcaguucuguugggaaacugaggggcauggaccagugugggagaucugggcauagagaaaaggaugagauuaccuaagacaguggaaauggauaagaugguaagauucuagaaacauuuuggauguuaaauuaaaaagaaaaauaccucagugacuaauuggauaugggauuggagaaggcagagaguauaaaauaaccuugaaauuucuaacuugccaauguaauaacugagaagagaaacuacauuaucaguaaucucuuuguaugggagcaaaguucuacugcauguucucacuuuauucaacacauuggccaaugauuaauuauucuuugucuuucuuacuagucugaaaccuaagagaauuuuucaaauauuucuuuucuaaaaggaaaauuauaugggguauuuuuuagauuauaaagguaauauaugcucauuauuuuaaaaaauucagauaaugcggaaaaauauaaaaauuauuguauagucuagaggaaaguaaaaagcuuucaucauccaugguugaccccuaguaacaucuuguuuuuauauacuuucuaacuuuucuaugcagauacguauguaaauaaauauuuccuauaaauaggauacuuuaccugcuguuuuauacccugccuuugucacuugaugauauauauuaugcauauuauuccaugccaaauaugaaucuauuucauaauuuguaauugcuguguugaauuccauuguauggauguaccaucaucaguuuucuauuuuuaucuuuucuguacaauacugccaugaauauuuuauacuucaucuuuacaaguuaaucauaucugauuauuuuucaggauaaauuuucaauaguagaaauccugggucaaagauacacguuucaaauuuuaauucguacuuugugauuaguuaugccaauuuacauucuagucccaaacuauuggguauaaacccuauuucuguuuuucuagcuccacgacuuuucucuaaaauuagaaugcuaaauauuuaucuuuuaagguuguuauaauuaagucagagaaugaauauacauauuuagcccaauguuuaauaccuaauaauugcauaauaaaugccagccauugcuuuuaauaacaugaaauaugugcuuccccaaagcccuguuaauacuggguaacaucagucucuuuaauuuuuacuaaugugggaaaaugauguguuauuucaaugagaaauuuuggauggugaacaucuuuucaugugcuuauuagacuuaugacuuuuuuguuuauucauuucugaauugcuuuccauuuucugugauugcuuuaaauuuuuuuuuuuuuuuuuuuuuuugagguggagucucgcucugucgcccaggcuggagugcagcggcacgaucucagcucacugcaagcuccgccuccuggguucacgccauucucccgccucagccucccagguagcugggacuacaggcgcccaccaccacgcccagcuaauuuuuuguauuuuuaguagagaugggguuucaccauucacagaauggucucgaucuccugaccuugugauccacccgccuuggccucccaaagugcugggauuacaggcgugagccacugcaccuggccuuuuuuuuuuuuuuuuuuugggggguggggacaguuucacucuguugccaaggcuggagugcaguggcaugaucucagcucacuggaaccuccaccucccaggugcaagcgauucucaugcuucagccuucuaaguaccugggauuacaggcaugcgccaccacccaggcuaauuuuuguauuuuugguagagaugguuucacuuuguuggccaggcugaucuugaacuccugaccucaagugauccaccuaccuuggcccccaaagugcugggauuacaggugugagccaccgugcccagucaaaaauuugcucuuuuucuuauauuucaguauuucaguauuuuuuauguguuagagauguugacuucuuuuuuuuuuuuuugauacagagucuugcucaguugcccaggcuggagugcaguggcucgaucuccgcucacugcaagcuccgccuccuggguucacgccauucuccugccucagucucccgaguagcugagacuauaggcaccugccaccaagcccagcuaauuuuuuuguauuuuuuuaguagagacgggguuucaccguguuagccaggauggucgcgaucuccugaccucgugaucugcccuccucggccucucaaagugcugggauuacaggcgugagccaccgcgcccggccagagauguugacuucuaauuugcaaacauuucccuacguuuugucauuuuuaauugaauuauauauggcgcuuuuuaacccuauauauguaaaacaauacauuuuuagauaacucuaccauuuauuugcuuuaugauuucuggcuuuuccuacccuaagaguuuaaaaauauuuguauguaauuuuuuuguuacauuucuuacaguaaaauuuuuaauccuucuggaauuucuuuuguuuuagcguaagauggaguuuuauuuuuuauauacuaaauuuccauucaaaccaucuguuugauaacuuaucuagggcaaauuuccuuugauucuucuuuuuguuuguuuguuuuauagagacaaagggucuuacucugucucccacgcuggaguuuggugaugcaaucaccacucacugcagccuugaaccuauggguucaaagauucucucacuucagucucucaaguagcuagaacagacacgugcugccacacccagcuuauucuucuuuuuaauacucuucuuggcuauuauugcauauuuauucuccuaggaaaacuuuggaaaaucguucuguaaaauguaaaaaaaaaaaaaaaaaaaguguaaaaaaaaaaauuugaucaagucguugaugcugaggccaggcgcaguggcucacaccuguaguaauuccaucacuuugggaggccugggcaggcaaaucgcuugagcucgggaauucaagaccaaccugggcaacauggcugguauuuuuucauacaaaagauaugaaaauuagcgugugaaaaagauaugaaauuaucacguuuguugucaugugucaguggucccagcuacacugaagguugaggugggaggauugcuugagccugggagguggaggcugcagugagccgagaucgcaccacugcacuccagccugggugacagaucgagacccugucucaaaaaauaaaaauaaaaauaaauaaaauaccccuguugaaaagucacacugagauuuucauugagguuuucagauuucuuggaauaaacaguaaaucuugagugcacuuuaaaacucucaugguuacaacugucauuucaguucagccugucaguaagaacauuccagaauuuuuauguuaugcuuguacauacaauacuauauaaauagguauuucauaaaaauauguuuugaugguguucauugauucagagaccaaaacuuuucacucccaaaacucaaaggcaugccauuuucucaguagcaggaaaauauauuguuacuuguacguguuguaaaacuugaauuacuguuucagaagugauuucuauuauguuuauacaaggaaaaaauucaaaguaauuuacuuuaaugaauauguaaggcagacucuauucuaagauucuuuuauuacaguacaaaauauaacucuuuaguuuuacccauuucaguuccaucuuaauguguauuuguuucaguaauguuccccauccucacaaacauuuacuuuuuuuauuuuuaguuaaaaaaauuuuuguuccuggugggaccaagaguuccaacacaaacauuuaaauagaggaaaaauaaaugagagagccauuaaggucuucuuauaaaagcagauguuuguuauucggagcuuacaaauuauuaacccacauaucacaaacaagaaaucuguuuuucagguuucaguuucauaaauuucuuggcauaaucuaacauuuuaaaaauuaauauaaccaaucagugacugcuucagugaaacuaaguauacaauuaggcuuuacaucauauguuaaauguuucaguaaccauguacaaacagccuuuugauguaaaugggcuuuuuguuacccauuauagaggaaauugagguuuugaggaguuaaugucaaaugguaggaaggaacgaaacuaauauuuugaguaccaaaugaaccaagcacuuuauuugguguuuucuuggagcuuauuauuuugaauaaguagauuauuuucugacaguaaauuugaucaagucauuggugcauuauauaaaaccaaauuugucaccauauuaccaauucuuuacuuuuuguauucaucugugauuguuuacucaguuuuuguauaauagaauacacaaauccugcuuuucaucauugaauaaucacuuuucccugcugcuuaagauaucuguaguugauuaaaauaaaugaucucaagcauuuuucuuuguuuuucagauuccugaauuugacaacuuguaccuggauaugaauggaauuauacaucagugcucccauccuaaugaugaugauguucacuuuagaauuucagaugauaaaaucuuuacugauauuuuucacuaccuggagguguuguuucgcauuauuaaacccaggaaaguguucuuuauggcuguagaugguguggcuccucgagcaaaaaugaaccagcagcgugggaggcguuuuagguaaaacauuuauguuuuauuuuggaauauuauuuagcuuaguaaaaauauguuauuuuaaagauaauugauuuaacacaaucuucuguucauguuuauuuucugcguaaacucccccagaaauggaaauaucucagugucauauuuuaccagucgaguaaugaguuaggaacucagugagauguccuuucucaaaacauauguuggagguucucuuguucguuuguuuguuuguuuguugagacagaaucucacucuaucacccaggcuggagugcagugguacagucuuagcucacuguaauaucugccuccccaguucaagugauuaucggugccucagccucuuaacuagcugggauuacagccaagcgccaccggacccagcuaauuuuuuauauauauauauaaaauaaauuuuauauauauauaauuaauuauauauauaauuaauuauauauaaaauaaauuuuauauauaaaacauuuuauauauuuauauauaaauuauauauuauauauuuuauauauaugaaaauauauuuauauauuuauauauaauguauauauuuuauauguauaauuuauuuauuuuugcauauauauaugcaaaacuccgucucaaaaagauuauauauauuaaaaaaauauauauuuauauauauacaauauauuauauaauauauacaauauauuauauuauauauaauauauuauauaauauauacaauauauuauauuauauauauuuauauauauaauauauauauuauauauaauauauauaauauaauauauuauauauaauauauauauuuuuuaauauuauauauaauuuuuuuuuugagauggaguuuugcucuugucgcccaggcuggagugcaguggcgcgaucucggcucauuacaaccuccgccucccaggcacaagugauucuccugccucagccucccaaguagcugugauuacaggugcccgccaccacacccagcuaauuuuuguauuuuuaguagagacggaguuucaccacguuggccaggcugaucucaaacuccucaccucaggugagccacccaccucagccucccacagugcugggauuacaggugugagccaccgugcccagccaauuuuuaauauuuuuaauagagacaggguuucacucuguuggccaggcuggucuugaacuccugaccucaagugaucugccuaccuuggccucccaaagugcugggauuacaggugugagccaccacgucuggccagguuuuggugucaccuggggcucuaagaauacaucacuguaguuacaguucagcaauuaggaagcuacugcugcaucuguuaguucccaagcuacagugcaguugcuagaucuguacugaaaaaaacugauucccuguuccuugcuuauaaagucacacuuuuguuuucugucacaaguuuuuauacuucucauugauaauuugcaaaugauaguacuguaguagagaaaagcuccaauaguagucugcccugggaugguaacuagaaagugaacuaagagguucuucuaaugagaacauuauugacacuuaauucaacaaacguguauugaaugcccagacucuggguuagaugcugauuuuugacugagcauaaguccagauugggcagaaaggcaagugagaucagaaugcaauugauggacugugagaagugagcuaaguuaggaaauucaggguauuaucagcaccacugugugacuuaggcgguaggagaaguaaaaggaugagaagagguuacacacuaggauuuuaaaguucauuccuggacauguggaauauuucuguguaacagugagaucaggcugugucccgguucauggguaacagaaguaaagguuagaauugaaggcaagaaaucccuaguggagaguguuugacgggucauuagcauaaugaguccuucaaucauaauggcaaguaaaggaguggaaagaccaucugcacauccaauguggaagucaucaaagaaggugggacggugcuuugaagaaggcugccggugagaggaagaggauggcaaaaaguacugauuucaauaucaaaagaaaaaagauacugaaauuuuuagaaagacugugagaucuuugaaggcaagggccaucucugaguaauauuuaaauucucaaauaccacccaagacuuacucuaucagaaucucuaguaguugagaaacuccugggaacuauuuuuuaccauacuccccugguauuuguuaaaguaguuuuugggagccacuagccuagaagaucuaguguuaaggagggauuuuauaaaccuacuacaucagucuggguucaguugcaggugauagaaagcacucuagcuauuucagacaaaaagggguguaauucagggaauuggguguuuauaaaaaucacuguaaagccaaaagggcgggaaucuaggugagccguaagggauaacuucccaaacagcacuacagaacugacucaccaguggcagaacuauuaccacauucagguaacgugaggaguucagagcccccuaccaaaaugggugguuucgggaacuuacuccuuuaucugugauccaauaauuaagaagcugucacuuggggcucuaagaauacaucacuauaguuacaauucagcaauuaggaagcuacagcugcaucuguuccagagcuacagugcaccugcuagaucugcacugaaaaaaacugauucccuguuccuugcuuaucagcaccucuaaagauacugaauacugggaucuucuuuaccauugcugaaauauacagacauacuagagcuccagugccucaauugugaugcaggcaccaccacacuuccacuuuccaaaccuuauauggaggcaucuaauuggcaaaaucugagucauaugaagacacuuagcuucagggaagccugagaacuuucuaaccuaccuggugucagaagguaaacuaaaaggaaauggaauggaaguugagggccaaugcauuauaaccaccacaagcauuuauuaaauacugugcugguauugagcacuacauuuuuccuagaaauccccuagucaguuuucugccauucucuacagugaugaccuucuccauucauaauucccuguuuuacuuauuucuaaaucugccuucuuuuauccccaccaugccacuaaaauuuccugacaagauuacggcuaaauccaggccgggcgugguggcucgcaccuguaaucccagcacuuugggaggcccaggcggguggaucacaaggucaggaguucaagaucagccuagccaagguggugaaaccccgucucuacuaaaaauacaaaaacaauuagccagguguggugguggucgccuguaaucccagcuacucgggagggugaggcagagaauugcuuaaacccaggaggcggaggaugcagugagcugagaucacaccacugcacuccagccugggcgacagagugaaacucugucucaaaaaaaaaaaaaaaaaaaaagauuauggcuaaauccaaagaauacuucuuucuucaacuuauuucauuuauccacagcauuuaacaauguugaccauucuuucuugagcuucucccuuuccuugaccaucauguaaccacauucucucuuuguacuuucuuagucuccuugucuucuuuucuuccuuuguguuucuuaaauauuaauguuucuuaaguuucuguccuaggcucugagugauuucauccaauggcuuugauuacuaugucucugcugaugacuccaaauuuaucuuucugguggaucgcuuucuccuaagcuccuauauauccaaaugccuacuaaaugucuccuuuuggaaaccccagauauacuucaggguuaacauauuuagaacugaacucaucuuccccuuaaaacagucugccuucuguguuuccuauuucaaugaauggcaacaccugccacuagcuaccuaauccaaaaguccaagaguuauuuggacuucuugcucuuccucauuccucacauccaguccucuuuauccagucucaaauuugucacaucugucuacuucuuuucaucuuuaaugcuacugucucagccuagacuaccauuaucuuaaucuagauuacuucaauagucuuaccuuguuccugucaaacauuuucuuuauugcauccagauuaaacauuauggcuguuuaauuuucuaccuccccacuagaguguaaucucagaacagaaauaauuuuuuuuuuuuuuuuuuuuuggagagucuugcucugucucgcccaagcuggagugcagugaugugaucucggcucacuauggccucugcccccuggguucaagcgaaucuccugucucagccucccaaguagcugggacuacaggccgcaccaccacacccggcuaauucuuuuuguauuuuuaacagagaugggguuucaccauguuggccaggcuggucucaaacuccugaccuuagguaauccaccugccuuggccucccaaagugcugggauuacaggugugagccaccgcaccuggccaagaauaauuucucuuuuguuauaucccaagaccuugugacauaacaacauugaauaaucguuuggucagccaaagaaggaagggaagaaaagaggaaagaagacauugcagauaauacaaacaaguugauauccucagaguuuuuguuauguuaaagagguuggugagagagaaguuaaacuugaagaagaguuuguucaucacagaaauagaauuguguggggcacaguagaugaagcuaguagcaaggcuguagaaacuauacucaaagcagagcuuccuaacuuguaugccauguggcaugcugguacgcugcaaagggguggcaguagaagucaggcagguaguaggacacccauauucaaauccagguuugccugacuguaaaacucagguucuuucuaguaaauucuguugccucaaaaaugugaugauuuugcaguugauuucauuaaugucauuaggcuuucauuuuaaauguuuuuaggaaacacaaagauagauauuucaauuuuauaauugcauuuuuauauaaucuuagggauaauuuuaaugaucuuaaauguauacauuaaaugaugauuaagaucauuaaaugucauuaucauuagauguaguauauauaaugaacauuuaaagcuauacuuuugaucuuauuuuuagaaugaauuugccauauauuugugacaauaauuauuuuauguuuuuaacauucuguuaaaauguucuacuucuguauuccuaauccgaaaaauucaauuuuuuuuuuuuuaaaugagacagagacucacugugucacacagccuggagugcaguggguacaaucaucacucauugcaaucuugagcuccugggcucaagggauccuuuugccucagccucccaacuagcugagacuauaggcacaugccccuguaccuggcuaauaauuuuuuuuauuuuuguagagaugggaucuugcuuuguugcccaagcuggucuugaacuccuagacucaauuguucuucccaccuuggccucccaaaauauugagauuacaggcaugagccacugcaccuggccugaaaaauucaauucuuuaaauaaacaaaacagacaagucuggggcucauuuuuaucaaucauaaucauuucaaaacuuguauguuuugaacguuaaaacuggugaauuacuauuuuaguuauaaaggcaccuacauagcaguuuauauaaagaucuucacuuuuuuucagaaaacuuaagguacuuuuuucccuuaaccuuuaaggucagcaaaggaggcagaagacaaaauuaaaaaggcaauagagaagggagaaacucuuccuacagaggccagauuugauuccaacuguaucacaccagguaaauucacugagagacaaauuaugacagaauugaaauauaaauugaaaacuugguuuuuaaauguauuuuauuuucuaugcucuauuuauuuuggccuuaggguuccauuuacuguauuuucccacuuauguuugcucaugagacgauuuggucaccuuggucauaaauacuccuacaaaaacuguagggauuuucagauguagauaaauuagagcagauauggacaggaaucucccagguggacagaauugcagaccuugaagaaacuuauguuuauauaucuuucuguccuauuccugccauuuauuuauguuaaaacagacucagugagguuguagcuuaucaaguugauguagcuagauugugguagucagaguaagaaacugauucuccuaguccagggcacuuacuacucugcuucucaaaauuaguuaagauuuuuaugacuuuaaggaaaaugaauuuaucaguauuauguuuaauuuuguaugcagcagcauacucuauauacuucuacaaccuuugucuaacaucauauaauucuuuacuuugaaugaaaaucuuaaaaucuaacuuucucaucaguucuuuacuaacagugguaauuugcccuuucuuuaagugcauuggucacacauugcucaguuuaacaaccgguuuuauccugauugugguuuuagacuguauugcuuuugacuguugaccaucugagccuuucccaaaauguaaucauuguagacucagguuccaaauuaauaauaauuuuucagaauaauaauuucaguaguaauauuauuauuauuauugacaaucugauuuaagcugcaagccuuaaaaaaaaaaaccuucagaauucagcagaagaaauagaagguugagguucauuagagaucucaaacucugcccuuacaugaaaauuccugaagcacagugcugagacacuaguaaaauuccuugacuuucccugugugacacugauucuauuuagggggacuagugacauuagaaacaguugugauauuugcaagggaaaaguacauuacuuguuuuucaggauaagcaagagagcuuuugaccuucuuuggagauccuauaccuaccuagcuauucccggcguacucagauucaguuauguguugucacugagaacuuaauguuuuuaugucuuucuuagauuaaccuuuuuaaaacauuauuuuuaggaacugaauuuauggccagguuacaugaacaucugaaguauuuuguaaauaugaaaauuuccacagacaagucauggcaaggaguuaccaucuacuucucaggccaugagguuauuaucuuuuuuuauuuaaagaguuuaaaaaaaguauuuaauauucucaagcauauaccauauuacugcauuuuuaaaaacaauuuuauuuagacuccuggagaaggagagcauaaaaucauggaauuuaucagauccgagaaagcaaagccagaucaugauccaaacaccagacacugucuuuaugguuuagaugcugacuugguagguauaauuuuuauuauuauaaacuuaugcauugauaguuaaauaucuaagagauuucauuuuguacaggaagcuuacuggcuguggcaacaaauauuggagacacaauaaugauugcuacuucuaucauuaccaaauuucuaaaaaucauuggaaaaugagcuuuuuaaccauaguuuauugaccaacagaucucuauaauuagucuacaggugugacuaauccuagugcugugaauacuuugccaaggucagagaaauggggcugcuuuuuuacccucaggcuuaauacuuggcuuuuaauaccuccuuaucugaaaacuccaugcuccagauaccuuuaguagacuuuuuggcauuaacuuuuuauuauggaaauuuucaagcauaaacaaaaauagaaaagguaauauaaugaacaucguauacccuucaucuaacuuaaauaauuuuaaauuucuaccccuaaucaucugucuccucucccuccuacccacuccccgcccgauuauuaaagcaaauccuaaacauuuuaucauuaauuuguauauguuucauaauguuucucuaaaggauuaagguguuuuuuuaagaaaaaauauauaaccacaaugccaucaucccaccuaaaacagaaauuaaccuuuucuuaauauagaaauaaccaguuaguauuaucauuucccugauugccucauaaauguuucauuuuguuuucuuguuugaaucaagauugaaauaaacaguaugcaaguacauggcguuugauugauaugugucaacagacuguugacuuacuugggguauuagaauacugugugagaggccgggcaagguggcucaugccuguaaucccaucucuuugggaggccgaggcggccagaucaucuaaggucaggaguucaagaccagccuggccaacauggcuaaaccccaucucuacuaaaaaauacaaaaauuagccaggcauagaggcagauaccuguaaucccagcuacucuggaggcugaggcagggagaauugcuugaaccugggagguggagguugcagugagccaagaucgcgccacugcuccagccugggcaacagagcgagacucugucucaaaaaaaaaagauacuaugugagaaaauuaacuggaagugcucuuuuccauuuuuuuuuuuccugaguuuucauauacuggggcuauccuggucuccaaaagaguccugcauucuuuggucauagaaaagcugcugccucuaauuucuaaccaguucccccacggcaaguagaaauaugugaaaaccaagagaagauguuugggauuuggagggauaggaagaggagaggggacaggggauaggguaaugguuaugaaaagcaugugagcuaaggugaacauauuuuucuuagaaaaguacacuuuaucucauucauuaccuacaaauagaucauauuuuguuauuuguauauuuaaugugcuaauuguuucuuauucuuccuuguauagaauuguuuuuuaauugcuuuugugaaccuaauauuauuaaaaaugggagaauaaaaacauuucuuaaucauuuuucaacagauuaugcuuggauuaacaagucaugaggcacauuuuucucucuuaagagaagaaguucgauuugguggcaaaaaaacacaacgguaaauuauauagcauauauguuggaagaaagaaauuacgccuggauaguaauucuuuaacagauacauguuuguaaauacuuuaucucauuccguagguugccuuuucacuauguugauaguguccuuugaugcacaaacguuuuuaauuuuguuauaauccaacucauuuauucuucuuuuuuuaggaguuuucaaguuuuaacuuuuaugguuagaucuuugauucauuuugaguuaauuuuaguguguaguguaagguaagggcccaacuucauucuuuugcauguggauauccaaucuuccuugcauuauuuguugaaaagaccagccuuaaaugggccagaucucaguaguuucuuacuucuacuauauguuauuuaggacuucuuaauucugagaauccuuccacagaacacauaauguaaaccaauuguuuugaacuuuaacauguauuaucuauuauugcaauuguauuuuuaucuuuguuacccugcaaccuucauauaaauuguaugccuuaauuacaagaccuuacuaucuucugaugauacuuuugauuuaagcuuuguuacauuuuuaagcugggaccuuaaaaauaaaauucacuguaucuugaucaucugacuaauuccaggguaugugcuccagaagaaacuacauuucaccuucuacacuugucuuuaaugagagaguauauugacuaugaguuuucaguauuaaaaguaaguauuaauaaagccauggaccaaggauuuccauugcagaaauuuucacuggauuugacuuuguucucuauuuuacuguaggaaaagaucacauuuaaauaugauauugaaaggauaauagaugauuggauuuugaugggguuucuuguugguaaugauuuuaucccucaucuaccucauuuacauauuaaucaugaugcacugccucuucuuuauggaacauauguuaccauccugccagaacuuggggguaagaagaauuuaauaaucucucgaggauacuuuaauuuagugccaccuuacccuaaaaaugugacuuaguuuaguagauuauugcaugcacgcuaaagcagaaaaacauugaggauuuauuuuggucuaaggugcuaaccucugagguugucauuuucagugauucacaaggaaagaaagugaacagaguuaacgaaccucaauuauugauaucuaacuaaucuuugccuuuuuuuuauuauuuauuuauuuuuugagacggggucuugcucuguugcccaggcuggagugcaguggcgacagugcaacguuugccuucuggauucaagcuaugcccaugccucugccuccugaguagcugggauuacaggcaugugucaccaugcccagcuaaguucuauauuuuuaguggagaugggguuuuaccauauugaccaggcuggucucaaacuucggccucaagugaucuggcuucccaaagugcugggauuacaggcaugagccaccacacccggucuaaucuuugccuuuaauuccuuaagaaagccagcauacuuuauugguuuuacuuuuuucauauuuaagcauagaaauucaauuuuuuucgaauggauaugcaucacaguguuuauuaugaagcagugauuuuucaaugaaaacagaaaauugacaaacauagugaugccaaauaaaacagaccacaggguagcagaacaucaguccuuaaguuaacauaucauauuaaaugaucuagauagauuauagaccauauuuaauuuaauuaauuguuaccaaauguuggauuauuauguggaaccuggaauuucuuauauuuggcuuuggugcuuacauguugcauauuauaguagcauaaaauucacagaaacuagggccaguuuggauauaguccaacacuguuuuuucuugauuaguacuguagaacaugaacauucaacauuuuguagaaagaguuuuguagaauuguuuagaaaaaaugucagcuuuuaguacagauuuaaauuuuuguuucuuuuagguuauauuaaugaaagugggcaccucaacuuaccucgauuugagaaauaccuugugaaacuaucagauguaaguaacuagaaauuuuugguuuccugucgcagaguagcuguaaaugaucagucaccaauuauguaauaccagaagaaagggguuuuauaauucuauuccaauugcuuauucaauauaaacacuuuuaccuaaauuaauuuuauuuuuauuugcuuucuauuuguauuuuuagaguaacacaugaggucucccauauauauaaaagaguaacauucuccaauuuccuauaccccaguaguagucacuguuuuaaguuugauuuguauucuucuagauauacuuaaauuauuuaaaaauaaauuuaaauauuucuguacaguuugaucgggagcacuucagugaaguuuuuguggaccuaaaaugguuugaaagcaaaguugguaacaaguaccucaaugaagcagcaggugucgcagcagaagaagccaggaacuacaaggaaaagaaaaaguuaaaggugucuauuuuuuuagguguccuuucauuguuuuaacuguaaaggcaaaaauuauauucuuuguuucucauuuuccuucuuaugauuugggauugccucguuuuauuucucuuccucucuauaggcauuucagaaauugauuugguuucuuuuuuucuauuagcuucugucauuuaaugagaucuucaauaaucaguuccuuauuuuuacuguugaagagguacauuguguuuuauguuaauaaauguggaaaacauuucuaaacauaaaagcccagaaaaugaauuauuuucugggcuuuuuaaaaaaauuacuuaaaacauguuauuaaaaacaauuauuuaaggccaggugcaguggcucacaccuguaaucccagcacuuugggaggcaaaauggguggauuaccugaggucaggaguuugagaccagccuggccaacguggcgaaaccccaucucuacuaaaaaaacagaaauuaguuggaugugguggcacacaccuguaaucccagcuacuugggaggcugaggcacgagaaucacuugaaccugggagacagagguugcagugagccaagacugagccacugcacuccagccuggcugauagagugagacucugucucauaaaaaagaaaaacaauuauuuaaaaccugacagggaggauaccaugaucaugaagguaguuuucccagggcgagguuuauccauugcacucuggaugugcugaugcccugcgauuucgccaaaugugggaaacugaacugcgugacuuaugguaguggaggacugcauucacacuuuccccuggcaauuuuuuuuuaauuaaaaaaaaauuguuauuuuaaaacaauggacuaguuuuuaaaauguggauauuuauaguguuuaaugauaugagacauuaacuagaucagugauuuuucucuagaaaugauuuacauauaaaauacaauagucuaaguuaauaguaauggcaaaaaccacaauuacuuuugugccagccuaauagcacaauaucuaguaaauguuaugugcuuaauaaaugaauaauagaaucaauuagaauaugauaguacccugcagagcaucucugauaaucuccaaagaaugucuuguguuaacuugaaaaguaaaccucuugugaaaaauucuucagccucucuguaauuauuggauucugcugaguuucuuuuuuuuuuuuuuggagacagcaugucacucugucacucaggcuggagugcaguggcgcgaucuuggcucacugcaaccucuaccuccuggguucgcuugaauuccccugccucagccuccugaguaccugggauuagaggugcgcgccaccacccagcuaauuuuuguauuuuuaguagagacgggguuucacuauguugguaaugcuggucucgaacuccugaccucgugaucugcccaccuuggccucccuuaaguccugggauuacaggcgugagccaccgugcccggccaagauucuguugagcuucuuacucuccuugcuguacugguucuauuuagguucaaacuuaaugacucuugcuccaggaggggcaacuguccuuguuuucucuaguguaguccuucucgcugcuuagcucuuccucacuggaacuuggcagcagucagucugcauuccacugguuuuugugugugugugugugucuuuuuuuuucccccccuaagaaaacgggcucugcaacuuuuugggaaccuguacacacaaaacuuaccugucaguaaucccuggcucccccaccacaauucaguacuuaaacuucaccagucuuccagccauaugcagcuaacuuuagagacacugugcaggaauagcccagacacaggaaguugguagaggccauaaguuggaugaaagaaaggaaauggggauaagggaguaggaagaacuaaagagagucauuggcaguagacaggaaaucagagaauagaggagagaaaggauugagaucacaagggaggaaaaacagaugggcaggauaugaaggauguuauaacauggaagaacuauagaaaagcaaaugggugcauggaagagaaaugacaucucauuuugaaauguaucuugccauucauuuuauguugauuuacaauuuacagggccaggaaaauucucuguguuggacugcuuuagacaaaaaugaaggcgaaaugauaacuucuaaggguaaguaugaaguauguguuuugauauguuacuacuuugacaggauaauuguuauaccuuuuauuuauuauuacuaauuuuggguggaacagauuucugugauagcauauaagcaucaacuuggauaugcauuuaucaaaucauuagguggaaaaacaggcuauucauaauugucagucacuaucuuucugacuuuuuuccccagauaauuuagaagaugagacugaagaugaugaccuauuugaaacugaguuuagacaauauaaaagaacauauuacaugacgaagauggggguugacguaguaucugaguacguuuuugccaaugcuuuuauuuuaaaauagaaaaaauuagauuuugcaguuauucagaaaauaugauuuugaugaaguagugggagaaaaaggauuuuuugguuucaugaauuauuguguauguuucaacuagucugguuuuggagaagaugguauuaauucugacuuguauuauauuccugugauaaaaauugcugaagagaaaaugauccuuauguauaaggauuuuuguuacaaaguuguuuauaauaguaaaaaaauuagaaauaaucuaaauguccaauaagaagguucaucauaauuggccacugcuucuucauuacagucaccaucucugucaccucuuccaucuccggaaucugcagaacugcuaaacugguacuugcagaaaguucauaacaauuuggaaggaugcuuauaguacauuauuaaguacaaauuguaaaggcaagacaugaaaucauacauacaguaugcucucauuaaccuuaaaaaaaccuagauauagauaaaagacugaaacacuaaaaauguaaaagugauggcuauaagaugauaaaaaugcuguucuucauuguccagauuuucacuccugaggaaauaguucuuuuauaauaaaaaagcaauauuuuucauauuaaaaaacuaccucccagaaauauguaguuauguaauuucuaagugaauauuuuugccuuuagcccagggcucuguuuuguuuuguuuugaugauuugaagacuuauuuuacccaaacuuagaagauggcauuugguuuuugacaaagaaaggauuagaaggaauauuguucacauacagcacuucugaaagcauucuagcuucugugaccaaauuuuaagaucuuccugauuugcugcuuugcuucucucagauaucaucccauguaaagaagauucccaucccuuucucccgucucacccccacuauuuaagagagugguagugucacuauggaaagcuucauuggguaaaucuucaaccuuuggaccaagggagugguacauuaacugaguaaauaugaauaacagacuuaucuauuuugauaguugguuuaggaaaacugucaugugacaggauguaauuuuuaaaaauauuuuggaguuuuuaggauuauaauuuuuagccauaaauagcuaauucauugauuaaauaaaucaucugagguaaaauguuguaucagcagauaccgugcucuaaagacacgggccugucuucagaaaauauguuauaaugaaaauauucuauuuucagugacuuucuggcugaucaagcugcauguuauguucaggcaauacaguggauuuugcacuauuacuaucauggaguucaguccuggagcuggugagagaauaaaaacaaaaauaaaguuuugucuuuuuauaaugauucauucuacuagagucuuauuuaggaagcacuuccuuuuauuucuacuuaugguaauuuuuuuuuuuuuuuuuuuuucacucuguugcccaggcuggagugcaguggcaugaucucggcucauugcaaucuccgccuccuggguucaagcaauucugccucaacccccugaguagcugggauuacaggcaugcgccaccacggccagcuaauuuuuauauuuuuaguagagaugguguuucgccauguuggccaggcuagucucgaacuccugaccucaggugauccgcccaccuugaccucccaaagugcuaggauuacaggcaugagucacugcacccggccucuacuuaugguaauuuuuuaaaaguuccauacaaccagguuuaaaugaaacauagguaauauuuucuccagcccuaacagaaggcucauaauaagaggucuuaguuaauguaaagauuuaauguucucuaucaaaguuagucaaguuuggcaaagucuugauaauuacuggguuugagugaugguuaugugaggguguucauuauauucucuuuacauuuuuuguguuugcuaaaaaauucucuaucaagaauaauuauugaaguguucgggcacaguggcucaugccucuaaucccaucgcuuugggaggccaaggugggcagaucacuugaggucaagaguuuugagacuagccuggccaacauggugaaaccccaucucuacuaaaaauacaaaaauuagcugggcaugguggugugccucuguagucccagcuacuugggaggcugaggcuggagaaucgcuugaacuuuggaggcagaggcugcaauugagcugagcugagaucgcaccacugcacuccagcuugggcagcagaacaagacucugucucucaaauaaauaaauaaauaaauaaacagaauaaucauugaaaaaugggcuuacuucuaggaagggcuagaaaggugaagaagaaaagagaaaggaguucuuuuuuuuuuugagacagagucucguucugucagcaaggcuagggugcaguggugcagucuuggcucacugcugcaaccuccccuucccggguucaagcaauuaucauaccucagccucccaauuauuugcuuuuauggagaauaguaaucauuuuauuucucauguuuccuauucuagcaaaucccaucugcauuuucaaaccauccaccaaaguagaaaaauuaaaaaccaaaaaaugauacagugaauacuagagacuuuuagaugauaacacaacucuguuugguuugguuuuguucaaagcaccugugcuaggcucuguuucagagcuccaucuagcaauacaaaccagugcaaaauaaugugacauuaauuaugguuucacuuacuacauaaagccuuugaaaaaaguuuuauaaucaccugauucucagggccucucugaggagcaaucucaugaagaaaauccuugauuugccauuuuuaaaauagugugaauguaaguuauuccuguuguaacuuacauuaaggccaagcacauaaaaagcaugcucucacauaaucuucacaacuauuuaaaguaaacauuguuuucucccuuuuacagaugaagaaauugaggcucugaaagguugagaaagguuagguaaucuuccuaaagauuauacacccaagaauuaagucaaagccugucugauuccaaagucuacccuuuuucuauuccacauggcacuuggccuccuaaacuccuccauuuuuuuugaaauguacgccauaauuauggaauacaaaaacauuucaauguuuuugguauccugacucaaacauuagaagcauauugaaauuuuuaaaaauuguuuguucaaagcuuuauaaaauauuuauaccuguaauuaagaugagaagguaauaaaaacaaaaacaauuaguguaugugaucgauacaugguuucauccuuaucacaaauacaauaauaagcaugcuaauucaaagauaaaaguucuuagaucugacugguaauggccagauaaccucagacucacuuuucuuccucuccuugugagcuuuuaccagaacguucaacuguuuuuagucucuugcuuaaaugauccaggcucaagugaccaaacugaaagucuucugacuaccucauuauuucugguucaaucuauugauuggaagauucacuaucaacauuuugagaauuaaaaaaagcauuacauuauacguguuuuucaauuaccugauucaucccaauuucagaaaugugaaaccacacuuuaaaaauucaggaaauaggccaggcgcaguggcuuacgccuguaaucccagcacuuugggaggccgaggcgggcggaucacgagaucaggagauugagaccauccuggcuaacaaggugaaaccccgucucuacuaaaaauacaaaaaauuagccuggcauaguggcaggcgccuguagucccagcuauuugggaggcugaggcagcagaauggccugagcccgggagguggagcuugcagugagccaggaucgcgccacugcacuccagccugggcaacagagcgagacucugucucaaaaaaaaaaaaaaaauucaggaaauguaacauuuguugccaucggaugaccuaaauuuuccaacacugcuaauuucuuauauucagauaguagaauuaugggcaguacuaauuuuuuaaaauuauuuuuauauguuguuaaaauauggggaaaaguauauguuuauuauuaaccuaauucauaaagaugccacuuguuuaaaacucaguuuuguuuuauagguauuauccuuaucauuaugcaccuuuccugucugauauacacaacaucaguacacucaaaauccauuuugaacuaggaaaaccuuuuaagccauuugaacagcuucuugcuguacuuccagcagccagcaaaaauuuacuuccugcaugcuaccaggugggucuuagaauugaauguuuuuauguccuuuuugauauuuagaagcucuuccuccaaaccuagaaacaauaauacucaaauuuauuugguagcuaaguaguuauuuucaguuuuaaaccauaguauuuuuuuaacaagucccuugaaaaguaauucuuugauuucaaguuagcuuuguuuuaaagaugcaaagaaacuccguaaaucauucagagccuggcuucauuuucagcaccuuuaaacagauuuucaauuugucucuacacugaagaaaguaggcuaaaaccgacaaaaucugaagcuaucuacuuuaucuaaacauuuauagauucauuucucuucccuuuacugucuacauuuugguauagggaugguucuaauaagucauuuaucccaacagcaguacuaccucaguauauguuuguuuuuaaacauuuuauuuaucaauuugugaaauaaaaagcuuucuuugguuaacauauuucauguaacaggaggaaaauauuucaggaguugauaagguuaccaaaauuacgcuaagccuacuaaggugauucugaaguuauacuuuguaucguucuuugaggguaacaaucuguucuuuuaauucugugguuuggucaggaauuggaguagacacacacacccccuuuacuucuuuagcagugucagacucccuucugcaucuuucugaaccuuaaacuguuguugauccuggcuucccuuucuucguaaguuucuuugauuguuuuuucccugccuuuggauacaauacgcuuuaauacccaaccacucugaaccagcaugaccaugcguuuuacggucuguuuuaucguacagugcccaugccauacugguuauuuuaaauauuuugaauauuacccugagaguauacugccuuauuuccuuaugcuuucuuugucuaccuccguuauaaagucauagaaauguguuauuggacuauuucucuuugauauuaguggugcagugauucuuggauuuuaggauauuuuuauuuuaaacuaucuuggauguuacauuacuuaauagaaucaguucuucaggacaugaaaguaaauugucaauuugaggcuaaaaauagagaacuacuagaugccuuuuagaugaacugaaaugaagucugaauagaaaaacaauuuagcugugugucuuguagagugaaaaaacaagaaaaaauaauuuaaaaugaauguugagaguaaggaugacuuugcugcauaacuaagucaguaaaauguauaaaugaugaguaguagugaaaucagaauucuuauaguugaaaaucaaaauauagcaaguauauugugacauaucaaagguacaaaaauuuaguuugcuuugcuuagaaauuuuaaacuaacaugaggaaauauuauaaauacauuaacaaaaaacuauauugauauuaguucuuauauuucuauuauacuauuucauauuuucacagcauuugaugaccaaugaagacucaccaauuauagaauauuacccaccugauuuuaaaacugaccuaaaugggaaacaacaggaaugggaagcugugguguuaaucccuuuuauugaugaggucagugcaugaaauaaucauuacauacacauacauucuuaaucagagacuauuucacauagguuaaugagcaauggguuuuaaucaccauuuauguuuuguuaaugagauuuagcuacccucuucauuaugugcauaaaaacuuccagguaugccaauuauaauaaggcugaaguggcuuuacuauuauuagacaaaguaguccucagaacaaggaguaauauuaccggagauaaagagauauuuuauacagauaaaagagucaguucaguucaagaagacauaaaaauccuaaauauguuguaucuaauaacagaaccuaaaauacaugaagcaaaaauuaccagaauuauagcuagaaauuucaacacuuuucucugaagaauuaauaacacaagaggacaaaaauucaguaaggauggccgggcgcgguggcucacgccuguaaucccagcacuuugggaggcugaggcgggcagaucacaaggucaggagaucgagaccauccuggcuaacacagugaaaccccgucucuacuaaaaaaauacaaaaaauuagccgggcaagguggcgggcgccuguagucccagcuacucgagaggcugaggcaggagaauggcgugaacccccgggggcggagccuacagugaaccgagaucgcgccacugcacuccagccugggagacagcgagacuccaucucaaaaaaaaaaaaaaaaaaauuuucaguaaguauaaagaagauuugaguaaugcuauaaaccuacucauagaauuaaauuagaaauaguaacaaagaucugggggauccccauacauuuugaaacuaaauagcacacuucuaaauagccuaugaugaaagaagaaauuaaaagaaaaauuagaaaauauuuugaucugaacgauaauuaaaauacaauacaucauaaugggagcugagcaugguggcacacaugcuguaaucccaacacuuugggaggccaagacgguaggauugcuuuuuuucccucaggaaagaaaaaaaagggauccauggucaguaugauacgacuaaagcagggcuuaaaaggaaauuuaagguucuagacgcuaaacaagaaaaagguuuaaaauaaauuaccuaagcuucuaacuuaagaagauagaaaaagaagagcaaauuaaacucaagcagaaugaaggaaauaaaaagaagcagaaaucuacagaaaaugaacaaacaauggagaauaauuaaugacaucaaaaguugguucuuugaaaagauuaauaaagucaguaaauccuaccuagacuaaucaagaaaguuaaauaaaaggggggaaggcagaaauaaauuaccaauauugggaaugaagaggagcuaucuuauaguuccuucauauaguaaaagguuaguuaaggaauguuauggucaaacuuuaugucaacaaauucaacaaccuagaugaagugaacauauuucaucacaacuuaucaaaacucacagaaaaaaauauaaaaaucugaauagucuuuuguguauucuaggcccagaugucuucacuugugaauucuagcaaacauuuaagaaauaaugccaaucuuacacaaacuuucagaaaacagaagaaaggaaauugcuucccaacauuuuauuagacuagcauauuccagagacccaaauuugacauggcauuaaaagaaaugaaaauuacugacugauacuccuccuaaaaguagaugcaaaaacuccuaaggaaauaacaugaggccgggcacgguggcucaugccuguaaucccagcacuuugggaggcugagguggguagaucaugaggucaggagaucaagacuguccuggcuaacaagauuaaaucucgucuccacuaaaaauaccaaaaauuagcagggcgugguggugggcaccuguagucccagcuucucaggaggcugaggcaggagaaucgcuugaacccucagaggcagagguugcagugagcagagauccagccacugcacuccagccuggcaacagagccagacuccaucucaaaaaaaaaaaaaaaaaaaaaaaaacaugagauagaaucugacagcguauaagaaggauaauacucaugaccaaaugggauuuauuuuagaaauacaaaguuaguuugcaauguaauuuaccacauuaucaauauucaacauccaguuuuuuuuccaccuuccacuaucugaccaagaauauuuuuuucacaaacauccaguuuuaauagaaauguucaacaaacaaggauaacaggaaacauccucaaccuuaugauaaaggcauauaaaaaaucuuacugcaaacaacauacuuaauaguaaaagaaggaccaauuuccuguaaagucaagaauaggacaagauguccauucuaaccacuucuuucuaacguuuuacuggagguccaguguguuaagaugaagaaaauaaguaaaauuguuuuuaguggcaaguggcauuauuaucuauguaaaaauucuaagaaaucuucaaaagagaaacuuuaacugauaaguaacuuuagcaagguuacagaguauaagaucuguacaaaaacuaauuguauuuccauauacuagcaacaaaccauuugaaaauacaaaacuuuuaaaauaagaagcuuaaagauucugcuuaaaauagcauuuaaaaauauaaaauacacagcuauaaacuuaacaacauauguggaagcccucuaccuugaaagagauggaaaaccuaaguaaaugaagggauuauaucauguucauggauaugaagacuuaauauuguuaagguguacguccuccucaauuugaucuuuaaauucaaucccagugaaaauccuagcagguuuuuauauaauugaaaauaugauucuaaaguuuuuauaagauugcaaaggagaaaaccaaaacaauccauauaaagaacaguguuggaggacuuacaugaccugauuuccagacuaaccaugaagccacauuaaucaagacagucuguuauugguauagccauaagcaaauagauaaauuggaacagaaauaguccacccaaauguauguuuaugcaguuaauucaucuucaauuaaggcaccaaagcauucagugaguaaagaaagugcuuuucaaaaguuggugcuagaacaacuggcuauauuugugaauaaaagugaaucuugacccauaccucacaccauacacaaaacuuaauucaaaauaugucauagaucuaaauguauuaauaaaagcuaaaaccauaaaacuucuugaagcaaacuuaggagaaaauuucaagauucugaaaucacuaaccauaaagggaaagaauugagaaaauagauuucaccaaaaucaaaaaaauuuccauuuaucaaaagaugcuauuuaaaaaagaguagauaagccacaguguaggagaaaaaaaauauaugcagaacauacacaugcaugagacugguauccagaguauauaaccagcuccuccaacucaaguuaaagacacaacccaauuuuuuaaauggcaaaauauuuuugaagggccauuuucacaaggcaagauauacaaauaauaaacaauggaaaagugcucaacaucauuaggcaucagguaaauguaaauuaaaagcaugauaagauaccacuauaccauaaucccaguugaauggaaaaaacuuaaaaggcaauacccaauauuggcaagaauguggagcaauuggaauuuuuauacacugcuaaugggaguauaagauggauaaaagcacuuuucauaucuaucuggcaguuucuuauaaaguaaauuauacaccuaacccuaggacccagcaauuccauucuuagauauuuaccaagaggaggggaaaguauguuuaaaaaauguuuuguacaagacuauucauaauaacuaaacuggaaaccgcccaauaccagucagcaggacaauagauaaguaaauugugguacagauuaagcaucccuaaucugaaaaucagaaauuugaaaugcuccaaaauuagaaacuuugagcaucaaucugaugccgcaaauagaaaaucugcaccuggugucaugggauggguugcagucaaaaugcaggugcacaacacagcuuauuugcaucgcaagggauagaagacccucccagcccuuuucagcugcaauauaccuuuucugcacacacccagauucccccacccaagcacccccacaaaggguaauaaaauggcacauguauaggccagaugcgccaauggcagguuccccacaaugccccaaaugggccccaggccuaugugcauuacucacuguauuacuucgcuuauucuuuagucuggugugaagauaguguugacagugucaaaaaggacugcagcuaccccuauggguguuggugucaagaaaaauaggaagcauuuauguuuaccuguagcauagaaagucaaguuguuggagaaacuagacagcggugugugaacugucuuuuagaagaguaugcuauuagaauguccauauaugaccugaagaaacagaaggguaagcuguugacauucugugcuggaagugaugagcagaaguuaaugaaaaagagaauacugcauaaagcuacaaaugaagauaucaaucauguauugaaguacugcauuugucagcauugcugugaauacaugccauuuaauggcaggcugauaaugaaacaaacagaucuaucacagugaacuggaaauugaagagaacugugaacauuuaacagacugguugcaaaaguuuaaaaaaagacagugcucucuucagcaguacauauacuuaaaaaaaaaacuggaaugauacaaagaagauuagcauggcccuugcgcaagcaugauauacaaauucaugaagcauuccaugcuaaaaaauaguaaugauaaaaacaaaaaaguaggccgggcacaguggcucaugccuguaaucccagcacuuugggaggccaaguuggguagaucacuugaggucaggaguucaagaccagccuggccaacauggugaaacccugacccuacuaaaaauacaaaaauuagccagguuggugguucaugccuguagucccagcuacucaggaggcugaggcaugggaauugcuugaacccaggagguggagguugcagugagccgagauugugccacugcacuccaguguggugacagagugauacuccaucaaauaaauaaauaaauaaauuuuaaaagucacagcauugaauuuuuaaauguuugggaugauaaagcaccugcuuaucaugaagcuagagaaauucaaugacacguuugccagggucuuugcuagugauguuggaacaagucuguaaugcugaugaaacaucacuguucgggcauuauugccccagaaagacacugacugcagcugaugaaacagcccuuccaagaauuaaggaugccaaagaccaaauaacugugcugagauauacuuacgcagcaggcaugcauaaguguaaacuugcuguuauaagcaaaagcuugcguucucacuguuuucaaggagugaauuucauaccaauccauuauuaugcuaauaaaaaggcauggaucaccagggacaucuuuucagauugguuucacaaacauuuuguaccagcagcuugugcuuacugcagggaagcugacuggaugaugacugcaagauuuuguuauaucuuaacaacuguugugcucauccuccagcugaaauucucaucaaaaauaauguuuauggcucacaccuguaaucucaacacuuugggaggauugccugagcccaggaguucaagcccacccugggcaacacagcaagacccaaccucuaccaaaaaaaaaaaaaaugaacuggauguugugguguauaccuguauucccagcuaccugggagacugaagugagaggaucacuugagcccaggagguugaggcugcagugagccaugauugccucacugcgcuccagcaugggugucagagcaaaucccugucucaaaacaaaaacaaaaauguuuaugccuuuuugccaucuacuuucucccaaauaugacuuuauuaauucagccaugucagcagucauauccaaaaaauuauugccaagagcagugucaagaagcuuuuguccuguguuuuauucuaguaguuuuauaguuuaaggucuuaauguuuagguuuuuaauccauuuugaguugauuuuguuuaugguaagauaaaaguccaguuuuauucuucugcauauggauauucaguugucccaacaccauuuauugaagaggcaauccuugcccuguuguguguucuuggcaaccuugucaaaaaucagauggcuauaaauuauggauuuauuucugggcuuucuauuuuguuccauugguccauaugucuuauugaaaauacuuuuauguauguuuaccuuuuccauuuucucuuuuguaauuugcuuguuuauauucucuccccauuucucuuucuuuuuuucuuuugauuuuuagcuacuuuauauauuagaaauaguuuuccccaguaucacaucugucucuugauuuguauauggcaucuucugucauauacauuaucuuuuacuuaaaaaaugucuuuccccuuaaggcuguucguuuuuuuucugucuuccuuaaauaaaacuuuaucacacuaaauuaucaauaccaccuagauuuucuucugauacauuuguuauuuuguuauugugauacuuguuuuuauauaugguaggaaguucagaaguguaugugcuuuuuuuucagcuggauagcuaguuaggacauugucauuauuuaaauaccuaaaggacuguuuuggcauagauuugggucuauuauugaacucuauucuguucuucuggucugugggucucuuguagugucaguacuaguguuuugauuacaguagcuuuaucaaaagugauagaaucugguaagacaagucccugguuacuuuuuacuguccauacauuuauucuuccauauuaacacugguaucuuauucuuuuuuuaaaaaaaagauauuuuaaaucauugauguccugacuggaauuacuuuaaauguauaaguuaauuuggaaagauggacaucacuauacuacuacagaauuuguaaaguaagagauuaaugcucugugaauuaugauauaguauuauaauagauucacacuuaaaauuugauuuucugcugccuugcuuauuugcacuuuaguggcaacuguugggguaauagcuucagagaacuuugcagugguagcaguauucuagggcccuuugaaacaauaaauagcauauuuuucaugcaauaaaauggaagaguuucauuaguuaagauuuugguuuuuuguuuuucaagagcacaaaugguuauucuguauauggaggaaaaagacuuauucuguuuguugagauuauggaauuuuuaugcuuguaacccuucucuucaauccuuauauucagaagcgauuauuggaagccauggagacauguaaccacucccucaaaaaggaagagaggaaaagaaaccaacauagugagugccuaaugugcugguaugauagagacacagaguuuaucuauccuucuccauggccagaaaaguucccugccauagaacgauguuguacaagguaauguuacuugguaauuuuucaacaacaaaagagcgcuccuaacacaagggugcgagaaguggugaagggggagcuuugaauaucuguuuggagaauuagcaaauaguuuaugacaguuauagucaauugauaaucaaugaguuacaucuaacuugcagaggaucuaaggaucuuucacacuugugucuauaauucucuacuuuggucagauucuuuguuucucuuuccuucuucuauuaaaaguguuugaauuuuuucucucuaauguauaucccugcauuuugucucccucgaauggauaugugaauuuuuguuuccauugucaguguuucugcucccagcauuauuugauacgcugugauauugauuauaccccccagccacccaacuagaaagaaggaaauaagaaauaaagagcuccauuuuuuucucuucaugaaaauaucuuccuuuuuuuucucuucucucaccuucccugcaaauaaucuacccagauggcaauugaguugcaaauaaaguaaacaucucucaguuacaacuuuuccuuuuguuaaaggaaagagaaagauaaaacaggcauuauaaaauguuuauuuuccauccuggguuuuggaacauggaggauauagagauuuguguuaugugucauauuuuaucuuaaaauuuauauauauaguuuuguuuuagauuaauggggaaaaucucaacuuaguaaucuacaggcaugauugugucuagaccaguaacaauagagaggcugguuaucugcuuguguuuucuuugucuggaacuaauugucauucucuucuuuaaaagcaaggaugacucuuacgaaauauacaagggaaaguuaaaaaacuguaauuguuuguaauguauuaauuuuaaauuaaaugccuugauuuauuuucuagguauaaaauaauauccuuagaugcuuggcguguagacauaaacaaaaacaaaauaaccagaauugaccagaaagcauuauauuucuguggauuuccuacucugaaacacaucagacacaaagucaguggcuauuuaguucagaauuuuuucacuuuauuaagugugaagugauuauggagaaagaauuaaaauuaaauuauuugaauucuuuuaaaguuuuuuuugaagaaaagugguguucaaguauuccagcaaagcagucguggagaaaacaugauguuggaaaucuuaguggaugcagaaucagaugaacuuguaaguauuuuauuuaucauucauuuauuagaugccuauaauguauuaaacuguagcugcugggauguuuaccagggagguauuauauguuguaacucuagaaauuuggagccuaaauaaggaugaagcaaagaaacauucauacaaauuagauaauaguucaagaaccuguaucacugugacacaaugaauauacaaauuuucuagaaauuuuaaaaaggagaagagcuauguaaaccaaaaguuaaguauagacuuguaaaugagaauaggcuugagcugaggacugaaaaacagguuaggacacagaaaaggaggggaaaggcauucuagucaaaagaaauaucaugagccagucauuucagucaaaaaugucauauauuauuguuuuuaaccuuuuuguguaucugaacuauuucuuaacacuuagucuuuucuuuagaauaaaugugauauauuugaggagaaggaauaaauaagccuuauugaagcagaggauuuguguuuggaaauaguagaagauaaguuugaaaaaucagauugaggccagauuaugucgaaccuugaguaccaggcugaguuuggacuuauuuucccaugaccauuauuuuggaauugauauuuucauaaagauuaauuugguggcaguauaauaaacuaaauugcacaaaagagaaaucaaagaaagcgggaaagcuugcgaguguagcaucaggugauagagacauaaacuucagaaguagcaauagaucuagaugaacaagaugaaauaaaacugauagguuucauuauuuggucaaauacagggggugaaaagagaaacuauuaauaguaaaugugacugagauauccaggcuaauuaacuaaaaaaaaaauuguaauuuacuggacuagaaaaguuaaaacaggggaguugauaguuuagggggaugaaaugauaaauaaugauggaauuuuaagguaacacuaggauguuuaaccggaacugccuugccagccuuucuuaaccaguauuccacaagauguauaagcccuaaugcccuaagucauucauuguaagcaauaaauuaacuuaucuucugugcauuuagaacaguaggaguuauguaccaucuuugagagaacagagaaaguagacguauuuuguguucucugauucagaugaaaaaccuguuuagaaagucuguuuauggcugggcaugguggcuuacgucuguaaucccagcacuuuuggaggcugaggcgggcauaucaucugaggucaggaguucaagacaagucuggccaacauggugaaaccccaucucuacugaaaauacaaaaauuagccaaacuugguggugggugccuguaaucccagcuacucgggaggcugaggcaggagaauugcuugaacccaggagguggacguggcagugagccaaaaucgcgccacugcacuccagccugggugacaagagcgaaacuccaucucaaaaaaggaaaaaaaaaagaaaggcuauuuauauacaguuaaauaccuggagcuagagcuuggagagagagaaggauauucaaguugucaacagagaauugaugacuuugagguucauuuccuugaagacaaggugcauugaguguucauggucucagcauaaagaaaugcccacaguuauaaaugguggagagggagccaguagaaacagagagguuaggaagagugauuccaaaguuaaauaguaccacagaagcauggagcagaggauguaagcugcauaaaucugaagaauaauaaaaacucaaauaagaucugugaauuugucuuuuagaacaucaauguugaucuuugaaaauuccauuucgguagauugguggaagcagaauuucaauuucugagaacuaggcuaagauuguguagacgggaaguaaagguagcaaguauuaagcccuuggucaagaaguuauguguuuguuuguuuguuugacagagucucacucugucacccaggcuggagugcaguggcgcuaucuugggucacugcauccucugcugcccaggagcgauucuccugccucagccucccgaguggcuggaauuacaggcuccugucaccacgcuuggccaauuuuuuuuuuguauuuuuaguagagaccggguuucaccaucuuggccaggcuggucuugaacuucugacuucgugauccaccugccucggccucccaaagugcugggauuacaggcgugagccacagcgcccagccuacaguuucuuaaaacuagaauuuuuuacuuaagauauuauuuccuacagaauauuuguagagcauuuuaugguuuaugaaagcuuucauguauaugauuuucuuuuauccucaacauuguaagguagauguuauuccuuuuccucauaaaagaaaacugagauucaguaggauuaaaugauaugccaaagauucuauagcugaaaaagugguagaacccaaauuuggacccgugucuccugauuuuaagucuaauauucuuuuuucaucacaccagccauaaacugaaaugagcuuguauuucuuagauccuguuuuaaauaauugacuauuugauaugaaacagucaauaguucuuuucuagauauuucugcuguucuuuuuauuuuucucaguuaccauaaaaaaauaaggaagauaauuagaaugauagaguuuuacaccuggauggaagauggaauuuuguaaagcaacuaauucaacuuguucauuuuauuuauuuauuuauuuauuuuugagacggagucuugcucuguugccuaggcuggagugcaguggugcaaucucaccucacugcaaccuccgccuccuggguucaagcgauucugcugccucagccuccggguagcugggacuacugcgugugccaccacaccuggcuaauuuuuguaauuuuaguagagaugggguuucaucauguuugccaagcuggucuugaccucuggacuuuaaguuuugggauuacaggugugagucacugcacccggccccaacuuguuuauuuuagaauuuaaaaaacuuaaauggagauuggaaaauuuugccuguguaaaguuuucucuuagaccugaaaucaugaaugaacuuuuuugcuuuuacuuuaagaccguagaaaauguagcuucaucagugcuuggaaaaucugucuuuguuaauuggccucaccuugaggaagcuagagucguggcuguaucagauggagaaacuaaguaaguaagauuugauuuauaauuuuucuaacauauauuugcuuugugacuuugauggcuuuuauugauucauuuuuuuaacugacaaaauuauauuaagaacauuuacacucuguaccaaaaaugaaagucgucuaaugacaccacuugaaguucaaacacuauugacaguuuauuguaccucucuugagauauuuuagaugcauauguuauuuuuucccuuuuaauuucuuggaaguucuauauccuaauucuuuucuagaagugguuaucauuauauuacuuagcaaauacauuucucuuucuaacaagaauuaauagcauauguaaccuucccuuuucccugccccaucuggauuucauuuaaauuguacauuaauuuuuuagggcacauaucuuuuguuuuaagaaaaauaucuuaacauuucauugaaauucacaaucguuuauaucaauaaauguuuagauaaauuauuuuuugucguuuuuuuauuauuucauauaaauuuuaucuugauuucuuauauuuuauuuuucauauggcuagaauuuucugaaauaauuuuuuuucagagaagauggguagauauuauguuuuuugauuuugaguuauuacacauccgaaaugucuuuuuuuuuuuuuaaauuuacacauagguuuagaauuuuggaggcccaguuucuuuuccuuuucucuuagagcucugcauacaucucuccauuauguuauuuuauguaauguugaugagaagucagugccaguacgguuuuuuuccuuuguuggcaucugcuuuuguauaugaaaucuugaggauuuuuuuuaucagaauuuaauuccccuaccuuucugaugaaguccaauuuauuaauuuuuuuaugcuuuuggugucaugucuaagagcucuuauucuagcccuagauccagaagauuuucuuugauauuuucuuugaaaaguuuuauagguuuaccucauuuuauaugaaaucaguaauccauuuugaauuaauuuuuguauaagguauaaggggcagaucuacuuucauguauuuguguaugaauauucaguugcuucagcaucauuuguugaaaagacugugcuuccuccaugucuguuuuuaugccaguaacacauuggcuugauuaccauggucuuaacaucagguagugugauuccuucaacuucacuuuuuuuuuuuuuuuuuuucagaauuguuuuagcuauuuuagguccuuugccuuuucauauacauuuuauaauuuuccuauaucuccaaaaaaucuuggagggauuuuuauaugaauuguauuaaaccuauagaucaauuuggggagauuuaacuauguugaauauucuuauccaugaacacaauauaucucuucauuuauuuagaucuuugauuucucucaucauuguuuugguuuuuuucaucauacugaucagguacauguuuuguuagacuuauaccugaguauguaauuuuucuuggagugaguaugaaugguauuauguuuuaaauuuguuuccccugcuaguauauaaaaauacaauugauuuuuuauguugauuuuauaucuuagaauauuuuuuccuuuuuauuuuauuuuuagaguuuaggacagccaguuauuuuguagaauucuggauuuacucuguuguuuccuuuuagugucauuuaacuuugucgucuaucccacauauuuccuguaagcuagaaguuagggcuaguagcugaauuagauucagguuaaacuguuuuggugaaaauacuuuauaggggccaggugugguggcucaagccuguaaucucagcacuuugggaggccgaggugagaggaucucuugaggccaggaguucaagaccagccugggcaucauagugagacucugucucuacaaaaaauaaaaucauuagcuaggcaugguggugugcaccuguaguccuagcuucucaagagacugaggcaggaggauugcuugagcccagaaguuugaggcugcagugagcuaugaucacuccacuguacuccagcuugggugacagaaugagaccccaucucuuaaaaaaaaaaaaaaacuuuguagauaaugcauacuucauauugaauuuguauuuuuaacucuuuaaaaauguuuauuuuuauauguuuagucucuuaggaaaaaaauaugcuuuuaaauuuuauugacugacugacugauugggagagacaaggucuugcucugucgccccaagugcaguggcaaucauagcucacugcagccucaaacuccugggcucaagugauccucccaucuuagccucccgaguaucugggacuacagauauguguuaccauaccuggcauauuuuuuuuauuuuucuuuguagagacacugucucaauauguugccaggguggucuugaauuucuggccucaaguaauccucacaucucagccucccaaaaugcuaugauuacaggcaugagccacugcacccaaccuuaaauuuuuuugauacauaauaauuguauauauuuguagaauacaugugauauuuugauccauguauaugacauguaauuuucaaauuaucuguuaccucaaacacuuaucauuucuuuguguugggaacauuuucaaucucuucuggcuauuuucaaauauacacuaaauuguuaacuguggucaaccuacuguugcuauagaacacuggaacuuauuccuucuaucuaacuuuguauuaaccaacuuaucuucuucuuccucuguacuucccaugcuuuuaaaauuugaaugaaauuaacaagccuuguucuguaauuuauauuaguuuauaaaaagaccuguaauuauuauaguuuuguaauuuacauuacaguugugggguuuuuugcuaguauaccaugugaaaaaaauauuucauuuggaagacucacacugcuagaacucuauauuaaaccagaacauuuugguuauauaauuuuuauuuuaacucuuaagguuuuacuuggaagaaccuccaggaacacagaagcuuuauucaggaagaacugccccaccaucuaaagugguucaucuuggagauaaagaacaaucuaacugggcaaaagaaguacaaggaauuucagaacagugaguaucguuaaaaguauuuaauaucauggaacuaaaauccguuuuaauguacucauucucuaacuuauuuuccauuuaacauaguaguuacucugaauacuaauuacaccuucauccuguuuuagaaaguaaugaguucuaguuuaaaaugauaccugauuagcaguaguuacagccuugcccaguuugucacuaaaauaccuaaugaaguauagaaaaaaaaugacaaauuaauguaauacuaggaauaacacuuaauacauugacugauuuugagagcuauuuucacuaacuguauaaggccauugaauuuuuuggccacauguaagucaugaaaauuggaagaaaaauccuguuuuguuccucaucuucucccguuccccauucccuuuacucucuuccacccaagccauauuccccagggcuuagaaugcagccaaacugaaaugcuaacccaccugggaauguugguuuucaggaucaccagaguguuuugugucccaugaucccaccccagcagcaccucuccuuugccauccaaacacaagaauucccaaaacaaaagcagaauacgagaggcuggcauuggcacaugaaauguuuuaaauguauaccaucagccuuccuauccauggauaagcuuucggagaauucagggauacuccuucuaauuuuggggcuaauaccaggccacaauauccuuauucaaagaugaauaaaccgggaaaacguucaaagaccaugaaaaaccauccaacaccaaaggagauaaacauagcucucgagagguagagcauauuuuugccucccaacaguguaaauuagauaccccaucauaguuuauaucauucuaaguugucuuuuguagcauauaaauaaaaccauaauaaacuuacuuguaugauuaauuuaauaacucuuucuuuagauaguaugcaccauaagaguagagagcauaucuguuuuuguuacuucuuuauuccaauuuauugguuagugccuaggcacucaguuacugaguuauuguuugaaugaauagauaauauuuuagucaagacuccuuuaauuggaaaaaaaaaucauucaaaguacuucggguaaaguguuuagucauuuguuuauauauguaacauugauaugugaauaucaauguauugauaccugccauaauagauacaguaguaugcauuguaaugaauaaaaacacguaaugaauaauaaugaguaaaaacacacaguuccuacacuuaugauauuuacagcugcuggaugggagacaacuaugguaauugcacuugaaggaguagugcucugagaccauuugacuuagcuagggaggaauuugucauagucagggacaguuucccaaggaaguauugauuaaaucgauaucugaaugcugacugggaguuaggcaaggaaugaaaaggaaguguuucaugaugagggaagacuuacaugaaaagcccuguggcaggaggaaaagcaguguguauugaggaagauuuggcaacaaagaaaaaagaaaguggcaaccucagaaguaggaggacagcuagaagaggguuauaucauguaaaccaaaggaaaagauuauuucaagaacaagguaauaaaccacaccguauauuuugaagagauuuagcaagagcuguauugauugagccauggagcugaaagccaaacuagaguggguaaaggaaugauugagaguugcagaaguggagacacaguagaaauugacaacuuguucaaaaaguucagcugugagagagagaccaagagaucuugaccucuuaucuguuguuccccuucugaaugagcuugaacuucuaugagggcagcaaaggacagagagagucgucaaugcagaagacugcuggagaugauaacaauguauacucguucacucgagaauaguuucuagugccugccaauucaggcuguccuguuuaaccuugucgaccaaguuggguagacaaggcuauguggauucaugagcacuuagguuuauuuuauucuggucaccauuuucuuagacugcuuuucuuugcuaccauauuccccccugauaccaucucacuuuuugucccuuccuuucaugccucccuagcucuucugucuuccaaggugaaauucacaagauuacuguugcucugccccugaggguuuacuuauuugugauuuuugcacauuagaauguuaguagcaugaggugaggauuccauggcucuaacaauaggaguuauccuuaugcagagcauucuuagcucuaugacuuuugcaggaagaauguagaaccuauuacuuaucucauaucuccauguaucuuaacuaagauauguucuacuaaguugaguauauucuuuuccuauaaacauauacaugaaauauuuccauaaguaccaaaucauguaguuuuauuuugagaaacccucuaagcacauaugauguaccuaauaaauuucuguauaccuguguaacaaauuuuuuuucugaugaaaaucaccaguaagagauagcuaaagaaggauauaggauugaguagagcugguuuuugguuuauucagagaguuuuaauuguguguaaaaacaaugagaaggagcagagagaaaacaauaaauucuaagauggaaggagauggauucuuaaauaggauaugagauagcuccucuguuuuaacaguaugggaagcaaauauaaguugguuuguguguuuggcauggggaaagcugaggagcucucauuugauuauauuuuccuuguaaagcagaugcugaguuuagcuauugaggauggcuggaggaaaaggaagguuggucauaaguugaaguagagugaaggagguuugaaaauaguuauucagggaaauagaagacuaucaguuuaucaggaaaaugugguagaaugguaagcaguauugaggauccuuuuugaaguuggagucauaauuuauaaugaaacauucuacccuguguuuugggauagaagugaguucaccagucacagccuuagaaaaaacaaauggcuggauuuacucagcacuggauuuugccacaugagcacaaugaagagacaaagaggcaagagaguuuagaauauuggcaagaauguuacugaagugguggauggugaaaucuaagugggauagagggagaagugaagaaaguagacaguaauaguaguaauagucugggaggccaggcacgguggcucaugacuguaaucccagcacuuugggaggccaagaugggcagaucucuugaggucaggaguucaagaccagccugcccaacauggcaaaaccccaucucuucuaaaaauacaaaaauuagcugggcauggcagcgccugccuguagucccaacuacuccagaagcugaggcuggagaaucacuugaaccugggaggcagagguugcagugagccaagaucacaccacugcacuccagccugggcaacagagcaagacugucucaaaaaaaaaaaaaggucugggagaagauagaaaguuuagugguuuggaaauccuagauaaaauugaacaaaguaguugaacaugcaaguuggaugaagaggaaguuaucagacagugagauguuuguguuagugauuucagagguucgguaguuauggauaaugucaaaaaccaagucauagccauagaaauugcuggcuuacgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcauuaccauucaggacauaggcaugggcaaggacuucaugucuaaaacaccaaaagcaauggcaacaaaagacaaaauugacaaaugggaucuaauuaaacuaaagagcuucugcacagcaaaagaaacuaccaucagagugaacaggcgaccuacaaaaugggagaaaauuuuugcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaugaucacuggccaucagagaaaugcaaaucaaaaccacaaugagauaccaucucacaccaguuagaauggcagucauuaaaaagucaggaaacaacaggugcuggagaggauguggagaaauaggaacacuuuuacacuguuggugggacuguaaacuaguucaaccauuguggaagucaguguggcaauuccucagggaucuagaacuggaaauaccauuugacccagccaucccauuacgggguauauacccaaaggacuauaaaucaugcugcuauaaagacacaugcacacguauguuuauugcagcaguauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaacugaacaaugagaucacauggacacaggaaggggaauaucacacucuggggacuguugugggguggugggaguggggagggauagcauuaggagauauaccuaaugcuagaugacgagugggugcaacgcaccagcauggcauauguauacauauguaacuaaccugcacaaugugcacauguauccuaaaacuuaaaguauaauaaaaaaaaaaaaaaagaaauugcuggcuuaggugaaaugaaggagguuauuggagauaaagagauuaugaaaaugaguuacagugguggguagaucauacauguagacauugacauaagaauagaaugggaaguggaggguaguuuucuacuagagauuuugaggucucagugggcuguaaggagaauaccaaaacacucuccuaccccugagggugcaugguaugaaaacaaacaacuacuauuugauagggaagugguggaaccuucagauaaggagguagaaguugaggauaaaauggagugaaaagguuuaggaauggaagaagaccuggaaaagggggcaaggaaguacuuuauaggacaucauggagaaagugaugcacauagaggauaauuuggagaacagcuccugacagaucuaguaaucaaaaaacaaauaugcaaaaauagaaucaaaauaauauaaugcauugcuguaaaaguuauagaucagauuaugcaccauauauuaaaaacccuuucaugcaggauaguaagaaaauacaauaaauuuuauuucauucauauauauauauauauauauauauauuuuuuuuuuuuuuagugagacggggucuuacuaugucacucaggguggagugcaguggcacauucauauuauaccucaccacaaccuggagcuccugaguucgagcaauccuccugccuccgccucugcaauagcugggacuauaggugcauaccaccaugccaggcuacuauuuuaauuuuuuguagagaugggguaucacuguguugcucaggcuagucucaaacaccuagccucaagugauacuccugccuuagccucuggaguacuuggaauuacaagggugagccaccaagucuggcuaagaaauuuuaaaacagacaacaacacugaccccaaagcaguaaaaguauauaguaaaagaaaaaguaaauggacgaaaaucuuccaaccacuugggaauuuaaaaguuuugagcuaacuauuugggggauuuuauuuuaauagaagcaucgaaauacagccauaccuuguuuuauugugcuucucuuuauugugcuucagagauaguugcauuuuuuuuuacaaauuagaggcuugcgacaaccauguugcaacucuaucagugccauuuuuuccaacaguaugugcucacuucaugccugugugucacauuuugguaauucucacaauauuucaaacuuuauuauuguuauuuuuauaucugucauggucaucuaugaucagugauuuuuaauguuacuauuguaauuguuuuuggucaccaucaaccaugcccauuugagauggugaauuaaucaauaaauguugugugugugcugacugcucuaccaaccaacgguccccuagucucuuucucuuucccuauuccaugagacauagcaauauugaaauuaggccaguuaguagcccuacaauguccucuuaaguagucaagugaaaggaagaaucacauguuucuagguuuaaaucaaaagcuggaaaugauuaagcuuagugaagaaggcaugucaaaagcugauacaggccaaaagcuaggcuucuugcaccaaauaguugugaauacaaaagaaaaauucuugaaggaaaucaaaagugcuacuccagugaauacaccaaugauaagcaaauuaaacaaccuuauugcuaauauggagaaaguuuuaguggucuggauagaagaugacacuagucacagcauucccuuaagccaaagguuaauccacaguaaggcccuaccuuucuucaauucuauaaaggcugagagaggugaggaagcugcagaagaaaaguuugaaguaagcagagguugguucaugaaguuuaaggaaagaagccaucuucauaauauaaagugugagcugaagcaacaaaugcuaauguagaagcuguagugagucauccagaucuagcuaagauuguugaugaagauggcuacacuaaacaacaacccuagacaaaacagccuucuauuggaauaagaugccauccuggacuuccauaggugcagaggagaagccaaugccuggcuucaaagccucaaaaaucagguuaacucucuuguuagggaaaagugcaacugguuacuuuaaguugaacccggugcucauugaccauucugaaaauccuggggccuuuaagaauugugcuaaaucuaugccugugcucuauaaauggaacagcgaagucugaaugacagcacaucuguuaacagugugguuuacugaauauguuaaguccacucuugagaccuacuggucauaguaaaagauccuuuccaaauauuacuguucauugacagugcaccugaucaacugagagcucugauggagauaugcaaggagauaauguuuucacacaugcaaacacaacauccauucacgcaugcaaacacaacauccauucugcaacccauggacuaaggaguacuuugaacuuucaaguuuuaguaguuaagaaauacauuuuuggccgggcacaguggcacaugccuguaaucccagcacuuugggaggcugagguggguggaucaccuggggucaguaguucgaggccagccuggccaacaugaugaaacacugucucuacuaaaaauacaaaaauuagcugagcgugguggcggacaccuguaaucccagcuacuugggaggcugaggcaguagaaucgcuugaaccugggaggcagagguugcagugaaccaagaucacaccacugcacuccagccugggcaacagagcgagacucugagugacugcucugauggaucugagcaaggugaauugaaaacguucuggaaaggauucacuauuauagaugccauuaagaacauucaugauucaugggauuucaaaguaucuaucaacauuagcaggaauuugaaagaaguugauuccgacccuccuauaugacuuugagagguucaaaacuucaguggaggaaguaacugcagaugugguggaaauagcaaaaaaaaagcuagaauuagaaguggagccuuaagauggaaaugaauugcugcuuucucaugauaaaacuugaauggaugaggaauugcuucuuuguuuuguuuuguuuugagacagagucucgcucugucacccaagccagagugcaguggugcgaucucggcucacugcaaccuccaccucuuguguucaagcuauucucgugccucagccuccugaguagcugggauucaggcaagcgccaccauacgcagcuaauuuuuuauauuuaguagagacagaguuuugccauuuuggccagguuggucucaaacucgugcucucaaguguccaccugccuuggccucccaacgugccaaagugcuuagauuauaggcaugagccaaugcacccggccaagaguagcuucuuauagaugaacaaugaaagugguuucuugagauggaaucuacucauagugaagaugcugugaacauuguugaaaugacagcaaaggauuuaggauauuacauaaauuuaguugaaaagcaguggcagacuuugagagcauugacuccaaguuggaaagaacuucucuuguggguaaaaugcuauaaaauagcauugcauucugcagagaaaucuuucaugaagagucagcugauacagcaaacuuuauuauugucuuauuuucaaaaauugcgucagccaucccaaccuucaucggccacugcccugacuaaucaacagccaucaauaucaaggugagacccuccacuaacaaaaaguuaacuacuaauagccuacuguuagcauuuuugagcaauaaaguacaguugaucuuugaacagugugggagguaggggugcugacccccaauacaguaaaaaaaaugcacauacaacuuuugacuccccaaaacuuaacugcuaaaagccuacuguucaucagaagacuugccgauaacauaaguaguugauaacgcauauuuuguauauguauuauauaguguguucuuacaauaaaguaagauagaagaaaauguuauuauaaaaucauaagagaaauauauuuacuauuaauuaagugguagugguugaucauaacaguuuucaucuucgucuucauguugaguaggcagaggagggguucaucugcugucuuggagguguuagaggaggaggaaaaucugcauguaaguggaccuaugucauucaaaccuguguuuuucaagugucagcuguauuugaaaaugaaaguauugucuuagcccagucugaggcuggguaauuuauaaagaaaagagguauguuuggcucaaaguucugcagacugcacaagaaguauggcaucagcauauguuucugguaagggccuuaggaagcuuccacucauagcagaagacaaagaggaacaggcguguacagaucacauggcaagaaaagaagcaagagagggguagggagggaggugccagguucuuuuuaacagucaguucucaugggaacuaguagagugauaaacccccguauccuccucauugcaaggaagacagcagcaagccauuuaugaaggauccaccccaugacccagacaucucucaccaggcuccaucuccaacauuagggauuggauuucaacgugagacuuggugaagucaaacaaacuauauccaaaccauaguagauauauacauuuuuuaaagacauaaugcuauuauacacuuaauagacucaguguaaacauaacuuugguauguacugggaaacagaaaaauucaugugacucacuuuauugugguggucuggaacugaaccugaaaugucucccaaagaauggcuguauacauauggagcaaaaaauacuugcgaauuauagguguauuaaucauaaguauauuacuugaugaauuuucacauguggaacaagaauacaagucaagaaacaauaacaggaauauuaccauaauccaaggaagucccuuguacacccuuuuauccauuaccauccgcugcucccuccccacccccagugacgaggauaaccauuuugacuuguaaccacauacauuuguguuuucuauuuuugaacuuuaugcaguauaaguucauucacacagaguguauucuucuugagccugauuucuuuuggucaguauugugauucuaauauccauauuguuacauguaaucauaguuuguucauuuucacuaaugauacuauuacauuguaugaauacagcacaauuuuuccauucuacaguggauggauauuugaguuguuucucauuuggggcucuuggugaacguguauauaugcauuccuuuuggguauaugucuaugcauuccuuuuggguauauaucuaagaguagaauuacugcuucauagcauaugccuacauucagcuugaacagauacuaccaaaaagguuugcaaacucuuuguaucaauuuacgcucuaccagcaguuuauaagaacuuauguugauuucuguuuucauaaguacuuacuauugcuuuuucauuuuagccauuuugguauaguaguaguaucucauuuugcuuuaauuugcauuucccugaugacuaauaaaauugaacauccuuucguguuuguuggccauuugaauaugcauacucuuuugugaaaugccuguucaagucuguugcccuuuuuaaaauuggguugauuaucuuuuucucauuacuuuauaguuuucuuacuggcuuauugugucauucucaauuucaggggaaaacuaaguaauuuaucuuuaaauaaaauuaucacuguagcuuguuuuuaauuacuguucuuuaucagguuaaggaaauuuccuucuauucugauuaagaguuuuuaucauuaauuggugcugauuuguaaaauguuuuuuccgcagcugucaaacugauuauauuauuuuuauccuguuaaucugaugaauugcauugauugaauuuccaauauuaaucuaccccuaaauuucuggaauaaaucccauuuauuuaugauauauuauccuuuuauacauaauuggauuuuaucuguuuaaguuuguuuuaagauuuuugcaucuacuuucaugagaaauacuggcccauaauuauaaagauuuccugaaauguccuggucagcuguugauaucaagauuacuggcuaaaugacuuuuaagugaaagugguagaaaaaaauucuaauaaauuuuuagaaaaugguguguuucaaaaauuuguuggaaaacuuuuguuucuggcuaaggugacaugacuuuuuucagaccaacuuugccauagacaacauuauuaaaguauaagcugaugugaaaaaauauauaacguguuauauaauuauauacuauauuauaugcuauuuauauagucuauauuauauacuauuuuuaugacauauuuguauaaacaaaacuuuuaaagugugauugguaaagugagcucgguagauggacugaguaguaauacgggcauacuaaaaauugaaucagugagcuaaaugaucaaccuuaggaauuccuucaguaagcaguacaaaagcacaaagagaugaaaauaauaucagaauuuuaauaucuaucuauuaggaguucuagaaagagaaaauggaaaggagauaagaaaguauuccuuaaaugaagaaugauuauauauuuagaugaaaggucagcaaacuucuucuguaaagggcaaauaguaaauauuuuaggcuuuguagacuuuacaaugucugucacaacuacucaacuuuaccauguagcgcaaaagcagccauagacaggaaguaaauggauaacuauguuccaguaaacuuuuaucuaaaaaacuaggaggcugucugaauuacuuuagauuggaaaagccaucacauacuccuggcaacccccaaucuauuuucugucuucauggauuuaccuauuuuagauguuucauauaaauggaaucauaugauauauggccuuuuguaucaggcuucuuucauuuagcaugcuuucgaaguucauacacauuguagcaugugucagugcuuauuccucuuuauggcugaauaauauuccauuguauggauaugccacuguuuguuuauccauuuguucauuuaugaacauuuggauuguuucuaccuuuuggcuauuugaauaguggugcuaugaucauuuguguaucaauauuuguuugaguaccuguuuccaauccggggggguuggaaugcuuagaauuguugggucauguguuaauuauauguugcuuuuugaggaacugccaaaccguuuuccacaacagcugcaccauuuuacagucccaccaguaauguacagauguuccaguuuuuccaugucaucaccaaaacuuauuuuuuucccuguuuuuuaauuauaacgauccuaguggaugugagaacaggaguuuuguauagcucuaugaguucuuauuuaaucacagagacaguuggagaaguacccacagaguaaaauaaauaaugcaaaaagucucaaguuagguaccuggaacugcuagcguauuuauuuaaaguuuauuuacacacuugauuaugaguugauaguuuacgauaguugacgauuaucguccuagaauaucugcauacucauucauauguauauuucauguuuauucuuuauuuuagcuaccugagaagaaaaggaauaauaauaaaugaaacaucugcaguuguguaugcucaguuacucacaggucguaaauaucaaauaaaucaaaauggugaaguucgucuagagaaacaguggucaaaacaaguuguuccuuuuguuuaucaaacuauugucaagguaagucuauaucaaguuucaauucugucuuaauauacacuauuaauacacuauucacuguauaaugaaaagauauguuaauauaaauagacuaauucagcaauguauaauagagauuaucauuuaauauaauuuacaaaauaacuuauuauuuguaagaaguauuacaugcucagacacucaguauauauaguuaggaaacuugucuuuuaugcuuucguaugcuuuuuuuuuuuucuuuuuuuuuuuuugagacagagucucgcucuguugcccgggcuggagugcaguggcgccaucucggcucacugcaggcuccgccuucuggguucacgccauucuccugccacagcuucccgaguagcugggacuacaggugcccgccagcacaccuggcuaauuuuuugguauuuuuuaguggagaugggguuucaccauguuagccaggauggucucaaucuccugaccucgugauccacccaccucggccucccaaagugcugagauuacaggcgugagccacugcgcccagccuuuuaugguuuuuuuuaaggacuuagacucuaaaagaaaaaaucccaccauuaacuuacacccuugaauuuuauauuuuuauucuucaaaaauguuugccuuaaaucuuauaaauguaaaaggcauuuuauuuuugcauuuauaaucuuagauacgauaagaggacaaaaauuuuuuuaaguauguagcgauccuguaauuugggguguuauaguacaguguagugauuaagugacuuaagaacacuggcugccugaguuggcuucuuagcugcaugaccuuggacaagauucauccccuuucugugccccaguuuugucaucuguaaagugaggcuaauaauggucucugccacagagguuugucaugaggauuaaaugaacucaauaaaugugugaagcacauagaagggugccugccauauaaccagucaacaaauuuuagcucuuggcauuauguagaaaaaucuucacauugacauuugcaaacagcauagucauaaucccauaggaaaaaaacuugauacgcaaucuauagaaauuaugacuaagauuauuuacuuuuauuuuauguaggacauccgagcuuucgacucccguuucuccaauaucaaaacauuggaugauuuguuuccucugagaaguauggucuuuaugcugggaacucccuauuauggcugcacuggagaaguuaguuuccauuauuguuacugauacauuuuucucuaguuuaaagcaguuacuuaacuucucuucauuuagguuuaaauuaaaauauaauaaugaagggaaaaaauaaagaauuuauccauguaacuuaugaacacaguguuugacuuauauaucuaaauacuauauaucuaagacuaaagaccauauacuuuuagucuugagcagauuaggaucaagaggugguguguucaaauccugaucucuuuuuuuuuagcaguuuuguuuauuguagugguauggaugaaacgauuuuguaacuauuuuagacauguaauaggcuugagugaauuuguaaaugcguucauauuugaggaacuuugguucuuaaauggaaaaagguacaugcaaauauggaaggagagaaagcaagaaagaaccuauagggacagauuuggaaguauuagugugaacucuugguuucuaaaauauguauauauguuuguauaucuguguauauaggcacauauauauguguauauauauauacacguaugcauauguuucuagcucuauuugcugaaaggaauaagaagcaaagacaccuuagcacaaugagcacauguaccacccagaucuugacgucuaauuucauaacucacuaaaaggaacagggcuucucagagaaauugcugauucuggaucuggggcagggaagauacaagaugaaccuggaacaucuuguuaugucagaaaguaaggaggugcucagaagaauggugggaguaugucauguaaacacaggaaccagguugaggguacuaccacugcccaaaucuuggauacuuugagugacaaaauaauuaaauucaguaguuaauuauaaaccacuggggggaaaacaggaauucaugauuccguagugacaguaaaaagauaaauagggaaaggaaggucucuugucuguaguagcauguaagaaguaaauuuggagagagugcugcaguugaaaaaccauugugcaaccauuaugauaaagauugaaucauguaagaaucaucuuugggaacuaaaucuagggggcauuuuuuuuuuaaaucaggagcaggauauuugcauggucuuagaauguaucuccuacagauuauuuauuagcugcaagggaaacgaaaacuguaauuaugcaggaaaaaaauugagcaacauauuaaugguauaaucaaaguuagcaucgcauuaaaggacagaugaacauuguguaccuccagauguaauacccuuuggaggacacaucaccuaugcaguauucuggcugugaauguacuaccauaaccuaauuauguggaagcaucaaacaaacccaaaauaaggaacuguuuuuuuguuuuguuuuguuuuuaaaaggcagguuggagagggagggacaaauuauauauucuucaaaaugucaauguuggcuggguaugguggcucacuccuguaaucccagcacuuugggaggccaagauaggcaaucacuugaggccaggaguucgagaccaggcuggccaacacagcgaaaccucaucucugcuaaaauuauaaaaauuagcuggguaugguggcauaugcauguaaucucagcuacuugggaggcugagaauaagaauugcuugaaccugggagacagagguuguggugaaccaagaucauaccacugcacuccagccuugaugacacagugagacucuaucuuaaaaaaaaaaaaaaaaaaaaaagcaauaacuuaaaaggucaguguuauaaaaacaaaaaaaggcaguggauacauuuuagauuaaaggaugcuaaagagauaugacaauuaaaugcaauaucugauccuaaucuggaucuuguaauaaaggaagaaaauaguucuauaaaggacauuauuuggucaacugacaaaauuggaauauagaugguagcuuagaugaaaguauuaugucaauguaaauuuauauacuuaauaacuguacugugauuauauaguaaaauaucuaucuuaggaaauacacacugaaauauugaggucagggacaugauguauguaauauauacucaagggguucagaaagauaacuauguauaaguaaauacacacauaguacacaaaaguuaaaggcauuuguuuuacaaugcuaacaacaggugaaucuggauaaauuuuuuuucuuuucuuucuuucuuuuuuuuuuuggagacagagucucgcucuauuacccaggauagaaugcaguggcaugaucugggcucacugcaaccuccacuuuuuuuuuuuuuugcaacuuuuugguacuuugaaauuauuugcaaauaaaaaguuaauuuaaaaaagaaugauugggccaagcacaguggcacacaccuguaaucccagcacauugagaggccaaggcgggcguggggaaauugguugagcacaggaguuugagaccagccugggcaacauggcaaaaucccaucucugcaaauaauugagcuuaguggugcauaccuguagcuccagcugcuugagaggcugaggugggaagauuguuugagcccaggaaggcaagugcagcaagucggcaagccaugauagugccacuacacuccagccuagaugacagagcaagacccuguugccaaaaaaaaaaaugauuguccaggugcaguggcuuacaccuauuaucuuaccacuuuggggagaccaaggcaggaagauuacuugagcccaagaguucaagguugcagugagcugugaucccaccacuuuagccugaaugacagagcgagauccugucuacggccauaccacccugaacgcaccugaucucgucugacagaaugagauccugucaaaaagaaaacaagaaaaaacaaauuaacaaccauuaaagcaaugauacagugacucaaauuuauaguauuauagauccugucucaaaagaaguuaaccauuaaagcaacgauacagugacucaaauuuacaguauuuucauacccacuuaacaaauuucaagagaauuuccacuauccaacuugucauacuguauuucaaaaauaauaguguucaaauaaguuaaaaaauaaaauguacugaaagagacuauacugugauuuuuuuuucuucuaagguucaggauucaggugaugugauuacagaagguaggauucgugugauuuucagcauuccaugugaacccaaucuugaugcuuuaauacagaaccagcaugugaguacaguaguuuguauuguuucauuuagaauugauaaacuuuuaaaauauuaggauauuuuugccaccuccuuugaauuuauuucagauauuuuauuuaauaaugauuagauucucucucccaguugcaucugguauuuaaaaauaaguguggaaucugugcucaaaacuucauguagaucuuuguggggggaaaucacugaaaucccguuauuaauccauagugauuguuauggauuauuguguucaagcuuauaagaggcacauugauuagcacacccucugggaacagauuuagguguuuuaaaccuuucauaauaauucagagccugcauuuuuaguugcaagugacaaauggccuuucugcaaaggcuguauguaucucuucagcuaagaaugaacagucucaauccuaaagaauauuggaaaaaugcauuuaaguuaacagcaucuuuuucaggaccuucucaccaaaaaauuccacuggcguucuuuucucuuguuaaaauagagggaagguucugauaucugucauuuguucuuauugauugguuggauaauuagcuaaaauuaauucgcaaucaaccagcuucauuuucugacucucaugccucguucuuucugauuuauaucuccauuuugauggagcacuuacuccaguagcuucugagaaaacuugcaugucuggagaugucuuuauucuucuccuacacuugauugauaguuugccuggguguagaauccuagauuagagauuauuuucccucagaauuuuguuuugguuuugguuuugguuuuuucuuuuugugagacagaguuucgcucugucauccaggcuggagugcaguggcacgaucuuggcucagugcaaccucugccucccugguucaagugauucuccugccucagccucccaaguagcugggauuacaggcacccaccaccaugcccggcuaaauuuuguauuuuuuuuuuuuuuuaguagagaugggguuucaccauguuggucucaaaccccugaccucaagugaucugccugccucggccucccaaagugcugggauuacaggugugagccacaacaccuggccuucccucagaauuuugaaaccacuguuccauucucuucucguuuccauauuguuguugauaaauccugugccauucugauucugaauuucuguaugugaucuauuuucauuuucugaaaucuuuuuagcaccuuucccuuacuggugcuuuuuaauaaugugaggaugugugccuugguauggaucuuuuuucuucccuucuccuguucagcucuuucaggcuugcaacugaugcccuuccauucugagaaacuuucuuguauuauuucuuugauaauuuucuccucacuauuuuuuuccugcuuucuauuucugggaauccuuuuaguucaaucuuagaccuucuggauugaucuucuuaguuuuaucucuccucauccauuuccuauauuguuauacuucuguucuacuuugggaaauucauucaacuuuauuguuuaucauuuaaaauuucuauuugauuuaaucauuuuaauuucuaaaaguguguccuuauucucuggcuauauauagcaucuuguucuuacagugaauggaauaucuucauuuauuucucugaagauaauucuaggauuuauccuucuauuuuuuguguuuucuguuaaaccuuucauaacaauucagcaccugcauuuuuaguuggaagugacaaauggccuuucugcaaaagcuguauguauccacucagcuaagaaugaacagucucaacccucaagaauauuggaaaauugcauuuaaguuaacagcaucuuuuuuaggacuuucucaccaaaaauuuccaguggcuuuccuuucuccuguuaaaacagagggaagguucugauaucugucauuuguucuuauugauugguuggauaauuaacuuagcuaaaauuaauucacaaucaaccagcuauugcuacuuagccuuuuuuuuuccacuaauaguaaaauauaaagcuuuauauccugugaaaugaauuuaaggcauuauguaucagcacacccaugaggaaacuuuauguauggaaggcagucaucccuaaaaucuuaccaucuggugccauuugaagaacaaauuuagacagcagucaugaaaccaggagaguggcucuuuagauaaaguagcuggagcuuuguacugggaaucagugaagguuaaauaacuuguguuccuucaucccuggcuuuuucuagaucuagaagagccuguccuguuguaugauaguguacaguguuguuucuuucucuuuacauacguuuaacuuucacucaagcugacuucuuuuuuuaccacaacauucucagcuacuuauuuuauauuuucuaggauguuugugaugguuuuaaugaaucuuaaauuauagcaaaacccauuauuucucaaaaggaguacuguuggcaauuugggcaggacaguuauguauuaaauaaaacuguuuuguauauggcaggacaguuggcaucuuuggcucaagggcauuaagugcuaguagcccaugccaguuauuguaauuaaaugugccucuacacguuuccaaaugcuuguuagaaaaguguugcuacuuauauuugagaccuacuaccuuaauucuuugaacuguucuggaaagcauacuugauuuguauuacauuauugcuaaaucugauuauguucuuaaguauguuuuauuguuauguacaugauguuaagaguauaugguaguuuauccuaguuaguauuggauucaugaaucauuugcuuccugguuaaauauuauaugaucuguuacuucuuuuuuuuuuuuuaaugugacaauauguuuucuucccuuaaguauauaaauuaagguuacauuucauugacuguauuaauuaugggucuauacaugcuuguauguuuucauaugauaguaaauauuaggggaaaagaauauuacuuauauccauauaugaaggacacuuuuaguuuuucucaguagcaacgauuuugaugauguaccuauuuuuuaauucaauguaauaauuacugaggccucauuuugucccaaguacuuugcuaggcccugcuuggaauaugaaaauuaguagaaacgaaaacaaaaacaaacaaaaaacuugccuguggaguuugccauuuaguacuuacaguagaguuuauuucuuaagacaguuucacaaacuguauauuuccuccccccuuuuauccauccuugggaauucuguccuuuaaggagaaagagagaggagcagaaaaauucugccuacagauccuuucaaaaaaaaggggaaauggaucuaagugaaaauccuuauauugccacaauccaaugguuagugaugucuugauuaucuccagauuuuaaagguaaagaaauaacauuuaauguaaacuuguguuuccauaauugaccuuuuuguuuuuauauuuaaagaaauauucuauaaaguacaacccaggauauguguuggccagucgccuuggagugaguggauaccuuguuucaagguuuacaggaaguauuuuuauuggaagaggaucuaggagaaaguaaguuuauguuagagaaauuuacuuaaaguggcagaaaaauuaaaugauaaagauuaaaugcuuaauauuucaguauuuauuuucuuauuaauugcucuggauugucuuaaaauugugcauaaauuucucugaugguaaucuuucaucugaauggcacauguuuuaggugguuggaaaagacaguucuuauuuuuuagcagcuaauaaauugaaccuugaaaaaagguaucagagggugugugugaaccucaguaguauauuuccuugcaucuuguuauuucauuuuccucuauaauuacauaauuuauuuacaugcuuuguuaacuuggguuuugaagcuuuucuucuaguuuuucaauuacugcuacuuuggaaauaaccauaauaacuaaaauauagaagaauaaucaaaacugagcuuuucuaagaauugaaagcaaaacuuuuuguuccuugaacgacauuuuaaaacucgugugugugugugugugugugugugugcacgugugcgcaugugugguuuaaauucagcccucauggagaccauaaagcaaauguggguuuaaaucucaaauucaacaagaaaaaugaggagguaccuggauauacuaagaaaguuggaagugaauggauguauucaucugcagcagaacaacuucuggcagaguacuuagagagguaaguacauaauaagauacuaguagucauuccaaaaucuuaggaaaauacuguuuauuuugccuuccugauauuaguuuuagaggacaaauauuuccauuaguaaaaucuggcauauguuacauguaaacuuaauuuugcaucauggaauaucauaggcacuagcuaaaauugaguagaaaaauaccauauuauuaaaaagaaaauauauaaugaaaauugcccucuuuaguuaaaauuuuucuuaacuuacuaucauacauuguucacuaccuugcauaccuaugucagcacugagagaacugauauggauaaacaaagcucuuagcauaguggauuuuuucugauucuuagaacuauguagcuauacagguuacuaucuuagaauuauugaauuuuauugcugaaauuaucuaggaaaucagcaagucaacucauaccaaaagugagaaagccaaguaccaagauucacugaguuacuagugacaaagauuuacaggaaguauauuuacaucugauucauaauuuaauguucuuuccauuauuccacugguuucuaaccuuauauuugaagaucucuuuauuaguuuccuaggcuagcuccuguaacaaaguaccacgaacuggguggcuuaaacaacagaaauuuauugucucaaccaguucuggugaccagaaguccaaaaucgagauauugcaggacaaugauggucccucugaaggcacuagggaagcaucucuguucugucuucucauagccuuauauguucuuuggcuuguaaaugcaucccugcaauccuccguguuuaugugauguucucgcugggugucucacaucaucuuucaucucuguaugucugucucuguguccuaauuuccccuuuuuguaagaacaccagucagaucagaguccaugcuaaugaccacauuuuguuugacugccucuacuaaaaacccuauuuccaaauaaagucacauucgauaacuucugaguggggcaggacacaauucaaucccauauuaccaucuggaaauuuagauuguuucuucuguucacuuucuuauuucuuuaaaaggucauguuuaaacuacuuuuucuuaauuuuucaacuugacauauuuauggauuuucugcugugaguggcuuuccuauccugagcuucagcuuucuuugacuuccaccacucuggauucccucagacacauauuuccccucucacuaaacuuuuaugaagauuuuuuauuaaaucuguauuaaagguuuacuuccuuaugaugaaguaaauguucacaguuggaccuuauggaguauuaagauuacauuuuauuucuuguacacauuuuuguuugcuguuuuuuucauuugcuucuuaucuguguucacauaacaaauucugugucauagcuguuuacacuauggucagacagaucaggugauugcucaguuccauuuuucucuuggagacuucuuuuaaaaccugugucuuccugcuucaguuugaacugauugcucucuagggcuguugugcagcucucauuauucaguuuccugguacugucauccuaggaauucaguuuucuucaccagucugccauauaggauuccuuccuuuucugacuuucaugccucacucuuucugauuuauaucuccauuuugauggagcacuuacuccaguagcuuccugagaaaacuugcaugucuggagaugucuuuauucuucuccugcacuugaucgauaguuugccuggguguagaauccuagauuggagauuauuuucccucagaauuuuguuuuuauuuuuguuuugcuuuguuugagucagucucgcucugucacccaggcuggagugcaguggcacgaucucagcucacugcaaccucugccuccccaguucaagugauucuccuaccucagccucccgaguagcugggauuacaggcaccugccaccaugcccggcuaaauuuuguauuuuuuuuaguagagaugggguuucaccacguuggucucaaaccccugaccucaagugaucugccugccucggccucccaaagugcugggauuacagguaugagccacaacaccuggccuucccucagaauuuugaaaccacuguuccauucuccuuucguuuccauauugcuguugauaaagccugugccauucugauucugaauuucuguaugugaucuauuuucauuuucugaaaucuuuuuagcaccuuuccuuuacuggugcuuuuuaauaauguaaggaugugugccuugguauggaucuuuuuucuucccuucuccuguucagcucuuucaggcuugcaacugaugcccuuccauucugagaaacuuucuuguauuauuucuuugauaauuuucuccucacuauuuuuuuccugcuuucuauuucugggaauccuuuuaguucaaucuuaaaccuucuggacugauccuuuuaguuuuaucucuccucauccauuuccuauauuguuauacuucuguucuacuuugggaaauucauucaacuuuauuguuuaucauuuaaaauuucuauuugauuuaaucauuuuaauuucuaaaaguguguccuuauucucuggcuauauauagcaucuuguucuuacagugaauggaauaucuucauuuauuucucugaagauaauucuaggauuuauccuucuauuuuuuguguuuucuguuuucucuaauugcuuuuuuuccuccuguuugauuuagucucucuugcaguguuaaaguuuuguuguuguuguucuugucugaugaucuuugauauccaauuauauuuaagaaugaggcacuaaauagcugauuggaaauuuaguguacuuaggugggguuuaucagguggaucaggagggacuuuccuguuucuacagaggaccuccuaguaucacuaccugcauguuuaucuuuucuuucccggagagguggccuccacccuuuuccuugacaguggauaugaauguaguggauuaaacugauugccaguauucuggaaguuaaccagggaaagaagguuucauuaccaaguggauacugugauacaccucccagaccacuuuucaagacugaaagaccuauccccuugcagcaggaaugcugcuuuccggcagcccucagcugugagcccucuuuaguaauugccuggaugaggagaacugccucaacuaagguuacuuucccuucccacaacagccgcaaaucaaugcccaaucuauaaggagguauagaaacccagacauucugauugucccaauucauggcaagucugaagggccaucccaguuugagaucuuuguggggcuguucaaggaauucauugagaauuggucacagcccauccucuuccugugcccaauucugcuuucuuccucucccuucccuuccacggguguugaucaaacaagcacucccuaccugcaugcuuaucuccaucccagaguccauuucuagagaccuuaugcuuccuagugacacauuguauaguauuuaugcuuucauuaauucacuguuuucaguauaacaccuguccucuccuccuuaugccuuccucaccccuaaguccgugacugguauacacaaggcuagaguaucuauuugaccucucuaaaauauacgcuacaggucauaugcuggggugguaggcaggcaaccacaugacaguauaacugcuuguuauacaaacuuuaaaucuuacuaaaccucaccccacacuuucaaauguaccuggaaccuauaauuccugagcuuuuucagaguguucuguguuuuaaaucaacuugcuucuuauugacuucccccacugguaguucaagauucaacuuauuccugucugucaaaucagauaauauucauucauccaguuuccaguuucuaaaauuuuaacagguuauauaugccaccagauaccgugcuucauuuuucaucugucucucuaggucugugcucuuuuuuauacuauauugucauuuuaauggauuggagagggauggaagauaagcauauacguucaguuugcuauauguaucgaaaaguccugcacucuucagaaagaaauggaguuuugaaaauuaucagaagaugcuuuuaaucuauuuuaauuuguuguauuguggagugcucuaguuuuguugugaaaauuagaaaacuaaccuauagauaccauuuuugucuaucagcugucauuuuaaugaaagagaguagagucaguaauugaaguuuauuauaaguuuaugacuugaaccuuagccagugggaguuuuuugagggucuaggaguacucugacuuaccagucuuacacuuucuaucacuuuuaauaauaucccuuauuaauauuauaguaguccucaauaagcuuuauauguuucuuuaggaucugaaauuauuauguaggaaguuuauccgaaauuaaccauauauauuuuaagacaauauuuuuguuuguuugaccagagcuccagaacuauuuaguuauauagccaaaaauagccaagaggauguguucuaugaagaugacauuuggccuggagaaaaugagaauggguaagcaagauuuaugauauuuauuaccucauaguucaauucaguguuuucaaugacaacugcagcugguuucucaagaauuucauauuacuuuuuuuuuuuuuuuuuugagacagguucuuacucucuugcccgaaugcaguggcucaaauguggcucacuuuagccuugguucccuggacucaaacaauccuccuaccucagccuccugaguagcugggccuauuaggcguacgccuccacauuugacuaauuuuuuuuuuugacuccuaggcucaggccaugcuccuuggccucccaaagugcugggauuacaggcgugucuuguuacuucuuuuuguuuuguuuuguuuuguuuuguuuuuuugcauuguuucauuuuugcuuuaagagcuuaacaaauuuucuuucauuuauaucaacaaauacuuuuaaacuaaucuuuuugugugucuuuuaauuacuaagagguaacauguccauauuuauauuagauuuagaauuagucccgauuaaguucagugacuaauuauuaguuauauaaguuuuaugucuuuuauaauuuauagcccugagaaaguuuuaaucaaauuuuaaaaauuauuguuuuugcuuuagugcugaaaaaguucaagaaauuauuacuuggcuaaaaggacauccugucaguacuuuaucucguucuucuugugauuuacaaauucuggaugcagcuauuguugagaaaauugaggaagaagucgaaaagugcaagguacuaacuuucaguaaccaagauuauugaugagauuuggaauuaaauggacuauacuuuacaaauaauucauuuguguuucaaccaaauaaaacauauacuuagugauucuaauuaguaucaaauaauccuguaauuuaaaaaaguucuaaccauuuauaguagcuuuuaguagccaauaguguuaugccaaauuuauauuguauagcacuaauauguuaauggcuacauuagccaucauaacuaauuauaaacuuauaaaauuauauuuucaauauacaaaagccauaguauuuaaauuuuaugcccuuguaguguuuccaauauugagaauuaauauuuugugauuuuaguuacaguagaaaguuugagaauaagguuaauaauccccuauuucuuccuguucuaacuacauucuuuuuuuuuuuuuuuuucuuugagacagaguuucucucuguugcccaggcuggagugcaguggcaggaucucggcucacugcaaccuccgccucccagauugaagcaauucuccugccucagccuccugaguagcugggauuacaggcgccugccaccauacccagcuaauuuuuguauuuuuuaguagagacggcauuucgccauguuggccaggcuggucuugaacuccugaccucaggugauccgccugccucagccucacaaagugcugggauuacaggggugagucaccacacccagccucuaacuacauucuuuaaagacacaguucaucuuuuuguagaacaaaaaaguuuaauugacuuuugacagucaauucuaaaauauacucuuguuuuuuuuuuuuuuuuuaauuuuggagacagagucucacucugucaccgaggcuggagugaaguggcaugaucucggcucacugcaaccuccaccucccagauucaagcgauucuucugccucagccucccauguagcugggauuacagguaccugccaccucgcccagccaauuuuuauauuuuuuaguagagacggaguuuugccuuguuggccaggcuggucuugaacuucugaccucaggugauccaccugccucagccucccaaagugcugggauuacagacaugagccaccgugccuggccuaaaauguacuuuucuuacucauacacucauugaguuacuaaaaauuuuugaacucccucaaucucuccuauuucuuacgucucgcuuucuuuuaaggaguagacuuuuauaguagaguugcguuguuuuaucuauagaaaaugaauugauuauuuugccuuuuucaacuuuuuauuucauguuucacaaauuugcccuuuguauuaaaaugcuguugcuuugccaacacagcauucucuuguucgaacuaauugcagaauaaguuaagaacugggcucuggagcugucuccccuaacacccugaguuugaaucgguuuuucaauauuaauaaccuuaggcaagauacuuaaccuuuccuuccauaccucuguuuccucauugguaaaauuagaauaaaauaguaccugccucagaguguccucaaaaagauaaacugaguuaauauugcguaaacuacuucuaauaaugccuagcuauuauuaaugccuaauaaugcuuagauguuuuuauuaauuauuauuuaaauuauccuaucacauacugaagagcugugauuauagucuagaaaaucaccacuagaugacucuuuuucucuuuaggaaaaaauauaaggcucagagccaagaguuuaauuuuugaaaggucauuuauuuucagcugaggauagaaagccuguauuucuuuuuaauugccuuucaauguagagugaaaucaguuuguucagcaucauuuuugaggugaguuuuccaguuaacaaauguuuaaaaccuuaagccccccaauuuuaacccauuuggauucagagcuuucuaaaauguuucacacauuuucccuuuacuuuacaaauggaagauacauauacaacgucuuagucugugauauugauuacauuuuaaaauauauaugugcauauaggcugagugcaguggcucacgccuguaaucccagcacuuugggaggccaaggcggguggaucaccugaggucaggaguucgagaccagccuggccaacauggugaaacccugucucuaauaaaaauacaaaaauuagccaggcgugguggcggguaccuguaaucccagcuacucgggaggcugaggcaggagaaucacuugagccugggaagcggagguugcagugagccgagacugugccacuguacuccagccugggcaacagagcaagacuccauaucauuuuauauauauauguguuaaauuuauauguuuauaaauuaaauguuuauauaaauacauauuuauauauaaacauguaauauauuaacuccauaucauuuaauauguauuauauauaaucauauauaugaucauacauauaugcauauagauaagacaggaguuuucuuaaaccuguuaauuugucagggaggugcaguuaugagugauuuuuuuuuuucuuucaggauuauguuacuagggcaauaaaaggagaaaaaacuaaaaaacacuguaauucugaagaucauuuaaacuuuucuuaguaaugcaggaucaucauuaaaaguauuaguaguuggcugggcacggugacucacagcuguaauuccagcacuuugggagaaggguggaucacuugagguuaggaguuugagaccagucugggcaacaucuccacaaaaaauaaaaaaauuagacaggcaugguggcacacgccugugguccuggcuacucgggaggccaaggcaggagaauuacuugagccagggaguuugaggcugcagugagcuaugaucacguuacugcacucuggccugggugacagaggaagaccuugucucaaaaaaaauaaaaaaaaaagagucaguuuucuuguuggaacaugguuuccaaacucugcuaauuaucaaaauuacugguagaacuuuccuuccauaccucuauuuccucauuguuaaaauuagaauaaaauucuggguucuuccucuagagcagugcuucucaaacuuucagguaacaaacaaaucaccggagaaucuuguuaaaauauaguucucauucaguaggucuggggugugacuugagauucuggcauuucuuucuuucuuuuuuuuuuugagacggaguuucagucuuguugcccaggcuggagugcaguggugcaaucucgacucacugcaaccucugccuccuguguucaagcgauucuucugccucagccuccugaguagcugggacuacaugcaggcaccaccaugcucggcuaauuuuguauuuuuaguagagacaggguuucuccauguuggucaggcuggucuugaucuccugacuucaggugauccaccugccucggccucccaaagugcugggauuacaggcguaagccucuucaccuggccaaaauucugcauuucuaauaagcucuuaggugaucauauuuugaauagccaguccccaaacuucucauacauuagauauggguugggccuauuaugaacauuacccagcuuauucauuugccugaugaaucaguuuugauccauguccucuaaucaaugcuauaguguaauaaugccuguuaaugucuuagagcauauggguuguuuuuugaugugcaauaccccacugugccugcuuuuuaaaguucccuuaaaucucuucauagucuuuccuuuugcuguuguagucuuuuagugcaucuagucggcugugggcauagauacuuugucauuaaggccuucacuguucacucuauuaaaauuguaaugucucccccuacugcuguccuccuuaacugcuucauuuuucucuaggcuuuuuaccugcuagcaugcuauauaucuuccuuauuuuguuucuuguauaucucccucaacuagaguaagagaacaguucacugcuuuauccccagcaccuagauuaaucaauauacagcauacaaauggaucucaguaaauauucauugaaagaauaaaugaaaugccucauaacaaaagaaaauagacacuguuuaaaggcuugagcauuuuauaguauguaaauacaugaacccuauaguuuauggauucuauagccuggaucuguucuguguccuuuuguacauauucccauaagcuauguucuaaagagaggugacugccauauaauuaaacugcuguaauuuuuaaaauucgauaagaauuaacuuuaaauuuuuuuaguaugaauaguaguuuauaaauuguaaaggauauaaauuuuucucacuuuuuuauuagauagaacagauaauauguccaucuuacagauggaaggaggcugaugccuaaaguaguuaagugugaguucacagaacuagcaaguaucaaagauaggagaaaagucuucuuccagcauuuuuuagauaaugaaaagauucuaauaucgcauuuuacaauaaauucaaagcaaaggguuuugucaaaugaaugccaccauaauuuuuauaaguggccacaaaauucaugguauugucauaggucaguacuugauacuuuuuaaaaauauauacaucuuuguuggccauuguauguaauucuuuucauaguuauaaaaaagacauuugaauaggauagcauuuauauaaaggccaaaacagacaaauguaaucuuuuguguuagaaguaagguuacuucuggaaaggguaguaacugggaggagauggaaaggauuucuuguguugugcuuagcaauguuguuucuugaaccagguauaguuauacauagauacacuauaaaaguucauuggccuauauacuuauaauuuugcauuuuccuccccaugcugucuuauacuucagcaaaaaauuuuacuuuaaaaaauuuuuaaauaaugauuuaggcuauaggcauuuuauauguguuuauuucuucuugcugcagcugcagaacuuuaaauauuuuaaaaauuaaucucuucauuuggcuuuuuaaaauucagacauguggaaguagugaguagguagugauuuuauaauuuuauauuuuaaaaauauuuaacaauuuuucuuuuuccucagcaaagaaagaauaauaagaaggugcgaguaacagugaaaccccauuugcuauacagaguaaguuuccuaucaaagaauucagaguuguugcuuucacuuugaaugcauggaaggagcaaagauguuuucaguauauuaguaugaaaauuuuuuuguuuauuauaauuaauagcuuucuucucuucagccuuuagaacagcaacauggagucauuccugaucgggaugcagaauuuugucuuuuugaccguguuguaaaugugagagaaaacuucucaguuccaguuggccuucgaggcaccaucauaggaauaaaaggagguaauauccuaauacuugaaaugucuucaacguaauuuauauuguaaaguaauaaacaggcuugucuguuuuuuauaucuaaccagaaagugacuauaaaucaggaacaaacaaucuuuuuauguuuuaguuaaauuuuuuuuagguuauacuuuucagagaaaaaaaaaucucuucuguuuuuuauuguauaaucuggaaagagauuaaaaggagaaacugagaaggggcugcugagaauuuaguaguuuuauaucacauuaaaauuaugcaagaucuuggugagcauacauauguuuucaugaaacugauaauuuucauugcuucuccugaguuucauugcucagagcuuuauuuucauuguaaucacuuauuuucugagauuaaauuucauuguaaucacuuaguuucugagauuaaauauauauuacguuaguuacaguuaaaagacuugaaaauuaaauguguauauuaauuuggacuuuaugaauacaacuaaauuacauauauaaaauagaccuaucaaucuguugcacaacagugugcauacaguucacauuacuguaccauacgcuuaaaaguggcuaagauggugaaaaaaaaaaucagagaagggggaaaauaaggaagcagcagcuaaauaucugaaugugcccccaaagauauuccuggaauaaccagcuuuauagcauagauucaaaaaaaguuagugccagcaugaagcagcaucaugcacccaggagucagugugcuggcagcaccauuccucuauauauaucccaggcaccgaaccucuuggucucacuaucccaaaaguaggaagaacagacgggccacuagcugaagagaacugcuuaauuagugccagcaaugugccaggcacuaacauauuuugcauuuaacccucacuaucacccaagggguggguguuauuuccucaccugauaaguuaaguaaucuuccuguguuuacauagauaaguggcagagcugggauuugaacuccuuccccugauuccuaccuaaauuugaacagugguucuguacauuuuccauuuguagauccucuuugaaucuuccugcccacauaacuaaaagaauuuucuucccuaauuuuuuuguuuacuuuuuuggaagacucacuauuguuaaaaugucagugaaaucaguugcuuugauuuauacagucaaagaaaucccaaucaagaucccagcagccuguuuuguagaaauugauaagcugguuguaaaauuuauuuaaaaagcaaaggcucuagacuaaccagaaaaaauugaaaaagaaggacaaaguuggagaauuuacccuaccugauuucaaaacuuuacaaagcuagaguaaaauuuacaaagcuagaguaaacuuuacaaagcuagaguaaacuuuacaaagcuagaguaaacuuuacaaagcuagaguaaacuuuacaaagcuagaguaaacuuuacaaagcuagaguaaacuuuacaaacuagaguaaaauuugcacugaaaaacggugugaauuaauaugaagaugacauauagaucaauggaauauaauuagagucccgaaauagacccaaaccuguauggucaauugauuuuacaacaaugugccaggauaauuugaugaagaagggauaaugucuuuaacaaauggugcuguccccguuaguauaguggugaguaauaagaaaaaaaauguaauuuaauuuaaaaaucgugcuguauauauugaggacuuguuuaguguaaaagaaaaaaaaugguguuggaacaauuagacaccauaugcaaaaaaaaaaaauccacaacuccuuaccuuacaucuucuauagaaauuagcucaaaaugaauugaagacauaaauguaagagcuaaaauuauagaacuuuuaggagaaaaucuuaauaaccuagaauucgguaacgauaucuuaaauaacacauagagagucugaaagaaaauugccagccuggugccguggcucacacuuguaaucccaacacuuugggaggccaaggcgggaggauugcuugagcccgggaguuugagaccagccuggguaacaacgugaaacucugucuuuacuaaaaaaauuuuuuuuaauuagccaggcauaguguugugcaccuguacucccagcuaaucaggagggugaggugggagaaucacuugagcccaggagaucggagaugcagugagccaugauugcaccacugcacuccugccugguugacagacugagacccugucaaaaaaagaaagagagagagagagaaaaggaagaaaggaagggagggagggagggaaggaggagaagaagggaagaaagaaagaaaagaagggagggagagaaaaagaaaagaagaaaaggccggagcaggagggagggaaggaaaaagaaaagaaaaagaaaaaggccaggggagggauggaggugggggugggggcggggguaggggggacgaagaaaaaaaggccgggcacucaugccuguaaucccaacacuuugggaggccaaggcggguggaucacuugaagucaggaguucaagaccagccuggccaacaugaugaaaucccgucucuacuaaaaauacaaaaauuagagacgggcgcaguagcucaugccuguaaucccagcacuuugggaagccaaggcgggcggcucacaagguuaggaguuugagauuagccuggccaauauggugaaacucugucucuacuaaaaauacaaaaauuagccaggcaugguggugcaugccuguaaucccagcuacuugggaggcugaggcggaagaaucacuugaaccugggaggcagagguugcagugagccgagaucaugccacugcacuuuagccugggcgacagaucgagacuccaucucaaaaaauauauauacaaaaauuagccaggaaugguggccggcaccuguaaucccagcuacucaggaggcugaggcaggagaaucucuugaacacaggagguggagguugcacugagcugagaucacaccacugcacuccagccugggcaacagagcaagacucugucucaaaaaaaaaaaaaaaaaaaaaaagagagaaaaagaaaagaaacaaagagaaaauugcuacuuuagacuucaucgaaauuaaaaaaaaaaaaaacucucuucaaaagacaccauuacagaaaugaaaaggcaaauauuagcaaaacauaaauccaacaaaaugcuuuuauuuagacuauauaaaaguuuuuuuacaacuuaacccaauuuuuaaaaugaucaaaauagcugaacagauauuuuaccccagaagauacauggauggcaaauaagcauaugaaaagaugcucaacaucauucguuguuagggaaauacaaauuaaaaccaaauaagauauuaccacauacagacuagaaagacuugaauuuaaaagagugauuauaccaaguguugacaaugauauagggcaacuagaacucuccuauauugccagucguaauguaaaagauaaaaccacuuuggaaaguaguuuaguggguucuuuuuuucuccccccauuggugggcuaucaugauguagguaaguccuuaaaaaguuaaacauacaucauagcauagggcccagccaucccauucauagguggguauuuacccaagagaaauaagggcuuaaauccacauaaagccuuguucaugaaucuucauagcagcuuuauauguauguaauaaccaaaaacuagaaauaaucuaaauccccaucagcagaugaauggauaaacaaauucuuggauacauaugcaguggaauacuucucagcuauaaaaaagaaacaacuacugauagacacaacauaggugacucucaaaauaauuaugcucgaagaagccagacaaacgaggaauacacauuauauuauuucauuuacauaaaauucuacaaauguaaaguaaccuauggugacagcagaguuuuaguugccuagauuaggaggauucggauuacaaaaggacauggaaaguuuuggaagugauuauccuauuuaucauggcuuuaugguuaauuauguauguuaaaacucauuaacuuguauauuucagauaugugcaguguaucauaugucaguuauaccucaguaaggcuguuuuguuguuguuugguuuuuuuuuuuuuuuuugagacggagucucgcucugucgcccaggcuggagugcagugaugcagucuaagcucacugcaagcuccaccucccgaguucaugccauucuccugccucagccucccaacuagcugggacaacaggcgccugccaccaugccuggcuaauuuuuuuuuuuauuuuuuauuuuuaguagagacgggguuucacuguguuagccaggauggucuugaucuccugaccucgugauccaccugccucggccucccaaagugcugggauuacaggcgugagccacugcacccagcccaguaagacuguuuuuuuuuuuuaaaaaaguacaugcccuaagacucagcaguuuucacuuuuaaccuagggaacauucaccugcauaaaggacacauuugcauguucauuguagcauuguuuauaauagcaaaaguuagaaaucaccuaaauguuuauuggcaggagaguggauaaauuauuguauacccauagaugggauacuauauauccagaaaacugaaugcacauguuuacgugggugaaucucacaaauauaauguugaaagaaaaauaaguugcaaaauaauauauucucuaugauaucauguauauguuucaaaacuugcaaaacaauacuauguauuauucauagauacauauguauguaguagaaguauaaagaaacauaaggaaucauaacugccaaauugaagauaauguuaccuaguugggaauugggacaauaaugauccucuaaggcacugguauucuguuucuuagcuuauauaauguuccuuauauuaauauuaugccauuguucauauccugaauauuuuauaucauaucuagaauuuuauaauaaauacuuccaaacacuccaaaaacuuaucuguugauuuuucaucauaugauuuuuuagugucucuuuuucucucccuauuguaacagcuaauagagaagccgauguacuauuugaaguauuauuugaugaagaauuuccuggaggguuaacaauaagguuuguauuucccaaugauaauugcccuuugugaauauguucauguggccagugacuuuacauuacuuuuuauuuguuuacaauuucaguuugugggauguguaagacguacuugcuacuagggauguaacacugaauaaggcagacaugcuuucuacccucagagagcuuucauuuuagugagggagguaauuaagcaaccgauuacauuauuaauuauuuaauuaaagcauggcaagugcuaggaagaagugcagguuuuuauaaagaguaugacccauccugagaguaacagaaaggccucuuugaggaagugguauuuaagauagaacuugaagaaugaauaauagcuaaccagggagaaaaggggggaauaaugacauuugcacaggaagagggaauagcauauguaaacaaugcuauuaggguuaaauaacuugaggaauagaaauguccuuugaaauuagugacauguaugucuuugucaccaauuuuaguggaguuguagguacucacgacagauuggcaugauuugacaagugaauggcagguguaguaauggagacaggaaauugaggcaacacuugggaaguuugacuauaaaggaaaggagaaaguuaacuggagguuaggagguuuaaaggaagaggguuaaauuguuuuuaauuuaacacagauaagacaaguguuuugggggaaagugccaauagaaaguuuaaaguuauaggaacaaguaucaugauaaaaugagaggcaccaugguguaaacuugcaguuaaacguuguauuuccuuggguagguuaauuaagugucugacccucaauuuccucaucuauaaugaagauauauacauacuucccuagguuauugugaggaugagaugaaauccuuuccaguuuucugcuuucuaaaaaucagcuggaaaacugaacugaauuuagcuuaguuuccuuuuuuccucuauuuugauaagugaguaauuaaaauaaaaaauuaauuacccuuuuuuaaccuccuuacaugaacucacagucuuuggcuguuauaccaaguagucaccuucaggaugcuauuauuauuguuuugcaacuuaaauaugcuuguuauucaaagacuuuuccggucuacacucuucacauacagcagcagaauccggaucuccugucugauuuuauuuuucaugaaaguguuugauuaccaauaccuuugauucacuaacuuuccaaaauauauuuuaaguauauuuuugugguuuuuuccccccucuccuaguaagggacagugaauuuacugacugauagagagcuggguaaaagauuaccugccugcaguguauucauuucuguaauacagaaucuuuaguaaguuuaguucucaugaaaauagauacuuccuagcaaccuugaacuuacaaagguuucucauagaaaucuacuuuuccacuuucuuucaauauaagaaaauuauacucucaaagagaaaaaaaauaggugauagaguugaaaacuuaacaagagaaggauucuuuaauaucugacacguuuaucaaagccaugaaagauggaaaucacaaauacuugucucuuaagccuuuccagguacaggcccagaacuuuaagaugggaaaaugagggaaaaaagggcuggacuccacauuugaccgauagacaaaugagaucaaagcugacauuuacccuguugcuuaggaagagcuauacugagaaugguuccaugcuccugagcuuucauaaccuagacugcccaaaccauaguuuucguuuuuuuguuuuuguuuuuguuuuuguuguuguauuuuguuuuuugagacagauucucacacuguugcccauucuggagugcaguggugcaaucuuggcucacugcagccugcaucucccagguucaagcaauucuccugccucagccucccggguagcugggauuacaggugugugccaccaugucuggcuaauuuuuuuguauuuuuaauagagacagaguuucaacauguuugccaggcuggucuugaacuucugaccucaagugaucgaccugccucggccucccaagugcuguggcugggauuacaggcaugaaccaccaugcccgcuccacaguuuuuaagacguucgaggccaggcaugguggcucaugccuguaaucccaacacuuugggaggcuaaggauggagggucauuugagcccaggaguucaaaaccagccugggcaacauagugagacccugucucuaagaaaaaauaaaaaagcaugccaguuguggugccuugcaccuguggucuuaguuacucaggaggcugagaugggaagacugcuugagcccaggaguucgaaacugcagugaguuaggauauagcaccauugcacuccauccugaguaacagugagaucucaucucucaaaaaaaaaaaauuaauucauaaauuuucaguuguauucagcaauuaagaugcaagcuucuuaacgacaaaucgacacacaccccuagaacauaguuggguuuucucuacuuaguaaauacuaaauaugcucuuaggaaaguuuuuagaaauacaucaucuuauaaauugagcuauugcugugauuugagguuccucuaccgaauuaaaaaguaauauuuacuaaugcugaugauggauuguccaccaaaaauuauuugacuuuucucccuaacacauuuaguauuguuuuccuuccaacccugauauaacuuuuacuuuuagaugcucaccugguagagguuaucgacugccaacaagugccuuggugaaccuuucucaugggagucgcucugaaacuggaaaucagaaguugacagccaucguaaaaccacaaccagcuguacaucaacauagcucaaguucaucaguuuccucugggcauuugggagcccucaaccauuccccucaaucacuuuuuguuccuacucaaguaagacucucagucuuuaacuucuccucuaccccuuuuacaaaucacaaaucacagcagacuuuguaaauguaaaccuaauuuaacuuaguuucccucuuuuauuuaaaaaguuuuggcucaggucaauuccaaauuuaagauacuaggcuaauaaagaaugcuauugcuagcauucuaccucugcuauaaaauaacaguuguauuaaaggaaaaaaguguauuuaaauaaggaacuuaagaauguccaugcuuucucuguaaauguuuacauuucaaguuaacauuuaauuuuuuucuuguauaauccaaauguccuaugcuaucugcuauaaauaacauaaauuugaaagauaaagggcaaggauuauaucacguuuaucaaaagcaauuuucaaguuucuaccauacaauuuaugggugauuuccuuuauuuccucuuucuggggacaaaaauugaguugucuugugugagacacuuuauuuaauuccaugaccccaaaucucaugcuuauuaaguacguuuuuuuaacccaaauaguaccugcuuauuauaaaccaauuggaaaacacagauaaguagaugauaacaaaggaaacacaagcaaaaguccucuaaaaucucauagguuaccacugucaaaauuuggugccuauuuuuccagaguuuuaaucuuaauaguugauauuuaaauuuauuagauuauuuuguguaaggugaagauuuuaaaaauaaaaucuuuaggugucaauuugagugagagaauguauuuuaauacauuagaagacaaaaaaccuauuggugggauauugauucaguauaaucuuuuauaguguuuguuaugcuuuaaauauuuuucaacaaauaaaaccauucaaaacuaauugcauauaaagaacaccaguuucacucucauagaauacuuuugugauuacuaugcugagcuuuagaaaaaaaggaacuaagagauuucacauaaugaaaguuaguuuagggguggacgugguagcucacaucuguaaccccaacacucugggaggcuaaggcaggaggacugcuugaggcaguaguucaacaccagccugggcaacacagcaaaacauggcaacccaucccuagaagaaaaaaaaaaaauaguugggcaugaugguacacgcuuguaguccuagcuccacaggaggcugaggauugagcccaggaauucgagguuacaaucaccuaugaccccaccacagcuccccagcuugggcgacaugagcaagaccccacaugaguaagaccccaagucaaaaaaaaaagguuuaauauccugucuaccacugaauaacauuaauagaugaauuauuugauuuuuaauauguauuuuuauuucuuccuauuucauuuucucaagaaauuguuuguacuuugcuagguaccuacuaaagaugaugaugaauucugcaacauuuggcaguccuuacagggaucuggaaagaugcaauacuuucagccaacuauacaagagaagguuaguauuccuuguuuugauggacaauuaauuuaaagaaaauauauuuuuauauuuuucuuuuaagacuacaaugauuauuuuucugugacaucucauaaaauagaaaaugacaauuuugaucaugaauuuucuuuuucuuuuuuuaaauaauuucaacuuuauuuguuuuagguucaggagauacauguacagguuuguuacaugaauauacugugugacacugagguuuaggguacaaaugauccugucacccaggcagugagcauaguacccaauaggugguuuuucagcccuuccccccuccucccuaucuucccccaucuguaguaacccccagugucuguuauucccauuuuuaugaccauguguccccaaugcuuagcucccacuuauaagugagaaccauauaguauuugguuuucuguucuuauauucauucacuuagcauaauggccuucaguuccacccauguugcugcaaaggauguuauuucauucuuuuuuaugacugcauaguauuccauaguguguauucugugguguauauauaccacauuuuuaaaaaucuggccgggcacuguggcucacaccuguaaucccagcaccuugagaggcugggguggguggaucacuggaggucaggaguucgagaccagccuggccaauauggugaaaccccaucuguacugaaaauacaaaaauuagccagcuacucgugauggugaggcacaagaguugcuugaacuugggaggccagagguugcagugagccaagaucgccccauuucacuccagccugggcgacagaguaagauucagucucuaaaucaaucaguuaaucaaucagucuuaucuaccauugauaagcacuuagauugaguccaugucuuugcuauugugaauagcaaaugcaacucauauauguggguaugugucuuuuuggaagaacgguuuauuuucccugggguauauacccaacaaugggauugcugggucgaaugguaguucuguuuuaaguucuuugagaaaucuccaaacuacuuucuacaguggcugaacuaauuuacauuccuaccaggaguuuauaagcauucccuuuuuucuacagccucaccagcauccguuauuuuuugacagccauucugaccggugugagaugguaucgucuugugguuuugauuugcauuucucugauaauuagugauguugaacauuuuuuucauauguuucuuguccacugauaugucuuauuuuacaaagcaucuauucauguuuuuuccccauuuuuuaaaaauuaauuuuuuaauuaaaauauaaauuuucuuaagauuuugcuaaucuucucuguaccauuccaauuuuaguauaugugcugcugaagcaagcaucuugugcccauuuuuaaauggcauuauuuguuuuuugcuuguugaauuaaguuccuuauagauucuugauauuagaccuuugucagaugcacaguuugcgaauauuuucucccauucuguaguuguguuuacucuguugauaauuuuuuuagcgagcagaaacucuuuaguuuaauuaggucccacuuguaaauuuuuguuuuuguugcgauugcuuuugaggacuuagucauacauucuuuucaaggcugauacuccaagugguauuuccuggauuuucuucuaggauucuuacaguuugaggucuuauauuuuaagucuuuaauccaucuugaguuaauuuuuguauaugcugaaagguagggguccaguuucauucuucugcauauggcuagccagcuauccagcaucauguauagggaguccucaccccauugcuuguuuuguugucuuugucaaaaaucaggugguuguaaguaugccauuuuauuucuggguucucuauucuguuccauuggucuuugugucuguuuuuguaccaguaccaugcuacuuuuguuacauggcagauacaugguaauauaaacuuacaguauaacgugaagucagguaaugugaugucuccaacauuguucuuuuuguuuaaaauugccuuggcuauugggcuuuuuucugguuccauguaaucaugaauuuucauaauuauuuucagaccuuaguuucuggaccaaugagucgagaguauagauaauuuuuguuuuaaaucagcuuuaggguuuuuuuaguuauuuacgaagucauaguaacuauauuuuaaauucaacaaaggccguuaucgcauuuaacaacuuacuuuuuccacuugaaugugucacuuuaugcugguaguugguuaucuuaaauaugaaugaacaaauauguauuccuugguagagauuaagaagagagaaaaagugcugcuaaaagauuagagacucagacaaagaaaggaagaggaaaggaauaaauuccuacuacauguuuugcuaguuaccuaucuucucagcuuagaucaaaaaggaauguuuggcgaggcgugguggcucaugccuguaaucccagcacuuugggaagccaaggccgaaggauuacuugaggucaggaguucaagaccagccuggccaacauggugaaaccccaucucuacaaacaauacaaaaaaucaaucaggugcugugguggcacacauguguagucccagcuacucagaaggcugaggcaggagaaucacuugaacccaggagguggaaguugcagugagucaagauugugccacugcucuccagccuggaugacagagcaagacuccaucucaaaaaauaaaaaaaggaauguucaaguuuauaaaccaguagccuguaccuucagacccucauuuauucuaauguccugcaguaaugguggcauuaucagagauaaaagagaaaauuacaaagggaauauaaacauaaaugguaaaauaaauauaaauaauaaaauaaacauaaaaaauuaguguauaugucauaacuuaaagaauaaagaaaaaaauuaaggugacaagauacguaguucuccucagccaauaugcuauuauaagcuuucuuuagguuaucuauaaauuauuuuguuuuaaacuauuugaaucacaaaaccugauuuccugauucugaguccaguacuguacuuacugcaccacacugcuucaggguauaaacuggguucaaacccaagagauacuuugcccaauuaugccuuggggccaaaacagaugacagggucuuuaagaaagauuaaucaggcagcaguauguaagaaggacuauaugugaaaaagauaggaaacaagaaucguaguuagaagguuaauuuaggccaaggaugacgaucuaaaguccaguugcaggaacugaggaggaguagaaugauagaaugauuuauaauaucauuguaaaaauaauguuagaaagcaaaaauuuuugacucuaagcauuuuagauuauaugccugaggaauggugguguuagaaauaaggguaagaggaguaacuuuaggugaggccgauucugggaccuuuuuuuuuuuuuuaacuuaaaaaaaaauguucuucuucucucaugcugccuugucuaagaugggacaccuugagguugaggugaugguggaguauccagcugugauaucuguccuagaaaguugcagauacuggauuaaaucuugacugagguucaaaucagagauauagauuaguaauacuuagcagagagguuacagucaaagucauuagucaagcaguaaggcaaaaaaugaaaagaaaacuguuguuggauuuggaggaacguuccucaguaaaagauuaagagagcgggagggaguuaauuaaaaaguugaacaaauagauaaaggcaagaauugcuuccuuuuagaacaaaacuugaaaaaauugucuauacuggcaccucucuccccccuucucucuuaaacccacccuaaucggucuuucauucccaucacuuuauggaaacugcccuuucaagguucccaaugaccuuugugugcaaaaaccgugugaucaagucucaguuuccaucugaauugacccaucagcagcauuucauacaguugaucacucaguucuccuugucauccauucuucacuugucauuggaauaccacccuucccuguuuuucuuccugucucauuggcuguuguuucucagucuucuuugucaguuucaccuaaacucucgggcucuuuaaagauggaauccucuagggcuaaauuauuggacuucuucuguaucuauacccauuuccauagauagauagauagauagauacauagauacauagauagauacauagauagauaauuauagacagauagauagaugauagagaaaaaaauagauuuagauaagauagauauagauacacacacaaacauauauaccuacaaaaguacauacaucaugucucccaaacuucucuuuccagcuuggaaguccuccaugauauuuagacucaguguucaacccuucaucuccacucaaauguccaacucuaugucuccacuuggguacuuaauauacaucucaaauuaccauguccaaaauugaacucuuguucuucccucacaaacuuacguuaccuaaugucauuuccaucucaguuaauagccacucccuccuuucacucagaccuuaagagucacauccuuuacuccuuccuuucucuuuuacccucauauccaauucauuaucauauguaaaucucuuucaaauaugucuagaauuggaccauuucucacaggcuccuacuacccuacuccaaauucauaccaacucucaccuugaugguuacaguagucuaguaaucugcuuccauccuggcuccucuacagucuauucucaagacagcaggcagagugaugcuauuaaaauaugucagagaucauguccuucugcugcucaaaacccuccacugauuccccguuucacugaguaaaagccauuauuuuuauauaauggccuggaaugucccauacaauauugaugugucaccucucuaaucacauuuucuauaacucacauuuuugcuacagccauaauggucuucuuucucuuccuugaguaugccagggaugguccccacaacagggccuuugaguuugucuggaauacucucucuccucagagagaggcuuauuucccuaggcuucuguguccucauguauacaaugaaguucacuuagaugaccucuaaggucuuuuccagccacaaaauaguauugcuguaguacucuggaauauauacagcuccaggguuggaauccugccucaacuccucaaacuaaugucuaaggccuucuauaaucuaaccccaccuaauuauaugauguauguccaaccauuuggacauaauagucuguucuaguuagacuggucucuuuacuuuaucuuucccacagaugauucccauuugggguuauguguucuuuuuguuccuuccacuuagaaugcccauuuuuucucucacuacaaauaacccccuaggucucagucaaaaucuccuauuuccuugagaaucacuugauauuauauuuucucauuaucuccuacaugcaaccccucuuacuuggugcuauuucauuguuuauuucagcugaacacucucauguuuuaucucuuaaauguccuaagaauuaugagaucccaaguauaacgcauaugcauuaauaagcagccuaaccugaugagcaaauucaagagaauucacugugauaagaaauauucaagcuuucauuggcaaaacauggcaauguguacaaauaccuuuauauagauaucaaacagaacacccuaaagaacuauacccaaauauuugcuuacuaauuaaacauauggcuuaccuuuucucugaaguaguacugugaacauggauuuuggaguuagagcuccaaaauaauguaaauaauaauauuauauuauuuacuauuuauuuuacuauuuaguuaguagcauuacuauaaugauauuaaaauaauggguacacaguucauuuaccauaccuggcacauagaagacacucagacaauacuuguucuauccugauguucuaauucuucuccuuagagucaaaaucacccauaauguacugcuguaguccaaagccccaccagccauugugccaugaugauagaaaucucaugccauuuugacucuuaauaacugaaaagcuggccgggcgcaguggcucacaccuguaaucccagcacuuuugaaggccaacgcagguaggucacuggagcccaggaguucgagaccaaccugggcaacauggcaaaaucccaucucuacaaaacaauacgaaaauuagccaggcauaguggcacauacccauagccccagcuauucgggagacugaggcaggaggaucacuugaacccaggagucgaagguugcagugagccaggaugaccccacugcacugcagccucagugacagagcaaacacccugucucaaaaacaaaaaacaaaacugaagagccuugggcugggcacaguggcucaugccuguaaucccagcacuuugggaggccaaggcaggaggaacacuuaagcccaggaguucgacaccagccugggcaacauaauaagaucccugucucuacaaaaaaaauaaaaaauagauuuuuaaaaaacugaagagucuugaguguuucuguccaugugaucucauuaggucuuccuugguacucccaugcauaucacaacuauuuuggagcaugcccacuaccaguuaggacauguugugucuuuguacccaguguccauuugucugugcugauaagaaaguaaauagagccuaccaaaagcaaaacggugaaauaauucauuuguauugaccuucucuagccuccacuucugcugcuucuuguugcuucaacugugggaaauugucuaucucuuuuugcauucaggcuuucucucccuauccaaaaaugaaaggaucugauagaaucuucauaugaaauuuaugccauuuugcuaauucugucuaugaacugucucaaucacuguaacuuuaucaucagucuggcuauuuaauauugaaggcuuccaacauuuaaaaaccuugacaauauaaauauuaauaaaaaucagguauugggauuguuauuaaucccaauaaaacaugggauuaauaaaaauuaacauggaagggaauguaagugugcuaacauccucaauuuucauaauguagagccagaaaugauaaauuuuuuaaaacuuuuuaauggaaaaguuuaaccauaaugacaucaaguaaauagaaugaaugaacccaccaguauucauucccugccaugcucuaguccaguacuauuucuucuauaaccccuacucauuucccaccuccaccuacccaagggaugggauuauuuugaagcaaaucuagggggaucuuuagagacugauauuucucuaaaggugaagaaacauuuaccuaaaguuuaguauuuuguuugguuucugcauuuguuaacaucaagcaaaauuagauuuaauucuuuuauugaaaggaggauuuuuggcugggugcaguggcucaugccuguaauccaaggacuuugggaggccgaggugggagaauugcuuaaggccaggaguuugagaccaccgugaccaacauggugaaaccccgucucuacugaaaauacaaaaacuagccaggcacgaugguacucacguguagucccagcuacucagaaggcugagucaugagagucacaugaacccgggaggcagagguugcagugagccgagauugugccacugcacuuccagccuugguaacagagcaagaaucugucucaaaaaaaaaaaaaguagcauuuuuauaaaaugauuguuuucuuuauaucuugcaaacuaaugcauagaaaaaauaucuagagugaugaucauuauguuaaugagucuggugauagaguucaaguggcuuuaaaagucucuauacuuuucuguauuaaguuuuuuucuaaggaacuauauaauuuuuauaaaaauguauuuauuaaaaguugaagauaagaaguaguuauaauauuaagauuuuguuuaauuuauaagaauuuuaauuuucagggugcaguucuaccucaagaaauaagccaaguaaaucaacaucauaaaucuggcuuuaaugacaacaguguuaaauaucagcaaagaaaacaugacccucacagaaaauguaaguuuuaaauuagaaagguguacuugugugugcugcuucuuuuuuaaaaaaauaaacauuuuauugauauaauuuacauaccauaaaguaaauucauuauuuuaaaguauacgauaagugguuuuuuguauuuucacaaaauuguauaaccaacaccaccaucuaaauuuagaacauuuuuugucaccugaaaaagaaacaccauaccuauuagcagucacuccuccaggccuuggcaacccauaguuuacuuucugccucuauggauaugccuauucuagacacuucauauaaauggaaucagaaaauauaugaacuuuuaugacuggcuucuuucacuuguguauuuucaagauuuaucuauguuguagcauguucagucggcccucuguaccuguggguuccacauccauggauucaaccaacugaggaucaaaaauauucagaaaaggcagggcacgguggcucaugccuguaaucccagcacuuugggaggccaaggcaggcagaucacuugagcccaggaguucaagaccagccugggcaacauggcaaaacccuaucucuaccaaaaauacaaaaauuagccaggugugguggcaugcaccuguagucccugcuauucaggaggcugagguagaaggauugcuugagccuggggggcggagguugcagugagcuaagaucagccacuacacuccagccugggugacagagugagaccccuucucaaaaaaaaaaaaaagaggaugauugugucugcucucaacaugugcacacuuuuuaaucuuauuauuccccuaaacaauacaguaugacaacuauuuacacagcauuuacauuguaucaagcauuauaaguaaucuagggauuauuuaauauauaaagaguauguuuguagauuauaugcaaauacuacacuauuuucuguaagggacuugaacauauguggauuuugauagccacaggagggucuuggaagcaaucuuccacagauauggagggacaacuguaucaguacuucauccuuucuuauggcugaauaauauuccauuguaugaaugcuacauuuuaucgguucauccauuuguagacauggagguuguuuccacauuggggcuauagugaauaaugcugcuaugaauaucuguggaaaaguuuuugugugaacauauguuuucaguucucuuggguauaugcauaugagugaaauuacugagucauauagugguaacucuuaaguucagcuuuuuguauaacugccgaacuguuuggauauuaccauuuuaccuuugcaccagggaugugugaagguccaauuucuccacauccuucacaacauuuguuauugucccucucuuugacaauagucguccuacuaggugugagguggaauguucuugugguuuucauuuguaauuuauuaaugacuaauaauguugagcaucuuuucauguauaucaucuuuggagaaaugucaguucaaauccuugguucauuuuuuaauuggauuuuuuaaucuuuuuucuugguuuguaagaguucuuuauacaugcuagauauuacaugcuucuuggauaugugauuugcaaauauuuucucccauucuguggguuuucuuuuaacuuucuuuauacucuauugaaacacgaaaguuuuaaauuuugaugaaguccaauuuguguauuuuuucugcuuugucuuugguugcuuguaccuuagguguacaucuaagaaaccauucccuaauccaaagucacaaagaguuacaguguguuuucuucuaagaauuguauaguuuuagcuuuuagauuuaggucucuuuccauuuugaguaaaaguuuauacaugguaugauguaggaguucauauucauucuucugcauguggauauccauuuauccaaacauuguuuguuaaaaagacuacucuuuccccauugaauuuucuugacaccccauugaauagucuuggcacccuugucaaaaauuauuuggcuauagagccaggcaugcaucuguaguaccagcugcccaggagucugaggcaggaggauugcuugaacccaggaguuugaguccagcccgggaaacauauuaagacaccaucucauuuuuaagaaguaauugacuguagauguauggguucauuucuggacucucaauuccauuccacuaauguauaugcccguccuuaugugaaauacacagucuugauuacuguagcuuuguuguaaguuuugaaaucaggaaguuugagcccucuuuguuuuucuuuuucaggauuguuuucucuauucugggccucuugcauuuccauaugaauuuuaugaucaucuugccuauuucugcaaaaauggcagcuggaauuuuuauagggauugcauugaaucuguagguuacuuuggguaguauugucaucuuaacaguauuaaguuuuccuguccaugaacacaagaugucuuuccauuuauuucggucuuuaauuucuuuccaugaugucuuguaguuuucaguuaugcaagucuuacacuuuuuuguuaaauuuauuccuaaauauuuuacucuuuuucaugcuuuuuucaauggaacuggguuuuuaauuuuauuuuuugauuguucauuucuguuauagauauaaaacugauuuuuguauauugccuuaacuguuuauuagcccuaauuuuuuguggcuucugcaaauagagauaguuuuacuuuuuccuauauaaucucaaugccuuuuauuucuuuuguugccuaauugcuguguuuacaacagcuaguacagugcugaauagaaguggugagaacaugcauccuugccuuuuauuuguuuuuuaucuuuuauuuuuaauuuuuguggauacauaguagguauauauauuuauggguuacaugagauauuuuguuacaggcaugcaaugcauaaugaucacaucaggguaaauaggguauucaucaccucaagcauuuaucuuuuauguuagaaacaacauaauuauguucucuuauuuauuuaaaaauauacaauuauuuuuauuauagucaccccauuaugcuagcaaauacuaggucuaauucaucuauuuuuuuguaccugcuaaccauccccacuucccaccccucccccccacuacucuucccagccucuaguaaccauccuucuacucuauuuucaugaguucagucguuuuuaauuuuuagcucccacaaauaaaugaaaacaugugaaauuugucuuucugugccuggcuuauuucaccuaacauaugaucuccaguuugauccauguuguugcaaaugacaggaucucauucuuuuuuuauggccgaauaguacuccauuguguauauguaccacauuuucuuuaucuguucaccuguugauggacacuuagguuguuuccaaaucuuagcuguugugaacagugcugcaacaaacaugaaaguggagauaaucucugcaauauauugauuuccuuucuuugggguauauaccuagcagugagauugcugaauuauuugguagcucuauuuuuaguuuuuuacaaaaccuccaaauuguucuccauaguguuuguacuaauuuacaucuccaccaacaguauacagggguaccuuuuucuccacauccucaccagcguuuguuacucccuaucuuuuggauaaaagccauuuuaucugcggugacaugauaucucauuauaguuuugauuugcauuucuuugaugaucaaugauguugagcaccuuuucuuuuuuucuuuuuuuuuuuuaagacggaauuucgcucuuguugcccaggcuggagugcaauggugcgaucucagcucacugaaaucuucgccucacugguucaagcgauucuccugccucagccuccugaguagcugggauuacaggcgugugccaccacgccuggcuaguuuuuguauuuuuaguagagacaggguuucaccaucuuggccaggcuggucucaaacuccugaccucgugauccacaugccucggccucccaaagugcugggauuacaggugugagcgccuggcugagcaccuuuucauauaccuguuugccauuuaugccucuuguuuugagaaaagucuauucgaagcuuuugcucauuuuuuaaugagauuaugagauuuuuuuccuagaaaguuguuugagcuccuuauauauucugguuauuauccaucuugucagauggauaguuugcaaauauuuuuucccauucuguguauugucucuucauguuguugauuguuuccuuugcuguguagaaguuuuuuaacuugaugugaucccauuuguuuauuuuugcuuugguugccugugcuugugggggacuacucaagaaaucuuugcccaguccagugucggaguuuccccaauguuuucuuugaguacugucauacuuuaggcuuagacuuaagucuuuaauccauuuugauuuuuguauauggcaagagauggaggucuaguuucauuuuucugcacauggauauccaguuuucccagcaccauuuauugaggagacuacucucuccccaauguauguucuuggugccuuugucaaaaaugagauguguggauuuauuucuggguucacuguucuguuccaccggucuguguguuuguuuuuaugucagugccaugccauuuucauuaccauaguucuguaguaugauuugaagucagguaaugugauucuuccaguuuuguuccuuuugcucaggauaccuuuggcuauucugggguuuuugugguuccauguaaauuuuaugauuguuuuuucuauuuauguaaagaauuucauugguauuuugacagggauugcauugaaucuguagaucccuuugaguaauaggacauuuuaacaauauugauucuuccagucugugaaccuuggaauaucuuucucuuuuuuuguguccucuucaauuucuugcaucaauguuuuauaguuuucauuguagagaacucuuugguuaauuccuagguaauuaguuuuaucuguagcuauuguaaauggaauuacuuucuugauaucuuuuucagauuguuugccguuaacauauaaaaaugcuacugauuuuuguauguugauuuugcauccugaaacuuuacugaauuuaucaguucugauaguuuuuugguggaguauucagguuuuuccaaauauuguuugguucccaucuggaaagucaguacaaugcugaaaguggaaucuugacguauccagcuauuacuauauuuggauuuaucucuuucuuuagcuccaguaauauuugcucuauauaccugggugcuccaguguuggaaauauauuuuuuuacaauuguuuuuauacaguuguuauauccucuugcugaauugaccucuuuaucauuauauaaugaucuuccuugugucuuauuguuuuugucuugaaauguauuuugucuaauauaaguauagcuaaccccugcuccauuuugguuuccauugacauuggauaacuuuuuccaucccuuuauuugucugcaugugucuuuauaggugauguguguuucuguuaggcaacagaucauuggguccuuuuuuuaauccauucagccacucuaugucuuuugauuagaguuuaguucauugacauucaguguuauuauugacaagugaggacuucuuccugccacuucgauauuuguuuucugguuguuuuuuggucuucccuuccuccuuuccugucuuccuuuuauuauuauucuuccuuuuauuauuauuuauuauucuuccuuuuguuauuauugacaagugaggacuuacuccugccacuuuguuauuuguuuucugguuguuuuuggucuucucuuccuccuuuccuagcuuccuuuuagugaaggugauuuucacuaguggugugacauaauuucuugcuuuuuauuuuuuguguaucuguuuauguuuuuugauuugaaguuaugagucuugcaaauucucuuauaacccauuauuuuaagcaacuuaacacuuaacaacacugcuugcauaaacaaaaagaaaacuaauaaaaaaucuauaauuuaacuucauccuccugcuuaauaauauuuugcuguuucuauuuauaucuuauuguauugucuaugccuugaaaaguugucauaguuauuuuuuucauugguucaucaguuauaagaguaguuuacauaccauacaguguuauguguuuuucuguguacuuacuauuaucagugaguuuugugccuucaaauaaugucuuacugcucauuaauguuuuuugcuuucugaauaaaguacucccuuuagcauuucuuguaggacagaucugguguugaugaaauuccucagcuuuuguuugagaaagucuuuauuucuccuucauguuugaaggauauuuuuugucagauauacuauuauaggguaaaaaauuuuuuccuucagcucuuuaaauaugucaugccacugucuucucgccuguaagauuuccacugaaaagucugcugccagauguauuguaguuccauuguauguuauuuguuucuuuucucuugcugcuuuaugaucuuuucuuuaucuuugaccuuugggaguuugauuauuaaaugcuuugagguagucuucuuuggguuaaaucugcuuaguauucuauaaccuucuuguccuuggauauugauaccuuucucuagauaugagaaguugugugaaauuaucucuucaaauaaacuuucuaccccucuuucucuaccuucucuuuaaggcuaauaaucuuagauuugcccuuuugaggcuguuuucuagaucucguagacgugcuucauucuuucuuauucuuuucucuuuucucuucucugugugugugguuguuuuugagauggaguuucacuuuuauugcccaggcuggagugcaguggugcaaucucagcucaccgcuaccuccgccuccuggguucaagcaauucuccugccucagccucccaaguagcugggauuacaggcauaugccaccaagcccggcuaauuuuguauuuuuaguagagacaggguuucuccauguuggucaggcuggucucgaacucccgaccucaggugauccaccuaccucggccucccaaagugcugggauuacaggcaugagccacugcgcccagccuauauauuuucaaauggcccauucaagcucacugauucuuucuucugcuuaaucacuucugcuauuaugagacucugauacauuuuucaguaugucaguugcauuuuucaacuccagaauuucugcuugauucuuuuuaauuauuucacuaucuuugugaaauguaucugauagaauucugauucuuucucuguguuaucuagaauuucuuugaguuuccucaaaacagcuauuuggggauuuuguuuguuuguuuuuguuuuuuguuuuuguuuuugaggcagggucuugcccuguuguuggagugcagugguacuauuacgucucacugcaggcucaaccgcuugggcucagucaguccucccaccucagcuucccaaagugcugggauuacaggcaugagccaaugcaccugaccaaaacaguuauuuugaauucucugucugaaaggucacauaucucuguuucuccaggauuggucccuggugccuuacugaauuuguugaagucauguuuuuugcuggauggucuugaugcuuguugauguuuguuggugucuggggauuaaagaguuagauacaucucguagucuucaaagucugggcuuguuuguagcaguccuucuugggaacacuuuccaaguauuugaaaugacuuggauuuugugaucuaagccacaucugcauuaaggagcacaccuagaccaauaauucugugguucuuacaggaucagaggugccaucuugguggucuuggagaagauucaaaagaauucuccagauucccaggcagacucuuguucucuuccuuuacuuucucccaaacaaaugggguaucucuuucugagccaccugggcuuggggauggggugacacagguaccccuguggccaccaccacugggacugcacuaggucagaccugaagccaccacaguacuggaucucgcccacagcccgccauaccuggcugucaaccuguguuuacucaagguccuagugcucuauaaucaguagauggugaaaccagccaggcuuguguccuucccuuuagggaaguguguucccuuaggucccagguagauccugagaugccauccaggagacagggucugaauuuaaaaaccuuagaaaucuguguuguacugcagcuaagcuggcccugaaaccuugagccacuacccuucccacucuucccuucacuuucugcgggcagaagaguauuuccccguggccgucaccaaccacacgcccauggggaguacugcuaggcuguugcugaugaacucccaaggguucuucagucagcuugugauaaaugcugccuggccugggacucacccuucagggcagugggguucccucuggcccaaggcacaucuagaaaugccaucuaaaaaccacacccuggaauuggggacccugagagcccacuuagugcucugucccacuuggcagagcugguaccuaagaugcagacaaaaucuccuuuacuuuucccucugcuuuucucaagcaggacucucucaguauaaucaccacagcugggcaugugcugggucucuuaugaagccagcaugucucagacucuuaucgaaggcacauggauacuaccugguaucgcugcugguuguuucagucccaaggguucuuuaguuaacaagugaugaauccugccaggacuggguucuucccuucaggacuguagguucccuucuggcccagggcgugucuagagaugucauccaggagugcuaaggccugaaauggggucucaugacucugacacaagccugaguugguauccaagauacaaaaguccucuuuacucuucccuuuucuuucgucaaguggaagagagggaugucuuuuggagccucaagcuguguugccugggguugggggaguuggggaagugguggcacaagcacuuccuuagcugccccagcaagagucucaguaagucacaugccuagcaaguaaaaggcugcaagcccaacucaacacuaggacguguaguccuuguggccuggacagccuuucagguuuauuuaaggcuccaaagcacuucaguccaugggggcaaggcuugcagguacucaaguucccacugucuuuuuucuugaauaaacacucccuagauugcugcaagccuuugguuaacuucugugguucugaaaauaugaauucugcuaauuuaugcccauucucuuguugauuuuauggaggagagaauuuuuggagguccuuacucugacauuuugcugaugucccuucccuaacaacuugagauaaaucuuagagugauccaguuacuuuucugcuuauaaacacuugccuauuauauacuccaaauuauauuacaggcuuuucuuuaaaauaggugcaaauauuuuguuaauauucucucacauaauuuauauguuuauacucuuuaaauuucuucaguagugucuacuguguucaggcacaguugggaaugagaaucuucauccuguaguaauuauuucucuucccuugaccaaaggauuuccaaauugcagaaaauuauucuuuauguucaaaauaugacucauuuguuauucguuuauuuauucaacuacuauuuauugaguacaaggcacuguucuagaugcuggggauacaugacuaaaaaggaagacaaauuuucugaccuccuagaguauaauggaguuuacacucuaagaugaagacugauaauaagcaaguaaacaguaaauuccauaaucugaaguaauaauaagugcuaugaugaaaaaguaaaacagauuaagaggauagagugacaggggugcucuuuuaaauuggguuuacaagaaaggccuuucugaggagaugagauuccagcagagacccuaauaaagggcucaggaaggcaugaacuaugcaaagcuggcugaagaacuuuccaguagaggaaauaucaagugcagaccccugagucuaacuuauuauauuuuauauaugcaugguauuuuauuuaucuauauauuauagguauuaaaaucuuuuaaacauuuuucuaaaaagcuauuuucaaaaaaaauuuugugguuuuuaacuuugguucaguuugguaagugcuauaccuuuuuuuaauaccaguaucuguauguuauuuugguuuauuuuacucuuuaaguuaaauacagauuaaugucccuguaaaucugauaaugauaaauauagcauaaagguguuauauucaaauggauuuuaauuuuucuccaaacuaauauuuacauaaauguauguaaacuauuugaguuauguggaguuccaguuaguuuucuuuuguguaugucucaacaaauguuuaguguuaaugcuugucagcucacauuuucuuuuccuuuguuuuguaagauuacuuucuucccuuccucucuuccuuaccuccauuaccuuccuuuacuccccuuccuccccuucucuuuuccucucucucuauuccuucucuuacccuuccuucuccccuuuguccuuccuuccccugucucugaucucauucccuccucccaugcccuccucacuauuccccuuccccugcuucuuuccucagccucucuuucuuuuuuaauauugccucccucccucccuucccuuccuuccuuccuuccuuuuuccucuucucuuuccacccaccuuuuuauuuuuucagacuggcuuaaugaacagucuagugauagaaagugguaaaaauaaguuauaguagaucuauauagcuauauaauccaguauauccaauauaauagaauauuaugcaauaauuacaaacuaugcuuuuugugcuucuucauaucuaccucaugccccucauauuuuucaucuucauauucugucauuuaccaaauccuaugaaaauaaucucucaaauucauccuuuccuaucuccuucaucuucacauccugucauuugcuaaauccuagaauuuuucaaauucauucuuuucauuucuccuaccaucccccaauuuccccuuaacagaacuauuaaaauagcugccugaguuggucuuguacuauucuucuauuuagccaauaggcuauggccauauuuuaaucguccuaaagcacaguucucaucagauuacuaccugcuuaaaccuuucuguuacuggcugcccauuuccuaccaacuuaauauaauaccguagucuucagugacuugcagauuauggcucuaaccugcuuuuuuaguucucucaagcuccauuuuacccuuaacuuccaguggaacuugcuuucugcuuccaugucuuuuuucccacuauuugcuuugccuggaguacuuaacuucuuagucugcccuuuagaaccuaccuccuucgaggcccaauucagaugccaccuuuccauuuucucuauuauuaucuaagugucucuucucccccuuaucuauguuauaaauuccuuaaguucagagacugugucuugaaauucucugaauuuuuaacacagugccuugcuauuauaaauauuugguaguuuuaauugugcaguaaacacuuccauuuaugaaaauuucuguuuucuugucucuaguuaaagaagaguguaagaguccuaaagcugaguguuggucccaaaaaauguccaauaagcagguaagcuuccuuaaaaucaaauuucuaguuaccaauuuuuuaaugcaauugguggcucuguagcauuggacugaauuucucaaccuuuucaaccaaauuuauaagguguguggccagagggucacugaaguuaagcugacagucacuuggaugggagguuguacaccuaaaguccuggauuuggaacuagaggcaccugaaauccugauucucucauuuaauaguuggguggccuugagcaauucacuuuaccucucacagccucaauuuucucaucuuuaaguggagauaaaaauauuaaucacuuguccaggcgugguggcucaugccuguaauccuagcacuuugggaggccaaggugggcggaucaccugaggucaggaguucgagaccagccuugccaacaugguaaaaccccgucucuacuaaaaauacaaaaaaaucagccaggcgugguggcaugugccugcuguagucccaguuacucgggaggcugaggcaggagaaucacuugaacccaugaggcaaaggucgcagugagcugaaaucgcaccacugcacuccagccugggcaacagugagacucugucucaaaaaaaaaaaaaaauuaaucacuuguaguugcucccaauauauauggucuuuuguguguguguguguguguguguguguguguguguauacauagacauauauauacacacacauagacauuauauauggucuuauauauauacacauagacauauauauauggucuuauauauauacacauagacauauauauggucuuauauauauacauagaaauauauauuuacauauacaauugaaguacauggaacaaaauagcaaauuuaacaggcuaacuucuguggaauuagauuggugugggggaagccaagaucauuuauguuuuacuuuauauagucucugcuguuuacaaggauuauggaugcauuuuauaaugaaagaauaacaaaucuuugaucuaaaaaaauuugacacguauauuuauuagauguguacuuuucuguaugccuaucauauuuuaauauauauuuuuuuaaauugaucucuuauaguaauauauuaaauuuauaaaaggucuuagcugaauauuuggcacauaacagguaguaaauggaacccauuaauguuuagauaccaguaaacgguuuaauuacuugacuuuuaaggcccucuccauuugaaacucuuauacuguaauuuccuuucuucuagaaaagggauugauaaacuuuuuguucaauagacaucuuuggugaagcccauggacuuuuggugaagccauuauuauucucagaauaguauuuuuaaugcuaaaauaaaauacauacgauuuuaaagaaaaccaguuauacugauauacaauuagaaucaccacuguugugguuuucauaguugauuugggcugcuauaauaacaauaccauagacuagguacauuugaacaauaaacauuuauuucucacagcucuggaaucugagaaguccaagaucaaggcacuagcagaauaaugucuuuaaugcuaaaaagauuuaagagaaaaccaguuauauugaaauacaguuagaauccgguaaagugccauugucuggugggggcucccuuucuggcuugcagaugaugcgucuucucauauucuaacaugauggagagaaagagcucuauucucuuucuauucauauaaggacacuaauaccaucauggauguugcacccuaaagaccucaucuaaacuuaauuaccuaccaaaggccccaccuccuaauaugaucccauuaggaguuaggauuuuaacagaagaauuuugggggaauacaaacaugcagaccauauaaguguuuuguugccuauauucauaauugcaggaaaugcuaaaucucauugagagguuaaugaagauuaagguguaauuuuccccauccaaguuuauaggccccuuuucuuaugauacaaaagggaaaauagcacauaaaauuuuuuugcaacaauuuauuuagaacacuauuacauauuaacuauaaauauauuugcacaaaaaguuuauucuuacuuuuuuaauagacuuuagaagggccugccaaauauaauauuaagcuauugaagagaaaugaaaguccagaagucucagaaacccaaaagguugugacugguuauccaaaugcuauugauaagguaaaaaacuauuuauuccaauucucuucccaaacuuuaacaccugggaagaugauugagugaaaaucgaaugaccauuuuuguacauaaaacucagcuuuuuguguguucuuguauuauacguucaucuucaugcccaaaauauuuauucuuuuagccuaacucuggaauugagaacuuuuuagcaucuuugaauaucuccaaagaaaaugaaguacagucaucucaucauggggagccuccaagugaagagcauuugucaccacagucauuugccaugguucguauuuuguaggaacuuucuuacugugguaauuucucgacuguugaccaugcagacauaucccaugcaaguguucaaacacuuccaucauggaggcugguauguuacaucauuauugucaucuugugaggaaaccaggcugcccugggcaauuuagccauacuuuuucucuuuagaccacaguuccccugcuuuucaaacauugcuacuagguaacugggaugaaaguuaagcaggaggauaaguaucguuucuguaucagaaauguggguguuggguuuuuuuuuuucaguuucuaucugaauguaguuaaugucuuaauuguuaacaauggaauucuuuccaagaaagaucaauaaguucuacagauguaauguugacuuuguucucuucacccucaccaucuccaugugaaucauuuucaaaaagaagggaacacggaugcuuaaagaaauucuaaaaauugauggcucuaacacuguggaccauaagaaugaaaucaaacagauugcuaaugaaaucccuguuuccucuaacagaagagaugaauauggauuacccucucagccuaaacaaaauaagaaauuagguaaguaaacuaaauacuauuaccaauaauaucauuuuaaaaauucaauucauuugguucuuuuuaaucauguacuuuuaaagauaaaacugcuuuuauuuuaauguauuuauuuauuuuagagauggugucuugcuguguuggccaggcuggucucaaacuucugaccucaagcaauccucucacuucagccucccaaagugcugggauuacagguauaugccaccacaccuggcccaaaacuacuuuuauucuuaaaacuauaauuuuuauauuuguuucaguuauauaauaauauaacuggccagguguggcucaugccuguaaucucagaacuuugggaagcugaggcaggcggaucucuuaagcucaggaguucaagaccagccugggcaacauggcggaaacucugucucucuaaaaaauacaaaaguuagcuaggugugguggcgugugccuguagucccagcuacuggggaggcugacgugguaggauugcuugagccuuggaggcagagguugcagugagccaagaucacgccacugcacucuaaccugggcaacagagauagacccugucucaaaaaacaaaaagaacaauaauaauacaaccauguaaccaauagaucuacagucacuaaaugucuucuugugauuacuuaauuguaguguuauagauaaucauucuguagacauccaaaccuuuaaaaguuugcacauucuagcuuuuguccucaguaauuuaaaaauuaucauguaacuuaaauacauuauuuaacuuuucugaaaucuuguuucuuauuuauaaaauaagaauaauacauuacagauuacuugugguaauuauauaacauguauaaauauaaaacagcacuauguccaacacauuguaggugcuaauaauugauauuaauauuauguuaaaauaaccuaacuguuguaaaaauagaaaaaucuacaaaaucaauuaaaaaucauuaauagaguuagauauaggaaagugagucauacucuuaagucuguaaagccuauagcauaacaucuggcacauaacuggauuucaguaaauauccgccauauuuguuccuacccugaauguccucuauacuuuagcauuuuaucuguauaaugaucuacuaaaggcagccaggaagaaugacugauacaaaaguggaugugggcagaaguuucucagagaagucaaaaacauuuuggaauaagcagaucuaagcguauuaaagaucaaaaccuggaauuggcugggcacguuggcccacaucuguaaugccagcacuuugggaggccaaggcggguggaucaccugaggucaggaguuugagaccagccuggccaacauggugaaacccccuuucuacuaaaaauacaaaaaauuagccgggugugguggcaggcgccaccaaguagcuguaaucccagcuacuucagaggcugaaucaggagaaucgcuugaacccgggagguggagguugcagugagccaagaucacgccaucacacucgagccugggcaacaagagcgaaacucugucaaaacaaaaacaaaaccuggaauaaaagcagaaccuaaccccauuuauauuccagugauaauuaauuaaaaauuccaaaaaauauuaggaaccugauuauuuauuauagugacagacaugguccugaaauagaaccaaauuaauuuuaagacaaaauuagauaaagauggucccauugucaaaaacaaguaaguuuuacuuuauuucaguauaggaaaaaaaaaaaaaaaaacucauaggcuuuagagucuuagggucacuagcucagaauccagccccuguuauagaacuaacuggcucugugacuuugagcaagccacuuaacugcuuuuuuaaucuauauuaguaagaaguuuggauuaauucuucaaugagguaugcuuuuguucuauuagugaguuuguuaaucauaaagaaugugaacacucagaauuuuaaaaucaucuuccauauaaaaacacuuagaagacaauuucaaaaaaaacuuuuaagaaauauuauuucagagccacaaaaauauucauccaugugucucagaauguaagguggaauugcaagaauugagguggaagccaaaacuucaaaacuuaaggaugaauuauauuucagcucaagaaagccauuuguuuauucauucuuuuauuuuucucuucuuacuucugcaaaacaagaaagccauuuguuuguucaaauuuuaccuguagcaguaccauguagucauuagcugcucaagguuuuaauuuuuggcaguuagguacuuauauuuuaaaaucuuuaucuuaauaauuuaucauuaaucaauuauacucauccaaaaaccuuuacugaagucacaauaauuuuaggaaguacuaaauaguuguuuauaugugcuucauggaagacucaucuuuuuaaugcaguugguggcucuauagcgucuaacugaauuuuucaagguuuucgaccaaauuuauaaggugcguggccagaggaccacugaagguaagcugacagucacuuggauggcagguuguacugcuagaguccaggauuuggaacuagagccaccugaaauccugauucuguuauuuaauaauggguggccuugagcaauucacuucacuuuuuagcaguuuccugcuugcucuucuauaaaacccuacaauaagugcauaauuugagauaguauuuuauuaauaaagauagacucuuuucucuuuuuugguagcaucuuauaugaacaagccucacagugcuaaugaguaccauaauguucagucuauggacaauauguguuggccugcccccagccagaucccuccuguauccacaccaguaacugaacuuucucgaauuuguucccuuguuggaaugccacaaccugauuucuccuuucuuaggaugccacagguauaguauacuacuguucuauuuauauaaauuauuuaacauuaagcuuaaauaaauugguugaaaauguuuagcuagaaaaaauaaaauggggccuauuuuucuuaacuuuaugagcagcauagauuuaugcuucuuacccuagcucuaauauuuauacauaaccaaagcccuaagagaagcugacagggaggaacugggcagcagguauccuggcaagauuccucaaacuaauagagccagggaucuuggccuacaguagcaauuuucaaacuuuuuggucucagaaacuucacacuuuuuuuggaggaccccaaagagauuuuguuuacuuauauccauauuuacuguguuugaaauuaaaacaaaaaaaauuggccaguuguaaugggucaugccuguaacucagcacuuugggaggccaaggcgggaggacagcuugaggcugggaguuuaagaccagccugggcaacauagcaagaccucaucucuacaaaagaauauaaaaauaaaauuagccauguguguugugagccuguagucccagcugcucacaaggcugaggcaggaggacggaagcccaggaggucaggacuucagugagccacgauuaugccauugcacuccagccugggcaacagagcaagaccuugucucugaaacauauauauauauauauauauauauauauauauauauauauauauauauauauauauauauauauauaauauuacaaguaaaccuauauguuuauuaauccauuguuuauuaaaaauaacuuucaccuaauagacaucuguagaacauuucauccaacagcuguagaauauacauucuuuuccucaacaaauggaacauucucaaggauaaaccaaauguuaagccacaaaacaagucucacaaaauucaaaagauuaaaauucaaucaaguauauuuucugaccauaaugaaauaaaaccagaaaucaauaacaagaggaacuuuggaaacuauacaaauaaauggaaauuaaacauuauguuucugaauggcccuugggucaaugaagaaauuaagagaaaauuuuaaauuuuccugaagcaaaugaaaauggaaacacaacauaccaaaaccuguaggauacggcaaaaguaguacuaggagggaagauuauagcaauaaaucccugcauccaaaaaguacagacacuucaaauaaacaaccuaacagugugucuugaagaauuaguuccagcagucacacuacuggguaucuaucuaaaggaaaagaaauuguauaaaaaagauaccugauuuguauguauauugcagcacuagucacaauagccaagauguagaaucaaccuaaggguccaucaacagaugauuggauaaagaaaaugugguguauauauacacaauggaauauuguucagacauuuuaaaaaagaaugaaaccaugucuuuugcagcaacauggauggaacugaggccauuaucuuaagcaaacaacucagaacagauaccacauguucucauuuauaagugggagcuaaauaauguguacauagggauauagagugugaaauaauagagacuuggaagggugggggaugggcagggaguagauggugagaaauuacuuaauggcugcaauguaugcaguguacauaauucaggugaugaauauaagaaaagcccagacuuuaccacucugcaauaaauccauguaacaaaacugcacucgcaccccuuacguuuauacaaauuuuuaaaauaaauaauaacuagaaaagcaagaggaaaccaaacccaaaauuauuagaagaaaagaaaugauaaagauuggggcagaaauuaaugaauugauacuaaaaauaguacaaaagauggaugaaagaaaaaguuguuuuuuuuuuuuaaaagauaagcaaaaucaacaaaccuuuagccggacuguaaaagagagaauauccauaugaauaaaaucagagaugaaaaaggagucauuacaucugauaacacagaaauucaaaauauuuuagagacuauuaugagcaacuauaugcaguaaauuggaaaacuuagaagaaauggaugaauuccgagacacauaaaaacauaccaagauugaaccaugaagaaauccaaaacuugaauagaacaacauuaacaagauggaagcgguaguaaaaagccucuuaucaaaguagaccaggaccugguguuuucgcuacugaauucugccaaacgcugaaagaagagcuaauaagaguucuacucagacuguuccaaaaacuugaggaggagaaaauacuuccaaacuugccaguauuacccugauaccaaaaccaaagaaagacacuacaaaaaaugagaacuacaggccgauauaucugaugaaguagauauaaaaaucuucaacacaauacuagugaauugaauucaaaggcacauuaaaaagauaauucaucaugaucaagugggauucaucccagguaugcaaggauguuuaaauauaugcagucaauaacugugacacaucaacaaaaugaagaacaaaaaccauaugaucauuucaauacuaacugaaaaaguguuugauaaaauucagcaucucuuugugauaacagcucucaacaaacuggguauagaaggaacauaccucaacauaauaaacaacaacaaacccacagcuaguaucauacugaaugggggaaaaaugaaauacuuuccuuuaaauucuggaaacaagacaaggaugcccacuuucaccacuguuaauauaguacuggaaauccuugccagagcaauuagacaacagaaauaaauaaaaggcauccaaaagggaaaggaaggagucaaacuacucuuguuaguagacaauauaaucuuauauuuagaaaaaaacuauuagaauugauaaauucagugaaguuguaggauacaaaaucaacauacaaucagucacauuucuauauacugacagcaaacaaucugaaaaagaaaccaagaaauuaauccccugcagaauagcuacaaauaaauaaaauaccuagaaauuaaucaaguuaaccaaagcagugaaagaucucuacaaugaaaacuuauuauaaaacaaugaugcaagaaauugaagaagacacaaagaaauggaaagauuguccauguucauguauuggaagaaucaauauuguuaaaaugucuauaccacccccaagcaaucugcagauacagugcaacuccucucaaaauaccgaugacauucuugacagaaauagaaaaaaaaaaaaaauccuaaaauuuaucuugaaccgcacacgauccugaauagcuacggcaauccagagcaaagugaacaaagcuggaggcauuauacugcaaaguuacauaaccaaaacaacaugguacuggcuuaaaaacagacagagaccaauggaacagaauagagaauccagaaauaaauccacacaguuacagucaacuuauuuuuuauaaagaugacaagaacauauguuagggaaagaacagccccuucaguaaaugauccugggacaacuagauauccauauuuaagggaaugaaacuaagugcuuaucucucaccauuuucaaaaaucaaaucaaaauggauuaaagacuuaaauguuagaucuguagcuauuaaacugcuggaaguaaacacuggggaaacacuccaguacauugauuugggcaaagauaaguaagacaucaaaagcacaggcaacuaaagcaaaaaugcauaaacgguaucacaucaagcuuaaaaagcuucugcacaacaaaggaaacaaucaacaaagugaaaagacaauacacagaagaggagaaaauauuugcaaacuacccaucugacaagauauuaauagccagaauauauaaggagcucaaacaauaagagaaaaaaaacaaaaaaucccauuugauagugggcaaaugcaauauacccauguaacaaaccugcauguauacccccaugugucaaacaaaaguugaauuuuuaaaaaauaaaauauaacuauaaaaauuuuuaaugggcaaaugaucucagcaaacauuucuaaaaagaaaacauacaaauggccaacagguauaugaaaaaaugcucaacaucacuacauuagagaaaugcaaaucaaaacuacaaugauauaucuccaauuaaaauggcuuuuaccaaaaaauaaaaaacaggcaauaauggaugcugguaaggaugcagagaaagggaaacccucauacauuguugguggaaacguaaauuaguacagccacuaugaaggacauacagcauggaaauugcucaaaaagauaaaaauagaccuaccauaugauccagcaauuccacugcuggguauagguccaaaagaaaaaauaucaguauauguaagagauauuuguccucucauguuuauugcagugcuauucacaaaagccaagauacaaaaucaaccuaaguguccaucaauggauaaauggaugaagaagauguguguguauauauauacacacuucucaagauauacacuucucaaaagaagacauuuaugcagccaacagacauaugaaaaaaugcucaucaucacuggccaucagagaaaugcaaaucaaaaccacaaugagauaccaucucacaccaguuagaauggugaucauuaaaaagucaggaaacaacaggugcuggagaggauauggggaaauaggaacacuuuuacacuguuguugggacuguaaacuaguucaaccauuguggaagucaguguggcauuuccucagggaucuagaacuagaaauaccauuugacccagccaucccauuacuggguauauacccaaaggauuauaaaacaugcugcuauaaagacacaugcacaccuauguuuauugcagcaguauucacaauagcaaagacuuggaaccaacccaauuguccaacaacgauagacuggauuaagaaaauguggcagauauacaccauggaauacuaugcagccauaaaaaaugaugaguucauguccuuuguagggacauggaugaagcuggaaaccaucauucucagcaaacuauuucaaggacaaaaaaccaaacacaacauguucucacucauaggugggaauugaacagugagaacacauggacacaggaaggggaacaucacacgcuggggacuguuguggguggggggaggggggagggauagcauuaggagagauaccuaauguuaaauaaagaguuaacgggugcaucacaccaacauggcacauguauauauauguaacaaaccugcacguugugcacauguacccuaaaacuuauaguaaaaaaaauaaaaauaauaaaaaaaaaacugaaaaaaaacccaauaauauauauuuuaaaauaaccaaaagaguggaauugaaauguuccuaacacagcaaaaaugauaaauacuugaggugauggauaucucaguuacugugauuugaucauuauacauuguauccuuguaucaaaauaucacauguaccccauaaauguguguuauaauuauuauguauucauaaaacuagaaacaaaaaaaaaauaguaaaaaauauuaacuacuuaaaaaauuuaguuagaagagugauauuacucgaauuuuuuuuuuaaagagauggggugucauuuuguugcccaggcuggcuucaagcaguccucccaccuuggcuucccaaagugcuaggauuacaggcacaugccaccaugcccguccugcucuacauuuuaaaaauccuucucaccacaguaguaauaggagaagcuagauucuccugucugcuuaauacugucaaucccuagugauacguguuuuuuuguagaaaucuauguccucauacagauacaaaauuagaaaaaugaagagaaucuuaauagccuuuucagauaguuuuggcuauacuuuaauauuacauuaaaacuuaaaagugggccgggcaugguaucucacgucuguaaucccagcacuuugggaggccaaggcaggcggaucacuugagguaaggaguucgagaccagccuggccaguguggugaaaccccaucucuacuaaaaauacaaaaauuagccagguaugguggcgcaugacagagcaaaacuccauuuaaaaaaaaaaaacaaaaaaaaaaccuuaagagugguauuuuguuuaagguuaguugcaguguggaaucuugcaguguggaaucugaaaccuuaucaauaaacauuuuuguccuccauauacuugugagaagguaggaaauaagaaaaaguaaugcgaaaaagagcauagcaccucaauauaaucaugcgcuagaugcgguggcucacaccuguaagcccaacaacucaggaggcugaggcagaaggaucacuugagcucaguaguuugagaucagccugggcaagaccucaucucuuuauuuuugagacagagucucgcucugucacccaggcuggagugcagugcugugaucucagcucacugcaaccuccgccucccggguucaagcgauuauccugccucagccuccugaguagcugggauuacaggugcaugccaccacgcucggcuaaguuauguauuuuuaauagagacgggguuucaccauguuggucaggcuggucucgaacuccuuaccucgugauccaccugccucggccucccaaagugcugggauuauaggugugagccaccgugccugggcuagaacucaucucuuuaaaaaacaauuuuuuuuuguuuguuuguuuggggacagaaccucgcucuguucgcccaggcuagagugcgguggcacgagcucacugcagcuuccaccugccagguucaagcgauucuccugccuccugaguagcugggacuacaggcacaugcaaccccacccggcuaauuuuuguauuuuuaguagagacaggguucaccauguuggccaggcuagucucacgcuccugaccucaggugaucugccugccucagccucccagagugcuaagauuacaggcaugagccacugcgcccgaccaucaucucuaaaaaaacuuuaaaaacagcuaagcgugguaguacccaccuauauucucagcuauucaggaggcugaugugagaggauugcuuaaaccugguaguuggcuacagugagccuugaucacaccacuguacuccagccugggcaacagagugagaccccaacucuaaaaaauauaugcauauauaauuaugaaaauuugaucucagugccucccugaaagggucucgcagacccucagcuauccccagacugcacuuugagaccuacugaccgcaagaaaguuguuuuauucucuuuauauccaguucuugauacccucuaaccuaaaacagaaagcaguuuuuucuaaaaucagggccaaggcaaagaugccugcuuucaccacuucuauucagcacaguaauggaaguucuguccagagcaauuaaguaagaaaaauaaauaaauaaaagacaucuaaauuagaagggaagaaguaaagcaguauccguuugcagaugauaugaucuuauaguagaaaacucuaaagauuccacaaaaaaucccaacuaauaaaugcagcaaaguugcagaauacaaaaucaacugacaaaaaucaguuguauuuuuauacacuaacagugaaaaaucugaaaaggaaauuaagaaaacuaugauaguaucaaaacuauuuauaguaucaaaaauaauaaaaugcuaaggaauaaaaguaacaaaggaaaugaugugcuuauacaccgaaaacuacaaaauguugcugaaagacauguaaaaagacaaauagaaacacacucuguucguggauuggaaaacuuaauauuguuaugaucucaguacuacccacagcagucuacaaauucagugcaccuccuaucaaaaucccaauggaauagaacagagagcccaaaaauaaacccuugcauacauguucaaaauauuuuuugacaaguugucaagaccauucaguuggaaguggauagccgggcgcaauggcucaugccuguaaucccagcauuuucagaggccgaggcaggcggaucgcuugaggucaggaguucaagaccagccuggccaacauggugaaacccugucucuacuaaaaauacaaagaauuagcuggacaugauggcaugcaccuguaaucacagcuacuugggagccugaggcaggagaauugcuugaaccugggaggcagaaguugcagugagccaagaucacgcuacugcauuccagccugggcaacagagaacagagugagacuccaucucaaaaaaaaaaaaaaaaaaaaaaaaaggaaguggaugaucuuucagcaaauggugcuggguaacuggauauucacauuuuaaagaaugaaguuagcccuuaccuaacuaacauaauauaugaaaauuaacucaaaauggaucaaauaccuaaauguaagauaaggccuaaaacuauaaaagucuuagaagaaaacuuagggcagaagcuucacaacauuggauuuggcagugauuucugggauaugacaccagaagcacaggccacgaaagaaaacauggacaaauuguacuucauggaaauuuuaacauuuugugcaucaaaagacaauaacaagagugaaaaagguaacucauagaauaagagaaaauacuuccuaaugauauaucugauaaaaaauaucuggaauauauagagaacucaugaaaugagucuuaaauguaagaccugaaacaauaaaaauccuauaagaaacccuaggaaaaacuucuggacauuggccuagacaaagauuuaugacuaaucucaaaagcaaaugcaacaaaaacaaaaauagacaaaugggacucaacuaaacuaaaaagcuccugcacagcaaaagaaauaaucaacagaguaaacagacaaucuacaguauuugcaaacuauguaucugacaaaggacuaaauauccagaaucuauaaggaacucaacaaguaaaaaacagauaaccccauuaaaaacaggcaaaggucaugagugaacauuucucaaaagaagacaucucaagggguugccaacaaacaugaaagaaauguucaacauuacuaauuaccagagaagugcagauuuuagggccacaaugagauaccaucucauaccaggcggaauggcuauuauuaaaaaagucaaaaaacagauuuuggcaaggauguagcaaaaagggaguguuuauacacuguugguuggaauauaaauuaguacaaccuguaugaaaacaguauggugguuucucaaagagcuaaaaauagaacuaugauuuaauccagcaaucucacuucuggguaucuaccccaggaaaagaaaucauuauauaaaaaguaugccugcauuuguauguuuaucacagcacuauucacaguagcaaagauagggaaucaaccuaaguguccaucaguggaugauuggauaaagaaaauguguguggguaugugugcgugcguguguguguguguguguguguguauacacacaccauguacuacuauccuauacacacaccauguaauauuauccagccauaaaaagaaugaaaucacguaucuuguagcaacauuaauggaacugggggccauuauccuaagugaaauaauucagaaacagaaagucagauaucacauguucucauuuauaaaugggaacuaaacauggacauacagaguggaauaauagacauuagagauuucaaaagaugggaugguuaagagggaugugagggaugagaaaugaccuacuggguacaauguauacuaaucaggcaauggguacacuaaaguccauacuucaccacuauguaguauauccauguaacuacauuuguacucccaaaucuauuuuuuaaaaaaaauuaagguaaaccaaaacaaaacaagcuuuuuuauaaaacagaaaauuaaaguauaauauaguuauaauuuaaauaugaguagaaaacacaucagaaucucugagucuuuuauauuuuggcaauuaacuuaucuuaccaaaauaucuccuaaguaaaggaugguauaaacaugagucagcaaauuuuuucugugaagagucagauaguaaauauuuuaggccuugugggccagauagucucuaucacagcuuccgaacucuacaguuacagugugaaaguagccauuagaauggauguggccauguuccaguaagacuuuauuuacaaaaagaggcagaacuccauaguuugucaacuccuuguauaaagaaaacaguuuugcuggcuuucauuugcauuagguggauugacccuucagccagcuuagaaagcuuuuuauuuuguaaacacugaaaaagauaaggcaacaacucgaaaauuuuugccuggcaauugaaaacuugaacugaaagcccuuuuuuaaauucuugauaaaauuauuuuacuuguuuagacuaaacuuugggagaggucaacuuccuagacagagaauuucauagacauauauauucucuuuuuuuagacaaugaccguuugccaaguaaaauuaucuaauggcuuacugguacaugggccacagugccacucugaaaaugaagccaaagagaaagcugcacuuuuugcuuuacaacaguugguaagaacuguccaugacuucucuauuaaaauuuuuauuagucccuauagaaagcuuguauugcauugucuuguaacuuuuaaauacuuccacagggcuccuuaggcaugaauuucccuuugccuucacaaguauuugcaaauuauccuucagcuguaccaccuggaaccauuccuccagccuuucccccaccuacugguaagauauuuuucauuuauaaguauuugucauugaguuguuauuuuuacuaagcucuuuuaagaaaucaagaauguacucaaauaucuaggaauguaagaagaaauugugagaaagccuaaagccacagccugcagauucaucuaaaaguaccauucucuuccuacagccucuaguauggcuagaguaguaagaagagguugagugggcaggcccuuauucuccaguagcugcuaacagauaaauuuguguuuaaguuagacaucaaaagguaaaaaaaaaaucauguaauuucuucaggacuguauuuucuuauugguaguagacuauguccaaaaucuuguugagacuaacauuuuguaauucuaaaucuuaaguucugagauuuucuaaaucacucagcuuuuuuuccuaauagcaguuggcuucccuuuaucuuaauuauuauuguuuuaaagccaauaauuuauuuaaguuuagaaaaucccuuuucugcaucuacugccagguaauacuccaggaauucuaaauaucuaaugcuuacaauaagcauuagaaaggugaauaauacugauuaaauuuaugacaugcaguugucucuucucauuaaacugaauaauaaaggauuucaaaaguguaaaucugugaggaugaagacagaagaaauaucagcagauuagagauuugaaaagaguuuguguugagaaaaacaacugcagaaguaaccauuuuagcagagcaaguuuaaaagcuacaagcuaaagugccuguagaagagacuacaaaugagcauaaguagauugucccucgccguucccaagagguucagaucuuggaggcaucagaaacuauuagagaagauaaagaggaggcaugugcugaaaagagagggauugguugaaagucuaugugcaaaguggugagacuacccccgucuucccucugugacgcagccagaccucugcaagcaaaaaacuggagguguguuuucuagaggagcuaucuagauaugggaauaccaggcagagaagagaauggaaugugagacugaaaacacagagauuaaggaaaaguucccuuuuucucauccuguucucagauuguagccagucauacccuucuccccagauaggaaauuggaagaugaaaaaagaauagaguacagguaaaauuguuaaguaaaauuuuaaaauuuaguagauaaaguccuagcaaagccaaggaagauaaaagcuguaaaauaagaaagaacagagacuuagugcacagauccagcucccaccuuauuagaguuccagaaaaagagaucagagaugaaggaaaggagguaagugucaaaaaaauaauaaacuuuucuaaaacaaaacgauaugcaucucuaaaagagccaccaaauguugagcacaaugaauaaagacacagauuaucuucagauucugaauacuagugauaaaaaggugguccuaagagauucagagaagaaauauguacaaagaucaaaaauuagaaugguacugcacuauugaacagugccuagaagccagaaagcauugaauaccucaaaacccugaggcagaaugaguuucauccuaauuucucuguauagccaaacugugaaucuaauacaaaggagacacaaagauauuuucagauacgcaaauuuauuucuuauguacccuuuuuuuuuuaagcaacaaggucucacuauguugcccaggcuggucucaaagucguggacucaagcaguccucccacuucagccuucagaaaugcugagauuacaagcaugagccuucaugccuugccuacccuuucuuaagaagcuacugaauuacaugcuccaacaaaacaaagcaguaguuuaaaagaaaauuaggaaaccaaaauaacaaauuguagauguaguauaguuauacaaugaauggaaaucccaggaugccagcugcucagugggucuagaaagugacuagucccaacuagacaggcagagggaagucuuggcaguaaggaagguuauuaauagaugagcaaugggaaaacauuaaggauggguauagagaagacuaagcagcuuuuauuauauuuuuccuaaagaauugauaugagcaagacuaagcuuuuaaaaaauaauuauuagccugggcaacauggcaaaacagccugggcaacaugauaaaaccccaucucuaaucuacaaaaaauacaaagguagccagacaugguggcaugcaccuauagucccagcuacuugggaggcugaggcgggaggauaacuugagccugggaggucaaggcugcagugagcugugaucgugccacugcaccccagccugggugacagaaugagaccugucucaaaaaaaaaaaaaaaaaaaaagaagauaaugacuaacucaaguaaaaacaaaagguuuuacaagaaaauacauaauggaucucuuuuuacaagaaaagaaacauuaucagaguacccagcuuggcucugcagugauaauauuuacauagccacauaccacaaauagauaacacuguuuguauauuuaaacaaaugauguaauguacuuacauugggaguacaggguaaguagugagggguaaugcaaaaaaacuaaauuuuguucuaucugaauaggaagucaguagaccuaaaaaugccuaaaauuaauaaguuauuaacaaguagcauaagcaaauaauugaacaguguggaaauaucuaaaacaguuaaaccuggaguagaacagaugucugcuguuuucuguugaaaaucuuuuuuaggccgggcgcaguggcucacgcuuguaaucccagcaguuugggaggcagagguggguggaucacuugaggucaggaguucgagaccagccuaaccaacauggugaaaccgucucuacuaaaaauacgaaaauucuaaaauuagcugggugugauggcacacaccuguagucccagcuacucaggaggcugaggcaggagaaucgcuugaacccaggaggcagagguugcagugagcugaaaucgcgccacuacacuccagccugggugacagagcuagacucugucucaaaaaaaaaaaaaagaaaaagaaaaucuuuuuuaguacaauguauauguaguauuuugauuuuuuuuaauguaauuugucuaaggucauuaaguuacuaucuagcagaacuggcaucaaaauccaagucugagccaggcuuguugacucaugcuuguaaucccagcacuuuggaaggccuaucucaagaaaacccccaaaggcccaaaccaaaccaaaacaaaacauuguuuauauagucaaaggaaugccagugcaguacaguaacaaaagcaugggcuuugaaaacagauagcugagugugguggcucauaccuguaaucccagcacuuugagaggcugagcucagaggaucacuagagccaugaguucaagaccagccuaggcaacauagggagaccuuacugcuacaaaagauggaaaaaauuagcugaguguggugccaugugccuguaguuccagcuauucaggagguugaggcaggaggaucaguugagccugugaggcggaggcugcagugagccaagauugugccacugcacuguagccuaggucucaaaaaaaaaaaaaaaaaaacagacgacagacuuggauuuuuuuuuuuuuuuuuuuuuuuuuuuuuugagacagagucccacucugucacccaggcuggagugcaguggcaugaucagggcucacugcagccucaaccuccuugggcucaguugauccuccuaccucugccucccaaguggcugggacuauggcacccaccaccacaccuggcuaauuuuuguaucuuuuuauagagacaggguuucaccauguuguucaggcuugucucaaacucugggcucaagggauccgccagccucggcaucccaaagugccaggauuacaggcaugagccacugugcccagccaacaauguuuuagucauaaaguuuucaugacguaauggaucugauguuuuuauauagcucaauguaauaguaucaccguaacuuauaaaaucuaauuugacugcugcugcuucacauucaaaaaugaauacaguagcuauguauagauuaauuuuaaguaauuaguauguguaggguaccuaaaaguuugcacacaaacuucucuaaagaagaauugucuuaugaucauauauuuuuuaagaggaauguuuguuuuccccauuuauuauugauauuuuaaccuuuuucauguugauuaguuuauucauaccuacuaauaauuuuaagguuauaauuggaaugcuuuugguccuauaaagguguucuccaaauauuccaguuaaaauauguaaauacauaaaugccaagauauuuggagguuaaucagcagagaacaacuuaagcauuagauuaacauuuuaaaguuauuuuguaaauuucuauuuuaugguauaaaaaaauuugugauguaaaaugucccaguugaggaauauguauuucauauuuguaacagugauuuauuggggaaauuacggaguugaccauuguauaagauuagcauagcaucuuuuaaauagaccuucuuagcauuaugacucccaccaaaguugcucguagauaguuucaagaccuaauuuucuacuuuucuuaggucucacucugucaaccaaguuaaagugcagugacaugaucuuggcucacugcaaccuccaccucccaggcucaagcaauccucacacauuagccuccugaguagcugggaccacagccacgugccaugccuggcaucccaaagugcugggauuacaggcaugagccacugcgccucgccuaauuuucugaaucuuauuaguguuuuucauauuaaaaguuuucuucuucuuagaauuuguguauguguauuucauaacacugaaauauauuaugauucuucucuccuaaccuaaaagugucuuaaauagcugaacuuuaauuaagcuauacuguuuuacaggucuggcugcuuuuuaucucuaugaaaagaauauuugaacauagugcauaucuucuucaguggcgugugcuggugccuugaaugucacuguuuaauguaguuuucaaaugcucuacugguacaggcugucuccauaagaaucgccuauggagcuuaauacaaacuccagggccccucagagucuggcuuacuaggucugaggcccuguccaggaaucuguauuucacaaacuccucaagugauucagauauacaaauuagauuuggcacccauugguucauuacauuuuuaauaaacaaacuguaagugaaaaaaggccuugacuucaaauauuaaaauagagaaaagaaagauucuaccugucauaugaaggugaugagauuucaggacuugagguuuuuugguuuuuuuguaggcugggaucacuauggaagcaacuaugcauugggggcaggugagauccuuaagauuucucuauuugugcccaagcuuuucucucacaagggacaauuucaugacccuuuuauuuuuuuuauaaauauaauugcaaauauuccuaaaacuuguaucagcauaugauauuaguaguaguauucuccuuuucaggccaguauaaugauaaauucauuuguguagauaguccacacaguccuaggaaaggauccugagguugaauguuguaaggaagaguaauuauaggugaaguaaguguaggccuuuugccaaaggggaaaaaaaaagcccaaaaaggcuagcagaaggaggucucaaauuucagagcuuugaugauaccauuuuacuaaaagaaaaauuuuccuugguuuuuaacagcuaauauaaugccuucgucgucucaucucuuuggcucaaugccauggggaccaucggugccaguuccugggaagcccuuccaucauacuuuauauucugggaccaugcccauggcugggggaauaccagggggugugcacaaucaguuuauaccucugcagguaagaaaaauaauauuuuuaagauaauuauuuguuuaaugcugaaagacuauugauaaacauuuuuuuauucaguuuacuuauucagugccaacuagaaguucaguacuaguguggguaguaagaaggcaaugguugacaagucugaccugucucugcucucugaguuuguguucuaauaaacaauaauuguaccaaguaauaugcuauucuaauacagauugauuaaaaucaguaauauaaauaaaaucacaaauauuuucaaaauaaccuaugaagaauuguauuuuuauuauuauuauuauuauucauuuuuuuggagaaggaucucacucuguagcccaggcuggaacgcagcccaugcacaaucucgacucccugcagccuugacuuccugggcucaagugauccucccaucuuagacucccgaguaccugaggcuacaggcaugugccaccaugccugucuaguuuuuguaauuuuuuuguagagaugggguuuugccauggucucgaacccuaggucucuaccgauccaccugccucggccucccaaagugcugauauuacaguugugagccacugcacacagcccaagaauuuuaaauauuuuguuuguaacuaaguccuuugaauuacuaaagucuuacuuggcaauuauaaguggaagucacagaucagcugugauugacaaauauuaacagcaugcaugguuuaugguaauuuccaacacuagcuaauuuuuugccuacauuauuaauuagugaugcuuuuauuccuaacagguuacuaaaaaaaggguugcaaacaaaaagaacuuugagaauaaggaagcccagaguucucaagccacuccaguucagacuagccagccagauucuuccaacauugucaaaguaaguccacgggagagcucaucagcuucuuugaaguccucuccgauugcucaaccugcaucuucuuuucaaguugaaacugccucucaaggccauaguauaucucaccauaagucaacaccaaucucuucuucaagaagaaaaucaagaaaacuggcuguuaauuuugguguuucuaaaccuucugaguaaauuuggcucuuagaauuaaguuaauuucuucucuuuccaucuaccuuuuuauaaauacauaucuaugucucauaaaaauuagaauguacuauuuuaaaauaauauguguaaauugaaauuuuuuucauuuuuaaguuaucaggcacuuuucaugcuguuuaaaagacuguguaucaaauugugcacuuuaaguaugugcaguuuguuguaugucaauuauaccucaauaaaucuguaauaaaaaacuaaauuaaaccuugcauuaaaauaauaucacaguaucaguggacuaaacauuaaaauguaccacucuaaucauuggccucaugauugaagcauccugaacuaugaauuagacaucaguuagcaauaauaagcauuuuuuacacuaucauugaggaauaauuacauggagcaugaaauuugggccuccaguauaacuuacugaauguggauuuuauuucucuuuuuaaugauguaagaaaauugucaggagaauggcucuuauuuauguguguuuuaacuuaugcuuuguugccucugagggucuuuagaccugcugugaaaggaucacauuuguuguggugcugccaguuuugcuuuauucuaaauuuuguaccaaagcaacuuuagaauaaucagaauauuucaucuaacugcuuagaacuauaaauagcauucuaaauuugaguaaauacaauuuuuuagguuacucaagaaccagcauuaguaauuucuaguaaaauuguuucaaaaucuacaggguacaaugauuacaaauuaaucuucuaacaaaauaaaauaugaaauauuagucauguuaauuaauaaacuguauuauuuuguauagcuuuuuauuugcuuaccugacauuuuaugagagcuucauaguuggucgguauguagugcuucuugggacugaagaaauucuaauuguuguuuaaguuccaaggugugcuacaauauaggaggcacagucaucaguuugugacauacauuauuuacugccuauuucauucugauucuauauuuuuagcuuuaugcugaacuguucaaugaugcugggauucucucuuugcaugucauaugugaaugugugguucaagcuguaacuguugaaauuauuuuagaauuuaugacgauuucucagcagggccuauguuuauauauauauauauauuuauucuuuaguuuuugugauaugcuuauauuuuuaaggaaguaaguuauagcauacuuuuuuaaaaguaggaaccacaaucuuuauauggagcagcuuguuauaucugauuuucauguaacucauuggaaacucugccaugacucuuaaaguagucuuacuuguuuuuuaaaaugcugguauuaaacuaaauggacuccuuucacuaacugcugauuucagaguuuaaauguuagcaggauauuuguguauuagcagugccuucaguauaagagagaaauauucauuaucugucauuuaucauagucguauaaguuuccaugauuuuauuuucuguuauuuucauaaguucagauguuuaucaguucccaacauuguuucuuuaucuguagugggaucuugaguaaugaggcucaaguaaauccucaauguguauaauuauugccucauaaacucucucuuuguuuuuaaaggaaacaucuauuaugguaauacaaagaaaaguuaaauugugacaguaauguuauauuaaccucuuccuacuuuaaagugugaaauguuucaccucagcuguacaaacuccagcauugagaauuugccucacucauuacuccugugugacaguuauauaaauagcaugcagcucacaucuguuuuagagcauagaagaagcggcaccugccaucuucugaaaacuccaaagggaaauuucaguagacauagugcacuaaacccauaaggauacuugaccaauauuugagcacagcaagcugacaguucuauacagauaggcagugaaagaguuuuauuuuccagccaggcgcaguggcucaaaucccagcacuucgggaggcuaaggcaggcggaucacuugagguccggaguuccagacaagccuggccaacaugaugaagcccugucucuacuaaaaauacaaaaauuagccgggcgugauggcacaugccuuuagucccagcuacucgggaggcugaggcaugagaaucauuugaacccgcgaggcagagucugcagugagccgagauugcaccacugcacuccagccuggagagcagagcaagacucugucucaaaaaaaagaaaaaaguuuuauuauccuuacuuuuuuuuuaacauuauuauucuaaaggucaaaacugagaagagauuaagauaggagagagcuccauaauggcuggauaguggucaggcauucucuauucuuuucccccuguagacccauucuaaaugugggccugaggucaaugggagaugugcccucccuauggaggauguaagaagcagaggccauuucugccccauguugaggaaacaaucuguugauagaccuggaauuuagaguauaucugaaaagcaguuggacuucaagaaauuuaaaauucucucuuugagaugggguggacuaagaccacccccaaaguuuaaaaauaugcucauucaacuugaaucuucugaggacuuuuugugaaaaugguggacuguuuagggcauaggacagauuccccaaauugcuuuaugcuuccacauaacuagagcacuucaaucuauuuaagccuuugucuccuaacugaaacauuauuucuaaauauuucuauucaauaaguuuuuucuuuuuugagcaacuuaagugaauuuugaagauugcuccuuccagucucguuccuuuucacauuuuccugcauuaccuaauaauuaccucagcguuagaauuugaauguauuaauugauuuaaacaucauguagacuaaagucuuaaacaucuaagacucaguuguaguugcagaaaaaaauuaaagucaccucuacugaaccuugguuucaauuuaagauuuuucuugcuuuucaaagggguaacuaauaaagauugaaggguuuuuuucccgauugguggaggaaugaagaacuauugaugcaaguuuuuuuauuguuucuuucuaugaucagguaccugcuuucauuuuagacugcuacuuccaaacuaagcuagauucuugguuuuaaugagaggaggcagagagagggaggcagauggaagaagaaaaacaguuaaauaagacauacccagucacugcauuuuuggacuauaccguaucuuucuagcacaaggaaauagauaaacuguaaggucuuuuuuacucacuuuuuauuuauguguucuauuuguguuagucauaacuguuuauagugguugucuaauuuuuacuuuuauuauaugagauagagcugugcagaucuucacucaaguuaguucugucacgcuucuucccauuauuuagagcacaguuuuuuaaagcaacuguacaauuucucagccuuaugagcuugcuguauuucuugguaucauguugcuuccaaauuuuguuuuuacuguagaagacaauuaauuuauuguagagaaguggcugugaaagucguucucugucuuuaaaaaucaauugcagaaguucauuugucauuuuucuagagauaaauuauaguacucaaacuggcagugcucaguauauacauuuuguaagcuuugucagugaaaccaucaguuuugcaggagcuuccuuuccuagucaagauaaagcuuaaaauuccagaaauuaaugucguucggacugacuuuauucauauuuccaucaaacuucuccaauacaguaagagauaguguugaaccagcaucaagucuccagaaacauggcagagcagacaggccguuaaguuucacagacaucauagauccuuuucuuaaagaagaaaaacauguauaaaauaguuuuaguaguccaaaaugucaacuaucuguagcugcuuuugugugugugucagugaacaaauaauaaugccuugcucaaucaaugcauucagccaucucaagugcaauuugugaaggagacuaugguuuccaaaagauacauuuuuuuacaaaguuaaaccuguaaaaagucuuuuuuuuuuucccuccagccguacaccaacugcacuugguuguuucagcaguugguauacuauuaaauuguccaggccaaauagguuucuguagcuguuuuaguaauuugaagccaaauucucaugcuguuucucauuaaaaagaaugagaauuugguccauaguuagcuuuaaguucucucuuccuuucuuucccuuacaguuaaggguuuggugggggauggggagguuguuuucguuuuuuggauuuuuuugucuuuuggcuuuaaguaucauauuuucuuuugccuguauccaacugcuucuuugaguauuuucaucuaguuuaaugugaguaauagaugcugugcugucauugaaguguucaacauuuuguucauuuaaacaaaaguguaauucauacauauauagauacauaucuuaauugauuucucaacuauuuuauaaguaacuggaauuuuucauuagaucuuauacagagaaguauuuuauuaaaaauucaaaagggaagacuuuuaugugcucauuuuguaauuuuugauuuuaaauaucuuuacauugucugccaauuaaaguguuuuaaacuugcauuggaauggacuccgaauguauuuuugugguguuacguuauccguagauuucuagcaugaaguuagccucacgaugcugugcaaaggauuuuaaaauaugagagucacugaaagaguuuaaacaucuguucauguuaaaugcucuauggauuuuaauuaaagacuugagaaugauuuuauaa

SEQ ID NO: 192087 - RNA, 49913 nt, Homo sapiens
ggcgcggcgcggcgcagucggcucgaguacuccccguaacgaggagguguucucggccgucccacccuucacugccgucuccgggcugcgccgccggagccgggacgcgccuccgcagcccucgccgccuccauccccgcggccgcagcuccucucgccguccgcgcgcacaccaugacgaagaacgagaagaagucccucaaccagagccuggccgaguggaagcucuucaucuacaacccgaccaccggagaauuccuggggcgcaccgccaagagcuggggugagcgggcagcagcugggcguccggggccggccucggucccgggggcgccgggcgcggucuggugggaacggaaaggcgggaggcggcucccagcgccggggcucccgaccgcccgacccuaacccgggcggcggcggcgcagugcggccccauucauugcuccccgggccggccggacuggccgcagcucgcucccgaagcagcggggcccgcgggcagcccggccgggccgcgcugguuccucccucccugcugggagcggggcgcacgugcugcccgggccucccgcccggcgcggcgccggaagccggggaccccugcccgaagccgggccccgagagugcaggagccgagcccccgggccuccuuuguacggagcgcuccggcccgagaggcccuggcggaggcgcccggcccgcugagcgguucggagaagccagacccugccccacuccaggggagaggaaauuuccacucccgccgcuaucuugugacucguccacgcugccaccccgaccggucggaagagugcgacugaguguuaaguguggguguggguugcuuaaacguguagcggugaguuaaucacagaaguacauuguacaagaaaaugcacuugaauuuggacagugaaaaggcccuuaaaaagguugguuccucccggauuccuuuuuaauuacagagguuuucuuccuuacaaauuugcuucuuuggggaaaguaaauccugucugaacaacacagguuuuuuuuuuuuuucccgugucuucaaaacaggagagugaugguuguauguuagcagauuuuuucuaugcgugagcucuuuguuuuaauauauuuaaaccaucuaccguguagaguagcuuuaggaugccuuuuuuuccuaaaauuguaucaaucucugaaugcaggcuagagcuuuuuuuuuuuuuugccuuuauacuuaaguaaacuaauuuuaccuuuuuaaauccuuuugaaacauuuuguuagugggucuugaaagaccauuucuuucugagugggaauaaaucucgagagcuuagaacuauuugggcacaacauuuuuaggauaagcauggagaaauaagcugugacucagaaaauaaacuguuggugcagacugaaauggacuccuucagggugaaaaggcgacuugaagucuuaucacaagcugaaaggggccuuggaggauuuuuagcccaacccccacuuuagagaugagaaaaaugagacccagagagguugugauuuuugccuuguguaaaauuacauaugccacaaagccaagaaaagaacccaguucuccuuuaauccuaguccagcgguuguauuauuuuacagaugccuugccuaacugcaugguaaucacucaugauuuuuauuuaaauugcuguuuucuuuugggaacccacuagugugaugaagaaauaaaucuugcauccagacuuacaugggaacaaaagaugaacauuuauaaagcuuaauugcuuguuucuagaguguacuaacuuuuugcugaagaaauuuuugagugguggagagagauuaauuuugauaggcuaccuuccucccuuucucccuuccccagugcuuccucauuuccagaacggaguaacuccacuuuguguuagaaugacauuucuuacugcagauagugcucuucaaccuuuguauuguaugaccuaggguagagauuuuauuuuauugagucaaugcauuuaaauagauaacaugcacaaauaaauagagagcaauguguaaggacuguaaaacuaguacaagugaaguugggauucauuuuggaaggauuaagucaaucucuucaaaaucgauaaguauuacucuuaucaguaaauuuuuuguuuauuguaauaauaguaagucagugaagaauggcauauauaggugaaaauuaaccauaauccugucccaauguaaggguaucccucuaaggauaugugagggagucgugagaggaggccgaaauccauauucagcuugccaggcuguguauccuagaccaugguugggucugccuagagaaggggcaccuuguucuaauucuugcaaaggcaggaucaguuuggagagcucugugccucuggggauaugucugccaggaaggauucuuuuuuuaauucucuugaagggacuguaugggcuugcugccagaugucaucauaccucagagauacuauuaacauucugguauauauguuacugaauuguguauaacauuuuuuuuaaaacaaaaggaucauaaaguguuguuuuauauucugaguauauugugggcaucuuuccauguuacuaaagauuuuuagacagguuucccuauauucacccuuuucauguacauuuuugcacauuuauuuccuugguauauauuuauaccgaugggauuucuaggccauucauauguacuuuuuacauuuugaaaacuuguuuucaugugcuuuccaggaaguuucuaacaauuuauacucccaacgguauguaguggugucucauaccuucaucagcacugaggcuauuuuuaccuguguuaucucuuuuaaaaccuuacauuuuuggggccgggcgcgguggcucacaccuguaaucccagcacuuugggaggcugagguggguggaucacuugagggcaggaguucaagaccagccuggccaacauggugaaacccugucucuacuaaaaaugaaaaaaaaaaaaauuagccgggugugguggcaccugccuguaaucacagcuacuugggaggcugaggcaggagaauugcaugaacccaggagguggagguugcagugagcugagaucgcaccacugcacuccagccugggcgacaaagcaagucuccaucucaaaaaaaaaaaccuuacaguuuuugguaacagcuuuuuuuuuuuuuuuuuuuuuuuuaagaaaaacagccuuuugucauuuugcaaauuuuuuuucuaguugucuuuuugacuuuuuuuaaucaaauuuuauguagguggugggagaaaaagauuauguauuuguuguaggggguggaaggaaaaaaaaucacaucuuuuuugaccuuguaaaguugcuaggacuccuggugugucuacccccaggauuuuaucauucauuuaagauguuuccugguuuuauuuuuacacauuuaagucuuuaguauguuugucucauuuugaucuaagguuccucuccaagugcauuggauacauuaaaaagcacacauauuuaaaagguaguuuugcuauuuacauuuuggauaaagugaaaauguugcaaguuacauugcauugccuuauuuaaaacagcuacguaaagauuuugaguggccgcuuuacuguguauuuggcuaauaucuuacaggugguuacagcaguuucaaaaugcuuauauacacauaaguuacuucaugugauuuucacaguaacguaaagccaacuaguugggugauccaaguguacuuagcacugguuuucaagcugaaaaguaaguauaagucagcaauaaauaguugccauuuaugaauacacaggacaaagaaaauugagcaccuaguggcugauguuugcaaaauauuaaauaacuuaaguucauugaauacaauuagagucaaauuaaugaagcuuagagaucuaguguuauuuaaacuacuaguagugggccaaguguugccauuaacauuuuuuuaaugaugaaauagaauaguaaaaauauguuuauuuuaccuaauagguucauucuagcuuuaaaaaaaguguuguuucaugaagcuuuuguguauuuugcauauauagauaccccaguguaaacuguauuuguuacuuuggcucauaguccaaaaacucuugaaagccacuaaucuagcccagugccuucauuucauagguggcaaaauuaaaccuaugggucaucugauuugccaaaauucacucagggaguuagugauaaaauccuuggggcuucagacuccaaggccagagauuuuuuaaaaaacaaaccaggcgggacaugguggcucaugccuguaaucccagcacuuugggagacugaggcgggcggaucaccugaagucagaguucgagaccagccuggccaacauggcgaaauccgucuuuacuuaaaguacaaaaauuagcccggcaugguggcgggugccuguaaucccaacuacucuggaggcugaggcaggagaauugcuugaacccgggagguggagguuacagugagccaagaucgcgccacugcacuccagccugagcgacaagcucaggacuccaccuccaaaaaaaaaaaaaagaaaagaaaaaccaacuaugccaugauguguugucauuuaauaacaucuacuugugagcuucuuugggguucauuaucuuuauuaagguggucugucaguaaaugcuuuguauuaauauuaacuuaaaacucaagucagugauuuccaagccuagucagaauucuggaccaaaacuguuagcaccuauauuuuguuugugugccuuuucuuuuacuauaguuccaugaagugccauuuucucagucacuucugggucauggcucaguaauuguucugcuuuggagaucaggcuucaucccaucuggggcaucugacaguaggggagaaggcagauguguuuguuuuccauugucugucacauaauuuuuguaagaugguguucuuuguccuguggagugugccauuaacccauuuaugcuggagguugcaauuuuuaaaauuuuugcaaugagaccuuggcaaggacauugagcaguaggauauaacucccacaugcuuagcguuccaguaauggaacacaggcauaaauggaagcuuuacaaacuuuacaaaaaugugcaucacugggaaaguaacaggacuugccuuacccugugugcaggcuauaaacgcaggccaaugguacauguggugacagcagcagaagagaagggcagguacugagccauuaucuagcaggagaaaguacuuccuggauuguccaggaaguaguccuguggugggagggagagaaaggguaaguguauguguuguguuacaauaccauuguaauuaugguaguacgagugcuuuaagauuauuaaagagccucuccccaccccugauguaauucgauuucuuugaaauugacuuuuggauuuauaucuauacaauuaaacuaguuguauuaaaagaagucuuaaaagcccuccugucuauaguaacaacuuuuccaugauuuuaucaucauuugauuaaggaccagucauuuaacacugauugugaaauaggaggaaacacccauuuaaccuugaaagauaaauuuaauuauuuucuaauuuugcauucauucuguugguuuugaagaaaagucaccuguaaucuuuaaccacuuaauauaaccacuauuaacauuuuaugucuuuuuccuauguauaaauaaguuuuuaaaacauaccuaaauaccugaucuuaucauuuaacauuuaaggagaauggucuuuauuccucugccuuuuuccuaaauguugaugugcuggagguguccuugggucugucaccuuuauggugaccauacauacuuccuguugaauuuaucuagucugguggcuuaguuacuaucucuguugggacucccaaagcugcauaucuaaucauacaauuuuguuuuguuuuguuuuuugagauagaguuucgcucuuguugcccaggcuggagugcaauggugcgauaucggcucaccgcaaccucugccucccggauucaagcgauucuccugccucagccucccaaguagcugggauuacaggcaugcgcuaccaugccuagcuaauuuuuguauuuuuagcugagauaggguuuuuuuccauguuggucaggcugaucucaaacuccugaccucaggugauccacaugccuuggccucccaaaguacugggauuacaggcgugagccaccgcgcccggccucaugaguuuuuaauguucuuauaaccaccugccuaucagaaaucuccaguuggauguuucauagguuaucuguucauauaaaucuguguuguucucaagggcuccuuagcacgacauacaaacucuuuaaaaucucaguggcuuacuucucuccugucaucucucucuaccauuccacauaguuauuuccuacuccuucugggcuguuuccuagcuucugggccucucauccccuuauuccauguuggucuggcugaucagaugucagcuuugauagucugauacccagaaaacaucuuugaacuccucuuugcauuaaggccaggugcaguggcucuugccuguaaucccagcacuuugggaagccgaagugggcggaucacuuguggccaggaguuagaaaucagccugggcaacauggugaaacccugucacuacuaaaaauacaaaaaauuagccaggugugguggcguagugaauuuuugcaaucagacuuugauaaugaccuguaguugcaacuauucgggaggcugaggugggaggaucaccugaguccaggaggucgaggcuacaaugagcuguaauugugccacugcauuccagccuaggugauagaguuagccuaucuaaaaaaaaguuaagacucaacaaaauaaaauaaaaccuuuuucuaucauagcauuuauaacuuuauauauuguugucauugccuauuuacuagacuauaaucuuauucuugucuuauuccucuuugauucucuaaccccuggccuguccuagcacuugcuaggaauguaauacaaacugguugaaugagcaguacuaugaauguuuccaugaaguuagucuucugcaguauuguuuuuaauggcuucacaguguuugacgguauugguguacccauaguauaauuguccccucaauuuuggggcauuuuccuuuuucuuuuguuagaguacugauggguuuucauggaaguucaguguucaaaagaagcuuagugauuauuccacuuaacuuucuuauuggagacucagcuggguuugugacaugccuggaucacgcaucugauaauagugacagaaccagggcaaaauuuuauuuagguuugcuuccugcuuuauugcucuuuucagcuucuuauacugcuuuuaugagacccucauaaagucuuuuuuucuuuuaccugcucucaaauuuaaugggaguuuauuuaauagugcccuucuucccuuauggggugcuauuacuaauaauauuucggaaaauuuuuuuuaacauaauaaccucccacauaccuguuuaaacuuuguuacugagucauuuguggagcuagcucuuauuugugacuucuuaggauuuugcuggugcuguggguaagauaugacuuuggaagugaccuuccugcaaggcaugggguacuuuucuuuugguuuuugcauguuggcaguaucuggcucauaaaaaguggccuuuuacauacucauacuccugcucccacucccuagcucucuaaccauuccuuuccuaguuccuucuuguuugcucuuccugucuucuaaguguuugugaugguuaauauuauugagugucaacuugauuggguugaaggauagaaaguauugauccugggugugucugugaggguguugccaaaggagauuaacauuuaagucagugggcugggaaaggcagacccacucuuaauugggugggcacugucuaaucagcugccagcaaauauaaagcuggcagaaaaacgugaaaaggagagacuggcccuagccuccuagccuacaucuuucucccgugcuggaugcuuccuacccucaaacauuagacuccauguucuuugguuuugggacucagacuggcucuccuuguuccucaaggagauauauacauauuauuaguucugucccucuaggcccugacuaaugcaauguauguaucucaggugcugucuuuggccuuguuuucucuucuucuuuccuggcaaugucauauaacaacugcaaagaucauuacagauuuuacuucuugguugacaucucucucagguuccaggccccuguuuauugucaguugcuuucugcauaucccacaaaucuaagagugugaggcuuagaugucuuaacuaacuuucauaccagauaacgucaucugguaaauagcucguuucccuuccuucccugagguucuguauugcuccuauuuuugcaguuuuaaaaaacagcuucacuauccugucgucuaggcuccagacuuagccaaauugugccggugcuauucaauaacaucgcuugaaccucuugaaucuuuguggcccauauccccauuacuaguacuacaauuauuuuaggaauuaauuuucuuugacuuguuuaccauuuucucuuuauccccaucaagacacacguucagaggacaucugagaugcucauuuuuccuagcuucauaauccuagccacccguaccaaauuucauuaacacucccaccaaccuuguccucauuuuaucaggaucugguagugccuuuucuuuuuucuuuucuuuucuuuuuuucuuuuuuuguuuuucagauggaguuucgcucuuguugccaaggcuggagugcaauggcacaaucuuggcucacugcaaccuccgccucccagguuuaagugauucuccugucuuagccucccgaguagcuggaauuacaggcacaugucaccaugccuggcaauuuuuguauuuuuaguagagaugggauuucaucauauuggucaggcugaucucgaacucuugaccucaggugaucugucugccucagccucccaaagugcugggauuacagaugugagccacugugccugaccagcgcaugccuuuucuuauaaacucugugauuuaaaaacuugaagcaccagaugaagaucuuuguaauuguuucacaguuguuccagcuucaaauagacgauuggcuuuccagcuuuuaucugcugcguuaaaacacacacacacacacacacacacacacacacacacacacacaccccuguaguguuguugacccuggggaaagugggucuuaacuacuggugcaucuccaguaagauccaaagaaucagugagaaucauugugacuuaagcaauguagcccacugcugucggguuauuucuaaggcagcagcuuugaucauauuaccuucuguaccccaaaacuguguuugggucccuacugcuuccagaaaguuuagguaaguuccagagagucuggcauuccagguuuauuguaugugggcguggagcuguuuccaacccuaaguaacccaucguuucccaccuugcccacaccccauuaugcacccuauguuguagcuacacggauguaucuaagacccuuagucuggaaccccugucuguuccuuccccaaucucuucguucugugcacacgaauucuuccuuauuucacagaccuagcuucagugcuggcucugccauaagccuucucugauaugcucagguggaaauaauaccacuuauuuccuauaacaucuaaaauguuguaucuguauauaaagguguaauucuaucacccagcucacaauggcucugcucuacuacauuucuaauuaauuuuuaaaguuuccagauagggcaucauaauaaaaagugaacugguagguuuauauauuuuuacuugaugcaucucagaauacaccaguauacugagaagaugaccagauaggacucauagaccuaaauucuaguuccacaucucuguuaaagcuuagauaacucaagaucucuuagccuuguuuccucuauaaaagaaaaaaguucagccagaugugauggcucaugccuuuuagcccagcacuuugggaggccaagaugggaggacuacuuuaggccaggaauucaauaccagccucgaugacauaaggagaccccaucucuacaaaaaauaauuuuaaaaaauuagcuggcuguguuagcacacaucuuugguuccagcuacucaggagguugaggcuggacaaucacuugagccugggaggucaaggcugcagugagccaugauugugccacugcacuccagccugguugaccgagugagaccauaccucaaaaaaaagaaaaaagacauuguaugagauaguuucaaauguaacuuugaaauuacaaacaaagccuaccuauauaaaugcuuuagaaugggaggcagcaagauucaaaggaccacguuauuguuggcuuugcugaccacacgguguuuguugcaacuaccuaacuccauuacuguagcuugaaauuggccauagaacuaacgggcauggcuagcauuuuauuuacaaaaauagcagcagccgugguuugcuuuagaaguuagaguuggugaguggucaguguagucugacucaagaaaucugaacuggucuuaaaugggauguggacucuuggcuuuguucuuuucuuauaacaaaaguaacaccauuauuuuuacaguacagaugugaauaucaguaaguccaacaucauccucagcuucuucccuggguaacccccguuaaguguguaaaugcuuuuuaaaagguaauauguggcauauccauaaagguccggcagugucuuauaaagguaaauauauacccacccccugagccagcaguucuacucuuagguguguuuauccaagagaaaugaaaacauacguucacaaaaugcucuuguacaaaaauauucauaguagcccuauucauaauaguuccaaacugggaacaguucagguuuuuaucagcuaggcgauagauaaacuugcaugucuacacaauggaauacuacucaaugguaaaaaggaaugaacuacagauguacaaaaugugaugaaucucacagguugacugcgaacgaaagccuuaccaaagagaguacauacuauaugguuuuauuuaugugaaauucuaaaauaagcaauucuuaccuaugcuggaaaaaaaaacccagaacggugguugccuuuagggcaguggacagggagaaugacuaggaagggacgugacggaacuuucagggugaugauaaguguucuguaucuugaauagggcuuuggaucauaagugaaugcauuugucaaaacucauuaagugguauauuggagauuuguguauuucacugaauaugcauuuuuucucaauuuuaguuaauacgcaugcugaauuguucucugauguuugcaacuugaaucuuuaaaaugagauaaauacaguaaaauguuaauuguagaaucuugauggguuuauggguguucacuuuuagguuucacucaacuuuucugugcauggguaaacauuccuaauugaguguuggagaauaugaauacauucguguguuucucucuaccuccuucaccagucucagaguguuuccuacagaugacuaucagguuuccugucaguccuuuuuucagcaccauuuuuauauauguauauaaacauguuucuguauauauguggaguauauagaaauaaguagguucuugucuaccuuuaccugaguaauaggaaacucauauguucuggaacuugauuuuuuuucacuuaauauguuuuggcuguauauauagguuugugucauuccuuuucauagcauaauguauucgucuauuuucacacugcuauaaagaacuaccugagacuggguaauuuauaaagaaaagagguuuaauugacucacaugauauggcuuggcuguguccccacccaaaucucaucaugaauuguagcucccauaauccccacaugccaugggaggaacugagugggugguaauugaaucaugggggcaggucuuucuugugcucuucuugagauagugaguaagucucaugagaucugguggguuuuauaaaugggaguuccccugcgcacgcugucuugcuugccgccauguaagaugugacuuugcuucucauucaccuucugccaugauugugaggccuccccagccauguggaacugagucaauuaaaccucuuuccuuuauaaauuauccagucucugauaagucuuuauuagcagcaugagaagagacuaauacacucacaguuccacauggcuggggaggcuucaggaaacuuacaaucauggcagaaggcaaagggaaagcaaggcacuucuuauucuuacaugguggcaggagagagagagagccaagggggaagugccacacaccuucaaacaaccagacucaugagaacucauuaucacaagaacagcaagggagaagucugccccccaugauucagucaccucccaccaggccccucccccagcauguggggauuacaauuugagaugagauuuggguggagcacagugacaaaucauaucacauaauauuccauaguguggagauuauacuauagaauauauauauuucuuucugaugaauguuuaaauuguuuccaauuuuuaucuuaaaaauugcugcagugcaacuuuuuaucuaggauaaacugagaaauggaauugccaguuuauaauauguauuuauuuuuaugaauauauuguucugagugggcacaauagcucaugccugugaucccagcacuuugggaggccgaggcaggcggaucaccugaggucaggaguucaagaccgccuggccaacauggugaaaccccaucucuacuaaaaauacaaaauuagcugggcgugguggcaggugccuguaaucccagcuacuugggaggcugaggcaagagaaucacuugaacgcaggaggcagagguugcagugagccaagacugcaccacugcacaccagccugggcaaaaagagcgagacuccgucucaaaaaaaaaaaaaaaaaaaaaaauauauacacacacacacacacacacacacacacacacacacacacguauaucuacauauauguguguauauacauauacauauauauauauauacaguucuccaaaaaagcuguaccaguuuauacucccaccagcaguggauaaaaguaccuuuucuccucaagcacuggauauuauaacaauauuguacaaucauacaaaaauauugugcaguuuuuuccauuuugauaggaugcugguaucuaucugguugguuuaauuuguaauuucuucaauauuuuuauauuugcucaauuuuaauuuuuaaaaaaugccuguaaucuaauuuuuuuucuuuuuuuuuuuuuuuuuuuuuugagacagaguguggcucggucacccuggcuggagugcaguggcauggucucggcucacucugccuccuaggcucaagcgauccuccugccucgccuccugaguagcugggacuaccuguguaugccaccacaccuggcuaauuuuuugauuuuuguuuguuuguuuuuuuguggggcuuuuuuuuuuuuuuuuuuuuuuuuuuuuuuuuuuugagauggagucuugcugugucacccaggauggacugcagugacaugauuuuggcucacugcaaccuccaccuccuggguucaggugauucuccugccucagccucccaaguagcugggauuacaggugcccgccacuacgcccggcugauuuuuguauuuuuaguagagaugggguuucaccauguuggccaggcuggucucgaacucuugaccucaagugaucugcccgccucagccucccacagugcuaggauuacaggcgugagccaccacgcccaccuaauuuuuguauuuuuaguagagacuggguuuugccauguugcccaggcuggucucgaacucuugaccucaagugaucugcccaccucugccucccacagugcugggauuacagacgugagccaccacgcccaccuaauuuuuguauuuuuaguagagacuggguuuugccauguugcccaggcuggucucaaacuccugagcugaagcgaucugccugccucagccucccacagugcugggaucacaggggugagucacggcccccagucuguguuauguucuuacugguuaaaggaaauuuugauacacuuugaauauuaagccuuuguuauacuuguaaauauucuuuauggacucaucuuuuuguucucuugucucuuaacucuuacuuugguuuauuuuuuuaauuguaaugguuuuaaaugaacauuaucacagauuuaacagucuucuauguucuuuucuuaaucacuuaucccuauauguuguauaauccaucauuuccccaaugauaugaauuggcaacuuuguuaaaugaaaaauuccauuuuauauggauucuuuuuaggauauuguuuuguugaucuguaucuugauuccuguguaucaucacacuauauaguaggcucuguauucgugauuguaaaguaaaauacauguguaaauuugugucaauacuaccuguucaguuuuaguauccaaauagugcaagccuuauaaaaaccauuaagguaacuuacagagcauacacaaagaauaguuuauguauagaaaauagucuguucuuuccauuuugagagaaccaacuaaagccauuuagacuuggugucuuuuacugggguaaaccucuuuuuuguaaaaauucaugguuugaacauuuuaauuuuccuaaaaaauuuuauauuucaucuguuuucacauuuacuaauugaaaacacuuuugaucaaguugauuuauuauuuaaauguauugaaugguuuuggugugguuuuucauuacauuuuguguccauuaacuuguguuuucaucuuaaaucucuccuacuuucuuuguauuuauuuuagucuugagcuaaaaaucuggcuuuuuuguuagucguauauuuuaaugauguuuuaaugaaugcaucuagggcuauggguuuuacuuugaguucugcucugauuacauuauuuugaauuuuuggauaucuguguuuuuuuaauucagggauugagauacaacuuucuaaauuuguauuguuaauuucuaauguauuuauuuugagauguuagagaauguggccucuuuuuuuuuuuuaauguuuuuuaguuuugaauuguguuuuguuuuuguaauguaagucauggucaguuuggggacagugcuccaaguuuguagagaguacauuucuuggugacuacaaaguucuacguauacuagguaacuguuguguuuuaaaaauacauauugcccuuuuuauuguccuuuacucaaucuguggguuucuggagagguauguuaacaucucuggucaugauuguggugaauuuuauaacucugcuuuugcuuuaaucauuugaagccacuuagcaucacagagguucauggcuauuaugcuguaucuucuuuauguguuuuuauuuacuuuuauuaaauacacaguaucuucacccuugcaaaugcuuuuuuacuugaauucuaguuugcauacaguaauaaugccauaucuacauuucuuuuguuagccaagaccuauuuuauuuuccuguuuauuucaaccauugguguuuaauuuuagauugucuucuauaacagcauuaaguggauuuuuuaacugacucugauaauguccuuuauuauuaccacuuuuaaauuauuccugccauauuauugacauuuuaauuacaaauuguuauugaauauaggcugggcgcagugacacacgccuguaaucccagcuacucaggagacugaggcacaaauauugcuugaacugggaggcagaggcugcagcaaguggagaucgagccacugcaugcagccugggugacagugagacugucucaaaaaaaaaaaaaaaaaaaaaaaaacaguuaucgaauauagacaaauuuaaaacuuuagccuuauguaaaauacaaacacagugacaaaaucauuggcugccuggggaaggguguguagauugcaaagggguacaaggaacguuuuggacaugaugguaauguucuauaucuuuaauggagcgguagcuucacagauuauacaacggucaaaacuaacuggaauuguauaccugaaauggaggaaacuuacuauaugcaacuuauuccucagaauugauaaggaaaagcaauuaaaacaucuuagauguuaccaguaagucuuagcagaucucugcucaccauugccuuauguaguuuuccucuuggccuuaguuuuuucuuuuucucacccaggcuggagugcaguggugccguugguucacugcagccuccacaagcuuccaccucucagguuaaagcaauucuccugccucagccucucgaguagcugggauuacaggcacgcaccaccacaccugacuaauuuuuuuauuuuuaguagagacgggguuucaccauguuggccaagcuggucucgaacuccugaucucaagcuauccacccgccuuggccuccuaaagugcuaagauuacagacgugagccaccacacccagcucucuuuauucuugauguucuaaaauuuuaccuuuuuauuucuagguauaggauguuuuccaguauuuuuuaacauuuccaaucuagacacaagcuuguuauuucuuugagaguucuugccccacccucuuuuccuguggaguuccuauuagauuuguuuguauuucugguucucuccccaaugucucaacaauuuuucauauacuccuucucuguuagcccacugucauagaauaccugacuugaucuuuagcucacugaauuuuucuucagcuugaccaguucuccugagguuaaguuuuuguuugucuuuaacagcuuuauugagguauaauuaacauacaauaaacugcacauauuugaaguuuugguauacacucauguauaugugugugcauaugcuguauucaugaaacugucacuguaaucaagauaaugaacauuuaucaccccaaacauucccucuuggcacuuuguaacccaucucuguucuuaccuucccaggcuccaagcaaaaaucugcuuuuugacagucuguauuaaauacagccaugccuucugagaaaugugcuuagcuguguucauugauuucauuguugugcagacauuauaaaguggacuuacacaaaucuagauggcauagcccucuagacauauaggccauaugguauagacuguugcuccuagcugcaaacuuguacaacauguuacuggaugaauacuguuagcaauuguaacacaaugguaaguauuugucuguaaacauaucucaacauagaaaagguacaguaaaaauaccauguaaacauaaaaaaugguauaccuguauagggcacugaccuugaauggagcuugcaggacuacaguugcagugagugaguggugagugaaugugaaggccuagaacauuacuguacccuacuguagacuuuauaaacacuguacacuuaggcuacacuaaauuuauuaaaauuuuuuuuacuucaguaauaaccuuagcuuacuguaacuuuuuacaauuuuuuuuuuuaauugagauggggucuugcuauguugcccaggcuggucucgaacuccuggcuucaagcaaucuucccaucucagccucccaaagcuaugggauugcaggugugagccuucauacccagcgacuuuauauacuuuuaauaacacuuagcuuuuaaagcacaaacacauuguacagcugcauaaaaauauuuucuuuauauccuuauucuauaacauuuuuucuauuuaaaaguuuuaacuuuuuaaacuuuuuuguuaaaaacuaagacacaaacaugcacauuagccuagaccuacacagagucagaaucaucaguaucaccgucuuccaccuucaucucuugccccacuggaaggucuucaggggcagcaacacgcauggggcuguccucugugaugacaaugccuucuucuggauaccuccugaaggauugccugaggcuuuuuacaguuaacuuuguaaguagaaggaguacacuauaaaauaacaacaaaaaguauagcauaguaaauauauaaacccauagcaguuuauuaucauuauuaaguauuaugcauuguacacaguuguugcauacuagacuuuuaugugacugguagguuuguuuauaccagcauugcuacagacacgugaguaaugcauuguguugcgacaucacuaggccauaggaauuuuucagcuuuauuaugaucuuaaugggacuauuguuguguaugcagucugucacugacugaaauguuacgugguguaugucuguauguggaaucaugcuuuauguuuuuuuuggggggagggucucauaggagaugacagcuccugugcauguuauugucucuuuuuucuuucuuuucuuuuuuuuuuuuuuuuuuaagauggacucuuacccuguugcccgggcuggagugcaguggcgugaucucagcucgcugcaaccucugccucccguguucaagcaauucuccugccucagccucccgaguagcuaggauuacaggugcccgcuaccaugccuggcuaauuuuuuguauuuuuaguagagacuggguuucaccacguuggccaggcuggucucuaacuccugaccucaggugaugcaccugccucagccucucaaaguacugggauuacaagcgugagccacugcgucccgccucuuuuuucuuuagcauaauuauuuugagauccaucuguguuuccauguguauccacaguucuuauugcugaauaguauugcauuguauggauauagccaaauuuauuaauucaacuguugguggauauuuggguuguuugcaguuuucagugauuauaaauaaagugucugaacauucacauuucccuacugugugaacaugggcuuuuauuuuucuuggguaaauaucuagaaguagauuggcuggaucuuuugguaggugugcauguugcuaacuuuucaaaaaauugucaaacuuuucuuuuucuuuuuaaaaacaacaacagcaacaaaaaacauucccaccagcaggaugugagaguuucaguugcuccacuucugggucauuacaugguacggucagucuuuaaaauuucuagcauucugguggguauguaguggagcucauuauaguuuugauuucucuucccuggugacuaaugauuuggaacacacuuuuuaugggcuuauuuuugcaauccuuacaucuuggugaaguuucgguucagaucuuuugccugcuucaaaaaaugugucuuggacugggugcgguggcucacacuucuaaccccagcacuuugggaggccagggugggaggaucacuugaguccaggaguuugagagcagccuggacaacagagcaaaauccccuucucggcuggggaugaugguucacgccuguaauucuaguacuuugggaggccgaggcaggaggaucacuugaagucaggaauucaagaacagccuggccaauauggugaaaccccaucucuaguaaaauuacaaaaaaaaaaaauuuucuuaagaagacccccuucuguacaaaaaaaauuuuuuuuaauuagcugggcacggugguaugugccuguaguccuagcuacuggggaggcuggggcaggaggauugcuugagcccaggaguuugaggcugcagggagcuaugauugauugugccacugcacuccagcuugggcagcagaacgagacccugucucuaaaauaaaauaaguaauauguuuuguuguaaaaguucuucauauauucuagauaggagugagucauuuauuuuauguuuugcaaauauuuuuucccagucuuugguuugcuuuuucauuuucauaacugucuggguucuucuucaguuuugauucuucuucaguuaagcuuuucuacuaaguuuuuuauuucaauaaucagaauaugauaucuaauuuuuaaaaauuauccuucaccuucuacuguuuuaauuaugcuuauuuuucuuuguucuauuugcugauacagcccaguguuuucaggcauugcugucuuuguugaguuugguacuuuucuuuauggauuaguuuuauuuugaaugugugauaauuauugguuuugugcuccucuucuguguguuuagacuuuccuauuacaacauucagggauggagguagccuguauagccaagagcagccuggguguggaggcugucugcuccuguaaccuuucaccaacccauucagaacauggcccacuuuuccagcccaagcucccuguucccacuucaagcagaugcugcugcuacuguugcuaguugcuuggcaccaggggcucaugcauacugagagaagcaaagcugugcucaccugacugcuccugcugugguacuccaucucaucaccuagucuuugacccagagcucccuccuccucuccaucuuuggugagccaacuaccuuauuucuggguggccuucucugaugucccuuuucuuccucuuccugcuagagaggauucuuuuuguuuuuuuuccuagcauccaguaucuauaauucauuguuuacauauuugucauuuguaauaacugaacucuuguagagaagcagcagauauuauucacaugugaauuucuaucacccugaguaacacagaauacuugaaugagacauuuuuauuuagagaaugggaguuuuaauagaaaagacaauagagcuugagacucccugggagagcaggccagacauggagagauacuggucuauuucuuuuacugguagguuaaucuuaggcagguuauuuaaucuuguuuaaucuuuuauauuacaauaauuuuaauuauauaaaaugugagaguguguguauacauacauauaugugcauacauuuuauuaaaacaguacauguucaucggguuuuuguuuuuguuuuuuguuuuauuuugagacagagucucacucugacacccaggcuggagugcaauggcacaaucuuggcucacugcaaccucugccuccuaggcugaagcgauucucccaccucagccuccuaaguagcuaggauuacagguacaugcuaccaugcccagcuaauuuuuguaauuuuaguagagacugguuuucaccauguuggccaggcuggucucgaacuccugaccucaggugaucugccugccucggccucucaaagugcugggauuauaggcaugagccacugugccuggccaacaaauaguuuuuuaaacaguagugggacaacuggaucuuuccaugcagaacaauguagguggaccccuaccucaaaccauauacaaaaauuaacucaaaauggaucaaagacccaaacuuaagagcuaauuuauaaaauucuuagaaguaaacauagaugcaagucuuuaugaccuuggauuagucaguguuauuuuagauaugccaccaaaagcacaagcaaccaaagaaaaaauagauaagugguucuucaucaaaauuaauaacuuuuuugcuuaaauaacauuauuaggaaaguaaaaggauaacuuguggaaugggagaaaauaauugcacauuauauauuugguaaggggcuuguaucuauauauaaauaacuucuagaacuuaauaaaaaaggcagauaaccaaaucuaaaaaugagaaaaugaucugaauagacaguucucuguagaaaauauacagauaaccaaugaguuuaugaaaaaaugcccagcaucauuagccauuagggaaaaugcaaauuaaacccacaaagagauacuacauuguauccacuaggauagcuguaugaaaacacaguaaaagaaguguuaaugagguugaggaggaauuggaucccugcuguaggaguguaaaauggugaaacugcuuuggaagacagucuaccaguuacucaaaaggcuagaguuaccauaugaccuagcaguuugacucccagguauauacccaagagaaaugaaaccauuuauuuauacaaaaacuugugcaugaauguuuauaacauuauucauaauggccaaaagauauaaacaacucacaugcacaucaucugauuaaugaaucaauaaaauauuguauauccauauacagugggauauuauucagccauaaaaaggaauggaguacugauauaugcuguagcauaaaugaaccuugaaaacaccuuacauggaagaagccagugacaaaagccauguauuacaugauuccauuucuaggaaaugucuagaaaauagaucuauagagacaaaguagacuagugauugccaggaacugggugcagggagggagaggaaugggaauggguauggaguuuugggaggagguguugaaaauauuuuaaaauuuauuguggugaugcuuauacaacucugaauauaaaauguaaacuucacacuuuacauaugugaaugguaugcgaauaauauuguuaaaaaucaguauuguuuuuaaaaauucaaauauacaaaagauuauaaacuugcaccuguucauauaauggauuuuuuagaaauuauacaugucucugcuuuaaaauguuuuaaacuauaaacagaaugcuaguuuauuuaccaaauggaaaugguugcuagucaucaguauuuucugagaggcccaaucuuucuagcaucuaggucccugaagauagcuagaaagugugcagagguugagaguaagaucacagggucuagucauguguugagggggcauauuuccaggcccucaugaagcccagugacuuuucccuguguccagauuaugugugcugguguugcauaauaaagaauuuguuggcuggaugcaguggcucacgccuguaaucccagcacuuuggaaggcugaggcaggcagaucaccugaggucaggaguucgagaccagccugaugaacauggagaaaccccgucucuacuaaaaauacaaaauuagccagguguggugacacaugccuguaaucccagcuacucaggaggcugaggcaggagaaucacuugaacccaggaggcagagguuguggugagcugagaucacaccauugcacuccagccuaggcaacaagagagaaacuccaucuccaaaaaaaagugucaguugagugugguggcacacaacuguagucccaacuucucaggaagcugagacaggagaaucacuugagccgaggauuuugaggaugcagugagcuuugauugcaccgcuguacuccagccugggugacagagaaagacccugucucaaaaaaaaaauuuuuuuuuuguuugauguuuuuuccagguuccuggcacagagcuucuaaagacccuggaauuugaguaguaggagugucuuuauuaugcuaaugaagugacuggcagugggucccuagauagcuucaagauggagcauggucccccagaaagaccaaaccaagucccuacaugguugggacuuugagcuagccagaccuccaaggagggcaggaaagagggcuggagacugagcuauauuguguggccugugguuuagucaaucauaccuacauaaugaaaccccaguaaaaacucuggacacugaaguucaguggagcugccagguuaggaaacacaugugcugggagggagauagcccugauuccucaaggagaggacacagaaacugccuugccucccagaccccauucuacauguauccuuuauaauaaaacugaaauccuaauuugagcacuuacuuuccugagcucugugagucauucuagugaacaaacuugagggugcaguggaaaccuccuguauuaguuacuaguuggucagaaguguggguagugggaggaccucugcagcagcauuucuauggaggacugagcccguagcaugggguaguuggugccagaauugaauuguacgcccagugugguugaggcagaagagcuggacagggcccguuucuccuuccccuggaugacauggugguuccuaagucuugccagguuucuugccugucugguuguuuucuuguuuuuguuuuuuugagaaggggucucucucugucacccaggucggagugcaguggcacagucucggcucacugcagccucugccuccuggguucaagcaauucucccaucucagccucucaaguagcuggaauuacaggagugcaccaccacgccuggcuauuuuuugcauuuuuaguagagacaggguuucaucauauuggccaggcuagucucgaacuccugaccucaggugaucugcccgccuuggccucccaaagugcugggauuacaggcgugagccacugcaccuggcccauguuaguuucuuuaguuggguaauaaggaaauuucuugaaagauuuuaaacuagcuagggaacguuaguaauaugauagguacuauuuaggcuguauuugcuguuuucugcuuacaucaaguagcacugaggcgggcauggcacauugaauagguuccaugaacacuauccaugacuaagucaggacgccgccauuuagagccccaucagcaaacuacaucugaguaacuaauuuaacugccauuuuacaccuggguaagagcagcaauuuacaacuucuguuuuuauuuucuguuguuuuuucuuuuagggggaagaggugguugauaaaguauauuuauaugugagacugacuaguuuaaguuuuuaaaaauuagauuugguucuuggcagaaggaucuuguucaaguaaggaaaacucacuucacugcuggaaauaacuuauuuacuuguuucuaauggccacuaguauauggcaucagauuugggacauagcuguugauuuguguauauauuguaugaauguaauucuuuauacucauuauuuucauuguguaauaguuccuuagaaagcagauuuggauauaguuuguucauaucugcuauauauuuauuugcuuuauaacuauuuuguaaauuuaauuuacauuauuuuccuagaaauuuaaaaucaaaauguucaaaacaguauuguaacaagaauauuuuaagaugacuuaaaaacacugcuaaauaauuaaacucuuagcaauuuuguuucagacaucuccacuuuaaugucaacugcaugggucaacaaacuacuguggccccagucugccuauuuuuauaagcaaaaccuuauuggaauacagccacacucauuacauuuaaguuucugucagcccugguguagaggauuuuaucccuucguuccugcagacaccuagaucucaaagaauuucucuucuguaucuuauuaaacuggccugugggcuuucuguguguuucauuucccucuauagcaaacuguuuacuucuuugagauuggucuuuucuuuuucugcaacaggaucgcaguaugugguagggaagugaugcugucugaaggugacauccuguucuccucucuucuguccucuccauccuuauuuuggccaccugguaauugggggggagggguagaaugcuagucuaaauuauaaaaugaaauugcuuuaacuauuuccccuuuacuugaaaaaggggguugggggugauuccugccuugcaguugagaaauaaaaguuaucuagcuuucagcacaaucuguuuuggggucaugggaucuuuugagaaucagaagaaaguuguggagccacucccuggggggaaaauauauucagaaauauauuauuacagaaaugaaucuuugaucaguuuuuaaaccuugaaauacaagugacuuuaccaauguauucuaauauacuuguuggcagccacuucugauguuagaacuuugaauauagacauuugagaaaaauaauugauuuuaaguguucccaaaguaaaucacugguucaggauagaucuaucuuaguguucccaaauugugaaaggaaagagauuaagcccuuaauguugaaacgugugucucccaaaucuugcuuugugcuuagcaguagagcuaugaaauuccauugaucagagggcuuguuucugaccuuguccuuuuuucacuuuugcacgagcccugccauuugaccaguguguccuaaacuuuauucauugagugcugucuucauaaguuggccuuaucugcacauuuccugauauucuuucaaugaacucaguuuuuaaaauauauauuuuuuuaauuuuuuaaauauggaacgacucacaaauuugcaugucauccuugcacaagggccaugcuaaucuucucuguaucguuccacuguuaguauaugugcugccaaagugagcaccuaauuuuuuuguaaagacaaaguguuuccugggcuagucccaacuccugggcucaggcgauccucccaucucagccucucaaagugcuggcauuacaggugggagccauuaacucacuuuuuaaaacuuaaauuuaagcaaauaauuacugucugugaaauaugcguuucauguacuaauucuuuuauauucgccacuuaaaggaucauguaaauauuggggguuuuguuuaccuaaaaccaucuuguaucuuuuuagagggcaucaaguucauuuugggaaacauuccccuauguacuggaauuuuaaagcuuugauuuugaaccagaguaugaaugguggaagcugcuuuaacuuggaaauaccagggaaaaggaggggucaugggaugggugggugcugucugcugaaauaccccuugcuugggcaaauuuauguguccugaauaugaggauauuuggcuaugugcauggcaaagcuugggaucguacccuugcaagaacaguugguuuguuuuuuaaccuggccaaacaugcauacacacacacacgcacgugcacauuucauaaguuuuauuuucuuuuacagguuugaucuugcucuucuaccuaguuuuuuauggguuccuggcugcacucuucucauucacgauguggguuaugcuucagacucucaacgaugagguuccaaaauaccgugaccagauuccuagcccagguaauuaucuugcaguuaugacuuuguuuuuuguuuuuuguuuuuuuuuugagacagaguuucacucuuguugcccaggcuggaaugcaguggcaugaucuugggucacugcaaccucugccucccagguucaagcgauucuccugccuccucagccugcuaaguagcugggauuacaggcaugcgccaccacgcccggcuaauuuuguauuuuuaguagagacaggguuuuuccauguuggucaggcuggucucgaacucccgaccucaggugaucugccccgccuuggccucccaaagugcugggauuacaggcgugagccacugugccuggcagugguuacggcuuuuaacaaaauugaguuauaguuuaucuucaccauaaaucuguuuuauauagcagauagaagauagcuaaaccuuggagcugaguaaugugaagguuuuaauuuuuguuguuguuguuuaauauuuacauacugauuuaaagaccuucacauuuauauacugauaaaucuugagaguuugaguggguuuguuuuguuuguuucgguuucuuuuuuuuuuugucagaaguaagcaaaugaauauugagaauucuaguaaaagccacguuugaagaauauaguuauaguuaugagugacuuaugaguaucguagagcaguuuuacuuugccuugaguaauuaagguauauauuuuggcacuagcuucaguuagagcuuuggacuuauaaaauacauacuuugucguucuaaaugguuaguuaugaaauugguaaguuguuaaauaaugauaccucauagagaacaaaaugaauauacucuucauauguuuaauucuucuugauuuucuucuggaaaaaaaauucauuauacaggagaauguaugcaguaaaaaacugaaacaucuaaaccacauuuucuaccuccugauuuuauucuuuuuaaacagucuuuuuuuuuuuuuuuuuuuuuuugagacagggcuuugcuccuguugccuaggcuggagugcaauggugugaucucggcucacugcaaccucugccucccggguucaagcgauucuccugccucagccucccaaggagcugggauuacaagcaugugucaccacgcccagcuaauuuuuuguauuuuuaguagagacgggguuucaccacguuggccaggcuggucucgaacuccugaccucaggcgauccacccgccucggccucccaaagugcugggauuacaggggugagccaccacaccuggccuaaacagucuuugaaugccagcucucccuuggugacuggacaugacccuuguccucagaugcugauaauuagaaaaguaagaaacaguaaugugcagaacuucaguguguauaauuccaaagacuguaaacuaacugcuauagaugacagagaagggaagguucuaccuaaagaagaaaguucaguccuagaggagugggauuuagagggcaggagaguggggaaucgggccaggaaggugggagucuagcagguuucucucuagagcagugguuuucaaccacugagucauauggcagcgucuggaaauauuuuugguuguuacagcuagagaggugguacugugaauagaggccagggauguugcuaaacauccuacagugcauagggcaacccccacaacaaagaauuauucagcccaaaaugccaauaaugcugagauggaagugcccuuaucuagauccuugcucacuguauagacuucugagcuauaucaccagccaaacugaacuaauugucucaaccauuuuuuuuccuagaacaauuuuuuucuaaugauuucuuuuguuuacagcuaaucuuagucuaaaugucuugaauaacucuuuuaaaacucuuaguguauuggagcaagugucagagauuaguuccaugcuacuuuuccuucaucucucauuguagcacuguuuuuuucuaccucagacuaauucuaagauuauucuuuacuugcuauuuaagugaugugacuuaccauugaacauagucugaucuauucaaaaacacugaacucuguuuauaauugcaugaaauauauaagcauauguguuaaauauuuuuaaguacacaguuuuuaaacugaguuucuuaaaauuauuugucgauuauuuuaguacuuaaaguaucauuaguuuaaauaaauauacaugcauacacauguacauauaauacauauauauuacauaugggacauauuaaacauuuccuuauuuaauauaucacauguacauguaauacauauauaauauguauuuauguguuguauauuauauacauauaauauguauuauauguacaugugugauauauuaaauaugggaauguuugaaggcuagagaaaauuuuaggauuguuuuaaagccuaugugcaagguugaauuaaucuagaucuaaugcuuuuuuuuuuuuuugagacgaagucucgcucugucgcccaggcuggagugcaauggcacgaucucggcucacugcaaccucugucucccagguucaagcaguucuccugccucagucucccaaguaacugggacuacaggcaugcaccaccacacccaccuaauuuuuguauuuuuagaagaaaugggguuucacuauauuggccaggcuggucucgaccuccugaccucaagugauccgccagccucggccucccaaagugccaggauuacaggugugaaccacugcacgcagcugaucuaaugcuuuuuaaacaaggaaaacuuacauuaaaguuggaagccugauugcuugccuuaucuucauuaguaagcuuaagcaacauggucuguauuacaugggugucaacuucugauaggaaauuguuggugguuauacuccaaauucaguaugugaaaaccacauuuuaauuacagagcaauaucugcuauugaaggaagaauauuugccauaaaguuuaaaaugcauagaccuuuuucauugaaaaggaguuagcugucuuaugaauguuuccauacaauuuaaaugacaaaaguacguaggcuuugauuugcucaaauuuuuuuccuuguauuaauggcacauugacaaaaccuaaaaauguuauuugauuuuuuaaaaaugcauauagaaaguucaaaguaaaauugcaucuuuuaaaaaggaagauuauaauuaacuguagauaaccaaauuuagggacaguuucuaaucgguaaugucugagaugguuuugaagguuugaguuauuuuuaauuuuagaugucuaugccuucauaauuagaauugggaaguucuugauaguuucagcauacugucaacacaauuuuccauguaauuugcugagaucugcuuuuuagagauaagaggaaggaaaagaagagaaggaaauuugauaaucucucccuuuuaugucuuuauaggacucaugguuuuuccaaaaccagugaccgcauuggaauauacauucaguaggucugauccaacuucguaugcaggguacauugaagaccuuaagaaguuucuaaaacgugaguauguuuucuuagaguaaggucagagauuuuaguuauagaaauuaguaccaaauugugggccgggcacgguagcucacgccuguaaucccagcacuuugggaggccgaagcgggcagaucaccugagguuaggagccaggucuuggaccuggccaacauggugaaaccccuggccaacauggugaaaccccaucucuaccaaaaauauaaaauuagcugggcgugguagcacgcgccuguaauuccagcuacucgggaggcugaggcagaauaaucgcuugagccugggaggcaaagguugcagugagccaaguuugcgccauugcacuccagccuuggcaacaagagcgaaacuccgucucaaaaaaaaaaaaagagucccaaguugugauuacauuuagacacaucauucuuagaauguguauuaccuucuauuuccuucuguuaagcagacaacugagcaagugcauuuuauaauuacuugugagacuguucuaacuauagaaagacacaggggcuuacucauggguaguagauuugauuuuucugucuuauaauaaggacacuaaauuucuugaaauguaacauuuauucugcauuaaaacuaaauauuuuaauuaauagagcaaaucuauauuuuaugaaauagugucucugaggacuuggauuuuuuuuugccauuuuauuuuauuucuuuuuuuuuguagcugauauacauuuauguugaauuugaaauaggucaguauaguuauugagaaggaagaaucuuuuuuuuugugccaggcauucuuuuuuuuuuuuuuuuuuuuuauuauacuuuaaguucuaggguacgugugcacaacgugcagguuuccaauguagugcuugcuugggggaugggaaauuauguuuauuauuuuaaaguuaugucugugucugauuuuuaauacauccguuuuucaaaguuaccaguuuguaacgcucuuugauagccauccuagcccaguuuuuccuccuguuuugcuuggccgagccauuuaugugaaugguguuaacagucacaugaguaaucaucgaauguccuggccugcugguucaugaucagcucaucucuuccucagccacagacaccugcaacugcucccuagaacauuacuuuaucucaucucccaccccgucuucccuuuuauguagcuuaauuccaugguuguuauuucauuuuuacuuuuacuggugcucuaaaaucccagaccucucagucuucaugucacacccugugggaguaccccacuccuggauaaagccauauaauuacuggauguagcucauccuucugugccccugccccugagcagauacugagcaggacuaauuagcacugugaguacuugagcaccucccucaaauggacuugcuuaacugccugguaauccuauggaauuucucuggauaauucucugaaaggauuauuuccaacuuucacucaagccucuaaccccuuaccuuuuuccuuacaacucacucucuucauauaaccugauuucuugcuucaagagauaauagaagaacucagaugggagcuccuccaguuuccccauuaccaguaaaacaaaucuacaauggcagccauuuugucugucacauucuuccugcucugacugggggcugcccuuccuuucaccugaggccaccugugucacuccugcuuuggaucucauccucucucagugucucagaaacauacuguguacucucucuucuuguguguauuuagccuuucugucuguauuggauccuuccugucaacuugaaaaaaucuucaacucucuccuaucuuaaaccaaaagcugcuucugaucccacauuaucuacuagcugucuuccuaagucucuuuuccuugacaguuaaauauguacucauuauuuaaaaaagacuuuugugaaaguauuauccgugguuuaauagcuuuaaaaggucugcaaugaaguguucccugcccuccucccuuccagcagaaguccuauuaauuuauugacauauuuuuugagggccugcuuuguggcaggcacucauuuggguuccagcaaugaacagaagaaaaauuccugucuuucuggagcuuagacucauggugaauuagaagauaguacauccugagggggaaaauaaaacagaaaaaggagauaggguaaguugggaaggauugugguuuuuacaugcagaguggucugggaaagccuuauggaaagggaaccuugagggaagagcugaaggaggugaaagaacuagcccuggaaauguccagcacaggaagcaguaggugcaaaggcccugaggcuuauggugcugauguguugaagauucaucaaggaagugagaggggcugaauggagugagccaggggagagcaguaggagacugagguuagggaguuaaaggagauccagacuguagguccuuagaacccauuguuaaguucuuuggcuuuuacagugaccaugaugagggauuuuaagcagugaacaauaacaugaucuaauucaaauuuuuaaaggauccugcaggcuucucuuugaaacuagacuagaaggggggaauuggggaagccaguuaggcuauuacaauaaucuagguaaguggagaugguggcuuggcaagggagagagcaaugaagguugugaaaaauagucugauucuggacacauuucuuuuuucuuucuuuccuuugucuauuugucugagauggggucucucucugucacccaguggcacaaucacagcucacugcagccucagucuccugggcucaagugauccuccugccucagccucuugaguaguuaggaauacaggcucacaucaucacgccuggcuaauuuuuuaauuuuuuguagagcuggggucuugcuauguugcccaggcuggucuugaacucuuggccucaagugauccaccugccuccgccucccaaagugcugggauuacaggcgugaguuacaguagcaccuggccuuuggauguguuuuugauagggaauuaacuucaugcuucugaacuuuuucuuacgguguuuuucuuccauaucuauaaauauuacacuuuuccugcugguucuugacuuuuuacuuuucuacauuaucacuuuucuuuauuaauuauuauuuaucacuuuuauacauuuucuuaguucacaugucucagaccuucccuccuuucucaacucaauaauaauugauuuacuauuuuuaguuucauuauugguugccuuuuuauacuuggucuuuauaucuucuuuuaucaucuauagauacucucuucugacuuccuuauuuguaaacuaucauuugagguauuuucuugagucucuuuucuggaaaacuccuuccuggagcccuuucccuccugcugcacucuacuguuucuacaucagccuuuuacucccaacuguccuuuggggaacuuccuuuuaccacuuucuuuaguuggacccacuguuucuuggcucuugcccugccccccccuuuuuuuuaauuauuuuuauuuuuucucuuaauuuacuccuuaguuuugauggaguacauucucaaguaauuuuauaagaaaagacaccugaaauguaaauuugaacccuuuuauuucugaaaauggcuuauuucugccuuuauauuugcuaguuuaucuccauauagaacucaguucuuuguaauuugccuuuucucuucucugaaaguuuuucauuuuuuuuuucaauuuucuuuaucucuuuuggauucuaaaauuucuaucuggauuucugucucuaaaguauuuugcugagacuugacugcagguuuuucaggaugaagacuuaaguucuucaguucaggggaauuauccucuguuaccacuuugauaauuuccucaacucaauuuucugguuuuuucuuucuagaacuauucuguuuguugggucuuagaccucuuguuuuucucuuacuuuguuuuuacuuaauuagacuuucuggggguuuacuuuaauuuucaacuccuuuuugguuuuuaaaacguucgacugcugucaauccuuaugcccuccuuuuucauguuugaaagauacuauaauauaucugguuaaaaaauaaugucuucucuauuuuuuuuccugcagauacuaauuggacuuaaaaaguuuuauuuuguuccaauuaucucuuuccuuuagggucauucauuccuccaguuaucuuggucuuuuuuuuuuuuuuucuucauugagacagucuuacucuguugcccaggcuggaguacaauggcuuguucucagcucacugcaaccaccgccuccuggguucaagcgacccucaugccucagccuuccaagcagcuaggauuacaggcuugcgccaccacaccuggcuaauuuuuguauuuuuaguagagacaggguuucaccauguuggccaggcuggccucaaacuccuagccucaaguaaucugcccaucucagccucccaaagugcugggauuucaggcaugagccacugcgcucggccuuuggucuuucuuauuuuaggcguucuucagaugcauagggcuccuugguuacucuggggucagugaccuuucuauguucccaucaugccuucugcauaaucuuacuggucaucacacaguuccuuacacuuaauaguauggaaguggaagucagcauaauaaaaaagcaaggucacugaugaacugaccuauaccaacagagucuaugcaguagaagcccuuggggaaauuggugaagggcuuauuuuuuugcaaaguguuggaugucaugaugcuguuuuguuauaaaguuuaucucuacccccacaaaauaccugaaucauucuuugcuuuuaaaugaguacauagucccacaguaaccuaguuucugguaaguauaagaugaaaccaaacauuuugacagugauuuuuuucccccaagguaaagacuuuacacuuccuuuuugaggcauacucuuugaaauuugguucuuauuuauuuauuuauuuauuuauuugagauggagccucacugugucgcccaggcuggagugcaguggcaaccuccgcccucugaguucaagcgauucuccugccucaguagaauccgaguagcugggauuacaggcaccugccaccgcacccagcuaauuuuuuuguguauuuuuaguagagucgugguuucaccaucuuggccaggcuggucuugaacucuucaucucgugauccacccgccucggccucccaaagugcugggauuacaggcaugagccacugcgccuggccugguucuuacuuucauugaauucaauaccuuuuucugguaccaauugcacccacacaccaauaguucuuccugaggcacuguuauaucauauguuaauuauuuauuaguaagcauuguccacuagauuaaguuaauugagggcaggggucacaucaggcuugcucacuuugugccucuugggcuaaacacugugccaaguacggagcagaauuguauugucuguugcauauuucuccucccucuucccucccauuaccaaguucuaaccauuuuacuccuuuaucacuguaaacuccaucucugcuaaaaacccccuucuaugagcuagucucucaccugggcggcuuuaauagucuccuaacuuguuuuccggauccuuucuuuuucccuucuggacugacuccacagaaaagucagaguuaauuuccuaaguauguucauacuauccacuugcccugguuuaaaacauuuuaguggauuguuaauugauguuuggcaaaacacccacccacaccccucaaaauucuuuaacauaguuuacaagacucuauauggucuggcuucuaccuuccuucauuggaagugcuucuccuagcuucauuaacucccacauacccuucugcauucagcucaguugcuuuuuuuuuuuuuaguguagguugucauaacacuacaucuucauaccucugcaauucugauuuuauacucacuuaaugacucucuuccccacaaaaccguaagcuccaugagggcagcagcagugccuuuuuacauccucuccauuguaucaccaagcaugcagaaggcauucagauaaugcuuuagccauggcugguacugccaccuaauggugacagaagagauggaucuauaauccaguuuguaugauuauugaaaugcaguaacuuuagagaacuaguuagcuguuaaaagguaaaggggcaaacuuaacauucuuucccuaaaguuaucugguaauuuacauugcuguuuuugucuuugaagaacauuuuccaaagguuaauauauuccugguuguuuuuaguaccuuuuuuggcugaucuagcacacauauauguuuccuuuuuagcauauacuuuagaagaacagaagaaccucacagucuguccugauggagcacuuuuugaacagaaggguccaguuuauguugcaugucaguuuccuauuucauuacuucaagcaugcagugguaugaaugauccugauuuuggcuauucucaaggaaacccuuguauucuugugaaaaugaacagaguacguacauauuuuaccucugcugcugcuuuuuucuaauauucucuuuuaaggaggcaacuauuuuuagauuguugugguuggguuaaugccuuccuuauuaaaaguuaucauuugggggguagcuugcuuuaaagacuagcaguaauguuuauugaucacuggaagaaaguuuauauggcaaaaaaaagagguucauagauuaaucauggaguaaggaguuaaaguaacuuuuaaacuuuucuucuuuggaaauagcuacaugcauuccagcacacauuaaugcuccaaggggcaaauguucuccuugucauaaccaaagcagagacuuguuagggugcagugcucaucugugaauccuguguuguaaaauaauuuaaaauuccacagacuccauaaaguuuaaacuuauuaacuuuuucgaaauaguagcaaagcauaguuuuauaguaucaguauauauauauguaauuagauaacagaaauacaaauaaaaucccauucuaacgaguucagugggauguugcaguuguauccaaaguagcagcauuuugcuguuuuacagaagggugccuaaauuguauaguaaugagcaaaggaagaagcuaauguucucugugugacaggaguaaugaauuagggucauugugcaaaggaagaugauacggcuuuucuugagucaugaagugaucccuagcccccgugccuugcugcucuguaaauguacuucagaguuguguucugaugcgcuuacuguuuugaggccugcaaggucucccuugaagagugaagucauucauggucauuuaaaacagguguagacuucucaaaaucaugaguuuaugaaucacuaaagucaucauuggugagcaaauugccaccaucccuaauaaaaguaaaauuuggaucuuuugaaguuggcacugcuaaauaagaagcuucccuguagggagaaccagcuaggcccugaggugcccagacugacaccccuccaaccucugcuucaucccuuugggaggccuuggacaacugacagcuuccagauugucccauagcauucuaggugcucaguaaaugauuaguggaauguuucaaccagaccuuauucagaauuaagaauugaaguuaacaaaguaagcugaaaguaaugugaaacuagaugaucuaguuuauaaaaugaauuaaguuuguuuuaacagagaugccuuuuguaaucccagucuacuagaaguauccucacgacaucuagauugcugaacauuuguucccaguagaaagccaggagaggaucaaccuucuggguuuguuuucuuucucaagauggucuccuugaaugauaauggccugagaccaugcuugcugaugacucagggcauggcuuugucaggaggacagcaucagacacacaggaaucauugaugagaugagcuuacguaguguagcaggagguuucauaccaguauaguucccaguuaggacgcaacaauacuugucuuuugagaggaauauuuagauuuuacgugcauucacguggaaacuguguauaaauucagaaugccaaaaaauuaucucacaaaauguauaaauaugugaguuuauucaguucugucagcuacauacacgaaaggagucuuaaaauagggcucucccagugugugccuuuuggggagcagauggguugugagauacagugaggcucaguggggcccucauggaaacacggagagugugaccugauauaguuuugugaagaacaguuaauuauuaugcuucugcaguucuuauuauauacauuaaauuauuuguucauauaaauauuaauaauuagauuuaaggguuucugucuguuucauauuuuaaggguagcaaaggguacuuuuguuucauuuaauucuuugguaauuuauuuauuuucuaaauugccccaguacaguaauaagauaucugauugcugaaguuauuuuauuuaaaaguucauuuuaauacccucaaauaagauuaaaguaaaaggcagauguauacagacuugguguuaaucucaaagucuucaccccuuguucccagcaacagagggaggaaguuccauugcauacuuacgugaaguuuaaauuuaucacuauuucuuaaccuuagauaauuggauuaaagccugaaggagugccaaggauagauuguguuucaaagguuaguauucaaaaaguaacuccuguuaaaucuuugauguuucuuaaaauacuuuaaaagucuaaugauuuagucaucuuuuuuuucuucccugucacauuuuaaaguccuuuguagugccuuagaauaaaauuccaccaaccguagucuuucucuuccuuaaugauaauucagaaagacauuuuccauguguauuugauuuugcacacauugccuuuauuuucacauauaccguauuucaucaauucuaagauucacuuuuuuucugccagcucaguaacacugaaauugggauuacccuuguaauugauggugucuuaauacuguaucaugacauuuuucucuuucuuaauaguuaguuggcgugcuagucaucagugcuaucugagauuuaaugaaauauggugcauuuuccuuaagguagaagcauuauuuaucuccccuaucccuacuuacuuuuuuuuccagaauacugugcaguuuucaucucauaacuuucuuuuguuuucucuccaugcugcaaaugccacuaagacaaauaauguaaaagauggguaagaguucugaggagacauuaaguucuaaauuuaucauugugcuaaauauuaacauuucaacucugauuguauggcagaaauauuuuacuuagaauguuacauugaaaucacuuuuaaaguugugaaaaaaaauucuuuuuacuguuaauggacuucuuauuugggcagaaacuucuugcucaguggucuucaaacuugaucacucaucagagucauguugccuuguuggguuccguucccauaguuucugacucaguaggucugagauaggguccaaaauuugcauuuuuuucuuuuuuuuucuuuuagacggagucucacucugucgccugggcuggagugcaguggcacgaucucacugcaagcuccgccucccggguucacgcgguucuccugccucagccuccugaguagcugggacuacaggcgcucccggcuaauuuuuuuuuuuuuuuuuuggagagacaggguuucaucauguuagccaggauggucuugaucuccugaccucgugaucugcccgccucggccucucaaagugcugggauuacaggcaugagucaccgcgccuggcccaaaauuugcauuucucacuaaaguuuccaggugaugcugaugcugcuggucugaggcccacauuuugagaacucccgauuuggaguguccuuauuaauuuuuuaagagcauuuauucacuauuuagaguagcauaaaaagccaggaaguuuaugguuucucaucuggguugaaauuauaugugugugaccacuggcaauucacuuuaccuccuugugccacagacagcucaaugggaaacuuguacaaaaagccagagucagcugggugcaguggcucgcgccuguaauccuggcacuuugggaggcugaggcaggcagaucacgaggucaagagaucgagaccauccuggccaacauacugaaaccucgucucuacuaaaauacagaaaauuagcugggcaugguggcacgcaccuguagucccagcuauucaggagacggaggcaaaggaaccgcuugaaccugggagguggagguugcagugagcugagaucacacuucugcacuccagccuguuggcagagugagacuccaucacacacacacaaaaagccagaaucucacuuaaaaccagauaccacaucuaagcugagcuuuucuuucuuuauuuuauuuuauuuuuuuuuuuuuggagacggagucucacucuguugcccaggcuggagugcaguggcaugaucucggcucacugcaagcuccgccuccuggguucacaccauucuccugccucagccucccaaguaacugggacuacaggcgaccgccaccacgcccggcuaauuuuuuguauuuuuuaguagagacgggguuucacuauguuagccaggauggucuugaucuccugaccucgugauccgcccgccucagccucccaaagugcugggauuacaggcgugagccaccgcgcccagcugagcuuuucuugauaaauucuucuaaaaaucuagugggcagcauauacugucagcucucaagucagaacacuauagcuacaagauacauuuagaaaaaauguuggguaacccuuugugauccucagggcuugcucacaaagcuuucugguagaaaguucuuggggcuugggugcuaggcuucagcuggguagaagugcuaauuucaugacagugcgccuguauacaggagccugugagcaggcugcauagauaagcuuggauggagugcugggucuacaaagccaauaccaccugaagggaaaacacauucaagccagaagcgcaaaagcuuuaaauuguguaaaccuuuggucaguauaaacaauuccauauaccucucccuuuuuuuuuuuuugagacggagucucucucuguugcccaggcuggagugcaguggugcgaucucagcucaccuuugccucccggguucaagcgauucuccugccucagccucccaaguagcugggacuacaggcacgugcuaucacgcccgguuaauuuuuuguauuuuaguagagaugggguuuuaccauguuggccaggauggucucgauucccugaccucgugauucgucuuccucagccucccaaaguacugggguaacaggcgugagccacugcacucggcccccuuaagguuuuaaaugcauuuuucuucuuguuuaucuauuacguauccuuugcuucuagaauaguugggggaaauguuaaugaaaaacccagauuuaaugauucggauuucaguuagcuuucccuuuugcuuuggagagaggugugugaaguacauaaaauaaucaaagcagguggaguuuuaauuuuguuuauuuaguuguggauuuuuuguuuguuuuuagaaaagcacaaaaguggaagaaauguuuguaaaauuuggcauuuauucccuaggcuagucacaaguaguaaaccaguuagaacccauaaauuuuagaaguguggcucuccagaacagauggaagcauuuacuacauaucauaauugcaauuuucuauuagauuugucuaugucaagcguucuuuaaauucuuuaguucuuuuauguaauacauaugucuuuuauuuugucuuguauugauuuuguucugccuugauuguuuuuauacaaguuagaguccugaaaauacaaacacuuaacauacccuuggaggugcuuuuuuuuuuucucucucucuccauagagacagggugucaccauguugccaggcuggucuuaaacuccuggccucaagcaauccacccaccuccgccuuugaaaaugcuggaauuacaggugugaaccaccgcagauggccaagguggccuuuuauauuaucaacuuaaaagaugauccugcaaaagauguaauuuucauauuuaugucauuuuuuucucaguguuuuauuuucuuaugaaaaugaaucauacuaagaaaaucaaaaaaugggaagaaacaaaaugcauuaauuuuuaaacuccauuuuguuucaguggaacuuagugaccaucaguagguucuuagaguuaguugcucauaguuuacaauaugaugcuauugccggacgcgguggcuuucaccuguaauuccagcacuuugggaggccaagguaggcggaucaccagaggucaggaauucgagaccagccuggcuaacauggugaaaccccaucucuacuaaaaauaaaaaaaugagccugacgugguggcaugugccuguaaucccagcuacucgggaggcuuaggcaagagaaucgcuuguacccaggaggcagagguuguagugagccaugaucgcgccacuccacuccauccuaggcaacagagcaacucugucucaaaaagaaaaaaaaauaugcuauucguauacuuagaaaauuaugacauacaugcuucacccugaguaccucauuauuauucagauacucauuuuaauauuuuacaauuucuaaauguuuauuuucacagaagguauaaauuaaaagauuaagaaaaauccugccaagaucacgucuuaggcacacacagagagcaguugagcgucugccacaccugauggucuugagccgugauggccuuaacucugagccccagugcccugcuccguaauugaugcuguccacuaaggcuuguuaggccuaaaggagggaaguguaagcuaagugugguaucugguaggaaacccacucuggguugggugugguggaucacuugagguaaggaguuugagaccagccuggccaacaugacaaaacuccgucucuacuaaagauacaaaaaucagcccugcaugguggcgcacacuuguaaucccagcuauucaggaggcugagacaggagaaucgcuugaacccgggaggaggaggcugcagugagccaagaucaggccauugcacucuggcuuaggcaacagagugagacucugucucaaaaaaaagaaaaaagaaaaaagaaacauacuccaagauacucaguaaacuguuucucaaaaaaaauccuuuuuuucauuuugcggaaauguguucugugaaggucauauauuaagguaaaauagguucaacaaaagcaauuaaugcagaaaagcacugauaucagagugacuaguuuuucucuaauauaaaauguuaucuuugauuuuaagcuuauuuuuuaaguuaaagaguacaaauguaggguggaguuugaguagugauugaaaauggcuuuugcgauuucuccuagcguuguuacuuccuacccuuuccacauauucaucaucuggaucauuagagcuugucugguggguggggcgcaucaucacucuguccuuugugcugucuggccggugccuuucaucugucucucaccccaccccacagccauaugcugcuucauaaugaaaugaaaugagcagaaucuagaacuccuuagaguggauucuuaguuuugcuuuaugcuguuucaugcaugcuuucaacccugucucaaaaaaauuuuuuuauauauauauaaaauucaaguauuuaauaauguuuuauuuuaacuaguguuccguaagcccagcacugauuuuaaucauuguggucuguuugcuacuucucagucuguguuaaaguuacacucauuagaauuaggcccauuuagaaaguguuacaugugaauuuucauaaauugcuuauuuaucaugaauaauacuagaaauaacuaauagcaugaauuaauuggauuacaggugaugcuugauuuguauguugauaaacauggaauucuaguagacaaguaauacuuaaugauuuauauaugcucauaaauuuauuccugauacaguauuuaaauuugucgaggagaguuuugcuuguaguaccuuaaauuuuccuucaugcuuccccucugguugcaguucugguuauuaaucacaugaaacucacaccugcugucucccaggccugagugcugcauucuagguuggcaccuugugguggcuguugcuuuccagucuggaagcacagcauuuuauucauuucaggaaaacaucgguccuaaaccugcuggugcauuccugcuguuaguagguagaaaggcuggcauuugguauuuggagggcagauaagauuuuacaggaguacaugaguuaaagaagggacucucaugaaagagaguauagaguguaucuggaaguguaaguaucaggauaguucauguggaagggguuaguuagauaauauuugcaaucaagaugagcaagcuucuucucagaaauacacuuguaaugauaauauaguuggagcagcauuguaguuucugcaaacuguucaugauugauauuccuuuaauuauaaacauaguuuuuacaaauucuuuuugugaccuaaagaggauuucuuuuguuuucaacuucagaaugaagauauaccaaauguagcaguuuauccucauaauggaaugauagacuuaaaauauuucccauauuaugggaaaaaacugcauguaaguauugagaaguucuuauguggugauuacucuuuugggaagcuggagcauguguugacguaccacuugucugggguagguagacgccagcccuguuuaauuugugcgucaucuauucagguuuuguuuuauuuuaauggugaugguaaauggaguucccacauuuacaauucagaacacagaacccaagcagauacguuaaaguuagaugauuauuucuaaaauaucauuuucuuuuucauuauagagguaguaguaggugcuuauguagagaaaguagaaaaguacuuaaaaagaaaaucaaggccgggugcgguggcuuacuccuguaaucacagcacuuugagaggccaaggcgggcgcauuaccugaggucaggaguuugagaccagccuggccaacuuggcgaaacccccucucuacuaaaaauacaaaaauuagcugggcguggugacaugugccuguagucccagcuacucgggaggcugaggcaggagaaucgcuugaacccaggagguggagguugcagugagccaagauuguaccaccacacuccagguugggugacagaaugggauucuguuucccccaccaaaaaaauaaaugaaaagaaaaucaaggccaggcgcaguggcucaccuguaaucccagcacuuugggaggccgagucgggcagaucacgaggucaggagaucaagaccauccuggcuaacacggugaaaccccgucucuacuaaaaauuacaaaaaauuagcugggcgugguggcaggcaccuguagucccagcugcucgagagggugaggcaggagacuggcaugaaccugggagucggagguuacagugagccgagauugugccacugcacuccagccugggcaacagagcgagacucugucucaaaaaagaaaaaaaaucaaaagcucauugcggccgggugugguggcucacgccugcaaucgcagcauuuugggaggccgaggcgggcagaucaccugaggucaggaguucuagaccagccugacuagcauagugaaaccccgucucugcugaaaauacaaaaauuagccgggcauaguggugggugcauguaaucccagcuacucgggagacugaggcaggagaaucgcuucaaccugggaggcagagauugcagugagccaagacugcaccauugcacuccagccugggcaacaaagcaagacucuaucucaaaaaaaaaaaaaauagguuaguggacuaaugaguuaucauaggagugggacuagcggcuuuauaagaagaggaagagagaccugagcuagcagguuagcaugcucagcccccuggccacgugaugccuugcaccaccucaggacucuguugaaaguacccagcagcaaagaagguucucaccagaugcagcuccuugaucuuggccuucucagccuccauuaacuguaagaaauaaauuccuuucuuuauaaauuacccaguuucaaguauuguguuauaagcaacagaaaacaaagacaguaguacaguuaacaaaggaaguuaacauauagugcucuuaugaaucuguagacuuuguugaaaauccaucaauuguuccaguaauacucuuuauagugaaagacaaguguuuuccugaucccagaugucacacuguuaacacguuuagcaaccuauaaucaggaauauuuccucagucuguuucauggcuuuguacucuucaaaaauaaguacgggccuuuuauggcuuauuuuauguucauuaguuggaguuuggugguuuuucaugauuaaauauagguugugcauuuuggcaugagugccucaaaagaaauguugaguucucagagugucaggagggacaugguaucauuucauuccguuaauggugauacugccuugauuccuugguuaaggugguaugagcgagguuucuacaauauacuuuuuuuccucugucaucaauaaguaucauguggggagaaaauuaaaaagcucguuacugccuggcacgguggcucacgccuguaaucccagcacuuugggaggcugagacaggcggaucaccugagguggagaguucgagaccagccugaccaacauggugaaacgcugucucuacuaaaaauacaaaaauuagcugaccgugguggcacacuccuguaaucccagcuacccaggaggcugaggcaggagaaucacuugaaccaggaaggcagagguugcagugagccgagauugcaccauugcacuccagccuggcaacagaaugcaaugucucaaaaaaaaaaaaaaaaaggccaggugcaguggcucacgccuguaaucccagcacuuugggaggccgagguagguggaucaucuggggucaggaguucgagaccagccuggccaacuucaguagcaauggcaaagcccugucucuacuaaaaauaaaaaaauuagcuggguaugguggugggcacccgugacuccagcuacaugggaggcugaggcaggggaaucgcuugaaccugggagguggagguugcaaugagcugagauggugccacugcauuccaaccugggcaacauacuccauuucaaaaaagaauauuaaaaaauaaugauaagggucggguguggcggcucaugccuauauauucccaagcacuuugggaggccaagguggacagaucacgaggucaggagaucgagacuauccuggccaacauggugaaaccccgucuauuaaaaauacaaaaguuagcugggcgugguagcgggugccuguaaucccaccuacuugggagguugaggcaggagaaucacuugaacccgggagucagagguugcagugagccgggaucgugccacugcacuccagccugggcaacagagcaagacucugccucacaaaaaaauuaauaauaauaaugauaauaggccgggugugguggcucacaccuguaauccuagcauucugggaggacaaggcaagaggaucacuugagcucaggggcaugagcugucacacccagucaacauuuuuaucaguaauuacagguauggacuuacagcuccaaaaaauuaaaaagaaugcagagaacagaaaauaauagagcuaaauuuuuuuuuuaauuuacaagccacguaugguggcucacaccuguaaucccagcacuuugggagggugagguggaagggccauuugaagcgaggaguuugagauuagccugggcagggagacccugucucuacaaaaaaauuuaaaaauuagugggcuguggcggcaugugccuauagucccagcuacuuaggaaacugaggugggaggauugguugaggcuucaaugagccauaauugcaccacugcacugcagccugggcaacagucucaaaaagaaaauuuacagaauaagccaauuccugguagagagaaguauuaaguuuccauagaguuugaauuaauauauuuuccuuuuauugccagguuggguaucuacagccauugguugcuguucaggucagcuuugcuccuaacaacacugggaaagaaguaacaguugagugcaagauugauggaucagccaaccuaaaaagucaggaugaucgugacaaguuuuugggacgaguuauguucaaaaucacagcacgugcauaguaugaguaggauaucuccacagaguaaauguuguguugucugucuucauuuuguaacagcuggaccuuccauucuagaauuaugagaccaccuuggagaaaggugugugguacaugacauuggguuacaucauaacgugcuuccagaucauaguguucaguguccucugaaguaacugccuguugccucugcugcccuuugaaccaguguacagucgccagauagggaccggugaacaccugauuccaaacauguaggaugggggucuuguccucuuuuuaugugguuuaauugccaagugucuaaagcuuaauaugccgugcuauguaaauauuuuauggauauaacaacugucauauuuugaugucaacagaguuuuagggauaaaaugguacccggccaacaucaagugacuuuauagcugcaagaaaugugguauguggagaaguucuguaugugaggaaggaaaaaaagaaaauaaaaguguguuugaaaaauauuaucuuggguucuuuguaaaauuuauuuuuuacaugcugaauuagccucgaucuuuuugauuaagagcacaaacuuuuuuuuguaaaacauguaaaaaaaaaaacugggauuaauuuuuaguguuggaacugccucuuauuuuaggcuguagauaaaauagcauuuuuagguuagccagugugacuaugcaccuaauuuuuuaugagauuaaauucauaagacuuaauuuguacaauaguuugugaaauaucuuguuacugcuuuuauuuagcagacuguggacuguaauaaaguauauaaauugugaaauauaaaaacuuggaacuuauucaaagcuu

SEQ ID NO: 192088 - RNA, 38124 nt, Homo sapiens
cauauuuucaugagcguauuuuaauuuuuaaaauuugaacaauucaaguaaaagucagcuagauaacauaaauacagaguaaaugcacauaauuuacagccauguacauaaaugcaagauaccaaaccucacaugaauagucaaaaguuaacacuuuugagguucacuauuuagcuaugacugauaggucauaauucuucacauaaacgggguacacauuccaaaaguuuauaaacacaaaaacugagucaaaccagaauuuuguuucuacaaggaguagcauaaaaaucaguguguagguuaaugggaaauacuaaguacaugauggagaagagaucugagugggcagaaaguuuguacauuguauuuuauguauuaaaauuccucaaauuuaaaucauucagaaauaccuauauucuuaggaauguuaaagucauuauauauuugaggagaaaaggcugaacuguacuuaucagcuccaaagggggucccuagauuacuaacagucugggcagaagagcauguaaacaacaaaaggcaggcauggacaauuauugaagggcaagaaauggauugauuuuuagcacuuaaauccuucaaauccgaauaaauauuuuuagugauuuaaaaccaaccuaaaaaugcugaaaugucuguaacccaguaauagagcaaacauuauuuuuaccaacccaaacucugcugguccuaacauaguaaugcuaucucacagauaaucuaaugauauucuauccugacuucaaaguuacaaauucacugugguggacccaucuagaaaggaugguucuacaaaguuacauaaugagaaucaaacgaacuuuuggugauaguuuuuuuccugggauuaaaaccacugcaugguaucccgaaaucacaaacgcuaauucuucagauuugaacuuugaaauuuaaaaguacaacaaacuaaauaauguggacucuacaccagaaauaaaaaagucaugauaaacagaugaaaacaaguuaaaaaaguccaaugcucugaauauguguuuuuguuuuuaaacaugagucgauuuuuuaaaaacuucaaagaaauauuucagagacaaacuuuauauacaacuuuuauauauaguuuuccuuuuugaauuaucucugucauacauaaacuauugcagauugugcuuagggaaaaauacaacugaaauaaacuucauugcuccuuucuaguuguugcacaaauaaacaauguccaagacucuaagauuucuuugcuuuccaguacauacauaauacuguuaaaagcugaauauaaugcacuaaaggucaacacaaguuuuacuugcuaaauacaaauagagaauauauguuuauccuugaaggacacuuguuaugaauaugcuacaacuaaauaauaagauguuccuuagcugcugguuuucauaucauucuuaaucauuugugggguacugagaucaguaagacuagggagagucucuaucuuacauucaacacaaugaauguuuaugggucuucacaaggcaaauggcacuguauuaggcaguagaaauggcaccugaaaaggcaaacacgauagauucagaccuucucuacagauuuguuacaaaccgguuuuugguacguuccucauaauacaugucaaagcugaaauuuaccauaaaagguacgaauaauuccaaagguaagaaaacugauuuugccuuuggucuccaaauagauuggaauauuuuuauuccaauugagcaccucaaaaacauccaguuacuguugaucacaaggaaguuaaagugggggaauuuaacagggcacuauguuucacuggugacagcagagaaagcuugcaaugacacgcugcaauauucuauaauguuggggguacgacaggguacacagaauaccuaaaacauuuauauuaaggauauccgaaacaacauauuuaaaacccagaaaaauguuaugaacacuguuucugccuaauacgugaccaauguuuuuguuuuuuuuuuuaaucuuaacaugguauucucuccuacucucucacccucccccccaaaaaaggccacaaagugcuuucacgaagcgucauucuuuuagauaaagccauugcacaaaauguacaguucagguauacugaaaugaguaccacaccggcguccaauugcggcaguuuuuauacaccaguauggcauaggcgaagucuuuuaacagaauuacagcaaacaccuuuauaagggccauacaaauaacacauuuaaaguauuaaaagguacagcugacucaauagcagaauuuaaaagcuacauccuauuagcacauuuaacccaaaugaacuugaaucuuucuaugauuuaccacgcaggaaacuaggacagaauaaauuucuugucaaaagcaguuuguucauuuacacaaaacuauaagucaauuaaugucacuaccugcuaaagcagacagcaagggggcccuugucuauaauauuuauacugucccaaauauugucaccuuaaaauggcaaaacuuuaaauuacuauuuucuuuacaaaauaaauguaaucuauuauauauagaccuggaaaaaacucaaaaguucaaauucuuaaugugaaagcaaguagguaaagauucaaaagugaaaaaaucuuuuacacuuuauguaaaugauacuuaaguaugacaaagaggugauaauucaaguucguaacuaguaagucacuaaaaagauaaaugcauucauucauguaccacaaaaucagagaagacacgaggacaugccgcagucagugaaaaagccgagaaaucaacauuuuacuaguuauuuugucccaaacuauuaccauguguguuugguauguuaacaauuuaaauauccacauuaggcuaaacaacaagcaccugucagcaguggaaaccaaaacauuuugaugcuaaaaaauauacaagauauuuagacgcuauuucauugguugucaaaaacagugacuacugccaaauaauuaaauuuaaaauauugugccagguccucucagggaaaugugaaaauaauacugacgaucucauugucauugcuguuauuuuacuggaauuaaacaaaggccagaaguuauaaauuuaugacugccaauacuaucuuuggauaguuacaauacaguauguaaaauuaaggauggcuuuguuuagaagacugccauaaaucaacaaaacccaacugugucugggggacaugguagagaaaauggcaauuuugagagaggagugcuucuaaaggcauuuccuuggaggcucugagguuuuuuuuuuuuuucacauuaccgaaaggccaaguaauguggugugauuacuauaauuccuacaacaaaacuuccacuuagaauaguuacauguucccaaacuauuuuucuucugucugccaugcuggcuucuguaucccaugguccacuguaaucuuuuggucuucuuuuuuugcaguacagcaguccucgugcugcuauccauugaguagguaaaccaccaauucauagguggccaucauaauggcuguguuuggaaucugucucacuagaugaguugucagaccacgauaaagagacccauaaccuucuucuugaacaagcaaagauagagucugaaaaaaagaucuguauuuuguucccucuucacguagucuuguucuuacaacuucuguguaggaaagaaauaaaauuaaacauuacugauaucuuuacacucuucuaauuauaacugagcacaucccauuuaucagucuguaaguguaagcucaggauaaaaaaggauggcuucuaauguguagcuuauugaaaccagucacauuauaguaacaucaaacuucuaauauggccaaaaucauguacauuaauuauagacuuuauagucuuugaauguaaaaagacacaauauaacaagagagaaguaucaguuguaugcuagauaaacagauaaaaggaagaauagaaaugagaaggaggaaaaggugaagaggcaguaaagagguggcauccaggaugaauauaaaaaggauacagugagaaacaagcagaaaagauuuguuuaaagugaguacuacaaagaaacaauagcauuauuaaucuauucaaaacaguccacauauaugaaugugaaacaucauguggacaaagaaguugacaauguuccaaacacuagcugccagcuauaaaacccagucugggaaucagguaagcaaaaauaauaaauuuuuaagagcugaaugaaccuuaaagauuagucaguccaauuuuuccucauuuuaaaaggugagaaauuggagcuacugagaaauuuuggccaguuguggguagaagcugggacaagaacucacagcuuccuauguaacuacuuuuuuuuacauccacuauuccucaaauuuuuucagcacaguauuccagaugggccuagggaaauagucuaaagcaacccacagcaauuguaacuauuuacuugaaaucuguucugucuuaaagauucgugccauuuaacuccaaaauguccuguuuggacaggugugguggcucaugccugagccugacuagcauucugggaggccgaggugggagaaucgcuugagcccagaguuugagaccagccuggggaacccagcaagacuaugucucuacuaaaaauuaaaaaauuagcugggcauaguggccugagcucauagucccagcuacuugggaggcuggggcaggaggauuaauugagccuuggaguucaagguugcagggagcuaugaucaugugacugcacucaagccugggugacacagugagauccuaucaaaaaaaaaaaaaaaaaaaaaaaaaaaaaagaauguaucuuguuuaucaacuguaccucuuccuguaaugacaucaucucacuucaagggaaaagacuguuuaaaccccaaaacucuguuccuuacaccuuagcaggccaccauccuaaccuaccccauaggucaguaucuaaacaauauugcugauacuguccuauuuugacuucuuuuagaaaagucaggaacuuccuucaggaaacugagauaaguucauaguccaaccugguuaaagaguugguuucauaaauuacuauuagagcaaauacacauuuucuaggccuggcucauuuuuccugauauaauauacaauggagacgguaaauauuaaucaguguaagugaacaaaaaugaagcgcuuacauuaaaaaacaaaucuuaaacaugcaaaaaucaaaagcgacacuuaaaacaaccaaaaaagcuaccaaaaaaccucagcauguagcagauaaauucuuaagugauuuaccuagcuauuaaugaaauaggcuauuauaaaauuuaaauacagaaauaaaaggaauuauuaacacauacuuauuugccaacaugaaauaauguaaaauagcuuggucuuugggauuacagacuuuaauucaaauuugggcuucaccauuaaguagguaugugaccuugggcaaguuauuucauguuuacauuucuuuucaguauucaauuugaaaaggagaacaauucugguuauguucuagcauaacagggaaaauaaguacuuuagagaauuuuuauguagauuaguaauguauguaaacuaucuaguauagcaccuacauacauacuuuuuucaaaacuuagaaacuugcccaaaagucaccaagcugaagugaguaaggcuggaauuugacugacuucagagcucaugcucaaucaccaccaugcuauuugauagcauaauacugaccuauuaauacagccuacauuacuuaaccagauuuaaucucauuaugaacucccaauaauuguauuuuguuauaccagaaugcaguaaaauuauaaaugcuuuaauaagugagcuguuggcuggggugggaaaauauuucugauuuaauagauaacucuucuuaccauguggauaugcuauaguuguggcacaaguuuuugagguggcagcagcuagcaucauucccacaaaaucugaugcuucuuucacagacucuucaucauuuuccauuguagaagcagucuuauauuccaguaguuuuuguuuuauacuuucauaaauaacaaaauggauaacagucucugauauaccagcauaugaagcagacaugccccuauaaaauccuuuuaguccaucugucugauacacuuuacgaacacauucaaaagcacccauucgccuuuccccgcgguuccugaaaagcaaaaagaaacaucuuacugauagguuuuuuaaaguaaguaaaauauaauaaaauaugucauucuaauaauaaaagaauggccuucuuuaacucaugaagaauuagaauuuuaaaacaauauucauauuuuagauuuccuauucuuuugucccaaauuugucauauuaaaugggugauauguaaauaguuuauuuuacugaaugcaaaaugcacuacacugaaucuucggucucauguccucauugggguucacauggcagggauaagcaacaaaauccuuuaggaacuauacacccugacugcagcucaagacaaaaacaaaacaaaguaaacaaaaauccucacacuguauuaauuccaguucuaaguaagcugaauuuccuuugcauuuaguaacauaaauagaaugacugagacaccaaugaugauagaauaucauaaaccaggcaguaugauuaacuaaaauucugugcaccugagggauucucuuucaaccccacucauauucucccaagaagugauagggugaauguaagucaaauucccuaugaucauuuaaaggcaauggucauaucagucucccuggugacuaguaaaugagaaacuguaguguuauauuuauucaguacucuuccuaauacaauuuccuuaguucuacuuaagggggcagcaccuacucuuauagaauacaacaucuccuacacauguaauuuugaguuuuaacaauauuuguuaccuuacacugauucccccaacagguccuuaucuauaagagacagguuuaaaugcuaccuacuaaaaaaacagaaaauuuaccuauuuauaaauuauaccuaacuuguuucugacauaaaauaaaaucacaacuacaacacccacuuaauuaccuacagauuccaccaguuuuaugaauggauugucuuuagauauugaauaccuauuagauaaaugauccacaaaccaacuguaacuaguuucauuaaagauccuuccucacaagaaaguuaaaagagauacaaauccugaaaggugacauaucagcccuauuuuuauuuuuuuauuaauuuuuuucuuuuucuuuuuuuucuuuuuuaacagauggagucuccauggugcaaucauggcucacugcagccucaaacuccugggcucaagcaauccucccaccucagccucccagguagcuaggauuauaggcaugcauuuuuuauagagauuaagucuugcaauguugcccaggcuguucuuaaacuccuggccucaagcaauccuccugcccuggccucucaaagcucugggauuacaggcaugauccacugcgcucagcccucagccuuauaaaccagaauccucaagucaaccuuucauuauuaccccaccccuauccaauuccccaaccccacaagccuaagaauugugccagcuuguguuacaauuauaaguggaaaaaaauaauauuaaagaguuuuaagucaugcuuuuccuggauuccucauagagcaacgcuaaacauagugaaaccuaacucugguaguuuacaauagaauaauguggacuagcaucuuguacuuucuaaucuuuggaauaagucuuagcuaccacuacuuuucagauauguggcuuuaagaaauaaacuuggaguuuugcuacaacacuuaagauuucauuaaaagaucuauuucagaugaaacaauuagauauuucuuuucaaguuuccaaauaguauauaguucaacauaacagaagauggaaaacagauauuuaagcaggcauaauuguuaaugauuuauuagaucaguuuuaccuaaagccuauaggacauaacacuauuucccaaacaccaaaauauaaaaacaguagaaacauguuauacacagaaccuacuccagacugaaagucuaaaauaguuuaaaaccauuaacauuauuauuguaacauauaagauaggaccaucucguuacuuaagagucucuauucuaaagccaguaggagaguugagauggcaagacccuacgcagcacugcuuuuggccuacucucaguucccagaacaccaaaggcccuacacuuuagaaccucugagguuugcaccgauugguuccucagcuuaaaauggguucaaaaaaccuuuccuugauuauuccauuuaaaauaaguccccacuguuuccuggugcaucucuaagacguagcaguaucugcuaauauagauuuguugaaugaaugaaucuugcuauuauaaaguggucagugguaacagacgauauaugagaacugucugucagccuaggguucucuauucacaaggucacuaaauuugagcaaugauccucaaagauucagucuagacuagcugaccuuguggcuuacuuagcuucugcgaggccaauuauaaguacccauguaaggaaaguauuaccuuuugggcuggguuaaucuaucucuuucuuuccuuucuguuucucuaugguaucuuucuagccacucuuuuuaaaacaaaacaaaacaaaacaacacauauuaauaauauacuuuuuucaccuggaaaaguucauauugucaacucuuacauuaucuuuuuucugauggcagacccaaguuucaaaauuaaacuacaacaacaaacaaauucagcagcaaaggaaagaaaaacuuuguagaaaaaaaauuaguuaaauccacuuuaaccaauuuuauuuuaaggaauuaacauaccuugcaucaagcuguaaccgagucuuuauaagccaaaugggguugguugcugugauugcaguaaaaccuaaacaaacauguuuaaaaugaacucugguaaaaaugaagaauucacuauuaacuuuaagguuuuaaaaauuagauaaaucuacauucaagaaaauguauauaaauaaacuacuaauuuauguauauauuacacuuuucacauacgacaaacauuugucuucacuuccaaucuauaugaauucucaaauucuguccuuaacuaacagauucuuuuaaaagcaaaaugaauauaaauugcuuucccaaccuacuuagaauauccuuuagggugcucucuacugucuaagcugaauucagaaauccaucucuacaaacacauagacauuuuguguauucuacggcuaaaaagcaugcacuugggauccuuaaaaccagcuaaaaaaaacaguuaccugggguuugauuagcaucccaaaucacuacauucaaaaugaauucuacacaaaugucaaauuuuaccaauaguuugaucuuuaguugauuauauaguggaaaagacuguuguuuggccccaugaauacuuucuacauauauacauacuaauacuguuaaaauaaccguaucacaguaagguuuuuguuaggguuaauaggacaggccuaucgucauuuacuuaaacacauacaaaaacucaaaaguucaaaaagucacaaauuggaaguucccucuuuuauagacauggaauaaacucaggguagaagacagcucuaguuuacuuuaaaacuaaaguauuauguacuagguauuggugcagaaugguggucaccuaagauggcucauuccagguaguaaauuaagaucuaccuggaacaguauguuucuaggauagugcauauguuuuacuugccaccuuccuagcuauggaaaaauagcacacaaaauacagucuugaugacagaaacuuauaaagauugcuucaucuacacaaaacaggguuuuaauuuacacagacuucauagaacuacuuacguuaaguuacauuuacucaauaaaaaauuauaugcagaaauguuuaaggaucuuaacuguuuuaauauuucuaucaaauacuagugggucaggcacauucuuuuuauaaagguggcuaaugaucaguacauuuaagaugaguaaaguacuuacaggaacagaaaugcuacaauauacuuaagaauaauuuguuuuuaaauuaauauaguacagauccaaucauaaaccuuucuuggcuuucaaagguguaucuacauaugcaaaauaauuacacuaaauuguuuccaaagcugaauuuggucucacaggguucuuuucuaugucaguaacugaguaacucaaauuuuacuuccucaacccacuguuuuaacauuguagaaauagccagacguuauacaaauggaugcuccaauuaaaucuauuuagcaagcaagauaaaugggauacaaauucaauuuaaauaauuccuuuaauacuuuuauaaagauuauauauucuacauuucucuuaagugcuuuuaauacuacauauguaaguauaaaacuagaaugggaccaacaguuuuagacgcaucagcagguacuaaacugauaaaauuuaaaguguugagcaggcugccaggaacaucuuuuuaaauaaaagguucuuuucaugcauauauucuugguaaaagaaaagaaaagaaaaacaugaaacuaucagaccaguuuaaauauuuucuugcaugguucuagcuuaacugagaauaaaguuauagaguauuauuuuucucuucuuuugaaccucauuuuucuacaugaaaaggcuaggauauucaaauuauauuuuaaagcaaucagacaucaauauucuggucaaacuccaauuuaaugauucuuguuuuguaaacuuaaauauuuguaauagcuaaauaugucuguacagcaaaauuaaggguuuaugaguaaaaagcugcuaagcagcauaaaccaacaaaauauucugcaucacuauaaugauuuuuauuaaucauuuuauagaaaucuuaagaaaaacuauuugcuuuuuauugaauuuuaaaagcuuaaaacugggaaucuuuacaucaaacuuuuuaaaaaacagccaaucuagguaaaaauucucauucaucuuauuauacuuauuugaaaagaagaugagcaccuaaguuuuuuuuuuuuuaaauaaaaguucuacuucuaaaaacauaaauuuuaagcaguacccaagcuucuguccauaauacucuuccaagucacaaaagaauuugaggcuggaaaaaaacccauauauaaaaaacuuuacaauaguacaauaaauuuuuauaaauguuguuaggaacaaaaccuuuuaaagacccauaaauuauaauuuuaaauuauucucuguacauauuacuauaaugucagaaagcaaacaacagguauuucucacuuaacuaaaauucauuuccaagcacaaauuaaccuauguaacaggacacauuaaaauuuagguaagugagagaauguuaucuuaucccuacguaauugcuauuaucaguaagcuauguuuacuaugguugcucuggcucaacucucccaaugagagcuagcucuuuauaaagacacuaaccuaaaugccagcaaaccauuggguuagguaaagaaucuagacacaauccacaguuuuagcuauuagcccuuuaccgcuaaaaacucagguccuugaguuuuaugcuauuacuuucuccuaaccaaagacacuuuaacaaacuaaauagacauuacuaggcuaauuacaucuaauaaauauaaucuaauaaucuaagaaaugaagccaauggaaaaaaacaaaaauuuaucguaacuuagcauuauauaugguaaggcaauuugagguuagcccaagcuaaacauaucuucccacuacuuauaugacaaacacacacaaagauacugggaauggugccccugaaauuuagaaauugccuauuacuuuuuauuuugcauuuuaauuuugugacauuuucauaauuugccaauuuauauuaagauucugagcaccuagugaaacaugaaaaugaacuuaagacgacaugagggauccauuuguaaguuaagaagaacuaauauugcuccacagucaguuaaagcaaagugccaauauauuggccauacucuuaguaggaugguuaguauguuagaaagcuuaaaaaauuuuuaaaaaugcuacuuuaaaaguuuugcuuuaucuaaguaagauuccauuugauagugucgagcaauuaaaaaccagauuaacagaaaaauucugcuuaaacuugcugaaaauguugauuucauuaagugagugauaccuguaguguugcauuuucaguacuuuuuauuucaacuucuguaagaacaaagcccaccuaaccuccuaaauguauuaacaccacuuuuaaaaguaauuaaaacuaaaacagcuaagaucccauauauucuuauccugcauuuauuugcaaaguaauuaauuuuuguuuuuuuugcaaaagaguucuaagaaagccaaguaucaacagacaaaaaagaauggaaagcauuguauuaggcuuuuaaauauguuaugcuaagcaaagagaacuaugauuuuaucuaaaacuuuuaagauaguauaauaccauuuacagcuauauauauauuguuauuacauucuuuggaggucaaggcuguuauggccaagcugaagaccccaggcuuuuauuacaugaugacugaaaaauaccucauucuuccuucuagaaggaauauuauaaaggaaucagacuuagcaaugcacacacaaauucaggaaauaaaaguuaauuucccgccuucuaauuccacagcuaucauaaaaucccaggguggguuucuuauacuacaggcugcaagagaugcucagaucaguacucacgagguuuaaguuaguccauauuucuacaggaagugaccugcggauggggagcaugagaugacacgaucucacucuuuucucgggagaaauguacaguaaaugccuaaaauagacacaggcuuuucuguaucauaacaacaagcagugaccucaucagaaacauguguacaaauugaauccuauuggaaggauuugagaaauauuuacugugagaucuaacuuuuuugaaaauuuuaaguuaaaaaaaagaaaggaauaucaaaaugggccauuuaaaaaaauguaccgaguacugaaaauccugccaucugcagcaguuucagaaucuaaauacuuaccuaaaagaagaucaauucugccuuaaagaaaaaaugcuaaccuugucaaaagggaauauuuagaggggaucaucaucucccauuuuccuaccacuauuaucuauuauaauuaaggagaugaaaacacaauuucuauccuuuaacaaucagccuacuuaauaaaucuuaaaaaaaaaaaaaccaacagaauauucaaguaacuucauuuuggagcuauuuauauaaauuuuuaauaaaauaaagaauacguugcuacaauaguaccuuucaccuuuugcacuauggccaguaauauugcacauccauacuuaugaaauauuuugcauuauuuuguauuuaauuucuuguguucuacaaaacaaaaaacaggaagaauguuuacacacaaacacacaaaacaucuguccaaccauccaucuggcugaauuaacugccauggacaaauaaaauauuuuuaaaaaauauuucauaaaugcaagacaauaccuguauuuaaugaguaaaagccuuuauuauaaugaaauuuaagucuaauagaaaaacauaaauugaaaaauaacuguaugcugugagcaaauaaaacccacuacguauguaggaaacauucaaugauuacauuauuaguauuuuaaaaauugagaauaacuguaugaauacauaauccaauuaaaauuagaauucauuuccuuuacauuuauaauguucuauauaaaaguauauacaugccagauaaaaucuuuuaaaaauugagaauuaguauaaagaaagaaguaauuuaacaaauuuuuuuugcauacaucugugccuagguguauacaaaggaauauacaaguuaauuuaaacaaaauauacaggcaacaaaacagauacccucaauagcugagauauacuuagucugucaaaggucauguguaggagaaaaaaaaggcaggcaaaauauuaagagucaacauuauuuaaucugauuaaauauccucacaacugaaacaaauuuuuaaugcaugaaaauuuauagcucaacuuuagaggcuuacaaauucuuauaguaugcacuacaacaaauaaaaagacccacuuuaaauaaacuguccuuuuaauaaaauaaauuuuuauuaucuaaauuaaacaugaguucauauggauaaaaugcaaaaugaaaaugaauugagaggucacuuggaauaaaaauuacguacagugccuuauaaauccuuaaugugugugcuaucugguguguuaaaaucuugcaggcaguaucauuaaugguuuauuuuagugugguuuuguguaguaaagugacaagguuagcauuuuuucccuugaauagacagcugaaaaugauuuuucacagaacuaucuuuaaguacuucauacccccaaaucauucauauuuagaccuauaaaaauaauccuaaaaaaaaccccgaguaaucuggucuagauuauuucaagaacaaagggggcaaaagccuacuuuaaugagucugcauuggaccauucaguuuuacuaaccauauaguuauguauaaaacugcaaagcuaaguguuaaugcucaugaauagugcacagaagcucugagagcacaguucucagaacaauguaacugcaaacaaauucaaacaguauuuucuacacaguaaguguacagugcaauaaccucugaacaaguaugagauuguaaguuuaccaaaacuugaggaauucaaguugggaaauggcaucaauguacagauaaaaaugaacuauauguuaacauuuguacacauuugagaaaaaagugcaaacugacaauucuacugaaauucuuugcaaugugauacaaauacaguaauaaauucugaugagauacuccaaugaaauaagauguuccaguggaaauaaagauauucugaaccucugcauuugcuauacugauauaacaaauaucaauauaaaaugacugcucaucuaacuuucuagauuccaauucuuucaaauaagauuaacauuucuuuauaauuaucugagguuauaagccaaaaacauaaucacugguaauucagaaauauauuuuuaaagaaccugauaaagugguuauaagguuugucacuggccaccaaccuuuaccuuacauccaaauucguaggggaaaaauccuaucuacuaauauucaacaucuguaaaaauuacauuaaaaauaauucuaguuguaacaagauaaucucuauaacacuaaaugaaagaacuaauucucaaaauccaaaucuauguagaccacuugacucauuccauggguaagcuaagagagguucacauaaauuacauaauuugcccaagguuuccuuauugguaaaugauuguauuucacucuuuugaccuuuggauugucccuuccaguuuuaaagcuucagugaaucaacugacaauuaauaaauacaaaaagccuuaaaaacaauuuguaauacgauaagggcuauugaccuuucagaaauuuguauuucaaacuuacuuacuucaugaaguauauaggucaaauugauucacuuuauuucuaaaccaaaaguguuuaacaguuuaaggcacucauuauuaagcacauaauugacauucaauuuauugaucaauagcugaugaaagcagcuacaguuuauaaaguuacagcauaauuugaaaaugugagauaugaguaaauauacaauaaaucucagauauuagggagaauuuucaauggaaaaucaaaguucguggcuuugucuaacaugcauagcagcaaaugauuccagaaccagauuggucaaaccaacuguuuaucuuuauggcaggguaaagaccuaaaacuaguuauuuuaauucagaaucauauauacuuaucagugaugacagaaacagagaguuccuggaaacauuucuauaguaagcauguacacauagccagugucuaaauuucaggugcugucuagugugaauuauguagaauaauaaacaauuuuaaaaaauacacauaguaacugaauugucaauaauaauacaucacucacaaaaauuucagcauuugagcacaggacaaaaugaauacuuuaccaagaauugccgacacauuucagacagaagccaaaacaugcagcaaaaagggaaaaggcacuaacagaaauugaggagagaagaguaaauuacagcuccauaacuuauuuauaguguaauuaugguuggauucuuaaaacuguuaacaaugaucacuaaacauucaguggacuacacaaggcaauauaaauauauuacuuguacccuagcauguaaacuccugacuacaaaaaugucaacugaugacagauuuuacauauaccuaauuugguuuauaucgauaaacguaaaaaucaucuaaucaaugaaaagcacauuaaucaucaacuuuucacuacaaacuuauaauucaauauuaagccucuagguuucagaaaguuuuuuuuuuuuuuaauauuauacauucauaccugccauugcagcugaaaucauauguacuuggguagaaucaggaucaaauacaucauucaacuuuuccuugcaguuugaauaagcagcaaaguauauugcucuaaaauagagauuuagauuuaucaauaagcauguucuuaaugcguaagauuuacauauaaauugaucuucauaauuuuagaauggagaaauuuaaaaaccauaaaguccuagccacauucucauguaacauuagauuuacacuuuucauaaauacucugaaguacuuucuguauugacucauuaaaauaagacaacaucaaauguaaaauuccuaccauucauccucaaacagacccccuuccaauacucugacagccacuuaacucacuaaaacuugguaaccaagaagauaaaaagaaaaaaugaaauuaaaaaaaaauaaaaacaaaauaauaacuaauuuaaacaaaaaguauuuaagauuuuaauguuuagaaacuaaaugaaugaauaaggcuguaaggcugguguaaugcuaaggcuaaauauaguuacugaagauaaguagauaugguaugagcacuuaacauauaauuuucuucauggggagaagagggugaagcagauccaacugauuaaaguauaugcuaaacaauuuuaagauacugugguauauucuaauuauacuacacacacaguaauucacauuauccuuaaacagacaaaacaauuccaacaaaagaaaucagacccaucaggucagaauguuuuccaauguuuguaaacacugagugaaauuuaauuauuucccucauuguuaacuuacugacuacgauuuuaugcauccccacuaccaccucuauguuaacuucccaugcuuugaauuauuugcuugcuguaugaaauauccaguuauuuccccaaaaauccugauuacucauccaauaagaaacagagugacaaauacaaaugagaauuucacuguuguaccuuuuuuaauguacuuaagaaaaaaggaaaauuaauauaacugaaaaugaaacauucuaauuuaugagaaagaaaaacauaagauacacuugaugccaaguugggaagaggaauaaacaaugcauuucuagaaacugguaagaaaaaaagaaauccuaaugagaaaauggccaugaaauauauauaggcaauucacaggagagauauacaaaugacaaauuacaagaaaguaugacugcaccaaaaauuaaauaaaucauauuaaaacagugaaaaaucccucuuaguccauuugguaaguauuuaaaaaagauggacaguagccagcauugguaaggcuauggauaagggauaaaaauccaguaugccuuuuuuuuuuuuuuuuuuuuuuuuuuuuuugagacggagccucgcucuuuugcccaggccggagugcaguggcccuauauuggcucacugcaagcuccgccucccggguucacgccauucuccugccucagccuccugagcagcugggacuacaggcgaccgccaccacacccggcuaauuuuuuuauauuuuuaguagagaugggguuucacuguguuagccaggauggucucgaucuccugaccuugugauccacccgccuuggccucccaaagugcugggauuacaggugugagccacucugcccggucaauauucacuagucuuaaauaugcauaugcccuuuuauccagaaauucuaauuuuaggugaccauccuaaaaaaauauacuuccuaaaguauucaaagauaaagguugagguauguuuacugaaccauuguuuauacaaugaaaaucuaaaaauaaucuaaauguauaauaaggaaauguuuauuagugcuagaaugcuauacaauuuuaaaaaaaucaccccacauauuaucauggaaaaacuucaguuagauuagguuaaacauuuaguauuauucaguuuauguaaagcacaauaaaguauacauguuuuuauguauaugauaaccgagaaaaauuacuggaagaauauacaugaacugucuauuaaugguguuuuuuuucuuuuaacuuguuuuauaauuaggaugcaauuuuggauauuuucuuaaagagagaaaagaacccauaaaaaguugaaacguaauaaauaacaagacauggaucugguacaugguuuggauacagaaagcauuuucacucuaaauaugaacuuuauacaguguucuaucauggaagagguuaacaaucuaagaugcaauggugucagagaaaaaugacgaaguuauguuuucauguccuuuuggcuuaauagggacugcaaccauucuaucuguuugguuugucccauaagccaaacaaugacuuaguuuuaagaguuccagaucuuccccuuucuaacugcuaguuccuuugguuguuccuuuaguuauuaguuccuuugcuuguucucugucuuuugacuuuuuuaaaaacuacuucacaauggucuuacuaugugguccuuugcaccuacacauggugccaugcccauccuuuuagaugguuacugauaccuguuugucacaccauaguucuuuauccuuaucaccuugacaccucuucagcaucuuccuugaauagcuuccuuuuuauuaugguaaaggccauguacaucacuuacugcccuucaacgauacacaaauucucagguuuuuagacuuuuugucccuuucuucaacccuguucuaagcccugacauccuuccuaguccuuugguucuauuuucuaucuuguuucuuugaaguuuaauuucuauguggaaagugagaaaggaacacuaacuucagguggagcgcacagcaggacagcuaugaaaagcagaaaaagucgagauauccuaaaugccuuuuggcccaaggaaaauauuuuguuuaaaagaaugcuuaccuuucuuagagucaaaauuuuucaagaugcaagagcugguuuaguuaaacucacaaaucuagcaaacacuuaucucaaaauaucaggaguauuuugcagccuuagcccuguguagauuuucaauucugcacccccaaauucuucuaacuccuauggucagaugagaggauaagcaucuccccagaagacucaauacacugccacuagcuacgagaguauuuccauuuauccugcaaauauuaguaauuuuauaucuccuagucuaugcaauauaaagauauauaauauauucauuauuuucaacuuugauuacaacaucucccccaaaaaaaucucagguccauuuauagaauuuuaacauuuaaaacucuuaucuauaaauacacuguuccuuaaacuucuagguauaauaugcgauacuuuauuauuuucccccaguauaagacuaucaauaauuuaaugcaaauacuauaccuucucccucacauuaugaaacauagccuuuguauucauauuacuacuguuaauuucuaacagcaaugaaauacuguuaagucuucaaaauauccaguaucauuuccuaccaccaaacauuacuuuauuauauaaauuuguucuggcuagaaucugaaauucuuaaaaagaaaauuaaguauuuuaacuucccauaaacauugaauacuacauuuauaaauuuaacuguaucuauaaaugauuaaauccaggugugcugaaacaaaagagauugccauaacuugcuuuaaacaauuuuuuuuuuuuuuuaccuggaaggggcuacccccacuaaauuggggccuaguccucuaaacaaggaacgaggcccuucuuuuuccaagaucacccugaaagagagaaaaaaaauucuaucagaaauaucuuucaaagucugguacuuuauuuacuuuguauauaaaguuagagucuaaauccaguacauuuguauuauguugugcuucucuggugaguuuuccuuacuuauuaaaaauuuguggccaggcaugguggcucaugccuguaauuucagcacuuuggacacugaggcaggcagauuccuugaggucagaaguucaagaccagccuggccaaccugguaaaaccucguugcuaauaaaaauaaagaaauuagcugggcaugguggugcaugccuguaaucacagcuacucaggaggcugagguaggagaaucgcuugaauuuggaaggcggagauugcagugagccaagauugcgccacugcacuccagccuggagacagagcgaaacucugucuccaaaaaaaaaaaaaagaaaaagaaaacacacacacacacacacacacacacacacacacacacacacacacacaaaacauuguuuuuucaugacauagcauaaauuguugaagacugauaauagauuuacuaguaaugauuaaaaaaucuguucagauucuuuccugaaagauuaagacacaaugauaaagaguucuacauuauuuucauaugaucaugcuacucuuaucuucgauuuccuuaauuuuacuaucuuuaccagcaaauugaaagcuuaauaacuacccgccaauuagaaauguaguuccuuccuaguuuucaggucuuuuacucaacauuggacaauacuucuuacuacuacaguauuaucucauccccauuccauugaaaugcuguagcagaaucuaucacccuaauguccuuuaagguaccagaaugguuggccuguuauuucuccugccacucaguuaaccguugcuauacugaguauuuaacuguauaauuagcuguuuauaacuagaaaaaguaaguagauagaaaaaagaaggcgaggccccugacauugggaaauuugcuguuuuguuuugguaaaaagaauuguaacaaaacaaauaaauuaacagaccauauuaacaagcaaauacuauacaaccuagauacauauaugcccagcagagaaaggaacagagccauguguaagucacagaagacuuuccuggaguaaguuaugaaaugaaguuuuggcagugagaaggaauagaaacugaagaguagguauuuuaauucagaguuaacagacuaggccaaguaguucucaaacaucuaucugcuuaagagggaucuuuuuaaagguaguugggucuaaugguuaauuuaaggccugaacugaguagccagacuucucagauaugaagcccaacguugguaauggauaacccuacgacccugaaauaacuuuacucucauacucaguuucaucagcaguaaauaaaaaaaaccaguaccccuuuacugguuacugugaggacuaaguaaauuaauauauaaagagcuuaaaagagcgccugaaaaacuucggaacuaaaacacagcccagaaggauuacuaaagcuccugugaagggaaggcaaaacuacugaaaaagagaauuaaaaaguauuaucacagaggucaaaagaagaauuuuaaggaggggcaaucugugguaauaaauaucaaaaucaugauauuaaaauacuuuuccuauuacaaaucagauagaaguauuuauguauaacuauagcauuuuuuuucugagacagagucucacuguaucacccagacuggaauacaguggcgcaaucucggcucacugcaaccucugccucccagguucaagugauucuccugccucagccuccugaguagcugggauuacaggugcgcaccaccacaccuggcuaauuuuguauuuuuaguacagacgggguuucaccauguuggccaggcuggucucgaacuccugaccucagaugauccacccaccucagccucccaaagugcugggauuaugggcgugagccaccacuuauggcauuuuaauucaaaacuguuaucaauuuuauucuaccuauucauguacuuauguaaacaaguuugaaaaaagaaaaggcugaugaaaccuuuuaguaacaaagguaaauacacagaaugaguuuauuugcuauuacaaaauaaacacuacugaacuaaguucaaacacugagcugauaaggcagacacgaaggcauuccauuauuuacaaguauaaacauacgaaaccuaauuuuaauaguuuugaaauuucaaauccaauugcaacauaaugaaguauggcaaacuguaaaaacaaaucuuuuccaaaccaucaggaaauguuaaacaaauacugaacagcauuagaacucugcugucucaguuguacuuagguuacauaaaaaucacagauuaucauuaauuggauguacuuacuuggaacauuaaaaauauacacgaaaggaguuagcauuaaacauuaucacauuucaaaaguaaaugaauaauccaaaauaaaauacuuauaauagcuuuagaaaaaacuccacuggauaaauguagaaauauucuaaauacacaugauuuggaaguaaaauuacacuuuaucuuaucugucuaacuguucuucuccauuagggauuaucauuccuuaugaguacaauucagaguaacuucuguaaauagguuuauaaaaaaucauuuucaauguggcagaauauaaguaaacaaacaucuggaacucacuaacgcaaacaaacuaaaaaacacuccugaauacuaugcucucacuuuaggcaaugaagagguccgggagacacuacucgguugacacuggcuccagccaugguguucagcugaacuucagaaauauaaagcgucacagaagaugacugcagucguguuuuuacaacuuccaguggacaugucagaauagcucccacuguaccaccacaucuaaaaaaaaaaaaaaaaaagaacacagcuuaucuacuuaauucauaaguuaguauauaugcccagagcuguaauccacauggguaccuggagcuuugccaacauacuaaaauuuauaauuuuuaauguuagaugacuaaacugauuuuuaagagauuccauuauuugauuucauacaaacuucuucaguaacuaaaaugaacacagcuuaguaacuaucuggcaagaauaacugcuaaacacuucaacugauaggugcuguuacuaaaauuguacugguaagucacauaauggcuuuaaauacuguccuaagguuugauuuaguacucauguauauauauaacuuguggcucuguuaaaaucuaggccauucuuugaaguauauccuaucuuucaaacuccuguccuuucaaacugaagaaauggucuucugaacaauaaggaagaacucacugauaguuaaccauacauaguucucuuauuuuaaauccccaaauauucagaaguauuucaccuacaaaaaaauacagcauuugagggcugggcgcauggcucacacauguaaucccagagcuuugggaggagacaagaggaugguuugaggccaguuugacaucagccugggcaacauagccagacaccacuuuacaaaaaauuuguuuaaaaaauuagccaggugugguggggcaugcauguaguccuggcuacucgggaggcugaggugggaaaacugugugagcauaggaguucagggcuacagugaauaugaucaggccacugcacucuagccugggcaacagagugagacccugucucaaaaaagaaaaaaaauuggcauuugagucucacaauuaauaccugucaggccuacacguggaaaacuguacaauguagguaggcuuguuagaagaauccaacuuaaauaaaaggacugaucaccagaacaauaauaacaaaagcucuuaaugacauugaacuguuuaaaagguauguaagauauaggcugaguaauuauuauuuucuuauuuuaaaauacaagaguagaaaauaauuuccucuuaaaacauuaauaacuaccaagugaagccuuuagaacugcuuucuaaccaaaagggaaaaucacucagaaaagcucuuagugcggugaaagagaaaagcuaguugagucagguuaacguggaccuucaaaaugggcauuaaaagaagaaaaagaaaagcaacccaugcaauaauacacuaaacaauucuaccuccacaauaaaaaaaacacacacacauauauauaaaggaaagcaggcauggcaauguuaauaucacuccgaauagaauguaaaagaaauuuuaaaagauaaaaauaugucauauugguguauuaguauaugccacaaagaaaauaagauaaaaccaaacuguaugcaacuagagugaaaaacuuaugcaacaaaacuauuaaaaaauaaagaacauuauauguaaaauaaaaaacaugccccuuaccucacaguacauuuuaaaauuaacucgaaauggaucacagaccuaaguuuaaaaugaugaaacuauaaaacaucuaggaaaaaaacaucuggaaaaaaaucuuuuaacuuugcguuaggcacagacuucuuauauggacaucaaaagaagcacaaaucauuaaagaaaaaaacugaaaaacuggaccuuaucaaaacuaaaaacuucuacucugaaagaaacugcuaacacaaugaaagaaacugagaagaaaaugaaagccauagacugagaacaaauauuuacaaaucauuaccugcaaaagugcuuacagucaggaauaaaaucaaguaauucaguaagagauuuaacagauagugauacauagacgcaaauaaacacacagaauucugcaaaucauuugucaucagggaaaugcaaaguagauccauuauaagauacuacugcccaucuauuaaauggcuagaauuaaaaagacugaccaacaaacagccaaccgcugaacuggaaaucucuuacacugcuggugggaauuaaaaaugguacaggcauuuuagaaagcaguuugucaguuucuuacagaguuaaacauaacacugccacacagcccuaucucacuuguagguacugacccaagagaaaugaacagacauguccacagaaagacuuguucaugaauguuuauaauagcuauacuuauucauagcuaaaaacugggaacaacccaaauguccaucaacuaguggaagcaaacugugguacaacuauauaauagaauacuauucugcaguaaaaagccaccaccuggguaaaucucaaaagcauuaugcuaauugaaaaagcuaagcacaaaaggcuuuuauuuuugacguuaaaaaaauuaucccccucguuaagcaaacacuuuuaugauauucuagaaaaggcaaaaugagaggaacagaaaugagaucagugguuuccaagggguagaggagagggaagaaagugacuucaaggggugugggggaauucuuggaauaacaaaaacuguucaauaucccuuuucuuuuuuucuuuugagauagugucuugcucugucaccaaggcuggagugcaguggcacgaucauagcucacuguagccuugaacuccuggguucaaacaguccuccugcuucagccucccuagcagcugggacuacaggcacaugccaccaugcacagcuaaauuuuuuaaauuuuuuaaaauuuuuuuguugagacagggucuugcuauguugcacaaacuggucuugaacuccuagccucaaggaauccucccacuucaggcuuccaaaguacggggauuauaagcaugaaccacuaggcccagccaauauccugacuaugguaguguuuaaaugacuuuauacaucugccaaaagucaauaaacagcauacauuuaacaaaggguagauuuuacuguauguaaacgauaccuugacaaaucugauuugaaaaauaugugaaaaccaguaagaauucuuaauauaugaacuacuuggggcugaauauauuaugugaaacauucaaucauaaauaagcuuaacacuucaaaaaaauuccacucauagcuuuaaauaggcaguugaaaaaauuuaaccccccccccaaaaaaugucgaaaccacaauuauacggucagauuucaacaaaauuagacaaaaaguaguaggauuauagcaaaucugaaacaaaauuaaguagaacuuagaaaccucaauacucaauaaacaaggaaaagauauuuucaaacagccaugaaauagucuuaaaaccucauuauauaugaggccacaagaggaaucuuaaauagaagccauaaauuuacuuagauaagaguugagagcuaagugguaaaagacaugagucaucaucacacaguauacuuggaguauaugcaauguaggacucagaagaaccuguggguuaguccauaccauauucacacuauaacagugaucuauuuauggcaaaccauaauucaauuugucuuugccugauuucuuuuuagcaguuuaguguauuuacuuuguaaauuuauugaacauaaaacccacaaacaggcccaaaaucuauaauaaacauguacauguuuugauuuuauauucuguaaaaccuaagaaagaguauucuugaauaugaauaacuucuaaaaaauguauucaaugaacaugaauuacuucuauaauuaaaacgaaaacaaacaaaaagcaacaugagcacauaaagccaugauuccuacccagucauuccugguuccaagaaaauaaauauuauacaacgaaaacaaaacaacaaugguaaaaacaauaccuaugccucacacgcuuguuguaaagaugauauaauauaauccacauaaagcauuuuguaaaguggcacauaaaaagugcucaauaaauauuagcuauguaguuaugugucuccauuacugauaaugguaacuaugaaauuuuguaauagaagucuuaugaauauuuuguggccagaccaacagacaagguaaauacuaugauauuuaaaaaacacuucagcaaguaaaacacaugagaaucuaaacuggccaggcaugguggcugaugccuguaaucccuuucagaggcugaggugguaacaucacuugaguccaggaguuugaaaccagccuaagcaacacagugacucugucucugaaaaaaagaaagaaagaggccgggcguuguggcucacuucuguaauccuagcacuuugggaggcuaaggcagguggaucaccugagaucaggaauucgagcccagccuggcaaacaugauaaaaccccgucucuacugauaauacaaaaaauuagcugggccugguggugcaugccuguaaucccagcuacuccggaggcugaggcaguagaaucgcuucaacccaggaggcagagguugcagugagccgagauugugccacugcacuccagccugggcaacaagagugaaacuccaucgcaaaaaaaaaaaaaagagagaaagaaaggaaaaaacagccaggugcaguggcacaugccuguaaucccagcuacuugggaggucaagguaagaggaucacuuaaaccugggaggucaaggcuuuagugagcugugauugcacuaucacacuccagccuaggccaaagagugagacccugucucaaaacaaugacaacaacaacaacaacaaaacaaaauuaaaaaacaacaaaaaaauaaggccaggcgugguggcucacaccuguaaaccuaggacuuugggagaccgaggaagccggaucauuugaguucgggaguucaagaccagccuggccaacauggugaaacaccaccucuacugaaaauacacacacacacacaaaauuagccaggcgugguggugcacgccuguaaucuuagcuacucgggagucugaggugggaggacuguuugaaccugggaggcggagguugcagugagccgagauugugccagugcacacuccagccugggugacagagcgagacuccaucucaaaaaauaaauaaauaaguaaaucguacagagguggggguggcauaaguggguauaugcacaagcacuuagguuguccugaagcaguuuuacauuauagaaugcaacagauguguaguauaggggugacacucugguauuucucuugcugcaauuuaaaaauaauuauuaugcacacugaaaucagaauugauguagagaacaaaacuauugcuucaauaaaguugggaugaacuacauuagauuuaucuuuucuccaugucaaaaaucucacugucuaaaggaauaugccagaagaacagagaggcccagagaaaucggcagcugcaaguuuucaaccaaugaggcaaaugggaaagacaacuuaguaaagaggaagaaaggcuugcagagggaaauaccaaaaagcagcaguuuuucccugcagaaucccuaggaggccuaaugauuagggcaccaaguauucaagagggaauuaaggcaaagaacugaaaacaggacuggcugcugucacagucuguaugacaaagguaggaugcccaguguugcucuaugccuuacacacacacacacacacacacagacacacagacacacacagagacacacacacacacgcuggauaaaacuacauuccuaggcagaagguuaauucucugaagaauacaaacucaacauuucugaacuuagguuuagcaggaacaaaggaugcaaaaacaauccacaccaagaugcgcuacugcaaucuuucaaggacuucaacuuccagaaagaaaaaaggucacauaauagaggaaaagugaccagauuagcaucauacuucucgacaacugcagauuacuuauccuaaaauucuauaccaaaccaaacuauacaucugggacaaagaaguauucaagaaauugccuacuguauacccuuuucuuacauagcuaacuaaaaaauguauuccacaaauuaagaaaguaaacuaaaagaagauggugguagggagggaaccaaaugcaggaacagaauaacccaagacagaagucccaagaugauagugaaauggcagaccugaaaaaaaaccaaucaagauaggauuaggaugacagaauucagugggacaaaagucuccaggaaaaaagacugacagaugaacacagcugaccauaugaaaacaaauguucaaguaugaguacucacauaacuaagcaaaaguuuuuuaauggaggcaauuauuaacuucaggggcaguggggggugggggcggggaggaaugaaguuauucaagaaaggaaaggucaacauaauagacaacuuaaacuuagcucugcagugaacaauauuuguauugucacaauaagguaagcacugacuuuugauuuuuaacaaaaacuguuaucaaauuauauauugagaggauguaaagaaaaaggaaacaagagagugguacaauauaacuaaauccucaucuaccagaacagaaagaugauguauaauauauuaauuugaaaaccaagaaaaagcaagagaaaaaaaugguggaguagaagcaggcacucauuacuggucuuacuucccucugauccagugauguggaugacaucaguugcaagguguggcuaauguaauuugcuauuaaauaacauaguucaagguuggaugcuuuacuauuuuuaaaaaguuacaauucaaaguuauuucuauaaaacagucacugguuuguucugugugcuuucuugauuggcaaagaauuccaaagacagaauagccaagucuguaacagaaggguguaaguucauuacuuuguaacaucaaaaauucagaaaggagaguuucuugguuacgaaucuaacaacacuguuaaaugucacuauaccccugguauacccagauuagaaauaacuacauguucuuuauguucguagugaaaccaccuagauugacacucauuuaaaguuuuauaggcaaauguccuauaucuuaaaagauacgagaaggccaagaucgcuuggugagucaaauaaucacauagcuauguauugaucuuauagaauauuuaaaauuguuuaauaugguaucacuaaagcauuuuauaagacauuuaaaacuauuuuaaugauguuugccaaauuguacaguaaguuuaucaagucaucucgguaauuuacuggaauguggacacaucucuagccuaugguaauacugcagaugcuaauaaagccaaacuuuuuagaguuuaacugucuaagaacuuucaaauguugcuucuacuuagugcauauaaugaagauaaaaauucuagcaugccagggggucuagcuaccuuaagggccuuuauggaccucuugaguaaagaaguggcaaaaagauaguguuuuuuuguuuuugaagcuaggcacaguguaaccaaaacugguuuaaaaaacaaaacaaauaaaacaacccugugcaaacaaguuuuguaagaaagagcaaggccucuguugggagccucaaagugcucucccacacuaguuauugaagcacgggaaucaaaaguugaggguggggagaugggagagaaaggagaaagagaaauuguucacuaagugaauaugaauagcagaugaauuucagccaucauacccagucaugaaucccuaagacagguacauagacauaaaaccccauugacuggauaguccuaagcugcugaaccacuagaucuggcucccccagcuuuaaaaggacuggaaaaaauccaaggcacuguuagauauauguccucaauauuaaccucuugagcguguauggaucaggaaacuuguuuuuaacaggcaagguaacagauagaugaacaaaauauuuucugaugaggucaacaauauuuguaugugcauauuauuuaaaaagguacuucagaauucauuuuauuaacuuuaagcaguguuuagcuuuauaaagcaagaugaaaaggauaaaauauuuuauuuuucugccuacagugauacucuacuuagggcauuaguuacauuaagaaauaucaaucacuggccgggcacgguggcucacgcuuguaaucccagcacuuugggaggccgaggugggcagaucaugaggucaggagauggagaccaaccuggcuaacgcagugaaaucccaucucuacuaaaaauuguaaaaaagaaaaaaaaaagaaauaucaaucacuaaagaugaaguuucuuuaaaaugcuagccaaacuuaaagaguuuuucaaucuuaaaacauguagacugggcugggcgugguagcucaggccuguaauuccagcacuuugggaggccaagguggguggaucgccugaggucaggagcucaagaccagccugaccaacauggugaaauccugucucuacuaaaaguacaaaaaauuaccugggugugguggcaggcaccuguaaucccagcuacuugggaggcugaggcaagagaauugcuugaaccuaggagguggagguugcagugagccgagaucgugccacugcacuccagccugggcaacaagagugaaacuccaucucaaaaaauaauaauaauuaaaaaaaccacguagacucucccugaaauucuauacaaaucauuaaggaagucuuaccaaaaauuguuucucugguaguacacuuguauaacuauuuucucugaagcuuuaguguuuagacaagaagcaauacaaguuuuugaaauggugauggacaucuauauaccugauagaccaacuuaggaaaagucagcaaugcgugcuugagaauaacacagcauuuuuuuaaguauaggaaguguuucugaugcaggaaaaaauuaacacguuauucuuauuguggaugauaaagcaaaaucaagacuaguaauacagaaaauuuuagccaacuuagauaaacauggaagcaagccguaucauacagcccaagaugcaguuguagagucuuuacuauuuagaguguuuuuugguuuucguaaagcuaggcacaguguaaccaagacugguuuaaacaaacaaaaacuaaaaucucugugcaaauaggucuuguaagaaagaaaaaggccuuuguugggagcuucaaagugcuuacuauuuuaaggaaaaauaguaagauacgagacugagaaauaaaaaaaauccauuauaggaacaaaauaggcugagggaauguggcagguuuaguaaaaguaaauuucccccuuucguugcuacccuuuacagcaaaccuuaaaacugucuauuuguugucucuaauuucucuccuacuccaaccagacuuuuacuccccugcccuggaaauuacuaaaagucaccaaaguuccucaauuaaauucagugguuaacagcuuucagacaucuuaaaugacaguaacauuugauaguugaucacuuacuccuuucuagaucuuguauauuugcuccauuuggauuucaggauaccguauuuuuuuggucacuaugaaguguacuuggcugguuccuccucuucuccucauuccucuucucuugaucucuuuuauugaaguccccagaggguagguagcucguggucccuucuucucuauauucacucccuuagugaucucaacuaggcucauggcaccacuuauguuccaaugacuacuaaauauauaucccuaguccaauccucuuuccuggacuccaggcuaguaauccaaucacuuaaacaaucagcuucuugaccucucuacuucucaaacuuaccaugucuaaaauggagcuucugaucuccccucaccccaacucuguuccaucugcaaucuugcccaucucaguugacagcaauuccacccuuccaggugcccaaacuaaaaacccuggaguuauucuucgcucuucuucuacacucugcauucaauaugucaaaaaucuuauuaucuuuaccuucgaagucuaacuagaauucaaccacuucucacaauguccauugcuuccaaccuagucugaaucaccauuaucagucaaguggauuauugaaauagccugaucaacucccuacuucugccccugucccacgcauagucuagcagagaccaauuagccuuuaaaaauucuaugacuccucccauuucaauagaaaaggucaaaguccuuuaaaggcuuaagaaggcucuaucauucuggccauaccugcuucauuaucucacucuuaccagggcuagggucuuacuggggcuaguuccuuuuguauagcuaauucucucccuuccaagucuuuacucaaaugucaucucaguaagauucaucaucauucgauuuaguacuagagugcacuccuaccacaguccuuuaaggugcaccauuuuuuuucccacagcacuuaaugccuucuaguuaaugauaacaauuacuagacaagacagucccuugucuugcuguccgguugucgauauucuucaauacuauauuacaaccagacaagugguagguucuuaaagguuagcugaaauguagaaucugaacuauaccaguaaacuuuucauacuguuauauuaaaauccacuggucuauuuuaaaaucugaaugacuuuuuuacccauggcugacuccaugaaaaaaagaagcuaguguagccugcaauugaaacaacgcagaaccacacuucggcauacaguuacuucaugucuauuucccauuuugucacacaaaauauuaaauauagagguauucaaagguugugauuuaauaaaauuaguauuuuuacuccuucaugagcauucuuagguuaaacuggcuuuuuuuuuuuuuuuuaauugcaaguaccuggaggugaauacgaugacuacagucuggugccacugccuucaugcaugcuaaggcaucagcaguuuuacccaucauugcuuuugcaccaucaggacaaaugucaacaaauuugugccaauaauguauuuuuaugaaaauaguuuuaaacucucagaccacaacaagggucucaagaaggagaaucccugacccacaauguugugcuacacuaauccauuugcagaaaaaugguagcugcugugcuacaguaauucauuuauagaaaaaugauuugagaauauucuccaacaggauaagaaacuucccuuaguuuugcagucuauuaguaagaagaacggaaugcauuuuuagaaggaaaaaaagggaaggaggaugucugaauguuugucucccccaaaacuaguaagaugaaauccuacucacaucccaaggugauaguauuaggagguagacgcuuucaaggugauuaggucaugagauuguagcccugacauuugggauuaguaccuuuauaagacaccagagaucuuggcuagccucuccuacuacgugaggauacagcaagagaguaucuucuaugaggaaguagaccaucaucaaaaaaccuguuacugcuuuaauuuugaacuucccagccuucaggacuguuagaaauauuuguuauuuauaagccaccaguuuuugguauuuuguaauagcagcuuaaacagagcaagacagaggaaaaggagagguaguaaaaauuaaggaaaugagacuaauaaaaauauggucagagugaagcggaaauaaaucacauuaauuauacuuuuaaguauucuacuucugcccugaucuucaagcaaacaggugaaauaauuuaacaaauaucguucauuauacccaaaugggaauuuccuacugaauaaauaauaaugauugagcaaaugaaugagcuccaggauauaaaaauagacaguucuuagaucaucuuugauuuuacucacuacauauauuaaauuaucugucauaagagcugcaaagaaaauacuucauccacuuaaaaucuuaagguauauagcuccuauuugagacaauaucucccucaaauagaaaaaaaaugagcugccucuguagauauaugcagcugauacaauaacuagacaauguacaauucuaucagucuuuaaaaauacauuuaauagugcuuucaucucuauauacauacauuagagguacagcuaaaauuaaaucacauuuacaccuuuuuuacaggcugucaugauaucguuccuuaacucaauuaaccuaacuacugaccuuacaaacucugaauauuaacucuggcaaaagcauaaugggaucaaagggugucuuaaagaaagcacgaguuaugcaugugaguauuucacccagaaccaagguccagugcugguguuuaacaauacagcuacuaggcuauuagaaaugugggauuccgauaaacauauuugaauauuacaauucuacuuaucagaaaaacaacuuaaaggcuccauauucggaaaacccuugccuaagauuaaauacucugugaaagguuacucuugguucuuuuaaaauauacugggcuuccuuuaaaaagauaagguguguuuuacugaacucacuuauguaaccacauauaaaaauaaaaucaagaugagaugcaaaggaagagaaauuauacggcugagcaccuaucuuguaucaaauccuacauaccauaucucauuuaauacucuaacuacauaugcuagacugggggggaggggauggagcuccuaaucuguguguuuagaugcuacaaacaccucccauuccuguucuuaaaccagaaaaccuauauuuacauguuuuuauaacaaaaugaugauccuaauccaaagugggaaauuagugcaaucaagcuaacauuuauuucaaauauaaguaugccccauuuuuaacuaaacuugauacaugaauccugaacgcagaauaauagaaauguuaggagcuagagaagggcuuuagagaucauauaauacaaccuccuaauuuuauagaugaagcaauugaaauaaaaguguccauuuuucacccaaauuaaaauagugcuagacuacaucugcggucuccucacuucaggguuauagaucuaauuacaagagggagcucaauuauuugcaugagaucuuuucaagagcaucuacauagcuacagaauuuuuuuaaaaagauuuaauuugccugauuauuggcaguaaacauuucagaaauauggaaagcaaacugccuaaacugggucucacagaucaauagaaaaauauuguuuuuaugccagaacaguggccggcccauaauugguguacaacaaauauuuguugaugaaagugugccaaccuaaagaaaguauugccaucacuggcucaauagaguccauauguccaacucaaagcaaggcaccgugaauagaacugcguguguauuucuuucauauucuuaaaagucgaucuaaaaacugcaggauuuaagaagaugccgguaagagucucagcauaauucaccgaaggcauuuuugauaagaaaacucuuuauaauccuccaaauaaguaacucuuaaaauugcuaugauucuccaaaugauuuagaaggagcaaaucuaaacaggaggcuaaacuggaagcucuaacacucauuuuggcaaucagggaacuaagacuuuaggcuuaguccuaaucuugcacacacauaguaacuauuaacacuaucuucaaaaaaucugaccucucuccacuccuacuuucuccuaagcagcagaaaagcaagcgguguucaagaggggugguuuucucgaaaggaaucugaccccaaagguacuggaaagcuuugcaccccauucaccaccuggaaaaccucgggcaagaaauuuuccaagggcuagaaacacccuacagcaaccacgggagaauaccaaagccuuccccgcucgaucccguagcccccuuaccacccaccuugcaaagccgagcccggaaaugagcggcccgagguccgagguggggcgugagugacgugcagaggcccaagcgagcgcugcaaggagcgagggcuaaaggagucuccggcgcccauuuuguccucagccuccgcacuuuccgccccguccccuugggccaugcaaccuacgcgaaauccgaagccaggcuccucaaagcggcccuggauccccgacgccugcuagauugcggcgugcggccagguccagcggcguccggguaaucaagcgccgaccccagcucuugcccgcgucuccucagacgcauggauucggccuccgccucaccccggccccgcgggcccaaaaccucacucccggcccggguuucaugccucaacccucuuugcccgggccucacucucucgcccucgggcccgggccucacccccuugcuuccccgaaccggagccccccucaccacccacgggcugggucgcuccccucacccgcaggcccguggcagcuccccgcccaggccucacucccgcccccccacccccccaccccccucggccccccucgccccccucgccugcgucuucggccccagcacccucagccccagugcgcacgccccgccaggaccuuacccuccggcaaacagaugcaccagcgugucccucuggcucauucucucucccgcauguccuccggccgcugaggcgggacgcggaucuggccgcccgcuacggcaggcggcuucggucccggacuggagacgcacagcgccccggggacggcgaggagagcuggccgagaugcggcugcagaaagcaaccggcacagcccuccccgcggcacuccagccgcgccaccgccugccuaagcgcgccgcccuucaccagaggcugaaagcgacgcagcgc

SEQ ID NO: 192089 - RNA, 38124 nt, Homo sapiens
gcgcugcgucgcuuucagccucuggugaagggcggcgcgcuuaggcaggcgguggcgcggcuggagugccgcggggagggcugugccgguugcuuucugcagccgcaucucggccagcucuccucgccguccccggggcgcugugcgucuccaguccgggaccgaagccgccugccguagcgggcggccagauccgcgucccgccucagcggccggaggacaugcgggagagagaaugagccagagggacacgcuggugcaucuguuugccggaggguaagguccuggcggggcgugcgcacuggggcugagggugcuggggccgaagacgcaggcgaggggggcgaggggggccgaggggggugggggggugggggggcgggagugaggccugggcggggagcugccacgggccugcgggugaggggagcgacccagcccguggguggugaggggggcuccgguucggggaagcaagggggugaggcccgggcccgagggcgagagagugaggcccgggcaaagaggguugaggcaugaaacccgggccgggagugagguuuugggcccgcggggccggggugaggcggaggccgaauccaugcgucugaggagacgcgggcaagagcuggggucggcgcuugauuacccggacgccgcuggaccuggccgcacgccgcaaucuagcaggcgucggggauccagggccgcuuugaggagccuggcuucggauuucgcguagguugcauggcccaaggggacggggcggaaagugcggaggcugaggacaaaaugggcgccggagacuccuuuagcccucgcuccuugcagcgcucgcuugggccucugcacgucacucacgccccaccucggaccucgggccgcucauuuccgggcucggcuuugcaaggugggugguaagggggcuacgggaucgagcggggaaggcuuugguauucucccgugguugcuguaggguguuucuagcccuuggaaaauuucuugcccgagguuuuccagguggugaauggggugcaaagcuuuccaguaccuuuggggucagauuccuuucgagaaaaccaccccucuugaacaccgcuugcuuuucugcugcuuaggagaaaguaggaguggagagaggucagauuuuuugaagauaguguuaauaguuacuaugugugugcaagauuaggacuaagccuaaagucuuaguucccugauugccaaaaugaguguuagagcuuccaguuuagccuccuguuuagauuugcuccuucuaaaucauuuggagaaucauagcaauuuuaagaguuacuuauuuggaggauuauaaagaguuuucuuaucaaaaaugccuucggugaauuaugcugagacucuuaccggcaucuucuuaaauccugcaguuuuuagaucgacuuuuaagaauaugaaagaaauacacacgcaguucuauucacggugccuugcuuugaguuggacauauggacucuauugagccagugauggcaauacuuucuuuagguuggcacacuuucaucaacaaauauuuguuguacaccaauuaugggccggccacuguucuggcauaaaaacaauauuuuucuauugaucugugagacccaguuuaggcaguuugcuuuccauauuucugaaauguuuacugccaauaaucaggcaaauuaaaucuuuuuaaaaaaauucuguagcuauguagaugcucuugaaaagaucucaugcaaauaauugagcucccucuuguaauuagaucuauaacccugaagugaggagaccgcagauguagucuagcacuauuuuaauuugggugaaaaauggacacuuuuauuucaauugcuucaucuauaaaauuaggagguuguauuauaugaucucuaaagcccuucucuagcuccuaacauuucuauuauucugcguucaggauucauguaucaaguuuaguuaaaaauggggcauacuuauauuugaaauaaauguuagcuugauugcacuaauuucccacuuuggauuaggaucaucauuuuguuauaaaaacauguaaauauagguuuucugguuuaagaacaggaaugggagguguuuguagcaucuaaacacacagauuaggagcuccauccccucccccccagucuagcauauguaguuagaguauuaaaugagauaugguauguaggauuugauacaagauaggugcucagccguauaauuucucuuccuuugcaucucaucuugauuuuauuuuuauaugugguuacauaagugaguucaguaaaacacaccuuaucuuuuuaaaggaagcccaguauauuuuaaaagaaccaagaguaaccuuucacagaguauuuaaucuuaggcaaggguuuuccgaauauggagccuuuaaguuguuuuucugauaaguagaauuguaauauucaaauauguuuaucggaaucccacauuucuaauagccuaguagcuguauuguuaaacaccagcacuggaccuugguucugggugaaauacucacaugcauaacucgugcuuucuuuaagacacccuuugaucccauuaugcuuuugccagaguuaauauucagaguuuguaaggucaguaguuagguuaauugaguuaaggaacgauaucaugacagccuguaaaaaagguguaaaugugauuuaauuuuagcuguaccucuaauguauguauauagagaugaaagcacuauuaaauguauuuuuaaagacugauagaauuguacauugucuaguuauuguaucagcugcauauaucuacagaggcagcucauuuuuuuucuauuugagggagauauugucucaaauaggagcuauauaccuuaagauuuuaaguggaugaaguauuuucuuugcagcucuuaugacagauaauuuaauauauguagugaguaaaaucaaagaugaucuaagaacugucuauuuuuauauccuggagcucauucauuugcucaaucauuauuauuuauucaguaggaaauucccauuuggguauaaugaacgauauuuguuaaauuauuucaccuguuugcuugaagaucagggcagaaguagaauacuuaaaaguauaauuaaugugauuuauuuccgcuucacucugaccauauuuuuauuagucucauuuccuuaauuuuuacuaccucuccuuuuccucugucuugcucuguuuaagcugcuauuacaaaauaccaaaaacugguggcuuauaaauaacaaauauuucuaacaguccugaaggcugggaaguucaaaauuaaagcaguaacagguuuuuugaugauggucuacuuccucauagaagauacucucuugcuguauccucacguaguaggagaggcuagccaagaucucuggugucuuauaaagguacuaaucccaaaugucagggcuacaaucucaugaccuaaucaccuugaaagcgucuaccuccuaauacuaucaccuugggaugugaguaggauuucaucuuacuaguuuugggggagacaaacauucagacauccuccuucccuuuuuuuccuucuaaaaaugcauuccguucuucuuacuaauagacugcaaaacuaagggaaguuucuuauccuguuggagaauauucucaaaucauuuuucuauaaaugaauuacuguagcacagcagcuaccauuuuucugcaaauggauuaguguagcacaacauugugggucagggauucuccuucuugagacccuuguuguggucugagaguuuaaaacuauuuucauaaaaauacauuauuggcacaaauuuguugacauuuguccugauggugcaaaagcaaugauggguaaaacugcugaugccuuagcaugcaugaaggcaguggcaccagacuguagucaucguauucaccuccagguacuugcaauuaaaaaaaaaaaaaaaagccaguuuaaccuaagaaugcucaugaaggaguaaaaauacuaauuuuauuaaaucacaaccuuugaauaccucuauauuuaauauuuugugugacaaaaugggaaauagacaugaaguaacuguaugccgaagugugguucugcguuguuucaauugcaggcuacacuagcuucuuuuuuucauggagucagccauggguaaaaaagucauucagauuuuaaaauagaccaguggauuuuaauauaacaguaugaaaaguuuacugguauaguucagauucuacauuucagcuaaccuuuaagaaccuaccacuugucugguuguaauauaguauugaagaauaucgacaaccggacagcaagacaagggacugucuugucuaguaauuguuaucauuaacuagaaggcauuaagugcugugggaaaaaaaauggugcaccuuaaaggacugugguaggagugcacucuaguacuaaaucgaaugaugaugaaucuuacugagaugacauuugaguaaagacuuggaagggagagaauuagcuauacaaaaggaacuagccccaguaagacccuagcccugguaagagugagauaaugaagcagguauggccagaaugauagagccuucuuaagccuuuaaaggacuuugaccuuuucuauugaaaugggaggagucauagaauuuuuaaaggcuaauuggucucugcuagacuaugcgugggacaggggcagaaguagggaguugaucaggcuauuucaauaauccacuugacugauaauggugauucagacuagguuggaagcaauggacauugugagaagugguugaauucuaguuagacuucgaagguaaagauaauaagauuuuugacauauugaaugcagaguguagaagaagagcgaagaauaacuccaggguuuuuaguuugggcaccuggaaggguggaauugcugucaacugagaugggcaagauugcagauggaacagaguuggggugaggggagaucagaagcuccauuuuagacaugguaaguuugagaaguagagaggucaagaagcugauuguuuaagugauuggauuacuagccuggaguccaggaaagaggauuggacuagggauauauauuuaguagucauuggaacauaaguggugccaugagccuaguugagaucacuaagggagugaauauagagaagaagggaccacgagcuaccuacccucuggggacuucaauaaaagagaucaagagaagaggaaugaggagaagaggaggaaccagccaaguacacuucauagugaccaaaaaaauacgguauccugaaauccaaauggagcaaauauacaagaucuagaaaggaguaagugaucaacuaucaaauguuacugucauuuaagaugucugaaagcuguuaaccacugaauuuaauugaggaacuuuggugacuuuuaguaauuuccagggcaggggaguaaaagucugguuggaguaggagagaaauuagagacaacaaauagacaguuuuaagguuugcuguaaaggguagcaacgaaagggggaaauuuacuuuuacuaaaccugccacauucccucagccuauuuuguuccuauaauggauuuuuuuuauuucucagucucguaucuuacuauuuuuccuuaaaauaguaagcacuuugaagcucccaacaaaggccuuuuucuuucuuacaagaccuauuugcacagagauuuuaguuuuuguuuguuuaaaccagucuugguuacacugugccuagcuuuacgaaaaccaaaaaacacucuaaauaguaaagacucuacaacugcaucuugggcuguaugauacggcuugcuuccauguuuaucuaaguuggcuaaaauuuucuguauuacuagucuugauuuugcuuuaucauccacaauaagaauaacguguuaauuuuuuccugcaucagaaacacuuccuauacuuaaaaaaaugcuguguuauucucaagcacgcauugcugacuuuuccuaaguuggucuaucagguauauagauguccaucaccauuucaaaaacuuguauugcuucuugucuaaacacuaaagcuucagagaaaauaguuauacaaguguacuaccagagaaacaauuuuugguaagacuuccuuaaugauuuguauagaauuucagggagagucuacgugguuuuuuuaauuauuauuauuuuuugagauggaguuucacucuuguugcccaggcuggagugcaguggcacgaucucggcucacugcaaccuccaccuccuagguucaagcaauucucuugccucagccucccaaguagcugggauuacaggugccugccaccacacccagguaauuuuuuguacuuuuaguagagacaggauuucaccauguuggucaggcuggucuugagcuccugaccucaggcgauccacccaccuuggccucccaaagugcuggaauuacaggccugagcuaccacgcccagcccagucuacauguuuuaagauugaaaaacucuuuaaguuuggcuagcauuuuaaagaaacuucaucuuuagugauugauauuucuuuuuuuuuucuuuuuuacaauuuuuaguagagaugggauuucacugcguuagccagguuggucuccaucuccugaccucaugaucugcccaccucggccucccaaagugcugggauuacaagcgugagccaccgugcccggccagugauugauauuucuuaauguaacuaaugcccuaaguagaguaucacuguaggcagaaaaauaaaauauuuuauccuuuucaucuugcuuuauaaagcuaaacacugcuuaaaguuaauaaaaugaauucugaaguaccuuuuuaaauaauaugcacauacaaauauuguugaccucaucagaaaauauuuuguucaucuaucuguuaccuugccuguuaaaaacaaguuuccugauccauacacgcucaagagguuaauauugaggacauauaucuaacagugccuuggauuuuuuccaguccuuuuaaagcugggggagccagaucuagugguucagcagcuuaggacuauccagucaaugggguuuuaugucuauguaccugucuuagggauucaugacuggguaugauggcugaaauucaucugcuauucauauucacuuagugaacaauuucucuuucuccuuucucucccaucuccccacccucaacuuuugauucccgugcuucaauaacuagugugggagagcacuuugaggcucccaacagaggccuugcucuuucuuacaaaacuuguuugcacaggguuguuuuauuuguuuuguuuuuuaaaccaguuuugguuacacugugccuagcuucaaaaacaaaaaaacacuaucuuuuugccacuucuuuacucaagagguccauaaaggcccuuaagguagcuagacccccuggcaugcuagaauuuuuaucuucauuauaugcacuaaguagaagcaacauuugaaaguucuuagacaguuaaacucuaaaaaguuuggcuuuauuagcaucugcaguauuaccauaggcuagagauguguccacauuccaguaaauuaccgagaugacuugauaaacuuacuguacaauuuggcaaacaucauuaaaauaguuuuaaaugucuuauaaaaugcuuuagugauaccauauuaaacaauuuuaaauauucuauaagaucaauacauagcuaugugauuauuugacucaccaagcgaucuuggccuucucguaucuuuuaagauauaggacauuugccuauaaaacuuuaaaugagugucaaucuaggugguuucacuacgaacauaaagaacauguaguuauuucuaaucuggguauaccagggguauagugacauuuaacaguguuguuagauucguaaccaagaaacucuccuuucugaauuuuugauguuacaaaguaaugaacuuacacccuucuguuacagacuuggcuauucugucuuuggaauucuuugccaaucaagaaagcacacagaacaaaccagugacuguuuuauagaaauaacuuugaauuguaacuuuuuaaaaauaguaaagcauccaaccuugaacuauguuauuuaauagcaaauuacauuagccacaccuugcaacugaugucauccacaucacuggaucagagggaaguaagaccaguaaugagugccugcuucuacuccaccauuuuuuucucuugcuuuuucuugguuuucaaauuaauauauuauacaucaucuuucuguucugguagaugaggauuuaguuauauuguaccacucucuuguuuccuuuuucuuuacauccucucaauauauaauuugauaacaguuuuuguuaaaaaucaaaagucagugcuuaccuuauugugacaauacaaauauuguucacugcagagcuaaguuuaaguugucuauuauguugaccuuuccuuucuugaauaacuucauuccuccccgcccccaccccccacugccccugaaguuaauaauugccuccauuaaaaaacuuuugcuuaguuaugugaguacucauacuugaacauuuguuuucauauggucagcuguguucaucugucagucuuuuuuccuggagacuuuugucccacugaauucugucauccuaauccuaucuugauugguuuuuuuucaggucugccauuucacuaucaucuugggacuucugucuuggguuauucuguuccugcauuugguucccucccuaccaccaucuucuuuuaguuuacuuucuuaauuuguggaauacauuuuuuaguuagcuauguaagaaaaggguauacaguaggcaauuucuugaauacuucuuugucccagauguauaguuugguuugguauagaauuuuaggauaaguaaucugcaguugucgagaaguaugaugcuaaucuggucacuuuuccucuauuaugugaccuuuuuucuuucuggaaguugaaguccuugaaagauugcaguagcgcaucuugguguggauuguuuuugcauccuuuguuccugcuaaaccuaaguucagaaauguugaguuuguauucuucagagaauuaaccuucugccuaggaauguaguuuuauccagcgugugugugugugucucugugugugucugugugucuguguguguguguguguguguguaaggcauagagcaacacugggcauccuaccuuugucauacagacugugacagcagccaguccuguuuucaguucuuugccuuaauucccucuugaauacuuggugcccuaaucauuaggccuccuagggauucugcagggaaaaacugcugcuuuuugguauuucccucugcaagccuuucuuccucuuuacuaaguugucuuucccauuugccucauugguugaaaacuugcagcugccgauuucucugggccucucuguucuucuggcauauuccuuuagacagugagauuuuugacauggagaaaagauaaaucuaauguaguucaucccaacuuuauugaagcaauaguuuuguucucuacaucaauucugauuucagugugcauaauaauuauuuuuaaauugcagcaagagaaauaccagagugucaccccuauacuacacaucuguugcauucuauaauguaaaacugcuucaggacaaccuaagugcuugugcauauacccacuuaugccacccccaccucuguacgauuuacuuauuuauuuauuuuuugagauggagucucgcucugucacccaggcuggagugugcacuggcacaaucucggcucacugcaaccuccgccucccagguucaaacaguccucccaccucagacucccgaguagcuaagauuacaggcgugcaccaccacgccuggcuaauuuuguguguguguguguauuuucaguagaggugguguuucaccauguuggccaggcuggucuugaacucccgaacucaaaugauccggcuuccucggucucccaaaguccuagguuuacaggugugagccaccacgccuggccuuauuuuuuuguuguuuuuuaauuuuguuuuguuguuguuguuguugucauuguuuugagacagggucucacucuuuggccuaggcuggagugugauagugcaaucacagcucacuaaagccuugaccucccagguuuaagugauccucuuaccuugaccucccaaguagcugggauuacaggcaugugccacugcaccuggcuguuuuuuccuuucuuucucucuuuuuuuuuuuuuugcgauggaguuucacucuuguugcccaggcuggagugcaguggcacaaucucggcucacugcaaccucugccuccuggguugaagcgauucuacugccucagccuccggaguagcugggauuacaggcaugcaccaccaggcccagcuaauuuuuuguauuaucaguagagacgggguuuuaucauguuugccaggcugggcucgaauuccugaucucaggugauccaccugccuuagccucccaaagugcuaggauuacagaagugagccacaacgcccggccucuuucuuucuuuuuuucagagacagagucacuguguugcuuaggcugguuucaaacuccuggacucaagugauguuaccaccucagccucugaaagggauuacaggcaucagccaccaugccuggccaguuuagauucucauguguuuuacuugcugaaguguuuuuuaaauaucauaguauuuaccuugucuguuggucuggccacaaaauauucauaagacuucuauuacaaaauuucauaguuaccauuaucaguaauggagacacauaacuacauagcuaauauuuauugagcacuuuuuaugugccacuuuacaaaaugcuuuauguggauuauauuauaucaucuuuacaacaagcgugugaggcauagguauuguuuuuaccauuguuguuuuguuuucguuguauaauauuuauuuucuuggaaccaggaaugacuggguaggaaucauggcuuuaugugcucauguugcuuuuuguuuguuuucguuuuaauuauagaaguaauucauguucauugaauacauuuuuuagaaguuauucauauucaagaauacucuuucuuagguuuuacagaauauaaaaucaaaacauguacauguuuauuauagauuuugggccuguuuguggguuuuauguucaauaaauuuacaaaguaaauacacuaaacugcuaaaaagaaaucaggcaaagacaaauugaauuaugguuugccauaaauagaucacuguuauagugugaauaugguauggacuaacccacagguucuucugaguccuacauugcauauacuccaaguauacugugugaugaugacucaugucuuuuaccacuuagcucucaacucuuaucuaaguaaauuuauggcuucuauuuaagauuccucuuguggccucauauauaaugagguuuuaagacuauuucauggcuguuugaaaauaucuuuuccuuguuuauugaguauugagguuucuaaguucuacuuaauuuuguuucagauuugcuauaauccuacuacuuuuugucuaauuuuguugaaaucugaccguauaauugugguuucgacauuuuuugggggggggguuaaauuuuuucaacugccuauuuaaagcuaugaguggaauuuuuuugaaguguuaagcuuauuuaugauugaauguuucacauaauauauucagccccaaguaguucauauauuaagaauucuuacugguuuucacauauuuuucaaaucagauuugucaagguaucguuuacauacaguaaaaucuacccuuuguuaaauguaugcuguuuauugacuuuuggcagauguauaaagucauuuaaacacuaccauagucaggauauuggcugggccuagugguucaugcuuauaauccccguacuuuggaagccugaagugggaggauuccuugaggcuaggaguucaagaccaguuugugcaacauagcaagacccugucucaacaaaaaaauuuuaaaaaauuuaaaaaauuuagcugugcaugguggcaugugccuguagucccagcugcuagggaggcugaagcaggaggacuguuugaacccaggaguucaaggcuacagugagcuaugaucgugccacugcacuccagccuuggugacagagcaagacacuaucucaaaagaaaaaaagaaaagggauauugaacaguuuuuguuauuccaagaauucccccacaccccuugaagucacuuucuucccucuccucuaccccuuggaaaccacugaucucauuucuguuccucucauuuugccuuuucuagaauaucauaaaaguguuugcuuaacgagggggauaauuuuuuuaacgucaaaaauaaaagccuuuugugcuuagcuuuuucaauuagcauaaugcuuuugagauuuacccaggugguggcuuuuuacugcagaauaguauucuauuauauaguuguaccacaguuugcuuccacuaguugauggacauuuggguuguucccaguuuuuagcuaugaauaaguauagcuauuauaaacauucaugaacaagucuuucuguggacaugucuguucauuucucuugggucaguaccuacaagugagauagggcuguguggcaguguuauguuuaacucuguaagaaacugacaaacugcuuucuaaaaugccuguaccauuuuuaauucccaccagcaguguaagagauuuccaguucagcgguuggcuguuuguuggucagucuuuuuaauucuagccauuuaauagaugggcaguaguaucuuauaauggaucuacuuugcauuucccugaugacaaaugauuugcagaauucuguguguuuauuugcgucuauguaucacuaucuguuaaaucucuuacugaauuacuugauuuuauuccugacuguaagcacuuuugcagguaaugauuuguaaauauuuguucucagucuauggcuuucauuuucuucucaguuucuuucauuguguuagcaguuucuuucagaguagaaguuuuuaguuuugauaagguccaguuuuucaguuuuuuucuuuaaugauuugugcuucuuuugauguccauauaagaagucugugccuaacgcaaaguuaaaagauuuuuuuccagauguuuuuuuccuagauguuuuauaguuucaucauuuuaaacuuaggucugugauccauuucgaguuaauuuuaaaauguacugugagguaaggggcauguuuuuuauuuuacauauaauguucuuuauuuuuuaauaguuuuguugcauaaguuuuucacucuaguugcauacaguuugguuuuaucuuauuuucuuuguggcauauacuaauacaccaauaugacauauuuuuaucuuuuaaaauuucuuuuacauucuauucggagugauauuaacauugccaugccugcuuuccuuuauauauauguguguguguuuuuuuuauuguggagguagaauuguuuaguguauuauugcauggguugcuuuucuuuuucuucuuuuaaugcccauuuugaagguccacguuaaccugacucaacuagcuuuucucuuucaccgcacuaagagcuuuucugagugauuuucccuuuugguuagaaagcaguucuaaaggcuucacuugguaguuauuaauguuuuaagaggaaauuauuuucuacucuuguauuuuaaaauaagaaaauaauaauuacucagccuauaucuuacauaccuuuuaaacaguucaaugucauuaagagcuuuuguuauuauuguucuggugaucaguccuuuuauuuaaguuggauucuucuaacaagccuaccuacauuguacaguuuuccacguguaggccugacagguauuaauugugagacucaaaugccaauuuuuuuucuuuuuugagacagggucucacucuguugcccaggcuagagugcaguggccugaucauauucacuguagcccugaacuccuaugcucacacaguuuucccaccucagccucccgaguagccaggacuacaugcaugccccaccacaccuggcuaauuuuuuaaacaaauuuuuuguaaaguggugucuggcuauguugcccaggcugaugucaaacuggccucaaaccauccucuugucuccucccaaagcucugggauuacaugugugagccaugcgcccagcccucaaaugcuguauuuuuuuguaggugaaauacuucugaauauuuggggauuuaaaauaagagaacuauguaugguuaacuaucagugaguucuuccuuauuguucagaagaccauuucuucaguuugaaaggacaggaguuugaaagauaggauauacuucaaagaauggccuagauuuuaacagagccacaaguuauauauauacaugaguacuaaaucaaaccuuaggacaguauuuaaagccauuaugugacuuaccaguacaauuuuaguaacagcaccuaucaguugaaguguuuagcaguuauucuugccagauaguuacuaagcuguguucauuuuaguuacugaagaaguuuguaugaaaucaaauaauggaaucucuuaaaaaucaguuuagucaucuaacauuaaaaauuauaaauuuuaguauguuggcaaagcuccagguacccauguggauuacagcucugggcauauauacuaacuuaugaauuaaguagauaagcuguguucuuuuuuuuuuuuuuuuuuagauguggugguacagugggagcuauucugacauguccacuggaaguuguaaaaacacgacugcagucaucuucugugacgcuuuauauuucugaaguucagcugaacaccauggcuggagccagugucaaccgaguagugucucccggaccucuucauugccuaaagugagagcauaguauucaggaguguuuuuuaguuuguuugcguuagugaguuccagauguuuguuuacuuauauucugccacauugaaaaugauuuuuuauaaaccuauuuacagaaguuacucugaauuguacucauaaggaaugauaaucccuaauggagaagaacaguuagacagauaagauaaaguguaauuuuacuuccaaaucauguguauuuagaauauuucuacauuuauccaguggaguuuuuucuaaagcuauuauaaguauuuuauuuuggauuauucauuuacuuuugaaaugugauaauguuuaaugcuaacuccuuucguguauauuuuuaauguuccaaguaaguacauccaauuaaugauaaucugugauuuuuauguaaccuaaguacaacugagacagcagaguucuaaugcuguucaguauuuguuuaacauuuccugaugguuuggaaaagauuuguuuuuacaguuugccauacuucauuauguugcaauuggauuugaaauuucaaaacuauuaaaauuagguuucguauguuuauacuuguaaauaauggaaugccuucgugucugccuuaucagcucaguguuugaacuuaguucaguaguguuuauuuuguaauagcaaauaaacucauucuguguauuuaccuuuguuacuaaaagguuucaucagccuuuucuuuuuucaaacuuguuuacauaaguacaugaauagguagaauaaaauugauaacaguuuugaauuaaaaugccauaagugguggcucacgcccauaaucccagcacuuugggaggcugagguggguggaucaucugaggucaggaguucgagaccagccuggccaacauggugaaaccccgucuguacuaaaaauacaaaauuagccaggugugguggugcgcaccuguaaucccagcuacucaggaggcugaggcaggagaaucacuugaaccugggaggcagagguugcagugagccgagauugcgccacuguauuccagucugggugauacagugagacucugucucagaaaaaaaaugcuauaguuauacauaaauacuucuaucugauuuguaauaggaaaaguauuuuaauaucaugauuuugauauuuauuaccacagauugccccuccuuaaaauucuucuuuugaccucugugauaauacuuuuuaauucucuuuuucaguaguuuugccuucccuucacaggagcuuuaguaauccuucugggcuguguuuuaguuccgaaguuuuucaggcgcucuuuuaagcucuuuauauauuaauuuacuuaguccucacaguaaccaguaaagggguacugguuuuuuuuauuuacugcugaugaaacugaguaugagaguaaaguuauuucagggucguaggguuauccauuaccaacguugggcuucauaucugagaagucuggcuacucaguucaggccuuaaauuaaccauuagacccaacuaccuuuaaaaagaucccucuuaagcagauagauguuugagaacuacuuggccuagucuguuaacucugaauuaaaauaccuacucuucaguuucuauuccuucucacugccaaaacuucauuucauaacuuacuccaggaaagucuucugugacuuacacauggcucuguuccuuucucugcugggcauauauguaucuagguuguauaguauuugcuuguuaauauggucuguuaauuuauuuguuuuguuacaauucuuuuuaccaaaacaaaacagcaaauuucccaaugucaggggccucgccuucuuuuuucuaucuacuuacuuuuucuaguuauaaacagcuaauuauacaguuaaauacucaguauagcaacgguuaacugaguggcaggagaaauaacaggccaaccauucugguaccuuaaaggacauuagggugauagauucugcuacagcauuucaauggaauggggaugagauaauacuguaguaguaagaaguauuguccaauguugaguaaaagaccugaaaacuaggaaggaacuacauuucuaauuggcggguaguuauuaagcuuucaauuugcugguaaagauaguaaaauuaaggaaaucgaagauaagaguagcaugaucauaugaaaauaauguagaacucuuuaucauugugucuuaaucuuucaggaaagaaucugaacagauuuuuuaaucauuacuaguaaaucuauuaucagucuucaacaauuuaugcuaugucaugaaaaaacaauguuuuguguguguguguguguguguguguguguguguguguguguguguguguuuucuuuuucuuuuuuuuuuuuuuggagacagaguuucgcucugucuccaggcuggagugcaguggcgcaaucuuggcucacugcaaucuccgccuuccaaauucaagcgauucuccuaccucagccuccugaguagcugugauuacaggcaugcaccaccaugcccagcuaauuucuuuauuuuuauuagcaacgagguuuuaccagguuggccaggcuggucuugaacuucugaccucaaggaaucugccugccucaguguccaaagugcugaaauuacaggcaugagccaccaugccuggccacaaauuuuuaauaaguaaggaaaacucaccagagaagcacaacauaauacaaauguacuggauuuagacucuaacuuuauauacaaaguaaauaaaguaccagacuuugaaagauauuucugauagaauuuuuuuucucucuuucagggugaucuuggaaaaagaagggccucguuccuuguuuagaggacuaggccccaauuuaguggggguagccccuuccagguaaaaaaaaaaaaaaauuguuuaaagcaaguuauggcaaucucuuuuguuucagcacaccuggauuuaaucauuuauagauacaguuaaauuuauaaauguaguauucaauguuuaugggaaguuaaaauacuuaauuuucuuuuuaagaauuucagauucuagccagaacaaauuuauauaauaaaguaauguuuggugguaggaaaugauacuggauauuuugaagacuuaacaguauuucauugcuguuagaaauuaacaguaguaauaugaauacaaaggcuauguuucauaaugugagggagaagguauaguauuugcauuaaauuauugauagucuuauacugggggaaaauaauaaaguaucgcauauuauaccuagaaguuuaaggaacaguguauuuauagauaagaguuuuaaauguuaaaauucuauaaauggaccugagauuuuuuugggggagauguuguaaucaaaguugaaaauaaugaauauauuauauaucuuuauauugcauagacuaggagauauaaaauuacuaauauuugcaggauaaauggaaauacucucguagcuaguggcaguguauugagucuucuggggagaugcuuauccucucaucugaccauaggaguuagaagaauuugggggugcagaauugaaaaucuacacagggcuaaggcugcaaaauacuccugauauuuugagauaaguguuugcuagauuugugaguuuaacuaaaccagcucuugcaucuugaaaaauuuugacucuaagaaagguaagcauucuuuuaaacaaaauauuuuccuugggccaaaaggcauuuaggauaucucgacuuuuucugcuuuucauagcuguccugcugugcgcuccaccugaaguuaguguuccuuucucacuuuccacauagaaauuaaacuucaaagaaacaagauagaaaauagaaccaaaggacuaggaaggaugucagggcuuagaacaggguugaagaaagggacaaaaagucuaaaaaccugagaauuuguguaucguugaagggcaguaagugauguacauggccuuuaccauaauaaaaaggaagcuauucaaggaagaugcugaagaggugucaaggugauaaggauaaagaacuauggugugacaaacagguaucaguaaccaucuaaaaggaugggcauggcaccauguguaggugcaaaggaccacauaguaagaccauugugaaguaguuuuuaaaaaagucaaaagacagagaacaagcaaaggaacuaauaacuaaaggaacaaccaaaggaacuagcaguuagaaaggggaagaucuggaacucuuaaaacuaagucauuguuuggcuuaugggacaaaccaaacagauagaaugguugcagucccuauuaagccaaaaggacaugaaaacauaacuucgucauuuuucucugacaccauugcaucuuagauuguuaaccucuuccaugauagaacacuguauaaaguucauauuuagagugaaaaugcuuucuguauccaaaccauguaccagauccaugucuuguuauuuauuacguuucaacuuuuuauggguucuuuucucucuuuaagaaaauauccaaaauugcauccuaauuauaaaacaaguuaaaagaaaaaaaacaccauuaauagacaguucauguauauucuuccaguaauuuuucucgguuaucauauacauaaaaacauguauacuuuauugugcuuuacauaaacugaauaauacuaaauguuuaaccuaaucuaacugaaguuuuuccaugauaauauguggggugauuuuuuuaaaauuguauagcauucuagcacuaauaaacauuuccuuauuauacauuuagauuauuuuuagauuuucauuguauaaacaaugguucaguaaacauaccucaaccuuuaucuuugaauacuuuaggaaguauauuuuuuuaggauggucaccuaaaauuagaauuucuggauaaaagggcauaugcauauuuaagacuagugaauauugaccgggcagaguggcucacaccuguaaucccagcacuuugggaggccaaggcggguggaucacaaggucaggagaucgagaccauccuggcuaacacagugaaaccccaucucuacuaaaaauauaaaaaaauuagccgggugugguggcggucgccuguagucccagcugcucaggaggcugaggcaggagaauggcgugaacccgggaggcggagcuugcagugagccaauauagggccacugcacuccggccugggcaaaagagcgaggcuccgucucaaaaaaaaaaaaaaaaaaaaaaaaaaaaaaggcauacuggauuuuuaucccuuauccauagccuuaccaaugcuggcuacuguccaucuuuuuuaaauacuuaccaaauggacuaagagggauuuuucacuguuuuaauaugauuuauuuaauuuuuggugcagucauacuuucuuguaauuugucauuuguauaucucuccugugaauugccuauauauauuucauggccauuuucucauuaggauuucuuuuuuucuuaccaguuucuagaaaugcauuguuuauuccucuucccaacuuggcaucaaguguaucuuauguuuuucuuucucauaaauuagaauguuucauuuucaguuauauuaauuuuccuuuuuucuuaaguacauuaaaaaagguacaacagugaaauucucauuuguauuugucacucuguuucuuauuggaugaguaaucaggauuuuuggggaaauaacuggauauuucauacagcaagcaaauaauucaaagcaugggaaguuaacauagaggugguaguggggaugcauaaaaucguagucaguaaguuaacaaugagggaaauaauuaaauuucacucaguguuuacaaacauuggaaaacauucugaccugaugggucugauuucuuuuguuggaauuguuuugucuguuuaaggauaaugugaauuacuguguguguaguauaauuagaauauaccacaguaucuuaaaauuguuuagcauauacuuuaaucaguuggaucugcuucacccucuucuccccaugaagaaaauuauauguuaagugcucauaccauaucuacuuaucuucaguaacuauauuuagccuuagcauuacaccagccuuacagccuuauucauucauuuaguuucuaaacauuaaaaucuuaaauacuuuuuguuuaaauuaguuauuauuuuguuuuuauuuuuuuuuaauuucauuuuuucuuuuuaucuucuugguuaccaaguuuuagugaguuaaguggcugucagaguauuggaagggggucuguuugaggaugaaugguaggaauuuuacauuugauguugucuuauuuuaaugagucaauacagaaaguacuucagaguauuuaugaaaaguguaaaucuaauguuacaugagaauguggcuaggacuuuaugguuuuuaaauuucuccauucuaaaauuaugaagaucaauuuauauguaaaucuuacgcauuaagaacaugcuuauugauaaaucuaaaucucuauuuuagagcaauauacuuugcugcuuauucaaacugcaaggaaaaguugaaugauguauuugauccugauucuacccaaguacauaugauuucagcugcaauggcagguaugaauguauaauauuaaaaaaaaaaaaaacuuucugaaaccuagaggcuuaauauugaauuauaaguuuguagugaaaaguugaugauuaaugugcuuuucauugauuagaugauuuuuacguuuaucgauauaaaccaaauuagguauauguaaaaucugucaucaguugacauuuuuguagucaggaguuuacaugcuaggguacaaguaauauauuuauauugccuuguguaguccacugaauguuuagugaucauuguuaacaguuuuaagaauccaaccauaauuacacuauaaauaaguuauggagcuguaauuuacucuucucuccucaauuucuguuagugccuuuucccuuuuugcugcauguuuuggcuucugucugaaaugugucggcaauucuugguaaaguauucauuuuguccugugcucaaaugcugaaauuuuugugagugauguauuauuauugacaauucaguuacuauguguauuuuuuaaaauuguuuauuauucuacauaauucacacuagacagcaccugaaauuuagacacuggcuauguguacaugcuuacuauagaaauguuuccaggaacucucuguuucugucaucacugauaaguauauaugauucugaauuaaaauaacuaguuuuaggucuuuacccugccauaaagauaaacaguugguuugaccaaucugguucuggaaucauuugcugcuaugcauguuagacaaagccacgaacuuugauuuuccauugaaaauucucccuaauaucugagauuuauuguauauuuacucauaucucacauuuucaaauuaugcuguaacuuuauaaacuguagcugcuuucaucagcuauugaucaauaaauugaaugucaauuaugugcuuaauaaugagugccuuaaacuguuaaacacuuuugguuuagaaauaaagugaaucaauuugaccuauauacuucaugaaguaaguaaguuugaaauacaaauuucugaaaggucaauagcccuuaucguauuacaaauuguuuuuaaggcuuuuuguauuuauuaauugucaguugauucacugaagcuuuaaaacuggaagggacaauccaaaggucaaaagagugaaauacaaucauuuaccaauaaggaaaccuugggcaaauuauguaauuuaugugaaccucucuuagcuuacccauggaaugagucaaguggucuacauagauuuggauuuugagaauuaguucuuucauuuaguguuauagagauuaucuuguuacaacuagaauuauuuuuaauguaauuuuuacagauguugaauauuaguagauaggauuuuuccccuacgaauuuggauguaagguaaagguugguggccagugacaaaccuuauaaccacuuuaucagguucuuuaaaaauauauuucugaauuaccagugauuauguuuuuggcuuauaaccucagauaauuauaaagaaauguuaaucuuauuugaaagaauuggaaucuagaaaguuagaugagcagucauuuuauauugauauuuguuauaucaguauagcaaaugcagagguucagaauaucuuuauuuccacuggaacaucuuauuucauuggaguaucucaucagaauuuauuacuguauuuguaucacauugcaaagaauuucaguagaauugucaguuugcacuuuuuucucaaauguguacaaauguuaacauauaguucauuuuuaucuguacauugaugccauuucccaacuugaauuccucaaguuuugguaaacuuacaaucucauacuuguucagagguuauugcacuguacacuuacuguguagaaaauacuguuugaauuuguuugcaguuacauuguucugagaacugugcucucagagcuucugugcacuauucaugagcauuaacacuuagcuuugcaguuuuauacauaacuauaugguuaguaaaacugaaugguccaaugcagacucauuaaaguaggcuuuugcccccuuuguucuugaaauaaucuagaccagauuacucgggguuuuuuuuaggauuauuuuuauaggucuaaauaugaaugauuuggggguaugaaguacuuaaagauaguucugugaaaaaucauuuucagcugucuauucaagggaaaaaaugcuaaccuugucacuuuacuacacaaaaccacacuaaaauaaaccauuaaugauacugccugcaagauuuuaacacaccagauagcacacacauuaaggauuuauaaggcacuguacguaauuuuuauuccaagugaccucucaauucauuuucauuuugcauuuuauccauaugaacucauguuuaauuuagauaauaaaaauuuauuuuauuaaaaggacaguuuauuuaaagugggucuuuuuauuuguuguagugcauacuauaagaauuuguaagccucuaaaguugagcuauaaauuuucaugcauuaaaaauuuguuucaguugugaggauauuuaaucagauuaaauaauguugacucuuaauauuuugccugccuuuuuuuucuccuacacaugaccuuugacagacuaaguauaucucagcuauugaggguaucuguuuuguugccuguauauuuuguuuaaauuaacuuguauauuccuuuguauacaccuaggcacagauguaugcaaaaaaaauuuguuaaauuacuucuuucuuuauacuaauucucaauuuuuaaaagauuuuaucuggcauguauauacuuuuauauagaacauuauaaauguaaaggaaaugaauucuaauuuuaauuggauuauguauucauacaguuauucucaauuuuuaaaauacuaauaauguaaucauugaauguuuccuacauacguaguggguuuuauuugcucacagcauacaguuauuuuucaauuuauguuuuucuauuagacuuaaauuucauuauaauaaaggcuuuuacucauuaaauacagguauugucuugcauuuaugaaauauuuuuuaaaaauauuuuauuuguccauggcaguuaauucagccagauggaugguuggacagauguuuuguguguuuguguguaaacauucuuccuguuuuuuguuuuguagaacacaagaaauuaaauacaaaauaaugcaaaauauuucauaaguauggaugugcaauauuacuggccauagugcaaaaggugaaagguacuauuguagcaacguauucuuuauuuuauuaaaaauuuauauaaauagcuccaaaaugaaguuacuugaauauucuguugguuuuuuuuuuuuuaagauuuauuaaguaggcugauuguuaaaggauagaaauuguguuuucaucuccuuaauuauaauagauaauagugguaggaaaaugggagaugaugauccccucuaaauauucccuuuugacaagguuagcauuuuuucuuuaaggcagaauugaucuucuuuuagguaaguauuuagauucugaaacugcugcagauggcaggauuuucaguacucgguacauuuuuuuaaauggcccauuuugauauuccuuucuuuuuuuuaacuuaaaauuuucaaaaaaguuagaucucacaguaaauauuucucaaauccuuccaauaggauucaauuuguacacauguuucugaugaggucacugcuuguuguuaugauacagaaaagccugugucuauuuuaggcauuuacuguacauuucucccgagaaaagagugagaucgugucaucucaugcuccccauccgcaggucacuuccuguagaaauauggacuaacuuaaaccucgugaguacugaucugagcaucucuugcagccuguaguauaagaaacccacccugggauuuuaugauagcuguggaauuagaaggcgggaaauuaacuuuuauuuccugaauuugugugugcauugcuaagucugauuccuuuauaauauuccuucuagaaggaagaaugagguauuuuucagucaucauguaauaaaagccuggggucuucagcuuggccauaacagccuugaccuccaaagaauguaauaacaauauauauauagcuguaaaugguauuauacuaucuuaaaaguuuuagauaaaaucauaguucucuuugcuuagcauaacauauuuaaaagccuaauacaaugcuuuccauucuuuuuugucuguugauacuuggcuuucuuagaacucuuuugcaaaaaaaacaaaaauuaauuacuuugcaaauaaaugcaggauaagaauauaugggaucuuagcuguuuuaguuuuaauuacuuuuaaaagugguguuaauacauuuaggagguuaggugggcuuuguucuuacagaaguugaaauaaaaaguacugaaaaugcaacacuacagguaucacucacuuaaugaaaucaacauuuucagcaaguuuaagcagaauuuuucuguuaaucugguuuuuaauugcucgacacuaucaaauggaaucuuacuuagauaaagcaaaacuuuuaaaguagcauuuuuaaaaauuuuuuaagcuuucuaacauacuaaccauccuacuaagaguauggccaauauauuggcacuuugcuuuaacugacuguggagcaauauuaguucuucuuaacuuacaaauggaucccucaugucgucuuaaguucauuuucauguuucacuaggugcucagaaucuuaauauaaauuggcaaauuaugaaaaugucacaaaauuaaaaugcaaaauaaaaaguaauaggcaauuucuaaauuucaggggcaccauucccaguaucuuuguguguguuugucauauaaguagugggaagauauguuuagcuugggcuaaccucaaauugccuuaccauauauaaugcuaaguuacgauaaauuuuuguuuuuuuccauuggcuucauuucuuagauuauuagauuauauuuauuagauguaauuagccuaguaaugucuauuuaguuuguuaaagugucuuugguuaggagaaaguaauagcauaaaacucaaggaccugaguuuuuagcgguaaagggcuaauagcuaaaacuguggauugugucuagauucuuuaccuaacccaaugguuugcuggcauuuagguuagugucuuuauaaagagcuagcucucauugggagaguugagccagagcaaccauaguaaacauagcuuacugauaauagcaauuacguagggauaagauaacauucucucacuuaccuaaauuuuaauguguccuguuacauagguuaauuugugcuuggaaaugaauuuuaguuaagugagaaauaccuguuguuugcuuucugacauuauaguaauauguacagagaauaauuuaaaauuauaauuuaugggucuuuaaaagguuuuguuccuaacaacauuuauaaaaauuuauuguacuauuguaaaguuuuuuauauauggguuuuuuuccagccucaaauucuuuugugacuuggaagaguauuauggacagaagcuuggguacugcuuaaaauuuauguuuuuagaaguagaacuuuuauuuaaaaaaaaaaaaacuuaggugcucaucuucuuuucaaauaaguauaauaagaugaaugagaauuuuuaccuagauuggcuguuuuuuaaaaaguuugauguaaagauucccaguuuuaagcuuuuaaaauucaauaaaaagcaaauaguuuuucuuaagauuucuauaaaaugauuaauaaaaaucauuauagugaugcagaauauuuuguugguuuaugcugcuuagcagcuuuuuacucauaaacccuuaauuuugcuguacagacauauuuagcuauuacaaauauuuaaguuuacaaaacaagaaucauuaaauuggaguuugaccagaauauugaugucugauugcuuuaaaauauaauuugaauauccuagccuuuucauguagaaaaaugagguucaaaagaagagaaaaauaauacucuauaacuuuauucucaguuaagcuagaaccaugcaagaaaauauuuaaacuggucugauaguuucauguuuuucuuuucuuuucuuuuaccaagaauauaugcaugaaaagaaccuuuuauuuaaaaagauguuccuggcagccugcucaacacuuuaaauuuuaucaguuuaguaccugcugaugcgucuaaaacuguuggucccauucuaguuuuauacuuacauauguaguauuaaaagcacuuaagagaaauguagaauauauaaucuuuauaaaaguauuaaaggaauuauuuaaauugaauuuguaucccauuuaucuugcuugcuaaauagauuuaauuggagcauccauuuguauaacgucuggcuauuucuacaauguuaaaacaguggguugaggaaguaaaauuugaguuacucaguuacugacauagaaaagaacccugugagaccaaauucagcuuuggaaacaauuuaguguaauuauuuugcauauguagauacaccuuugaaagccaagaaagguuuaugauuggaucuguacuauauuaauuuaaaaacaaauuauucuuaaguauauuguagcauuucuguuccuguaaguacuuuacucaucuuaaauguacugaucauuagccaccuuuauaaaaagaaugugccugacccacuaguauuugauagaaauauuaaaacaguuaagauccuuaaacauuucugcauauaauuuuuuauugaguaaauguaacuuaacguaaguaguucuaugaagucuguguaaauuaaaacccuguuuuguguagaugaagcaaucuuuauaaguuucugucaucaagacuguauuuugugugcuauuuuuccauagcuaggaagguggcaaguaaaacauaugcacuauccuagaaacauacuguuccagguagaucuuaauuuacuaccuggaaugagccaucuuaggugaccaccauucugcaccaauaccuaguacauaauacuuuaguuuuaaaguaaacuagagcugucuucuacccugaguuuauuccaugucuauaaaagagggaacuuccaauuugugacuuuuugaacuuuugaguuuuuguauguguuuaaguaaaugacgauaggccuguccuauuaacccuaacaaaaaccuuacugugauacgguuauuuuaacaguauuaguauguauauauguagaaaguauucauggggccaaacaacagucuuuuccacuauauaaucaacuaaagaucaaacuauugguaaaauuugacauuuguguagaauucauuuugaauguagugauuugggaugcuaaucaaaccccagguaacuguuuuuuuuagcugguuuuaaggaucccaagugcaugcuuuuuagccguagaauacacaaaaugucuauguguuuguagagauggauuucugaauucagcuuagacaguagagagcacccuaaaggauauucuaaguagguugggaaagcaauuuauauucauuuugcuuuuaaaagaaucuguuaguuaaggacagaauuugagaauucauauagauuggaagugaagacaaauguuugucguaugugaaaaguguaauauauacauaaauuaguaguuuauuuauauacauuuucuugaauguagauuuaucuaauuuuuaaaaccuuaaaguuaauagugaauucuucauuuuuaccagaguucauuuuaaacauguuuguuuagguuuuacugcaaucacagcaaccaaccccauuuggcuuauaaagacucgguuacagcuugaugcaagguauguuaauuccuuaaaauaaaauugguuaaaguggauuuaacuaauuuuuuuucuacaaaguuuuucuuuccuuugcugcugaauuuguuuguuguuguaguuuaauuuugaaacuugggucugccaucagaaaaaagauaauguaagaguugacaauaugaacuuuuccaggugaaaaaaguauauuauuaauauguguuguuuuguuuuguuuuguuuuaaaaagaguggcuagaaagauaccauagagaaacagaaaggaaagaaagagauagauuaacccagcccaaaagguaauacuuuccuuacauggguacuuauaauuggccucgcagaagcuaaguaagccacaaggucagcuagucuagacugaaucuuugaggaucauugcucaaauuuagugaccuugugaauagagaacccuaggcugacagacaguucucauauaucgucuguuaccacugaccacuuuauaauagcaagauucauucauucaacaaaucuauauuagcagauacugcuacgucuuagagaugcaccaggaaacaguggggacuuauuuuaaauggaauaaucaaggaaagguuuuuugaacccauuuuaagcugaggaaccaaucggugcaaaccucagagguucuaaaguguagggccuuugguguucugggaacugagaguaggccaaaagcagugcugcguagggucuugccaucucaacucuccuacuggcuuuagaauagagacucuuaaguaacgagaugguccuaucuuauauguuacaauaauaauguuaaugguuuuaaacuauuuuagacuuucagucuggaguagguucuguguauaacauguuucuacuguuuuuauauuuugguguuugggaaauaguguuauguccuauaggcuuuagguaaaacugaucuaauaaaucauuaacaauuaugccugcuuaaauaucuguuuuccaucuucuguuauguugaacuauauacuauuuggaaacuugaaaagaaauaucuaauuguuucaucugaaauagaucuuuuaaugaaaucuuaaguguuguagcaaaacuccaaguuuauuucuuaaagccacauaucugaaaaguagugguagcuaagacuuauuccaaagauuagaaaguacaagaugcuaguccacauuauucuauuguaaacuaccagaguuagguuucacuauguuuagcguugcucuaugaggaauccaggaaaagcaugacuuaaaacucuuuaauauuauuuuuuuccacuuauaauuguaacacaagcuggcacaauucuuaggcuugugggguuggggaauuggauaggggugggguaauaaugaaagguugacuugaggauucugguuuauaaggcugagggcugagcgcaguggaucaugccuguaaucccagagcuuugagaggccagggcaggaggauugcuugaggccaggaguuuaagaacagccugggcaacauugcaagacuuaaucucuauaaaaaaugcaugccuauaauccuagcuaccugggaggcugaggugggaggauugcuugagcccaggaguuugaggcugcagugagccaugauugcaccauggagacuccaucuguuaaaaaagaaaaaaaagaaaaagaaaaaaauuaauaaaaaaauaaaaauagggcugauaugucaccuuucaggauuuguaucucuuuuaacuuucuugugaggaaggaucuuuaaugaaacuaguuacaguugguuuguggaucauuuaucuaauagguauucaauaucuaaagacaauccauucauaaaacugguggaaucuguagguaauuaaguggguguuguaguugugauuuuauuuuaugucagaaacaaguuagguauaauuuauaaauagguaaauuuucuguuuuuuuaguagguagcauuuaaaccugucucuuauagauaaggaccuguugggggaaucaguguaagguaacaaauauuguuaaaacucaaaauuacauguguaggagauguuguauucuauaagaguaggugcugcccccuuaaguagaacuaaggaaauuguauuaggaagaguacugaauaaauauaacacuacaguuucucauuuacuagucaccagggagacugauaugaccauugccuuuaaaugaucauagggaauuugacuuacauucacccuaucacuucuugggagaauaugagugggguugaaagagaaucccucaggugcacagaauuuuaguuaaucauacugccugguuuaugauauucuaucaucauuggugucucagucauucuauuuauguuacuaaaugcaaaggaaauucagcuuacuuagaacuggaauuaauacagugugaggauuuuuguuuacuuuguuuuguuuuugucuugagcugcagucaggguguauaguuccuaaaggauuuuguugcuuaucccugccaugugaaccccaaugaggacaugagaccgaagauucaguguagugcauuuugcauucaguaaaauaaacuauuuacauaucacccauuuaauaugacaaauuugggacaaaagaauaggaaaucuaaaauaugaauauuguuuuaaaauucuaauucuucaugaguuaaagaaggccauucuuuuauuauuagaaugacauauuuuauuauauuuuacuuacuuuaaaaaaccuaucaguaagauguuucuuuuugcuuuucaggaaccgcggggaaaggcgaaugggugcuuuugaauguguucguaaaguguaucagacagauggacuaaaaggauuuuauaggggcaugucugcuucauaugcugguauaucagagacuguuauccauuuuguuauuuaugaaaguauaaaacaaaaacuacuggaauauaagacugcuucuacaauggaaaaugaugaagagucugugaaagaagcaucagauuuugugggaaugaugcuagcugcugccaccucaaaaacuugugccacaacuauagcauauccacaugguaagaagaguuaucuauuaaaucagaaauauuuucccaccccagccaacagcucacuuauuaaagcauuuauaauuuuacugcauucugguauaacaaaauacaauuauugggaguucauaaugagauuaaaucugguuaaguaauguaggcuguauuaauaggucaguauuaugcuaucaaauagcaugguggugauugagcaugagcucugaagucagucaaauuccagccuuacucacuucagcuuggugacuuuugggcaaguuucuaaguuuugaaaaaaguauguauguaggugcuauacuagauaguuuacauacauuacuaaucuacauaaaaauucucuaaaguacuuauuuucccuguuaugcuagaacauaaccagaauuguucuccuuuucaaauugaauacugaaaagaaauguaaacaugaaauaacuugcccaaggucacauaccuacuuaauggugaagcccaaauuugaauuaaagucuguaaucccaaagaccaagcuauuuuacauuauuucauguuggcaaauaaguauguguuaauaauuccuuuuauuucuguauuuaaauuuuauaauagccuauuucauuaauagcuagguaaaucacuuaagaauuuaucugcuacaugcugagguuuuuugguagcuuuuuugguuguuuuaagugucgcuuuugauuuuugcauguuuaagauuuguuuuuuaauguaagcgcuucauuuuuguucacuuacacugauuaauauuuaccgucuccauuguauauuauaucaggaaaaaugagccaggccuagaaaauguguauuugcucuaauaguaauuuaugaaaccaacucuuuaaccagguuggacuaugaacuuaucucaguuuccugaaggaaguuccugacuuuucuaaaagaagucaaaauaggacaguaucagcaauauuguuuagauacugaccuaugggguagguuaggaugguggccugcuaagguguaaggaacagaguuuugggguuuaaacagucuuuucccuugaagugagaugaugucauuacaggaagagguacaguugauaaacaagauacauucuuuuuuuuuuuuuuuuuuuuuuuuuuuuuugauaggaucucacugugucacccaggcuugagugcagucacaugaucauagcucccugcaaccuugaacuccaaggcucaauuaauccuccugccccagccucccaaguagcugggacuaugagcucaggccacuaugcccagcuaauuuuuuaauuuuuaguagagacauagucuugcuggguuccccaggcuggucucaaacucugggcucaagcgauucucccaccucggccucccagaaugcuagucaggcucaggcaugagccaccacaccuguccaaacaggacauuuuggaguuaaauggcacgaaucuuuaagacagaacagauuucaaguaaauaguuacaauugcuguggguugcuuuagacuauuucccuaggcccaucuggaauacugugcugaaaaaauuugaggaauaguggauguaaaaaaaaguaguuacauaggaagcugugaguucuugucccagcuucuacccacaacuggccaaaauuucucaguagcuccaauuucucaccuuuuaaaaugaggaaaaauuggacugacuaaucuuuaagguucauucagcucuuaaaaauuuauuauuuuugcuuaccugauucccagacuggguuuuauagcuggcagcuaguguuuggaacauugucaacuucuuuguccacaugauguuucacauucauauauguggacuguuuugaauagauuaauaaugcuauuguuucuuuguaguacucacuuuaaacaaaucuuuucugcuuguuucucacuguauccuuuuuauauucauccuggaugccaccucuuuacugccucuucaccuuuuccuccuucucauuucuauucuuccuuuuaucuguuuaucuagcauacaacugauacuucucucuuguuauauugugucuuuuuacauucaaagacuauaaagucuauaauuaauguacaugauuuuggccauauuagaaguuugauguuacuauaaugugacugguuucaauaagcuacacauuagaagccauccuuuuuuauccugagcuuacacuuacagacugauaaaugggaugugcucaguuauaauuagaagaguguaaagauaucaguaauguuuaauuuuauuucuuuccuacacagaaguuguaagaacaagacuacgugaagagggaacaaaauacagaucuuuuuuucagacucuaucuuugcuuguucaagaagaagguuaugggucucuuuaucguggucugacaacucaucuagugagacagauuccaaacacagccauuaugauggccaccuaugaauuggugguuuaccuacucaauggauagcagcacgaggacugcuguacugcaaaaaaagaagaccaaaagauuacaguggaccaugggauacagaagccagcauggcagacagaagaaaaauaguuugggaacauguaacuauucuaaguggaaguuuuguuguaggaauuauaguaaucacaccacauuacuuggccuuucgguaaugugaaaaaaaaaaaaaaccucagagccuccaaggaaaugccuuuagaagcacuccucucucaaaauugccauuuucucuaccaugucccccagacacaguuggguuuuguugauuuauggcagucuucuaaacaaagccauccuuaauuuuacauacuguauuguaacuauccaaagauaguauuggcagucauaaauuuauaacuucuggccuuuguuuaauuccaguaaaauaacagcaaugacaaugagaucgucaguauuauuuucacauuucccugagaggaccuggcacaauauuuuaaauuuaauuauuuggcaguagucacuguuuuugacaaccaaugaaauagcgucuaaauaucuuguauauuuuuuagcaucaaaauguuuugguuuccacugcugacaggugcuuguuguuuagccuaauguggauauuuaaauuguuaacauaccaaacacacaugguaauaguuugggacaaaauaacuaguaaaauguugauuucucggcuuuuucacugacugcggcauguccucgugucuucucugauuuugugguacaugaaugaaugcauuuaucuuuuuagugacuuacuaguuacgaacuugaauuaucaccucuuugucauacuuaaguaucauuuacauaaaguguaaaagauuuuuucacuuuugaaucuuuaccuacuugcuuucacauuaagaauuugaacuuuugaguuuuuuccaggucuauauauaauagauuacauuuauuuuguaaagaaaauaguaauuuaaaguuuugccauuuuaaggugacaauauuugggacaguauaaauauuauagacaagggcccccuugcugucugcuuuagcagguagugacauuaauugacuuauaguuuuguguaaaugaacaaacugcuuuugacaagaaauuuauucuguccuaguuuccugcgugguaaaucauagaaagauucaaguucauuuggguuaaaugugcuaauaggauguagcuuuuaaauucugcuauugagucagcuguaccuuuuaauacuuuaaauguguuauuuguauggcccuuauaaagguguuugcuguaauucuguuaaaagacuucgccuaugccauacugguguauaaaaacugccgcaauuggacgccggugugguacucauuucaguauaccugaacuguacauuuugugcaauggcuuuaucuaaaagaaugacgcuucgugaaagcacuuuguggccuuuuuugggggggagggugagagaguaggagagaauaccauguuaagauuaaaaaaaaaaacaaaaacauuggucacguauuaggcagaaacaguguucauaacauuuuucuggguuuuaaauauguuguuucggauauccuuaauauaaauguuuuagguauucuguguacccugucguacccccaacauuauagaauauugcagcgugucauugcaagcuuucucugcugucaccagugaaacauagugcccuguuaaauucccccacuuuaacuuccuugugaucaacaguaacuggauguuuuugaggugcucaauuggaauaaaaauauuccaaucuauuuggagaccaaaggcaaaaucaguuuucuuaccuuuggaauuauucguaccuuuuaugguaaauuucagcuuugacauguauuaugaggaacguaccaaaaaccgguuuguaacaaaucuguagagaaggucugaaucuaucguguuugccuuuucaggugccauuucuacugccuaauacagugccauuugccuugugaagacccauaaacauucauuguguugaauguaagauagagacucucccuagucuuacugaucucaguaccccacaaaugauuaagaaugauaugaaaaccagcagcuaaggaacaucuuauuauuuaguuguagcauauucauaacaaguguccuucaaggauaaacauauauucucuauuuguauuuagcaaguaaaacuuguguugaccuuuagugcauuauauucagcuuuuaacaguauuauguauguacuggaaagcaaagaaaucuuagagucuuggacauuguuuauuugugcaacaacuagaaaggagcaaugaaguuuauuucaguuguauuuuucccuaagcacaaucugcaauaguuuauguaugacagagauaauucaaaaaggaaaacuauauauaaaaguuguauauaaaguuugucucugaaauauuucuuugaaguuuuuaaaaaaucgacucauguuuaaaaacaaaaacacauauucagagcauuggacuuuuuuaacuuguuuucaucuguuuaucaugacuuuuuuauuucugguguagaguccacauuauuuaguuuguuguacuuuuaaauuucaaaguucaaaucugaagaauuagcguuugugauuucgggauaccaugcagugguuuuaaucccaggaaaaaaacuaucaccaaaaguucguuugauucucauuauguaacuuuguagaaccauccuuucuagauggguccaccacagugaauuuguaacuuugaagucaggauagaauaucauuagauuaucugugagauagcauuacuauguuaggaccagcagaguuuggguugguaaaaauaauguuugcucuauuacuggguuacagacauuucagcauuuuuagguugguuuuaaaucacuaaaaauauuuauucggauuugaaggauuuaagugcuaaaaaucaauccauuucuugcccuucaauaauuguccaugccugccuuuuguuguuuacaugcucuucugcccagacuguuaguaaucuagggacccccuuuggagcugauaaguacaguucagccuuuucuccucaaauauauaaugacuuuaacauuccuaagaauauagguauuucugaaugauuuaaauuugaggaauuuuaauacauaaaauacaauguacaaacuuucugcccacucagaucucuucuccaucauguacuuaguauuucccauuaaccuacacacugauuuuuaugcuacuccuuguagaaacaaaauucugguuugacucaguuuuuguguuuauaaacuuuuggaauguguaccccguuuaugugaagaauuaugaccuaucagucauagcuaaauagugaaccucaaaaguguuaacuuuugacuauucaugugagguuugguaucuugcauuuauguacauggcuguaaauuaugugcauuuacucuguauuuauguuaucuagcugacuuuuacuugaauuguucaaauuuuaaaaauuaaaauacgcucaugaaaauaug

SEQ ID NO: 192090 - RNA, 103955 nt, Homo sapiens
augugcuucaguuucauaaugccuccugcuauggcagacauccuugacaucugggcgguggauucacagauagcaucugauggcuccauaccuguggauuuccuuuugcccacugggauuuauauccaguuggagguaccucgggaagcuaccauuucuuauauuaagcagguauguuaauagguauaauuucuauguguuuagcauacugugucacuugggggaaauaucauucuauaauagaaaauguuaauguaaauuauaugugauaaugauaguaaugaagugaugguaauuaagaaaaauuaguuuauguuagcuaguuugaaauguuuguuuggguuauuaaaacugucaagaagauuuucuuuugaguucgucuuugaaauuacugucuuugagcuugucacacuuuuaaaaaugugauuuuugguucauuuucucuucucuccuuuuucuucucuucccccuuuccuugacucuugggggaagaaagacuuuucugcuguucaccagauauuuuucccucagcaggcuugccuuuucuguugcauuaguuuuuaaaguaaauugaugagcaccguugauuuguaaaaaccagcauauacaugaacuuguuuuucuaaacuuucuuucuaauguuuuucaaaaagcugaacccaaugugaauaucaggaguuacgguauuuuuaagaaaacauauuuaugauauaccucugaaaacucuuggcuuuggacaagccucuuaacuccuuuccaagcuucuucauuagagaaacuggaauucuaaaauggcaugauccuuaaaguaaaaagaaaauacagaauugacuuaagcaucucauacgcucaugcauggugcaccuauuuuuauagucaccagugacaaguauggauuccuauggcuauacuucacauuagauuaaccauuuaucucuuuuuaauugugaaauauacauaaccuggaauuuacuauuuagacauuuuuaggugugcauucacagugcugugcaaccaucaccaguauccauuuccagcacuuaaccaucaucccaaacagaaacuucauacccauaacugccccuuucccucaauuccuuuuuauuucuauucuguuuuccaucucuaccaguuugccuauucuugguacuuuauauaaguggaaacauacaauaaauagcuauccuuuuguaguuggcuugcauagcauaguguuuuuaaaguucauccauguuguagcauauauccuaguuucauucccuuuuauggcugaauaauauuccauuguauguauaugccacauuuuguauauuuaucuguugaugaacauuuggguugcuuccagcuuuuggcuauugugaauauuaugcuacucugagcauugguguauaaaugucuguuugaauuccugcuuucaguucuuuuggguauauaccuagaagugugauuguugguucacagugguaauuccauguuuuaacuuuugaggaacugccacacuguuuuccacaguggcugcaccauauaauguugggaccagcaguguacaaggguuccaguuugucuacauacuggccaacacaugcuauuuucuccucgcucccucccucccucucuuccucccucccucucuuccucccucccucucuuccucccucccucccucuuuuccuaccuccccuccuuccucucccucuccucccuuccccuccccucucucccucccucccuucuuccuuccuuucuuccuuccucuuuucuuacauuauuucuuuccuuuuuuuguuugucuaagagauacgaucuuguuugccauauuuucuguguguguguguguguguguguguguguguguguguguguguuuaauaguauccauccuaauggaugugaagugguaucucauuguggguuuuuuuuuguuuuuuguuuuguuuuuuugagacggagucucgcucugucgccagacuggagggcagugucaugaccuuggcuuacugcaaccuccgccuccuggguucaagugauucuccugcuucagcauccugaguagcugggacuauaggugcacaccaccaugcccagcuaauuuuuguauuuuuaguagagaugggauuucaccauguuggccaggauggucuugauuucuugaccucaugaucugcccaccauggccucccaaagugcugggauuacaggugugagccacugcacccagccucauugugguuuuuaugugcauuucccucaugacuaaugauguugagcaucuuuuuaugugcuuguuggucauuuguauguuuuuuggagaauuaucuuuucuagaccuguacugauuuuuaaacuuuguuuucuguuauugaguuguaggaguucuuuauauauucuggauauuaauaucuugucagauauauaugauuugcaaauauuaccucccauuuuguugguugccuuuucauucucuugauaaugucuuuugcuguacagaaguuuuaaguuuuggugaaguucaguuuaccuuuuuuucuuaauguuacuauuuugagccuuuagaaugaaaaguuuaccuaucauuauuauuauuguuguugcuuguacuuucuccuguauguuuuauguaacugaaucugagcugaggauuggccacaauuuuuaacucaggucuguuauuuucagcucuuagcuuuuguacuggcuguuaacaaaauaugcaaucccuuuuuguuuuuguguggugaacuucuuuuauauuaucucauccaggagacauggaaagagauguugagagauugauuaugaucauucugacaggacaguguuaguaaggauaccccugauaaaagaaaagagugcaggacaaaaauaauuuaaauauuguauggagguggugauacauacuuuaaauuaaaauuuuuuuuugauuacuccugaucaguaguuucugcuuacaggaaagugaaauaugaaaguuuucauugagucuuacuugucauagauaauuugcuuuuaguaauuucauuuauaaugcauuuuuugugcacuaugccauuauauuacccuacaaacaugggauaauaccauauauacucuccuauaauuugcuguuguaagaaaacuugaauauuuuguaugguuuuccauuucagaaugaauuuauauuuuuuucuauuuuucugaauauauuucuauuauuuucaccauucuguaauauucuauaauucauuuaaccaaucuuuuauugcuaaacauuugauuuguucauaguuuuuuauuuuuacaaacagugcugcagugagcauccuuauaucuuuguacacuugagcaaguguuuccauuccagaaaaugucuuauuuuuucucauagauguuauggaagcaaguucacaauuacccaauguucaaccuccuuauggauauugacuccuauauguuugcaugugugaaucagacugcuguauaugaggagcuugaagaugaaacacgaagacucugugaugucagaccuuuucuuccaguucucaaauuagugacaagaaguugugacccaggggaaaaauuagacucaaaaauuggaguccuuauaggaaaagguaaauuaaaaaauaaaaaaaaaguacaaauucuuaauauaucuauuuauauaaacauauaguaaguauauuuaagacauugcuuuucaaagugugguccauggaccacugcugaucuguaaauuguugccaguuugagauaagguaaguauagaaauugagaauaaauguuuagaaaccccuuuagcaauaugauauugccauagcauccaagggcuuauguuuaguauauguuuuuguugucuaaugauuuauuauuuauuuaauuuuuaaaaauagagacagggucucacuguguuguccaggcuggucucaaacuccugggcucaagugauccuccuaccuuggccccccaaagugcugggauuacagguaugagccacugugcauggcugauuuauuuuuauuuuacaaaaauauugaucuuugauggauuggaaagaaaaaaguuguugcuuuaccucagauuguuugagaaguccuugacuaaaggagacauuauccuuaguuucuuaugaacugcuccuauagaaugaacauauuuuauacacaacucucuaugccaaccaagacuuuaagcuguuugauguuuccauaaauaaauuauugacaaauuuuacuucuuaacugaaauuaucuuuaaguagaaguuauuuugguagagagucaggaaauaucauguccacauuauuccuugcaaauuuauuccauggaaaauugugaguaacacaaucaagaacauggaggagucucucuugcuauauaacauuaggagucucaggggcuaauguuuuaucaauaucuugcuuuagagaggguacugacuugaauuaggaacuacaaaagguuacugaggaggggacuuuauaguuuaaauacaaaaccagaaaauccacuggagauuuauguaucuagauuggguaccuguauugaucagauucacuguuauaggauaauauaguaccauccccuuuaaaauacuauucuuugaucuuaacccuauaauaauucaggcuagcuaaugauuauacugugggacuacucccucugagugcauagaaccuuguuaguuuacuaagggauacucugauauuuaaaaauauuugauuacuucagaggguggcuaguuuauuuuuggcaauaaauuuuucccaguuaacaaguuuauaguuauguaucauacaaaauuuuuucuuauauauuagugacauauaauuagaaagcauuauuagaaagcaugccuuucuauuuucuagagcuacaaagguguguuuuguuuuguuuguuuuuuguuucuguuuuuguuuuuuuggugacaaggucucgcccuguugcccaggcuagagugcagugguacgaucauggcucacuucagccuugacucgacccucagucgcaagcgauccucccaccucagcguccuaaguagcugggacuacauacagaugcaagccaccaugccuggcuaauuuuuguauuuuuauuauaguagagacaggguguugcccaggcuggucucaaacuccuggacucgagcugucugccugccucagccuucagagccacagcaccuggcccaaauauuuuuauagaauuuaaauuuuuguccauuauaaaagguuuucccuuuguucucaugcccauaaaaaguugaagaauauauggaagaggagaaagaaagaaaaaaaaucacuuauagucuuaucauccaggacaaguauauugaccgacaauauuuugauauauuucuuuugaauaaauuauauguauuucaaggcuuuuauuuguuuuuguuucuguggauuaaaauacuuagcuuuucuguauucucaugcuaauguaagaaagcaaaccagaaccacauugauuuuuagggaagcuaaaauauuuguuaauccaaaaaguaccacagaguaggccauguucuuuuugauuuuuuuuucuuuuuuaaauagggucucuuucugucaccuaggcuggagugcaguggugcgaucucagcucacugcagccucaaccucccaggcuuaagugauccuccuaccucagccucccgaguaguugagaccacaggcauaugccaccaugcccauguagauuuuagcauguugcccaggcugguaucaaacuccuaagcucaagugauccaccugccuuugccucccaaagugcuaggauuauaggugugagccauugugcuggccuuuuuauuuuuauuuguauuuauuuauuugauacagagucucacucuguugcccagacuggagugcaguggugcaaucuugacucacugcaaccucugccucccagguucaagagauucuccugccucagccuucugaguagcugggauuacaggcaccugccaccaugcccagcuaguuuuuguauuuuuauuagagacaggguuucaccauguuggacaggcuggucucaaacuccugaccucagaugauccgccugccucggccucccaaagugcugggauuacaggugugaaccacugcgcccagcuguuuuuguuuuuauuuuuaaauugagacagggucuugcccuguacccaggcuggaaugcaguggugcaaccaccagucacugcagccucagccucccagggucaagugauccucccaccucagcuuccugaguagcugagugcaagccaccaagucuggcuaauuuuuucuuuuuuuuuguagagauggaaucuuacuguguuacccaggaugugggccaaguuucuucaaggcauugguaucucucugaaauuuaccuccuucccaacauuuaccaaaacauggauucauuggccaccauuaccucuuccuaugccugccaaauguggcaaauaaaaauauugaagauugaaauauuacauaugcugugcuuaugcuaaaaacauauucauuguuuaucuaaaauucacauugaauugcgcauacuguuuuuuuuuaaccuggcaaccuuaccuuuuauccuaccauagcauagggguauaaucuauauuagacuaaugaauuuaauuuuuucuuuuuuuuuuucuguugagacgaggucucacucuaucacccacucuggagcauaguggcgccuuuuuggcucacugcaaccuccgccucccagguucaagcaauucucccaccuuggcuucccaaguagcugggacuacaggcaugcaccaccacgcccaccuaauuuuuguauucuuuggcauuuugauuauauacacaaauuuaaauguuaacauuuauuuaagaaauugaguaaguuguguauuuaagaaugaauuuucacuuuuaauacuugagaagucaagucaauuuuugcaguugcugauuugucugugaugaccauggcuugaugaggccaugccuccugggaaaaaauauacaauuauuucaguuuaacuuuaggaacaagguugccaccuccucucuccaaagaaaacaauagaaccuuuagagacguaauugcccugacuaggcuaaaaauaccuuuuccugaaagaugauguggcuaaucuuuuuuuuuucuguguuuauuccaaauaauuauuuacagagcuguuguuugaguucuguuuguucucuguaguaagguguaugccaccccauauuaauuucuccaaacacucaguaaaagaaucguaaucagaggauuuuguuagcauucugaaaaacauauuuguaaacucccuuauuucuccugaccuaucuaaaccugugguauaccuuaagugagggaaauagcuagucuguaggauuuuuuuuuuuuuuuuuuuuuauauacagagucucacuuuguugcccaggcuggagugcaguggcgugaucuuggcucacugcaaccucugccuccuggguucaagugauucucaugccugagccuccuaaguagcugggauuacaggauugcaugacuacacccagcuaauuuuuauauuuuuuguagagaugggguuuugccacauuggcuaggcuggucucgaacuccugaccucaagcgaucugccuaccuuaagccuuccaaagugcugggauuacaggugugagccaccauguccgaccuagucuguaggauuuuaacacccucuuuaguaugaauaaauuguucacucaguacuuuuuaaauauaaaaauuauauuugacuauaaauuuuacaguagccuuaaggaaaauuuaagcuuugcuguuagauucucuuagaagaagguauguaggguauuaacuagguuuaaaauuaaauuacuuagcuuaaaguguucguuauuuuugauaaaauuucuuuuuuuuuuuugagauggagucucgcucuaucgcccaggcuggagugcaguggcgccaucucggcucacugcaagcuucaccuccuggguucacgccauucuccugccucagccucccgaguagcugggacuacaggcaccugccaccaugccuggcuaauuuuuuauauuucuaguagagaugggguuucacuguguuagccaggauggucucaaucuccugaccucgugauccgcccgccucggccucccaaagugcuaggauuacaggcgugagcuacugcgcccggccuaaaauuucuguauuuaagagaucuuuauggugguucccaaauuuagauuguaucaguuucuuaaaaugaauaugcucagagauugggauucagugugucuggaauaaaugaaagcuguauuuuuuuaugugauucuaacaguuacaugaacagggucccuuauucauaauauauugaaaaacauuaccaaaacauuagugauugcaguucaguaguauugaguguuuauacuugaaauuuuaccagugaccgugggugauauggucucugcuuagaccucacaauccagugggaagugaggaucaguaaacacaguuuuauugcaauguauuaacugcuaugcuaugucagaaagggucaccuucaaauacugugugaucucacuuaaauguggaaucugaaaaaguugaacucaaaguaaacaguugaaugguaguuagcagagccaguugggggcauagaaagggguguauugggcugggaaaggggagacauuggucacuggguacaaaguuucaguuagcaggaauaaguucugguguuccauugcagggguucuccucugcucccuguugcugguuaggaaccaggccgcacagcaggaggugagcagcagguugggugagcauuaccaccugaacuucgccuccugucagaucagugguagcauuagauucucauaggagcuugaaugcgaagaauccuauugugaacugcacaugugagggaucuagguugugugauccuaaugagcgagaaucuaaugccugaugaucugagguggaacaguuucaucccaaaaccacccccacccccauucuauugcauagcaccgugacuauaguuaauaauaauguauuguauguuucaaaauauuuaugagagaauuuuuaaauguucucuucacaaagaaauaauaaauauuugaggugauagauaugcuaauuagccagauuugaucauuccacaauguauacaugugucaaaacaucacauuggccgagcuugggggcuuauuccuauaaucccaguacuuugggaggauaagguggguggaucacuugagcccaggauuuggagaccagucugggcaacauagcaaaaccccaucucuacaaaaaguacaaaaaauuacucaggcaugguggugugugccuguagucccagcuacuugagaggcugaggugggaggaucacuuggcuugagcccagagguugaggcuccagugagcugugaucaugccacugcacuccagccugggcgacagagugagacccugucucaaacaaacaaaaaaacucuaucacauuguaccucaaaaauacaugcaauuauuauuugccaauuaaugaaaaacaaaacuuuugaaaaggaaagucaccuuaaaucaauuaggugaaucagggaugaccucuuagaagauguauaccuacacugagccaucaaugcugauuaggaauuuggcagguaaagagagguggagaaaggaaaaaacaaaaagaaauggcacaugugaagaauggccuauucaaggaaaagaaauugauuaugggugguguagggggacagauaggacaacuaggaaagacuagagaggcagccaucugcagagcauacagugccauccaggccauguaaaaaguagagcuuuacuacuaagaacacuugggaagcuauugaagaaauauagguaggggaguaacgugauaaauuugcauuuuagaaagauuauuuagguuguagaaugaagaguggauuggagggauuaagaauuugaauagagaaauuagugaaaaaauguuguaacccaaaggaagggugaugauggccaggauuagguuaauguuuacaggaauugagagaaguggacagaguugagagacauuuagaagguggguuaaacaugauuuguagcagauuaagggaaauaaagcauuugauuuuuguuagauguauauauuauuggguacuuauuucccuuucgucaccuguaauaccuauugccugugaauagaaugaauauuaacagugcacuaaaaugcuucagccauuccacccaaauuacaguccauucauagcuaauuuagaguaauguauuuuauuccagaucuaaaacuauccaggaaaucauuuuaccuuugcuguguuauaccuuugcuguguuuuauuuuucuauauuuaauaccacaaaauugauucuaggauauauuuuugaaauaacaacuauuguuuucagugcauaaaaguaaaaagacaaugcaacccuuacugacaugcauauguucaaauaguauaguauagauuaauuuuauggaauaaaaaguaacuuuccucacugugcauuccucccuaauacuacaaaauaccacuagcaauagagucaucucaaguauccaaaacaaaaacuuaugcauauucuguauucuuccuuuugaauuuucagaaaagggauuuuaccugacccauucucuaccuacuuuuaaaaaauaucuggugcccuuaaaaacacaaagauugauuguauuuuuaucuccugcaccacuguauaaugauacauggauguaucuuuauuuaaccaguccugaaugauggccuuuagauuacauuuuaauuauuauacacaaaacugcagcaaauauucauauauugauaguauauccauagguuuguagaaauaaacaaagaccacucagaugagaacagagacuauuuaugcagagguugcuauaguaaaagaacuugagcuuggcagagacucagaggcaggcaggggagugggaaagcuuuacagugaaaaaaaagggaagguuucagagaugccugaugggaaauuauuggcagcagggagcuggaggugggcuaauuagaagcaaggcaucuuaugugauugguguuggguuaguauacuuggcuuucuucguugguccugaaucucucagguugagauuacgauugauaaaauugugaggucuaaggauguguguguguguguguguguguguguguguguguguguguaugauuucuaauaaauauugcaaaauugcccuccaaaaaguucauauuaauguaguuucucaacaaaacuauacuagaaugccuuuuucucucugccccuuccagcacaggguauuaucaaauuuuaaaauaugugccaaccugauagguaaaaauaaaugcacacauaaacauuuauguauguugauucauucuuuuagauuucuaaaauuauuuacuggaauaaucauaaguuuuugaaaaaguugucauauauaauugucuuaauggcagaagugacuaaaaauuaaguacaacccauccuucagcaauagguuugaacugugcagggccacuuauacguggauauuuuuuaauacguauauugaaacuuuuuuugagauuugugacaauuugaaaaaacuugcagacgaaucacagccuagaaauagugaaaaaauuaaaaaguuaagugucauuaaugcaugauauguauguaucauuuacuaccauaaaauacacauaaaucuauuauaaaaaguuaaaauuucaaaacuuacauacacagacauuuagacaaccauacauggugccauuugcaguugaaagaagugcaaacaaauguaaagauacaguauuaaaucauaacugcauaaaauuaacuguauuauacuacuguaauaauuuugcagccaccuccuguugcuauuguggugagguuaaguguugugagcauaugcucagaaaugccaugugacucuaaucaucuccacuugagcaguuucucugucuaguaaauugcauauugcaguaaaaagggaucucuccgaguucucauguauuuuuuaaauuguguuuacuggaauacugcaaaccuugaauaacacugugggacccauacaaaaugcuacuugugauccuggaaguacuucuaagaacagagaaaagucaugauauuauaagaaaaaaguugaaugcagcugggugcacaggcugaggcaagaggauugcuuaagcccaggaguucuagguacuagugugcugugauugugccugcaaaugccauauauauauauauauauauauauauauauauauauauauauauauauauauauauauaaaggcugaauagcuugauauguacuguagauggaggucugcagcugugguugccugccauuucgagauaaaucaauccaguauaaguaccauugugaaaaaacaaauucaugaaacugucgccgcagcuaugucagcaggugcuaaaccuugcacuuuuugugaaucaccuuuuuaucucagaguaaaaaugcagcuuguaugugggugcaggauugcuauaagaaaggcauaccaauagacucuaaucugauucaagaaaaggcaaaguuaugugacaaagcaauaagaaacugaaggaucuaguacaggagaauuuuaaugcuagcaaaggaugguuugacaauuuuauuuuuauuuauuuuuauuuuuaauuaauuaauuuauuuauuuuugagacggagucucacucugucacccaggcuggagugcaguggcgugaucucggcucacugcaagcuccaccucccagguucaugccauucuccugccucagccucccgaggagcugggacuacagguccccgccaccacucuuggcuaauuuuuuuguauuuuuaguagagaugggguuucaccauguuagccaggauggucucaaucuccugaccucgugauccgcccuccucggccucccaaagugcugggauuacaggcgugagccaccgugcccggccgauuugacaauuuuagaaagguuuggcauaaaaaaaaucaagguaacaggagaaguuauuuuuccugaccuagaaauagcagaugaguucccagaugccauuaagaaaaaucacugaggagaauagauaccugccugaacagauuuuuaguguuuuguuuuugagacaagaucucacucuguugcccaggcuguauccuugcccuccugggcucaagugauccucccaccucagccuccugaguagcugggacuacaggcaugcaccaccaugcccagcuaauuuuuaauuuuuuauagagaugaggucucacuauguugcccaggcuggucucgaaccccugaccucaaggaauccucccaccucggccucccaaaauguugggauuauaggugugagcugccuugucugacccugaacaaguuuuuaaugcagaucaaagugcccaauucuggagaaaaaaaaugccacaaaggucauuuauuaggaagagaagucagcaccaggauuuaagacaggaaggcuaacuacuguuuugugcaaaugcagacuaguuugugauacacuuuauuuguaaagcugcuaacccccaagccucgaagggaaaaagaaacaccagcugccagucuuuugguuguacaacaagaagaccuggacaauaagaacccuuuuucuggauugguuccaucacugcuuuguucugaagucaggaacuacuuugccaguaaggggcugccuuuuuuuuugagauggggucucacuucaucgcccaggcugcagugcaggggugcgaucuuggcuuacugcaaccuccgccuccuggguucaagcgauucuccugccucagccccccaaguagcugagauuacaggcacacaccaccaugucuggcuaauuuuuguguuuuuaauagagaugggguuuccccauguuggccaggcuggucuugaacuccugaccucaagugauccccccaccuuggccucccaaagugcuaggaugacaggaggauuauaggugugagccacugugcccagccuagggacugccuuuuaagguucuuuugauauuggaugaugcccguggccacccagaacccccugaguucaacacugaaagccucaaagugauuuacuuacccccaaacacaacaucucuaauuuagccuaucaggaggucauaaggaccuuuaaggcucauuacucaugguacucuaugaaagagaaccuggauagaacaucaugaaagucugggaguauuacaccacugaagaugccaucguucauauagaaaaaguugugaaagcuaucaaacccaaaacaguaaauuccuguuggagaaaucucugucccgauauuguacaugacuucacaggauugacaacagaaccaaucaaggaaauuaagaaauagauugugguauggcauaaaaggcagcagugguggugaaggguuucaagauacagaucguggagaaauccaagagcuaauaaacaccacaugagaggaauuaacagaaaacaacuucauggagaugagugcuucugaagcagugccagaugaugaggaagaagauguagaagaaacagugcccgaaaacaaauucacaugcaacagucugacagaaggcuucugauuauucaagaaugcuuuuuacuucuuuuauaauauggccccuucuaugauaccagcacugaaacuaaagcaaacagugguaggauugguacuauacagauaaacauuuuuacagaaaagaaaaagcaaagaagucagaaauuaugauguauaucugugaaguuacauacaguaugccugcgucugcugccuccccuuguaccuccuucacucuucugugucugccaccccugagacagcaagacuaaccucucccccuccuccucagccuacucagugugaagaugaugaguuaugaagacauuuauggugauccacuuccuuuuuuuuuuuuuuuuuuuuuuuuuuuuuugggggagucucgcucugucacccagucuggagugcagugacacaaucucggcugacugccagcuccgccucccggguucacgccauucuccugccucagccucccgaguagcugggacuucaggcacccaccaccacgccuggcuaauguuuuuuguauuuuuaguagagaugggguuucuccauguugguaaggcuggucucgaacuccugaccucaggugauccacccgccucagccucccaaagugcugggauuacaggcgugagccacugcgcccgaccaauccacuuccucuuaauaaauaguaaauauauuuucacuucuuugugauuuauuuaauaacauuuucuuuuuuucuaaucagaagagugcuggaauaauuaacauuuucuuuagcuuacuuuaggaauacaguauauaacauguauaacauacaaaauaaguguuaacugacuauguuguugguaaggcuucuggucauaaguaggcuauuaguaguuaaguuguucaggagucaaaagggacauguaggccgggcauggugacucacacuuguaaucccagcacuuugucagacugaggugggaggauugcuugagcccaggaguucaagacaacuuggacaauauagcaagaccucaugucuacuaaaaauuuauccagacauaguggcaugugcuugugacuguaauuucagcuacuugggaggcugaggugggaggaucgcuugagcccaggagaugaaggcuacagugagccgugaucacaccacugcacuccagccuggguaacagagcaagauucugucucagugaaugaaugaaugaaugaaugaauguuauaugugaauuuucuccucuguaggggguuggugccccauccaccauguuguuugagaaucaaccaaacaauaaagaacaauuuuauguuuaugggauuuuugacuaacuaaaacaauauaugauaaccauuuaaaaaucacaaugaacugaaaauucagucuauaaaauuuaaguguacuagguuuucuuugguuuguuuuuguuuuuuuaaagacuaugaacaguuuuagguucacagcaaaauugagaggaagauacagagauuuuccguauucccucugccccuguguauuguagccauucccauaguauaccaaguuuuggugaaauaauaacuugauucuuaguuuucuucuaauauaguauugaaacuguuuuucagauucuuagucuuucucacauauuuuaaaugugauuuauuaauacuugguuuguaaauaaaaacaaugaaucuuuuauguguggcuuuaaaauauguauugugaauuacuuuguaaaacugguaggcaaacuacauuucuuuaugagguuuugaguuguauuuuuuaaaaaaauauaauuguauguuugucuucuguacaugagauuuauuguuuuaucuggguuuuuugaucuuuaaugguauuuuccucccuaguuucaucugcuugauaaaagccaagcauccaacauccaaguuaguuuuuguugaauauacuuuguauucuuucuauauucuuuuauuauuguuaguuacugaaaaugacaccuuuaaaaaauguguuuaggucugcaugaauuugauuccuugaaggauccugaaguaaaugaauuucgaagaaaaaugcgcaaauucagcgaggaaaaaauccugucacuugugggauugucuuggauggacuggcuaaaacaaacauauccaccagagcaugaaccauccaucccugaaaacuuagaagauaaacuuuaugggggaaagcucaucguagcuguucauuuugaaaacugccagguaggauuauauuuuuuuaagaaauauuuuguaauaaauuucucauuuuuacccgaauacaacugcauuuuuagaagugucugucgcuugccuagcaaacacuauuagaaagaacaauuuuauauuucagauagaaauguauuuaggauuauauauaauagucuaaagugauauucuguacacguaucuguuuugauacaguggaauggugauuuagaaugggauuggcaaacuggacuguuuaauugguuuuuacaguuuuaaagggauguuaaaaagagaaaaaaaccucaaagauuuguaaagggauguuuaaaagaagaagaaguaaaaagaauaugcaacagagaccacuguguuguauguuguuugccaaaccugguccuuuacagagaaaguuugccaguugcuggucuagauaguguuccuuauuggaaauauuuuuuucucaugugacuuuucucccccaucgguagaaaugaaagccuaaucaaaauggucucuuuguuuccauauucuuaaauuugcauucugugacuaugugaauuaauuaaugauauggaaguaggcauuauaauagaguugauauacagcccauccauuucugaauguucauagcaauuauacaaacuagaugaugcuacuacuguuguaucaaguauagugguucuagcaucuagggucuggcauuagauuaagguagaaacucaaggauuuuuuuuuuuuuuuuuagacggagucuugcucuguugcccaggcuggagugcgauggcgcaaucuuggcucccugcaaccucagccccccagucucaagcaauucucuugccgcagcuuccugaguagcuggaauuacaggcgccugccaucacaccuggcuaauuuuuguauuuuuaguagagaugggguuucaucauguuggcaggcuagucucaaacuucugaccucagaugauccacccaccucagcuucccaaagugcugggauuacaagcaugagccacugcacacagccagauguuuuguuuuguuuuguucuugaauuacugugaauaaccauagcaaugacaacaaccaauuaugcaggguaagugcucaaugacuuaacagucguuguucuguguugagcacuuauucugcauaauuccugguauggcuuauuuuucauauauucuccaguucccacaccaaccuuacaagcguuguugucuuucccccaucuuacagugaagagacugaaaggaagacaaguuuaguguuuugugccaguccucauagcuggucagugguagagccaggauuucauccaggugucucugguuuuacccaguuuugccuccuuuuagacaacauguuaauaaguauuuguuaggacagaugugaaaaaaagauucugccuucaggcauuuucucuaaacaaguaaguuuaucuagggaaaaacaccauuugucauucuguccugagauacguugagucuaaaguucaauuuaagucaagauuugaguaucauuaaaaugucaaggucaaauuuacaauacuguuuaaggaauucuccguggucaagagagguagaauaggggaauuuacuguugaaaggugaugagaguucaacuugagaacacuggcuuuaccaggugagguggcgcacagccacuuugggaggcugaacagggaggaucucuugaacccaggaguucaagaccagguugggcaacauggugaaaccccaucuguacaaaaauuaccugggcaugguggugcacaucuguagucccagcuacccaggaggaugaggugggaggauugcuugaucccagaaggcggaguuugcagcgagcccagauugcgccaccacacuucagcuugggcgacagagggauaccuugucucaaaaaaaaaagguacaauauuucaugaagucauugaaagugauaaugaacaacugcuugaaauaugggaaaacuauuaggauauaagaucauuggugucuuacugggaggugaggucaaggaggaaagaggaggcaugcgacuucucaaaaugauuccuagcauccuagccuguguucuuugaugugugugacacugucuuagucuguuugggcugcuguaacagaauaccauagacuggguggcuuauaaacaacagaaauuuauuucucacaauuguaggguuuuuuguuuguuuuguucuguuuuguuuugagacggaguuucacuuugucguccaggcugcagugcaguagcaugagcuaggcucacugcaacugccccguuucagguucaagggauucccugacucagcuuccugaguagcugggacuauagacaggcaccaccacgccaugcuaauuuuuuguauuuuuaguagaggcaggguuucacuguguuugccaggcuggucuugaacuccugagcuuaagugauccacccgcuuuggccucccaaggugcugggauuacaggugugagccacugcaccuggccuguuucucacaauucuggaagcugggaaguccaagaucaaggcaccaguucauuccgugucuuaugaggauugcuuccuggugcauacauaacuaucuucuugcuauguccuuacguagcagaagaggagaggaagcucucuggggucucuuuuauuuuuuuuuuuuuuauuuuuugagauggagucucacucugacaccaggcuggagugcaguggcacgaucucggcucacugcaacuuccaacucccugguucagggauucuccugccucagccucccgaguagcugggacuacaggcaggggccaccaugccuggcuaauuuuuuauauuuuuaguagaggcaggguuucaccguguuugccaggcuggucuugagcuccugagcuuaagugauccgcccgccucggccucccaagaugcugggauuauaggugugauccacugcaccuggccuguuucucagaauucugaaagcugggaaguacuagaucaaggcacuaguucauuaugagggauugcuuccugguccauacguaccugucuucuugcuauguccuuacauggcagaagaggagaugaagcucucuggggucuuuuuuauuuauuuuauuuuauuuuauuuauuuuuuugagucggagucucgcucugucgccaggcuggagugcagugacacaaucucagcucacuacaaccuccgacucccugguucaagugauucuccugccuagccucccaaguagcugggacuacaggcaugcaccaccaugcccagcuaauuuuuguauuuuuaguagagacaggguuucaccauguuggccaggcuggucaugaucuccugaccucauuaucugcccaccucggccucccaaagugcugggauuacagauguaagccagcgugcacggccucuggggucucuuuuauaaggacacuaaucccauucaugaggacucugcccucaugaccuaaucacaucccaaaguuuucacuuccaaauaucaucacauuagagauuagguuucuacauaugaauucgccaggggagacacaaacauucagucuauggcaggcaccaacucauagaaaacacagaagaacaaguaaaauacuggaaaaaauagaugugaaauaguaaguuuaguuuuuaaaaguuugaauguaagacaucuuaaauucaggggagugauuuauuuaaauuaaauuaguggaaaauauuauggaauugaugucaggucaguauagagaauagcaauaaguuaguuguucagaguagcaguugguugcuuugggagauagcuucuuauaucuuuaguauaugaucauauaaugaaaaauuaccuugcuagauuaugagaggauucagguguuaacuguaucauucagucuuaugaugaacagauuugguaaugcuauaucgauuccaaacuauaucuucauuuuuaauugauuagaauuucuauauguuucuauuuacaugucucuaaaauuggacguaauugcuaauuuaugguuuaauucguauaaaguauggcugucuucuuaccagugagaaauguguaaguuuuuaaaaauauauauacaaaauauagcugcaguauguggccgggcaugguggcucgugccuguaaucccagcacuuugggaggcugaggcaggcggaucacaaggucaggaguuugagacuagccuggacaacauggugaaacccugucucuacuaaagauacaaaaaauuagccaggcgugguggugcacgccuguaauccuagcuccucaggaggcugagacaggagaauugcuugaaccugggagacagagguugcagugagccaagaucgagccauugcgcuccagccugggggacagugugagacucugucucaaaaaaaaaaagaugagauguucauuggaaaaugccuaaugguaaccuuuaguuaaauauuaaucuuaccuguggaagcugugcacuaugaauacaguaagaugacuuucaaauuaucagaaaucuuuaucuuucaguaaacuugucuacauucuaaauaugcauccauauaaaauuuguuaaggauguacccauauaaauauuauguacauuuguacauauuauuacauaaugauuguaaugugauuuuucagcauaaauauaacauuuacugcuuuuuuccccaucucccucccccuucaggacguguuuagcuuucaagugucuccuaauaugaauccuaucaaaguaaaugaauuggcaauccaaaaacguuugacuauucaugggaaggaagaugaaguuagccccuaugauuauguguugcaagucagcgggagaguagaauauguuuuuggugaucauccacuaauucaguuccagguauguauauuaacuauuaauuuaccagaaaagucuaugaguauauauauauauauauauauuuuauuucugacuuuaaaaauguguucccacacuggaacauuuggaauauacagaaaauuauacaguauuaaauaguaaauauucauaauaguacuuaccucugagauaaucauuguuacccuuuuggcauguuuuugucacuuuuugcaguuauguuuguauuuuagcauaaugauuguacagacaaauauguguauguauauguuuguauucugcuuugcuuuuuuuuuuuuuuuuuuuuuuuuuuuugagacagaguguugcucugucgccuaggcuggagugcaguggcaugcagucuuggcucacugcaaccuucaucucccagguucaagcaauucuugugccucagccacccgaguaguugggauuacaggugugcgccaccaugcccagcuucuuuuuguauuuuuaguagagaugggguuucaccaucuuggccaagcuggucucaaauuccuggccucaagugauccgcccaacuugcuuggccuuuccaagugcugagauuacagccauaagccacugugcccggcucauucggcuguuuugauuguuuuaguuagccuuauaauuauugucuuauaucauuaugaauuuuuuuaacacuuauagcugcuuucuauuucaucauauaguauaaacgugaaauauucugggggagguaaaguauuuaaaaaucgauuaaauggucauccauugaauuguauaaaaacuuauuugugauuauccauuagcuaacuaaaggaaaacuuuucaauuccagucugaaauauuuaugcguggaauuucccuugccccuuuuuuguuacuuccaugaauggcaagaauuuugcaggcauuagguuugaccauucucaaaagccuuuauuaaucauucggguauuuauuuauuuucauuuaauuaagaauucuuugagaauaugcuucuauacggcacugaauugccccagauuauuuuuggaguaaaguggaguuuaaauaugcuaugugcagugcagcaccccucucccuauaagguauacuguuuaaagacuagguccuuggcuuugccuucaaguaacuugaagauguuuuuguugaaauaucuuggagacuaaaaaauagucauuauguaaggaauauuauuauaagugcccaguuagagguuaguaguuacagaauuuuaggaaagucuuguuauuuugugauauuauuguuguuguuguuuaaacaagagggguauaggcaugccaauuauaaaguaauauguguuugagaauauggagcugcaauuuauuagcagauaacaugauguuacaccucuucucagguuucugguguggcccucaauuuuugugguuuaguacauauaagguccaggagcaguuauaacuuaugugcacagcuuugggaguugugguauucugauaguaagcuguugaacucuaguccauaagaagaaacaagaugaaaaaugcuuggugggcaacauagaaguacugacuuuucuucauguucugccaucauucaaguagauuucuguuucuuuaauuuaacauuucuuuuuaccuuaagagguguaaaggagaauguauauuuuaccagcauuauccucuauuauuauaaagaaaaacagaagcauguauguguuuuugugcaggguuagacaggagagacccuguacaaaagagagagagagagagaauauacaguguaggcaaaggaaugugagagaaauggaucuuucauagugaaaaguuuuuggaugaauauauuuaucauaauaucauauauaacuucugagagacauucuggaaguuuuuuuucucugacaaaaauguauuuuuaaugguucugaauugaauuacgauacauugaaucacacucuggaucuguauaggaaauucauucuucugaggaauacauuggauuccuauucacuuuguuaggaaucuuugguaauaugaauaaucaccccuuuucuuauaugccucuggagagucauucuaguuuugugaaaauagaacaucaaacugggaugaucgguagguuuuugaugggaagacggcugguaauacuugccuagagcucugugauggaaaggggccaucucagggauccauagaaagugugaaucugccacaugcgaaccacguauucagcuuuucuagccaagcugaaaguauggcugaaguaugacuuuaguguuagacaaauggguuuaaaucuagguuuuacagauacuaggugugcaacuuaacccuucugaguuucauuucuuuaauauguuaaaugaguguaaugagauuagcuguaacauacaauaaucaucuaacucauuucuuuagguacuuagguguucaguuaaugauagcuauuuuuuguauugugauuuaaaauucucauaugcuuaggcugggcuugguggcucacaccuguaauccuagcacuuugggaggucaagguaggcagaucacuucagcucaggaguucaagaccagccuggguaacauggcaaaacccugucucuacaaaaaauauaaaaauuggcugggcaugguggugugugccuguagucccagguacuccagaggcugaggugggaggauugcuuuagcccaggagauugaggcugcagugagcugugaucgugucacugcauuccagccugggcaacauagacccugucucaaaaaaaaaaaaaaaaaauuuuuuuuuuuuaauuucuugauauucugcugugguuuaagacauacuuucacagugcauuugauauaguguuguucagcuucauuuuauucuauugauuuagguguuggcaugaaaaucaauaccuuccccuuucuugccccuauaguauauccggaacugugugaugaacagagcccugccccauuuuauacuuguggaaugcugcaagaucaagaaaauguaugaacaagaaaugauugccauagaggcugccauaaaucgaaauucaucuaaucuuccucuuccauuaccaccaaagaaaacacgaauuauuucuguaaguuuuauuucugaaccuuuaguaaccccaaaagccaugugauuguguuaguuuacauaaguuucacacauauuuccuuugcucacuucuccuucugugaaaaccaauacauauuugccaaaaaucgaucaccauuuauuuaaaaauuaucuuucuagauacuauuauuuuuacucaagccacaauuaaauguaaauaugccguuuauauuuuugaugucuuuuucugccgaagaaaaaugccaucaaauuagagauuuugauuuaaauauaggacuucaaugaguaauuggagacauccuaguagaaaaguuagaugugcagaaauaauugaauuaaccaguauauuucauuucuaucagcuuaacuaugguaguauuuuugguauaauuugccugccuucuuaauacugaauucuuuuaguacuaaacauauaugaagggcacuauuguuuuucagaauguaauauauuuguauaaagcaaauuuuaacuuugucuuuauuugaacaguuaauacuuuuuagucaguuacucagucgucacaaauuguauauugaacuacuccuugaugauguuauuucuauauuaauauaaauggucagcucuuaauuuauacaaagcuuuuauuacuauuuguuaaugcuuuuuaauuuagugaaaucucuuagcauuaguggaaugcugccuauguuuugccaugaaagccaagugcuagggguuauaaugcuuaauuaauuaauuaauuuuuuuuuugagacagagucuugcucugucgcccaggcuggagugcaguggcgcaaucuuggcucacugcaagcuccgccucccggguucaugucauucuccugccucagccucccaaguaacugggacuacaggcgcccgccaccaugcccagcuaauuuuuuguauuuuuaguagagacgggguuucaccguguuagccaggauggucucgaucuccugaccucaugauccaccugccucagccucccaaagugcugggauuacaggcgugagccaccgcgcccggucaaugcuuaauuuaguauaugugacuuucaguuguuaguuuagagcucuauuuucauaguuuugccaauagacauuagaacugaugacaauugcauugcuagcauagaauauucauuucuuucauuaaaauaauuuguauuuauuuuauucuuuuacagcauguuugggaaaauaacaacccuuuccaaauugucuugguuaagggaaauaaacuuaacacagaggaaacuguaaaagugaguacccacuaagauuugaauuugccauccgcuccaguauuugaauaacucacugauaugcucaauaaugucacauuggagauugaauuuuacccauauugaucaauuacaugauauagaauaugguaauuuauuauaagacuauugagaauuuuuguuuuaaaauuuuaaaauuuuguuuuaaaauucaaagacuuuugaaucauuagagaucuacuggaaagauugacauuauuuuuccaguauauauuacauauuucuucuauauauuauauagaagaaauauauaauauagauggguaagacugugaagaaaguugagagaaauaauucaaaggugcaaaguagaguuaucuugguugaauaauucuagagagcuaauguacaacccgaagacuauaguuaaugauauuuuauacaggaauuugcuaggagaguagauuuuagguacucuuaccacuccuuacucaaaaaaaacaaagguaacuauaugugaugaugaauauguuaaauuucagcaagugaaaguuaagccaaaacuauagaucucauguuuuuaugcaagcuuacucuccucucucagccuugccuagagcugcacugaaccccucuuucagucuuuuuuuuuuuuuuuuuucuuuucuuuccuuuuaaacugagcacagagaacauguaauaccauuuccuggaagaaaauagauuacuacguuauggaccacaaguuguuaacacauggggguuuauugcucaaucccauacauuuaaauaaagacuuaacaaagcauuuugucucagaguauaaagcauuuauuuucccuaauuugcuggguaggaaauuaagugaauaauuuuugugauccaagaaagagauuugguuuguuugaaauguuuguugcuugaagauauauucaggagccccuugccaaaaauuaccaaugucuugcuuuuguacauggguauuaaagauuuugggggagaguagaagggugguuaccgccuuugguguuagacaagugggugaggcugugaaaaaaguugagagaaauaauuugaagguacaaagaguuaucuugguugaauaauucuggagaucuaauauacaacaugaagacuauaguuaauaauauuguauacaggaaauuugcuaggaaaguagauuuuagguacucuuaccgcuccucagaaaagaaaagugugugugguaauggauauguugauuuacuugacuguguagcaagcacuucauucuauauuaaaacaucaauguuguacaccuuaaauauaugcaauuuuagaagaagauucuuugaguagcuaucauuaaaauaaaggcuuugcuuuuauauccucagcuagauuuuucuuuuuuuuuuuugagauggagucucacucuguugcccaggcuagagcgcaguggcaugaacucggcucacugcaaccucugccucccggguucaagcaauucuucuaccuuagccuccccaguaacugggacuacaggcacacgccaccacaccuggcuaauuuuuguauuuuuaguagggaugggguuucaccauauuggccaggcuggucucgaacuccugaccucgugauccgccugcuguggccucccaaagugcugggauuacaagugugagccacugcgcccagccuagauuuuucuuuuuaaugagcauguuuauggccgguuaaccucuguuuucuauuuuagugguaauccuguuuuuaucuuuuaauuuaaauuuuuuaauugcaaaaguauaacaagacuaauuguugcaacaaaugaaaaagugcaaacaggcugggcgugguagcucacaccuguaauccuagcacuuugggaggccaaggcgggcagaucauuugaguccaggaguucaagaccagccuggggaacacggcgaaaucccaucucuacaaaaaauacaaagcuuagcuggguaugguggcauaugucuguagucccagcuaugagggaggcugaggugggaggaucgcuggagccugggaggucgaggcugccccugagcugagauugugucacugccuuccaccccggugacagagugagacccaaucucccccaaaaaaaagaaaggaaaagaaaaagugcaaacaugauuaagaaaaaagguacuggucucuccuuaccaucauaagggauucaaaguuaacaagcuuugugaauguccuccagguuuauaaaaauauauauaaacauaugauauggaauuaaagggguuuugguuguguuuauuucugugauuugucaaaugguuuguuaauaaagggaugauacuauguacauuguucuauaacuugauuuauucacuuuauaauaugugcuggacaguccucuggauuaguaaauaguagacuuccuugaggauuuuauucuuuuuuuaaaaaaauuauuuauuuagagacaggguauuacuuugucacccucacuaguugaguggcaugaucauagcucacuguaaccuugaacuccuggucucaagcgauccuccuaccucagccucccaaguagcuaggacuacagguauacaccaucacuuccagcuaauuuuuauuuuuauuucuauuuuuauagagauagggucuugcuauguugccaaugcuggucuugaacuccuagccucaagcaguccuccugcuuuggccucucaaagcacugggauuacaggcacaagccaccaugccagaccagauuucauuuuuaaaggcaaaaaucacauggagucaaaucuacccacaagucauauggaauauuauauauauauaugguuuuguuuaguaauuuauagguaucgauauagaaucuacguaguaacaaaugggaauuucugcuuguucuucccauuugcagguuaucauauuugucuucuguagauaauuuaucaguucuuugauuuguuuaugguugguauuucucugcagcccuuuacuuaauuucuuccuaaagaauauccaagaagccuucauucguguuuuauuuuuucucaagcauuaugcguuauuccuuugucaguggucagaaacccaauaaagucauugacauuuuauguccauauguuuugccacuucuaucagguaucaagcuugauugauucuauuguuugccguuguuauguucauggagaggauuaaugggcuuaaugacagguaguauuuaauguauguaccucaccccaccguaccuagcacuguaguucucuuuuucuuucuucuccccagcaggauuauauaguugaauuugaguacauuaaauguaauuaugacaugauuuuccuguagauauaccuugcuacacaggugaggagcuccaguagaauguuaaagcaaaaucugaaaaaagguggcagcuuuacaucuuucuuuccaaacuuuuuucuuuccuguaugcacuggcuaagaaucccaguacaauuucaaauagaagugauaaggguaaauggauuacucaggguucuccagagaaacagagccaauaggauacaauauguauagcuauaucuauauuaucacauauaaauaagcaaaaaauauagaagauuuauuauaagaaauugacuuaaaugauuauggaggugggcaacuggagacccaagagagccagugguugaguuccagucugaaucugaaagccugagaaccaggaaugccaguggguguaguuccuaucugaaggcugguaggcuugacucaaacccaggaagagccaauguuucaguuagagucccaaggcagggaaaaaagccaaugucccaguuacaaggcagucaagcaggaagaauucugucuuacuuggggagggucagucuuuguucucuucagguauucagcuaguuggaugaggcuagccuacaucagggagggcaaucugcuuuacccagucuacugaucacaauguuaaucacauccaaaaucacccagaauaauguuugaccaaauaucucauuaguaacacccagaaaaauguuugaccaaauaccaggguacccugugaccuaaucaaguugacacauaaaauuaaccauuauaguagaccuucuuuuuuuuuuuuuucugagagagucucacucugucacccaggcuggagugcaguggcgcaaucucaccucacugcaaccuccgccucccggguucaagugauucucaugccucaguguccgguguagcuggaauuauaggcaccugccaccacacccagcuaauuuuuguauuuuuaguagagacaggguuucgccauguuggccagccuggucucaaacuccugaccucaggugauccacccaccucagccuuccaaaaugcugggauuacagaugugagcuacuaugcccagccugccaucuugauuuuguucuuuaucuuaaaggacagcauucauuaagucuuucaacuuuaaauauaauguaguuuuuuucauagaugccccuuauucaagaaauucucuuccuaguuugcugaaaauuuuuauccuuuaagaaaaaguuaaucacuuuuucugcauuuuuugagaugauuuguauauuuuaauucauugguuuucuuuuuuuuuuuuuugagacggagucucacucugccacccaggcuggagugcaguggcucaaucucggcucacugcaagcucccccucccggguucaugccauucuccugccucagccuccugaguagcugggacuauaggcacccgccaccaugccuggcuaauguuuuguauuuuuuuuaguagagacgggguuucaccauguuagccaggauggucucgaucuccugaccucaugauccacccgccucggccucccaaagugcugugauuacaggcgugagccacugcgccuggcauccauugguuuucaaaaguugaaaccaaccuuacuuuucugaaauaauguucacucggucaagauguguuagccuuuuuauacauuauuaaauuugacuuauuaauauuuuguuauggauuuuauggucuaugcucauaaggaaaauugaggaauauugguguguucuugacuuguaaugucuuucuuugauuuugguauuagaauaacguuggucauauaaugaggugagaagccuucucuauuuucugaacaaguuuacguucagaaaauaccaguuggacugguauuauuuauugcuuaaauauuuaauugaacuuacuccaugccagcugagccuuaaguuuucuuuaugggaagguuuuuaauuagaaacuuaauuuauagccaggagucguggcucaugccuacauucccagaacuuugggaggccgaggcggguggaucaccugaggucaggaguucgagaccagccuaaccaacaggccgaggcgggcggaucucgaggucaggagaucgagaccauccuggcuaacacugaaaccugggaggcggagguugcagugagcugaggucacaccauugcacuccagccugggcagcaagagcgaaacuccaucucaaaaaaacaaaacaaaacaaaacaaaaaaagaaagaaauucaaaauuuauuuaauggguaugguagacagauuuucuguuucuuuugugucaauuuugguaauuuuugucuuucagagaauuuguuuuguuguuguuuauuggcauaaaguucauaguagucccuuauguuaguuuucuguugcuggauaacaaaauaccauaaacuuaaaacaacauuuacuuacuagcucagcaaucuagguguacuuuggcugcacuccuuuuugaaagcucugaaagagucugcuucugaacugauucaaguuguuggcccaguucuguuccaugugauuguaggccugaagucuccaauucccugcuggcuguuggcuggggucuucucucuguaacuagagacagcucucagauccuugcccuguggcccugucuaacuuuuaagucuggaaaauuucucacgcaucaaauuuucucauucuuugacucuuuugcuaggaagagcugagugucuuuuaaggguucaacaaauaagucagucucacugaggauucucugcccuccuuaaagcugacaguaucauauaguauaaccuaaucacaggcgucuaauccaucguauuugcagucugagagaucauauaggacacaugacucuguaugaggucuauaacagaaaucucaaauguucaguguugacucaccacucugccucccuggcacuugaacaucuuccaucucugugggagugcuuggaauucuguagcauauagcuuccugaucaaucuuuccuuggccuuguagggcuuuuuguuuguuuuuuguuuuuuuaaagacagucuugcuccgucacccagguuggaguggaguggauaaacacggcucacugcagccuugacuuccuggguucaagauacccuccugccucagacuccuguauaucugggacuacaggcaugcaccaccacacccagcuaauuuuuuuuuuuuuuugacuuuuuauagagacgagauuucacuguguuguccagguuggccuugaacuccuccgcucaagugauccuucugccucagccucccaaagugcugggauuucaggcaugagccaccgagccuggcuagccuuguaguguuuuccucuuucauguguacaucuuaauuaauauucagcagaagccugaacucaguguugccuaaagucuagaagaugacauuauuuauagcuguuuauagcucuagugggaaaggggucuucuaacucucagagaauguaugaauuguaccucuuuuucuccucuuuuuguuucuuuuuucucuucugcauugccccggucucugaacaguauuguggcaauagcaacggugguagcaguggcaguggcaggagaagcggggacaggcagagccuaagacucagaguugaauguccguuucaauuauaggaguuguagauacaagagaauggaguaagucuccccuucccucaccccccuaguguuuagcauaguugcaggaagugugagugaauaaagccgcagcuuucugguuggauaacaaguaaaggggaaccccagccuacuaaaaaauacuuggaacauugcagagugagauaagcucaggaaagcaaccucuuaaaguuaucuguguuuauaagcuuauuccugagcugugcauaugaggaucugcucuuaacagucuacauacuuugagaacugaacaguggcauauuccauuagccaagucucaaacugguuaauguguagugcacacaugggacagaugcaaauagcccugcaagaagacuugaaaacugaacugguaucggaacuguagcucacagaaggcucauggaaacuuccaacuguugaaccuaacuaacuauggucccccaaaacaaaaauaucaacauucuccauaggauauaaacaagacccaaugucucauaacauaauagacaaaauaucuggaauacaauucaaaauuaguugacacauaaagaaugaggaaaaucugaaguuguguggacaaugauaguucaauagacgucagugacgagaugacacagauguuggaauuaucucacaaagacauuaaagcaguuaugaaaaugcuauaacaacuaagggcaaaucagcaggagggacuggagagggagaaaguuucagccauuaaauagaagauauaaggaagaaucaaauggaaaauucagaacuaaaaaauauaauaacugaaauuuaaaaauacacugaauggacccaauagcagaauggugaugaaaaaggaaaggaucagugaacuuaaagauuaaucaauacaaauuuuccaguuugaacaacagagagaaaaaugggagaaaaauucgauagagccccaggaaccugugagaaaauacuagaaagucuaacauuugugcaaucugacuuugagaaaaauaagagaaagaguacaguucaggaagacuacuuaaggaaauaaucacaggaaacuagauuaucggcaaagucagcaaaagacagaaacacaaauucaagaaucccaagagaaauacaagugcagacauauccuguaucacacguauuagucauacaucauaauuccccauagccuaguuauauaggucucaggacuccuuaucuauuaaaguauauaacccaaggaacuuguaucuuuaaucuuaaacauuaaaaauauauauauuuagggaguauaaaugcauauuucuuacaugcauauauugcauagaagugaagucugggcauauauugcauagaagugaagucugggcuuuuaguguauuuaucacccaaauacugaacacugcccaacagguaaauuuucaaaccucacacccacacccccuacccccacaccuuccccguauuuuccucuuuuuaucuucuuucagugccuggaacacugaauaaauauuugugcaaugaaugaauacauuuuaacguaacugucucuaacauuuuauccuuaguugaaggucauguaguauucuucucauaagucagaacaaagcuaccuuuuuacaaauugugacauaauaaagaauauacauuuggucuccgccguggcuuuuggcacagagcuccuuaagucccuugucauuuccugagugauaggagcaucuauuauucuaaugguuugaucuagucucaguguccugacaaaagagcuuucaagacccauggaaucuggguaaugauagaagugucuuuuuguaugcugacaagaugaauggagacuuacagucccuagauagcuccaggauggagccgguugccagagaaaccaaccacgugaauagaggauuggaacuuucagcuccacaccgggacuucuggaguggggagggaggacagagaccgacuuaacaguggccaaugacuuaauaaccauaccuacuuaauggagccuccuccauaaaaacccuaaauaaugggauuugcaggacuucuggguuagugaauauauccacaugcugagaggauagugcagccaaauucuauggggacaagcuucugcacuuggaacccuucuggaccuugaagaacauauauauaccuuuucauuuggcuauucauuucuauccuuuguaauauccuuuauaauaaauggguaaauguguuucccugaguuuugugagccguuagagcaaauugaaccugaggagggcauuugugggaacccuugauugaucacaaguacaaauaauaaccugagauuugcaauugucaccugaauuggaagucagucuuauggaacuaaugccauaaccugguagcaucugcccuaaguccagguagcaucaaaauugaauuguaggauacccaauugguguccagagaguuggagaauugguugguguaggaaaacccucacauuuggugucugaagugaugaagguagaagagacaguuuuucacuuuuuacaaaugaucaaggcugggaaauucccaaaacaugggaauuuccaccuauucaugcuacugaucuuuuuuugugucuaauaucuaagggcaaaaauguaguggauuuuggccauauuguggaacaagaaggaaauuaaaauguugaugugaaaaaaauucauaucuuauucaacacagaacauuuuuaauuggugaguauaggaaugcagucuguguguuggcuuggcaccucccugcuauagcacaguggcaaguccuuugcaugucaaagccugacuucuuuugcucuccuaauguucuggggcuugugaagaaguguuuccaugaaaauuuauuaaaguuggauaauaaaacauguaaccguauaaagcaugauuauuauuuuuauuuuugagacggggucucgcucugucacccaggcuggagugcagugacacgucuuggcucaccacaggcucuggccccaaggcucaagggauccuuccaccucagccuccugaguagcugggaucauaggcccacaccaccacgcccggcuauuuuuuguauuuugaguagagaggagaguucgccauguugcccaggcuggucucgaacuccugagcucaagcgaucugcccaccucgaccucccaaaguguugcgauuacaggcgugagccacugugccagguuuuaaaucauacuuuaaauaaauuauacuuuaaaaugcuuuacuucucaagauugaagauaacccagaucaaacuucaggaaaugggacaauuuuuauaaaauuucaugugauacaaauuuagaggauggauuuuguuacugcuuuuucugaaaacaaaaacuucuuuuuuuaugcuucuuuucuuuuuauugggagauucuaaauucagagaacaaaauuuuuagcaucauuauaaaguugggucuuuuuuccuacucuuguuucuuuuuaacgauuugucaacuuuaauaauuaugguaaauuacacagagauuucucaagcagaacuaaucuuaaugacuuggccugaaauaaaucauacuuugacuguuaaauaaugauacuuauuuucaacaaauuuuuucagaauguucagggucuuguuuuuuuuaaauugucaccaugcucaaguuagauuaauucuuuauuguuauucuuuucaagaucacauuuuuuguuguggcuguucacacagaugguacgggacuuuuuuuuagcccauuauaauucaggguuuuuuggguuuuuuuuuuuugagcuuuuauagcagcucaucccuaauucuacuucauuuccuauaccugaguuuugccagaaguuuuuggaugcaguuauaacuagcauucuguuuuguuuuguuuuuaaauacuagcgaacauuuauugagccuuuauuauauggugggaacuuauuugucuuuauuucucaaugucuuuaucaccagaacacugaaaaauaaucauuuguaaaauucauaauuuucugcauaaacuauauuuaaaugccauauuaaaaaggugacaaauucagguaagauuaucgagaguaagaauugaauaccacuuuuauccugauauuccuaucuuauaaccucccauacaacagaugcaaaauauauuuuauguauguuuuguuuuauuuaugauuuaccaaaucucauuuuacagauuauuugaggugagccuacacacgugugugugugugugugugugugugugugugugugucucuuacauagcacauacaauacagacaguuuugacuuuaaaaaaaauagaggauaguuaauugacaggaaauaagaaaaaaaaaaaaaaaacacccaguagcaagauuccuaguagguauguguauaauauuagauccugugugauuaauuuuuugaugugggcuacauauuugacugucugcuugcccuacaccuaguggacaaggcaaagagaaaacaugaucaguuauaauauucagaaucucauaagguaaaacaaacuaguuauuuaugaguuuguagcauauuucaauacuguaaauugagagagauaugcuuagggaauccuuaugaaugagacacagugaguaauguagugagcaccaacaccucugacaacaucauauuauaguaggcaaaauaaugcuucucaucucucuuauaaugucuuucacuagguagacauaaaauacaauauugacaguauaaucuggaaaaagucauucuagaagagaccaaauuaauucagucuuaguacuguauucacccauuugaugguuuaucuuuaauugaauaauauuuggacuuccuaaauaaauguuguguguuuuucaggaaauucuguaugcauauuuuuauucaaaacuggauuugggaaagauuaggcaguggagacuuuguuguguucauuuaaagucaaauaagaucaaaguguauauacauauauaugcacacauggaucaucaacugagccuagaguaacauuaaaucaucuuggccaugcccaguggcucaugccuguaaucccagcaguuugggaggcccagacaaguggaacaccugaggucaggaguuagagaccggcaugaccaacauggugaaaccucaucucuaauaaaaauacaaaaaaauuagccaggugugguggcaggugcuuauaaucccagcuacucgggaggcugaggcaggagaauugcuugaacccagaaggcggauguugcagugagccgagaucaugccauugcacuccagcgugggcaaugagagcaaaacucugucucaaaaaaaaaaaacuuaaggauaugaaguuucuaagcagaaaucaugugugaauagauggcacugcccucucccccacucaccuuucaugaagauauguggaguguuaguugacuaugaaaucacuuucauuuucccaaaaaguagcuuaaacagggcuuugaaguuuuuuuguaguuugcaggcuuauuaucucucuggagaguaaaugguaauagaaauuuugagcaguaaaagguaagaaaucuuacaguaacaaaauaguuuuuucuuuauuuucuuucuuuccuuucuuuucuuuuuucuuucugaaugaggcagggucuugcucugucacccaggcuggcaugcaguggcacaaucucugcucacugcaaccuaugccucuagggcucaggcgauccucccacgucagccuccugaguagcugugacuacaggugcacgccaccacaccugacuaauuuuuguauuuuuuuguagagaugggcuuuugccauguugcccaggcuggucuugaacuccugcgcucaagggaucugccugccuuggcuucccaaagugcugggauuacagguguaagccaccucacccagccugaaauaguaauuuuacauuugaaaacagucagucauggugcuggucugccugaaaacauuugggauggagaggaggcaggugauuagguuuauccaagauacagacuuccagacgagugugaugggagagaggcacuugcagauaauuuuggugagagugaaggcagacaaaacuauuagagaaguggggagaaagagguguugguuguugaaauagaggucuuagugauggcuacaaaguuuuccuuugggaauguauuaacaguaaguuggaaucagggugggaagugguuggaaacugagauguaauaauuagugauuuggaggugcuaggguguggugaagucaaauucaggguggcaucgugagauuguguggcugaagggaaggagagaaguaccuaguuggagauauuuaggucaaggaacucaggagucagauggguuguuugccucaggcaugcggacccugcaucaauaccuguuagugauuuucuucucacuuagucgucuucacaucuuggaaagcaauuacugguaucuuucuugucagaaacuugaaaaaguacaccacuuugcuugauucccaagcuuuuuuuuucuagccuagcuauuucuucaggucucauuuucuauuuucacacuguacauacacauuucuuccccuaccccccuuuuuuuuugucaguguuugcagagcagauugggaguuuauaugaauuuaguuuaaaugaauggaauuuagguuaaauguugaguauauaauaucauacagaauuuuugguaauguguuuaaagcuaugaaauugauuauuucuucagccuugaaagacuucucuggagaugauacagagcugauacagacauugaugauggggcuguuucuuaauugcucaggagaaaauaauuguuguaugguucuuacaggcaacuaaacuuuuauuuagagaaacaaaguaauugggaauaugagaagugaaaugugucuuaauaugccuucacuuauuccuauucuuucuaguguucuauuuuagcuguuuaaaauaccacgcuagaccgguguuaaaggcucauaccuuugggagccaaggugggcagaucacuugagcucaggaguuugagaccagccuggacaacuuggcgaaacccugucuuuacuaaaaauacaaaaauuagccaggcaugguggugcgcaccuguaaucccagcuacuugggaggcugaagugggaggaucacuugaacccgggagauggauguugcaguuaguugagaucaugccacugcacugcagccugggugacagagugagaccucaucucaaaaaaaaaaaaaaaaaaaaaaaaaaaauacugagcuaauguaaguuucugauaaguuagauacuuuguuuauagcauauaagguagauauaaagauuuucuaaaagugcuguuguguaaaucuuucuucauaauuuucuuuaguucauagucuuuagaaacuaaaaaugaaagugcccaggcuuuuugacuaauuucugggaacacagggaaauaccauuuaaaguaguucagagacauggacuuaaagaaagauugcuuaagggugugacuacuuaauccugaaacugccugcuuaaagagagggagaaaaacccaaaugguuguuuuaaaaaaucauaucuaauacaaaaauaggcauauagaccaauggaacagaauaaagagcccagaaauaaggcugcacaccuacgaccaucugaucuucagcaaaguugacaaaaacaagcaguggggaaaagacucccuauucaauaaauggugcugggauaacuggcaagccguauguagaugauugaagcuggacuccuuccuuacaccauaaacaaaagucaacucaagguggauuaaagacuuaauguaaauguacacuuauauuuacuuuacauguaaaaccucaaacuauaaaaacccuggaagacaaccuaggcaauaccauccugcacuuaggaaugggcaaaaauuuuaugacaaagacaccaaaagcgaucacaacaaaagcaaaaauugacaagugggauuuaacuaaacguaagagcuucugcagagccaaagaaccuaucaacagaguaaacagccuacagaaugggagaaaauauuugcaaacuaugcaucagacaaagaucuauuagccaguaucuauaaggaauuuaaacaaauuuauaagaaaaaaaacauuaaaagugggcaaaugacaugaacagacacuuuucaaaagaagacauacaugcggccaacaagcauaugcaaaaaagcuuaaugucacugaucauuagagaaaugcaaaucaaaaccacaaugagauaccaucucacaccagucgcaauggcuauuguuaaaaagucaaaaaauaagagaugcuggugagguuguggagaacacauacacacugcuggugggaguguaaauuaguucaaccauuguaaaaagcaguauggcgauuccuuaaaaaacuaaaagcagaacuaccauuugacccaucaauccuauuacuggguauauacccagaggaauagaaaucauucuagcauaaagacacaugcaugcgaauguucauugcagcacuauucacaauugcaaagauguggaauuaaccuaaaugcccaucagugacagauuggauaaagaaaaugugguacaugaucaccauggaguacugugcagccauaaaaaagaaugagaucaugucuuuagggaacauggguggagcuggaggcuauuauccuuagcaaacuuaugcagaaauagaaaaccaaaugccgcauguucucacuuauaaggaagcuaaaugauaagaacuuaugaacacaaagaaggaagcaacagacacuggagccuacuugagggugaagcggggaggagggagaagagcagaaaagguaacuguuggguacuaggcuuaaugccuagaugaugaaauaaucuauacaacaaaccccugugacaacagcuuaccuauguaacgaaccuucacauguacccccaaaccuaaaaugaaaguuuaaaaaaaaaccacaaaaaauuucuauuuucauucaugguuucauuuaaugaguuuuggauugacuguggucauuuugcuguuaugucuguauauagggucuuacauuuggacauucagccauuuuauaauacuuucugggcuauuuaaaaauauuuaaagguaacauuauauaaaauaaaaucaaagaucauugauuuuaauauuugucccccuuuaaucagaggagacaacaaucaccaauauuccagcuauccacuauaaacuacuucuuuuuuuuuuuuuuuuuugagacagcgucucacucuguugcccagacuggagugcaguggcacaaucuuggcucacugcaaccucugccuccuggguucaagcaauucuccugucucagccuccugaguagcugggacugcaggcgugugccaccgugcccagcuaauuuuuguauuuuuaguagagaccgaguuuuaccauguuggccaggauggucuugaucucuugaccucaugauccgccugccucggccucccaaagugcugggauuacaggcaugagccaccgugcccagccuguaaacuacuuuuauuuguauucuucacacaguuuacaaggugaacaugcuuuuuuuuuuuuuuuuuuuuuuuuuuuuugagacacaaucuuucucugucacccaggcuggaguguagugguucagucuuggcucacugcaacccgccuccuggguucaagugauucuucugccucagccuccugaguagcugggauuacaggugcucuccaccacacccagcuaauuuuuguauuuuuaguagagaugguguuccaccauguuggccaggcuggucuugaacucuugaccucaagugauccacccaccucagccucccaaaaugcugggauuacaggcgugagacacugcaccuggcugugcuuuugauaauauuuugcuauaguauaguauuuugaugguauguugcguuauacuguuuuucauuuaagguuacaucauaaaucaacuuuuucuuuguauacagcauagacuucaugaugaauugaaaguaggagacagaggugacugaguagcugcugguaccauugucacugugguagaaagaacaugugugauuaugguuagucagcuucuaagguagauuuuuguuugaguuugaucugagagagacuugcacagguuuauagccugcuggaggaagauuuuuccaaugcagaggagcaaaggaguaacaucucaguacuuggggagcuggagcaauaugggaccaggggacuugaaggauuacgccuuuuucuggaguugaagggaauuaggucauguguucagauauaaauuccuagugaccugaggauuuacugcaacuacuuuuaguauccuuuguaacaccuguuacuugaauauuuaucauguuauaauaauccaucuguguuuagaauaaccaauuuuuuucuuuuagcuuaauuuuuuuucaaaagaaaaguuucaaauauacacaaaaguagaauaguauaaugaaccuccaugaacccaucauccagauucaaaaguuauucugauagcuuuuuaauaauauuucuuuagcuuuuaaucauuuaaaaauauuuaauucucuaauccaucuguguucauuuagcuggaauuagauaaaagaauauuauuuauuaagucagucaucuuuuuuuuacuauauuaugauaugucuggccuacuaaccuacaguuuuauuuaugccagcauaacauaguuuuaacuauuuuaguagguuuuaaacucauaauuauauuauaaauauuuauaauuaaaauugcugauuacaucaguauuuaaaauuuuauauuacuguuugaauauauuuuaauaucuauagaugaaguauguguauauucuuggguauuuaucuuccuuuucaaauauuggcgugguaacucuuaacuagcuagaaaagcuuuugcugauaagcuuuugaaaaaugaaagauaagccuaaacaauuccacauauguauucauuuguuuaguaaauauuuguugaguaauauugugugcuaguaucacaucugaauaaacugguauaaaaacuuugaccuuaaaaguguaucacugggucaaucucuguguuuuacuacuguuuuuagcucuacuuucucccugaguuuuaaauuggugauaauuaggucauauauuuuaaaaaacugcaaaugaguaaaauugucugggacaucuuacgcaugcccugcaucacucuggccccaggccuuuagggaaaaacaaaggaccgugauauauaggauaaucaagauauggauggaauaucuuuuguuagcucuugacuuaguaugacaaauucauaaauuauuuagaaguagaaagaaacuuuggagccaucucauccauucauucuuuccuacacauagagaaggguaagacaagaccucaaguaaaugaagucagugaguaagcauaugauaguaugcuuauacuuacugucacgguuucuuuagaccuguuuaaaccauugagcacccuggcauuuggaccaauaugugauuuuauagcugguuuacuuagcaagugaaaaacagauuagacuaacuacgguuuacugaacgauauacugguuaauuacacucuagugguucugcagacaaguaggcuuucuaaaacuuggcauguuucuucuuccaguauguuccuuccuucuccaaaauaaagauguuuuuaguguagaaacaaacaaacaaacaaaaagagauguuuuucgugguacaguauucaugacuuuguuuuuguuuuugucugcuucguuacagguucaugucagggcuggucuuuuucaugguacugagcuccuguguaaaaccaucguaagcucagagguaucagggaaaaaugaucauauuuggaaugaaccacuggaauuugauauuaauauuugugacuuaccaagaauggcucgauuauguuuugcuguuuaugcaguuuuggauaaaguaaaaacgaagaaaucaacgaaaacuauuaaucccucuaaauaucagaccaucaggaaagcuggaaaagugguaaugauauaccaacuucugaggauuguuuuauauaacggaauaauuuuaagacuguuugaaauaauugaguaauauaaguuaaauuauauuagguaacuuugauccuuaaaaacugauuuuaagaagauaagaaauuuccauguuuauaucuuuagauuuauguucaugcauuuauuuauguuuauguucaugcauuuuuuuuguaaucuugcuccuucuaccauggauuuucuuuuggcagguuuauuuuauaaguguuuuauuauauauguaauacuuuuaagaagauaugaagaaugaugauguuugaaaaauuuacaguucugcagucuuucaacugaaauuucaugugacagauauguuuaagaauucagaauuuuguguauuuuagaaagaucauuggucguaacugacucaacauaucuuguggggucuggggcauaaaugugucaucaaacauguuaauauuuggagugaaauauaucaguauucacacuaaaugugacuaucauuagcuuuuuguuaucucuggccacuuuuugcugucacaugagcuaugaacaaaccuucaguuuuuagagcuucucggauuuugaaauuaugaauauaagaggauggaccuguugucauacuuucaucuuccauguuauguuuucagucaaauguuucacuuucuucuugcuuuuugaaagcuuuuugguggggauagggacauuaauuuuauauguuuuuaaaaucuaguuacuauauuuaucuauauauuaauuuguguuauuuuauucuuuuuuucuuuugagacagagucucacacugucaccugggauggagugcaauggcacgaucucggcucacugcaacuuccgccucccgggaucaagcgauucuccugccucagccuccugaguaaaugggguuacaggcacccguuaccacacucagcuaauuuuuuguauuuuuaguagaaacaggauuucaccauguuggccaggcuggucuugaaccccugaccuugugauucacccgccucggccucccaaagugcugggauuacaggcguggccaccgugccuggccguguucuuuuauucuuaacaugggaauauaagcaucuccucugguuaucaucauauagucuucuaaaaauaauuuuuaggcuaggcgcaguggcccacgccuguaaucccaacacuuugggaggcugaggugggagaauugcuugaggacaggaguuggagaccaaucuuggcaacauggugagauccugucuccaaaaaaaaaaaaauacccuaaaaguaaaauaacuuuuaaugacuaaaaagucacagaagcauuaguuccuuaguauuuuuuucuuccuuaauauagaauuauccucaaaguguuugauuauaagauuuuugauacacuauggugaaauuaaucuauuuaaauguuuguauaaaaguccuaucagcucaaugccuccuuuuuagagauauauuuauaugccuagagacauuaucuccuuccauauugagauuuauguagguugaaagcucuuaaaacaaguauucugauauuauacguguuuucuuggauuauuaaagauuucucauuuuggcugggcgugauggcucacaccuguaauuccaacacuuuaagaggcuuagguagguggaucaccugaggucaggaguuugagaccagccuguccuacacggcaaaaccccgucuccacuaaaaggacaaaaauuagcugggugugguggcgggugccuguaauuccagcuacucaggaggcugaggcaggagagucucuugaaccugggagguggagguugcagugagccgagaucacaccaccacuccagccugggugacagagugggacuccaucucaaaaaaaaaaaaaaaaaucauuuucacaaggcuuuuuaguccauauucuauuuuauucauauacuauuuauuaugaaauguuaauugaguuuuaagguucuucuuaaacguaauaaagauagugagcauuuuucuauguauaucuuguucucauuuuagaagauuauuuuggaaaucauccagaacuuucuagaacuaacauuauugaaacaaaggacaugugcauguuuacaccuuaaaguuauucuuagcauauuuaugcaaugguaucuuuuucaacagcauuauccuguagcguggguaaauacgaugguuuuugacuuuaaaggacaauugagaacuggagacauaauauuacacagcuggucuucauuuccugguaagauuuacauucuuauccuuaguguuaaagcauaacuaacuuuuggcauguggacuagguaauauuuaugaaucaccguucuuucaauuuaauaaauaaaauuaucauuuuguauuauuuauucuaaaauagauuuacacaaauuauuuuaauauuaucauaaaauuacuuguuucugaguagauuucuuuacaaauuuuguuuugguuuaaaaucggccuauauuuuauuuuauuauuuauuauuuuuuuuuauuuugucgagacaaggucucgcuauacugccaaggcuggucucaaaacuccuggccucaagugauccucccaaagugcuaggauuacaggcaugagccacuguuacugaccuguauuuuaaacgguuauuuuaacaaguuaguauuuuaaacauacuuccaacaaauaauguaccauuauuuugcuaguaacaaguuaacucuaguauuaacaaauuauucauuuagcucauuagagauugucuagucucgcuaugggacauaacuuuuaaguuuugugauggguagcuuugucuuuaaaucuuaugcaucuccauaccauauuuaggaaugaaauagacuaaacuucuuuuuuuuuuuuuuuuuuuuuuugcgacggaguuucgcucuuguugcccaggcuggagugccauggugugaucuuggcucacugcaaccucugccucccagguucaagcgauucuccugccucagccucccugcuagcugggauuacaggcaugugccaccacguccagcuaauuuuguauuuuuaguagagacaggguuucuccauguuggucaggcuggucuggaacucccgaccucaggugauccgcccaccucggccaucccaaagugcugggauuacaggcgugagccaccgcgccuggccguauuucugaauauauuucuuauuuuaaugaauguguguugcuuucagcauuuuuuguagguuuuuuuuuucuuuuuuuuuuugagaaauucuccuaaggaacagugucuucuuuauaauaaccuuuguugcuccuaauugugcuaacuuucuucaugaguagaaggaacaucucuaauuagggagaaauaguaaaaacacuuuuuuuuuuuugagauggagucucgcucugucaccucggcuggagugcaguggugugauaugcgcucacuucaagcuccaccuccuggguucaugccauucuccugccucagccuccccaguagcugggacuacagguguccaccaccacaccuggcuaauuuuuuguauuuuuaauagagacgggguuucacaguguuagccaggaucgucucgaucuccugaccucgugauccacccaccucagccucccagagugcugggauuacaggcgugagccaccacucccagccuaaaacacuuuuucuuuaguuggcuuuagccugaaauuugagguaaauggagcaccuuccacacgcuuuuauuucucaaauacuacucaaaauacccucaucaagugagguagaugguuuuauuuccauuuuuacagauaagugaagcucagagaaaauaaguuagucuuacauagcuguuucaaaccuaggauuugaaugaaagacuauucaaaucuucccauuggucuauacugcuuucccaaauguuggaauuuuuaguguaaaucuugcauuauaauagugguuuucuuuuucuuuuuuccugucuuuauaguuuguugauauaucuagugaaguuguaaacuaauuugaauuugaauuuuuuaauucauggcuuuguaagugacauuucaaaauguucauguacuagcaguugucaccugaaaaauuacuuuuggauaaucauuuacugacauaucuauaaacucuuugcaaucuaauaguguguguguguguguccuucuauuccuauccucuccagcauguaccucuaacaguuuucacuaauuauguuauuccccaaauguaggagaacuguguauauuugacguauuucuuuuuguuuguuuguuuguuugacucagggccucacccugucacccaggcuggaguguagugacuugaacacagcucacuguagccuugcccuccugggcucagccucccuccucagccccccaaguagcugguacuauaggcauacgccaccacacccggcuuuuuuuuuuuuuuuuuuuguauuuuuuguagagacaggguuucgccauguugcccaagcuggucucgaacuccugggcucaagugauuuucaccuccucagccucccaaagugcuaggauuauaggcaugagccacagcucccagccuauuugacauauuucuuaggaggaacuaaacuuucacaauacaauaaaauauagcagcaaaauacuguacuuucuugagaaucuuaauuuagacucacacauguucuccagaaucaccaaccaacuugacuaguauuuuuaguaaaaauuacaauuuuuggugguguuaacuuggcauaauacuaugaaccugacuuccucucugagaaaauguaugauaaaaaauaauaaaugaacacauuaguucugcaugugucagcucuagaauuguuacauuuaacccaguaggggcaaacaagaagcaaagaaacuacaaauaaucuaccauccagagucccuaggucaucauuacaagguauacaaucacguuuauuauuuuuuuuccuaacuuuccauaauuuuuuuauguggacuaggaaauacaaaugucgauuccuguuuuucccccuauacuuacacaaaaugacacauucuguguaauguucugcuucuugcuuuauucaccauaucuacauaucuacauaucaccauaucuucucuacguaucuauguagagaacuguuuuuccccccaugccuggacuguuagauuuuuuuuuuuaagcagaauuguguucugauaguucaaacagugcugcuauaaugaauaaccaugcuuauguacaguguauaucugagauaaauuccuuagagguggguuuauugauucaaagaauagauaaauuuauaauucuuaucauuacaaauuguuccucaauagcguguaucaauuuuugcucuccauguguaguauauaugaaugccuuuuuuuuuugccacauauggugguucacauguauaaucccaaugcuuugggagacugaggcaggaggaucacuugaguccaggagauugagaccagccuggacaacauagugagacucugucucccuauacacacagaaaaagagugccuuuuuuucugaucacuuuugaacaaggcuaaaggauuaccucuauguauggggcuaauaaguacuaaaauacuaaauuugauuucaguuagguugcauuugauaggacaaaaguaaaauaguacuagagagcagaaguaugaaacuguaaauugcugagaaaucagcucuagaguuguauaaauuauuagaauugagccaggugcaguggugugugugugccuguagucccaguuacucaggugcuugaggcaggaggaucguuuggggcuaggaguuuguauccagccugggcaauguggcaagaccccgucucuaaaaaaacaggaagauuaaaaaaaaaaaaaaagaguugccuccauccaggugaaaauugaguuugggcugggugugauugcucacaccuguaauuccagcacuuuuggaggcugaguuggguggaucucuugagcucaggaguucaagaccagccuggguaacauggugaaacccugucucuaccaaaaauuaaaaaauuagcugggcaugguggcaugcgccuguggucccagcuacucaggaggcuaaggugggaggaucacuugagccugggagguggagguugcagugagccaagaucaugccacugcaccccaaccugggugacagaaacccugucucaaaaaaaaaaaaaaaaaaagaaaaagaaaaaauugaguccgugaggugagaaaauauuuaaaaagaugaacgaagaauuaaggaacgaaaacuuguaaagauuuuccagcuuuaggaaauaauucugagugugcauacuuuauggacauuagaccuaauuagaguagagcugauauuuuuuuuccuuaggagauacagaaagaacaacuguacuacagucaguauaagaaaagaaaaauuacuuuggagagagaggaucuuagauuguacaccuaacucuauuuucucaucaugaguuucuuaucugugaaauaaaaaaauuauaugaugcgaacuccagaguuuucuaacuacacugaaauucuaaaaucacacacacaguucugugaauugaccauauuuagcgugguggaaaaggaaaaggaaggaguaccuugaagaaagaagcaguuggugagguaaaaggagcgccacuuaauggaguauuccagaggcuaccagagaagguauuuucugucagcaguugcaggauaauaaagagcauuaucguuagauuugauaagaagaaugucauugaugacuuaaaauaccaauuugguuauugugacaaccaugaaaaccagauuacaugugauuaagaaguccauauguagugaugagauuauaguuucuaugggccaccuaauuuugauggagagagagcaguuccaauuaaagucuuuucaagauugagaacuaaauuugaauuaagagguaaaguagucauucaguuuuguuaacuuucucauuuuuaaaacauguaugcaaacucacacugaaauuuuguuccaagcauuaacagaaaauuagaggauuacugauagaauugucugucacacuucuguaguugacauacuucuaaggugauuuucaugggaggagauccauuacagcuuuuuuaaagccuaguuuuaaagacauuuuuuaagaaccaaaauuauuugcauguuuuagaugaacucgaagaaauguugaauccaaugggaacuguucaaacaaauccauauacugaaaaugcaacagcuuugcauguuaaauuuccagagaauaaaaaacaaccuuauuauuacccucccuucgauaagguaagcuaauuauuuaaaggaccucuaugcaugaaaugauugaaugaucaguuccucuauguauaguuuaagcucuaucugucucuuucaaaacuucccauacagugacagcuuuguugagugggaagaccauggaucagggagccuucuuaacucuguuaguuuugguuuuaucacugacuaaguaagaaaagguaccuccaggccgggcgcagugguucacgccuguaaucccagcacuuugggagcccgagguggguggaucaccugaggucgggaguucgagaccagccugacaaacauggagaagcccugucucuacuaaaaauacaaaauuagcuggacaugguggcacaugccuguaaucccagcuacucgggaggcugagcaggagaauugcuugaacccgggaggcggagguugcagugagccaagaucgugccauugcacuccagccugggcaacaaaagcaaaacuccgucucaaaaaaaagagagagagaaaaggcaucucuggaguucacuuuucuuauuuauaaaaugaagaaaucauaauuguucuauuuuuuaauaucucacgcccuuaaagggcuauaaauauauucauauguaacugaauacauaaaauguuguuucaaauauuaaagguauagucacugcuguauuagaauugauacucaaagaacaauugauuuuuguugaauaugucuguuaguggcgcuuccuaauguaguuauuuuauagaaucuauaguaaggacuucauuucuaaauauauuucuuuaauauacacacugcaugucuuggggauaaagagauuaucuaaugggggcuaaauauagggcuaugguaauuuacaugcuaagagagcugagcugucauauauuuuaucuuuagguuuggcaugguguuuuuuauuuuaaaaaauggaguauuucucugucauccaggcuggagugcaguggcacaauuauugagccucaaauuacuugccucaagcaacuguccugccucagcaucccugguacugggauuacaagugagagccacugcaccugguaguguugauuuuuauaaggaaaucuuugaacaaauucucagaauuuaggagccaggcaccauggcucaagccugugaucccaucagcuugggagucugaaccaggaggauaacuugaggcuaggaguucaagauagccuggacaacauagagagacccuugucuguacaaaaauuuaaaaguuagcugggugugguggcaugugccuauaguccuagcuacucuggagacugagguaggaggacuacuuuagcccaggaauuucagacugcagugaccuauggucaugccacugugcuccagccugggcaacagagagagacccugucucuggagaaaaaaaaauguucagaaaauaagcugaaaguuuauuuaauuuccucaauccgcuugaguacaaacuaccuuugaagauugauauuauacuuuauaaauacuuaagauaaucuaccuguacauuuaaaguauuagcaaauuaaauuuauguaauucacucuuucuucauuuucauuauaauuggauuuuauccaucuaaggaguaauuuuuuauuucaaguuuuuuaaacauguuuuucugaacaauaauuuacaaccaaauuaaauuuugugcuuauaauauaaauuucaaauauggcaagaaucauauacguuaguauacacugaguagaaaaagcuacauuuugacucauccaauacguuuauguagugucuuuaguuauuccuuugauagaaauuuauccauaagccauagcuacucgugauauauuuaauaguuuuagcugugacuauuaucauguucaguuaugauguguguucaacaguuauaggcucuuuuggcucaaaugaaaugcuuuuugaaguacuuuuacaaauauagccuccuauauuugcaaauauaaguuuuuuuuuuuguuuguuuuguuuuuuguuuuuuuuuuuuuuuuuugccuuucuaaucucuuggagagucuuucuugaagaagaucaguuugggauagagauuuuagucuuugaauauauauaagccagggacagcagccuuuagucccaucugcuugaggcugaggugggauaauugccugagcccaggaguucaaggcgagcuugggcaacauagaccccaucucaaaaacaaacaaaaaguauguaaauaaguauaugcuuauugaucuccuucaauuguacaaguuagauauugucguuacuucuacuuuuggugucuguuaauugaagaaaaaacauaaugagaaaaguuuauucuacaauuuaguaacucuuacauguuuuugugucuucuuaacuagaauacauuuacuuauacuuaaaagaaaauuuuugacauauauaugcuagcugguacuuguuuuaucuccagacaauuuuagugcuuccuaggagucauaaucccuuauagcaauaccaucauuucccuguugucaagaguuuaaagcacuugagaagcaucauuuugcuuuuaaaauucauguuucuguuacaaagcauagcaaugccagaucuuauguagucuaaguacaaauguagucauuuacacuuaaaauucuacaaauaugagagccaaaauucauuuucuuuaauuuuuuuaaacagauuauugaaaaggcagcugagauugcaagcagugauagugcuaaugugucaguaaguaucaagaguuuuaaauggcccuuucuuauggaguugugcacauuauuagguaucuuugccucauaguaaugaacucacagaagaccguaacucauaugcaagaacagucugugaguguggguaaguaugcacaugauaguguuuuguuaaauggcagcccaauuugugggugaucuggguucagugggcaagcccuuuucugauacaaguacagguuuagcagguaaucuauaagggauucuguggcaccucauagauuaacaaugcugucauagugaauauuauuuaguuuaaugaggagacuguauuucucucagguaacaaagcagauuuaguaauaggcacacacaucaucaugcaagugacccaaauuucuuccaucuuagugcucugccauauuuaacauguauuuucuauuucaugguuuaauauuacugcuucagcuuccuacuuuacuauauuccagccagcaggaacaggaaaaacaauaguaguggucacaccccauucuuauucaggauaucauuaguauguaucauuucugcuuacaugucauuggccagaucuuacugaccaugccuaaguacacacgcaucugagaggugcagucuuuagccacgccaucagucaugcgcuuggcuaagaguaagagauucuaguacuaaaggaagaaguggagaauggauauugagggucaaauaguagucucugccacauauacuauucccauuuguuucuaugcagauacuacaaauagguuacuuuguugacuuggguugcuauauuuauaucuauaucuacaucuauauaucuauaucuauaucuacauuuauauaucuauaucuauaucuacauaucuauaucuauaucuacauauauauauauaaauauguauaccaucugugcuuuuuuauuuaauuuuuuggcucuuucuaguuugacuuuguugagcuguaauccaguauucucgucaucaguuuacaacuuuuaagucuauuuagcaaagucauucuaccuguagcauggcaguguuauagagacuaggaggcaaacuggagacaauguguauguuuuucccauucucacagaaucaaagcacuauuuaauuuuggccaguuggugaaaugucuggccuaggcugucuucuccuuugccauuagagcucucagaaucuuucccuaguuucucagugugagucaucugcuacugcuuucuuauuaguguuuuuggcuuaaauuuugucuuuugaauuugaaugcuugaccuuaggaaagagagcaguagugccagacuccuagucuuuacaguuuacgaaaggcucugggccaguuugggaccauaauagccaaauucuuccucucucugucuuuuuucccaaaguuuuguguuauucagguuucuggagacaguuucagauaauaauuuaauuuguaaacauugugcaaauuuuaauagcuuaaauuauauauauggccugaaaaaaauuugcaugaucaauugaugaggcuggugugauaggauccuuguguuugacugcuuuuucuugcugaggauguagacuugagaauggccuggaaucucuaagaaguaagaguuuauugaaaaaguaaaacaguaaaauaaaaguggaagcaaucucagagacuaguguaaaaaaauguguguuuguguauaaauuuaaaaaauaaaagaaaaacuuuaaaaagagacaacugcaagagcaguuaccuuuaaugauacaaaacaaauuucuuacagguguuaauuuaucagcuuauuaggcaauuacugaaacagauaauuacaguuuaagcuuaggagauauaguuacacaggcaggucuugguucaagugccugucucauuacccuuuauaagacaauauugcuccuugaaccucagauaaaugaauuaguuuuuacuauuuccaccauaaacuuguaccugaccuaaaucagagaguuugcuacacacugagcaugcaguaaucuugcccaggucugauauaccuuuacaauuuguuuguuuuuuauuaggcacaaaguacaauuaauaaaugguaaggaugggugugauggcucaccccuauaaucgcagcacuuugagaggccaagguaggaggauugcuugaacccaggaauuugagagcagccugggccauacagagagaccccaucucuacaaaaaaaaaaaaaaguauuaacugggcgugguggcauggaccuguagucccagcuacuugggaggcugaggugggaggauagcuugagccugggaaguugaggcuguuaugacagaguaagacccuguaucuuuaaaaaaaaaaaaaaaaauuguaaaccaaaaaugaaaguuucucucugugacucccaccuaccuuccucuccagagcuaauuguaaacaguuuaauuuguagcuaucaauccuaacuuuauauguaaauaucucccccuuuaaaauaaaugagaucuauauauacauauauaaaacuauauauauauauaguuucuacuuuuuucauuuaauauacuuuguggauauugucaugugaguaugaauaggucuacuuuuuaaaaaauaccuuucuaacauuccauagcauuaauuacuaguaucuauuagauuuuucuuuuucuuuuuuuuuuuuuuuuugagacagagucucacucuguugucaggcuggagugcaguggcaugaucucagcucacugcagucucugccaccccggguucaagcgauuccccugccucagccucccaaguagcugggacuacaggcaugcgccaccaugcccagcuaauuuuuuguauuuuaguagagaugggguuucaccauguuggccaggauggucucgaucucuugaccccgugaucugcccgucucggccucccaaagugcugggauuacaggcgucagccaccacgcccggccacaucauguccuuuuaccccuuaauucuucaguauuuccuuuaaaaaauggcauuuuuauacauaaccugaguagauucaugaaggucaggaaaauaauacugauucaguucuauauaaucuacagauuuuauucaaauuuagccaguuuucucagucaugugcuuuauaagucuuggauccaaucucugguuacuugcugcauuucauugucagguauauuuagcuuccuucaguccgaaacaguucuucaguguuuuuuuguuuguuuguuuuuuguuuuuuuuuuuuuaaucuuuaaugacugacauuucugaagacuauaggccaauuauuuuauagaauaucccucaguuuggauuugccugauguuuugucauguuuaggaucccaguuaugcauuuuuagugugaauaucaaagaaguaaagguguaguuuucuuacugcauuuuaucaggaggcaauaucggcuuuuaccacuacucuggaaguuaacuguuaucccuugguuaguacggugucugcuagguuuuucuaguauaaaguuaauaaauaaagguuuugugggggcguauuuugacacuaaguaaacauucuauuucagaucaagcugucacccacuucuuuuugcauucacuaauacaucuuccuugaaucaguguuacugcaguggguugccaauuuuaaaucuugcuuuucguuuuggauuuauuaguuggcuuauaacauagguuagaggcuuuucuucuacucuaucucuaucuaucuaucuaucuaucuaucuaucuaucuaucuaucuaucuaucuaucuuuuuagagucagggucuugcucuguugcccgggcuggagugcaaugguacagucauagcucacugcagccuugaacuccucuucucccccauucaucucuuuuuucuuucuucuuuuuuuuaacuuauaggagauggauuugugauuuccauuuauucgaugauuuguaauuaguuacugucauuuaucuuaauguuuaauuuaucccagaucuggcucaugggagcccauuuaagcugucucuugucucuuuuugcuuugucccuaucauucuuugagcauuucuuucuuuccgauacaacagcguauuccacacucaucuaguacuuucccuaccccagccuuggaaucaggcauuucuccggagaguuucauuuuuuauauucaguuuauuccuuuuauuugugaaaaguauguagggauggauggauggauggauggacggacggauaaacaaacggauggaauggauugacagugucucgcuuuguugcccagacuggagugcagugacacgaucauggcucacugcagccucaaccuccugagcucaagugauccucccaccucagccuccugaguagcuagaacugcaagcacaugccacuauaccuagcuauuuaaaaauuuuuuuuuaauuucuauuuuuuuuaguagaauuaggggucucacuuuguugcccaggcuguucuugaacuccggggcucaagcagucuuccugccuuagccucacaaagugcugggauuacaggcgugagccaccauaccuggccuguguaagaucuaggcccuggauaugcucauugccccuggguauaaaguaaguaagugcuccuuggagaaugcaggggugcaguugcuuccaggcccuuuugugaaacagagcuagacaguauauauuuguuuaccuccauauguuugggaaaauaaacauacacagagauauauuuauuuauccaucuauuaaagaccaugaguucucaucaauaccucuaauauggauccauucccacuguauauuuucuagucuuugucuuuucauauuuguaauucccuuuucuaaugaugagaaaucuggauuucuguuaacuuugguguauuuacuuauuugcucaauccccuguuuguaaucagucuucuagucuuauaacugucuucuuagucuccaccucauuauccuuuuuuuuuuguauuuuguauuuuuuguaaagacggguuuucaccacguugcccaggcuagucucaaacuccugaccucaggcaguccacccacccacauuggccucccaaaguguugggauuacaggcgugagccaccuugccuggccugacuuggauuuuuauccaaaaagcaauacugccacccaguguuugcacaguuuacauuuuuagauuuuuagaaacuguuuuaagaaucucuucauccuuagcuuagaaauuauuaaaggaucuaccuuuuuuuuuuuuuuauggaauuauauuuuuguaucucacauacuuagguucauuuauuauauauaaauauauauaaauuuacugaaaguucgcugugguguuugcacaauuaaauucuauaaugagcauuuuacuuuuuuagagucgagguggaaaaaaguuucuuccuguauugaaagaaaucuuggacagggaucccuugucucaacugugugaaaaugaaauggaucuuauuuggacuuugcgacaagacugccgagagauuuucccacaaucacugccaaaauuacugcugucaaucaaguggaauaaacuugaggauguugcucagguaacaaaagaucguuucuauaacuuuuuuuggguguaugguacuugguuggauucacauaaaguauccuuuucucauagguauauuuucauagauaggauaauuuaagcaggagaaauuuugagguuuuaaacucuuauacuccaaguaauggaccagaacauuuccagaauuuaaaaaucucagauuuuggguaggauugccauaccuuucaccaaauacaauugaaacauugaucuugggacaauuaucuaucaaaaguaccacuuucuaagacguggguaccuucuaccagcuucaucagugaacuccagaguuuuaaaucuuuuagacucuuugcaaugacuguucuagaaugaauguccauuguuugaaaauuacaucuauuacagagaauaauauuuuagauaauauaucauucaggucaauuuuaacauucauuucaguuguccaguauugcugaauguaugcguuuugacagaauagaaaaaagaccauuuugcuucagaaacccaccaaauuuuaguucccugauuuaauuuucaagacccugccaaaaagcacuggcauuuauucaauucaaacaacccaccagugcucaauagaaagaccuuugaaauggguuuuuuaaucagaacaaauaaauuuggucuacuaaaauaaccaaauuuuuucauguuacuuauuucaguucaaugaaucucucuaguauguagucuuaguaaaucuauagugacuaaaaauuuagugaagaaauacagauuuaucuuaauuauaugcauuuuaaaaaucuuuggauuuauuguuucacuucucaauuuaagaguagaaaggauuucuuuuguguuuacuuuuagugucuaaagaucuuuggagccaggcaugguagcacacaccucuaaucccagcacuuugggaggccaaggcagguggaucgcuugagcucaggaguuccagaccagccugggcaacauggugaaaccccaucucuacaaaaaauacaaacauuagcuggacaugcuggcaugugccuguaguccuagcuacuugaguggcugaaaugggagaauuguuggaaucugggagguugaggcugcagugaaccaaaugccauugcacucuacccugggcaauagagugagaccuugucucaaaaaaauaaaauggcuggggucuguggcucaugucuguaaucccagcacuuugggaggcugaggugggcagaucaggagguugagaccagcucagcaauuuaagaccagccugggcaacauggcaaaaccuugucucuacaacaaauacaaaaauuaaccagacaugguggugcacgccuguuccagcuacucgggagguugggacaggaggaucauucgagcccgggaggcugagguugcagugagccaagauugugccauuguauucuagccugggugacagagggagacccugucucaaauaaauaaauaaauaaauaaauaaauaaaucuuuggagacauguuauauaauuauauuauuguguguaccucgauuaaacuuguuuccaccuuagaccaaauuagacugaaaaggaacuauuuuauuuuaauugcuguagaauaguuauugucuucuagccacugauguauuaucuaaauucaggauucguuuuccaugaaccuucaguaauggaaaacaagaucuaagcauuuuuuuaguugacacauuugccuguuucuuuuggauagugucuagugcugaguacauaucuaagaaaugcaucauauuauuucauuagaaucacaauggaaagaauuucuugcuguacucuuaaaagcugucuuauagagagguuuggugaguuuuggcaauuuauuuaauuuuacacuuacaugauuuaauuuuuaauaauuauaaauaaucuuaccaaagucauuacuuuccaaugguagaguuguuuuuaaccacaacauuguugaaccucuaguauuacauaaucuuaucucuccuuuucaguguuauuuaugggcaguguauuccaaguauuaacuggagauaugaggaguuuuuuuuauuacugcuauuucaaaacccaggaaauggucucuucccaacucuucugcucauaaagaagacugcugguccauuagggccuuuggcaaagcagggaggggggaucuauuagugagaaaaauuggggaugagguuggugcuuuaugucuuuauaucaguauuucucaaccuguuuucaucacuauaccuuuaggagcuuuuauagacccuuuuccccccaauaacccaugagauuuugauuccguagauacaugguacaucuuuucauguacguauuuguaucugugcuuuauacauaaaaaaagagcuagccuuauucaauauaggguuaagaauagcuaaguaaaacuuaaguuuaaaguuaaaauuuaggcuggguaugguggcucaagccuguaaucccagcacuuugggaagcagaggcaggaggaucacuugagucuaggaauuugagaccagcaacauagcgagacccuaucucuacaagaauaaauaaaugaaauaaaauuagcugggcaugguggcguguuccuguaguccuagcuacucaggaggcugaguugggaggauugcuuguacccaggaguucaaggcugcagugagguacgauagugccacugcacuccaggcuggacaacagaaugagacccuaucucuuacaaaaaaaaaaaaaaagguuaaaauuuaaaaauuacuaggcauuccacuguauuugcuaaguaacuauguaauuuauucacguaggugaauucuaaugugucaaauuacauauauaaguuaacaauuuaugcugagugcaguggcucaugccuguaaucccagaacuuuggggccaagguggguggaucaccugacgucaggaguucaagaccagccuggccaacauggugaaaccccaucucaaaaaaaaaaaaaaaaaaaaaaauacaaaaaauuagcugggcauaguggcaggcaccuguaaucccagcuacucgggaggcugaggcaggagaaucugggaggaggcuugaauccaggaaggagagguuguagugagccaagauugcacuauuguacuccauccugggcaacaagagugaaacugucucagaaaaaaguuaacaauuuauauaaauauaugcuaauaauagaguaauuaaauuuuaaaaaaucauucaaaaguauuguuuucgcaaaaauauuuuucaaauguaaaacaacugaaaaaauuaagcuaauuuuuaaaaaauuaguuaacuuuuauuuacuuuugcuugauaugagaaaaugccuuuuaacuuagcugguagauacucauuuagauauuguugacuuuugggggagggcuugccauaauuauagauugaauaacuuguagaauuaaauaauaaaauauaaacgguuuuuauugaauucucaaagcuuaauuggucggagaauaaaacuuaacauccacaagauagccaacaagcuugcaggccaccucucccaguaugacuuugagcaaucaauugaaagaaaauccucuaaccacugccaucuauuugccauaguuuuacagcagugaucuugcauacauaucauauaccuuccaugacguugaugucagugguacuuaggugauacccaggaaaauccaaugagagaaauuaaauacuaaggaauaagauuuuaucagauggaauugagcuuuagaaaggcuacaaauucaacauuuuuuucucucucacccauaaaauuuauuuggggguaaguacuucauagcuuuucagacuuaaucuauagaauguuucaacaacaaagacaaucuuuauuagucucuauuaacaggaauggauuuuugaggcaucaauaauuaaaagugagcuuugccuucuuuugaccuaucuuggugcuccugugugucaaggaaaauuagauuacuuuugucccccauuauuucugaaccaguuucauuuuuuaaacagcuucaggcgcugcuucagauuuggccuaaacugcccccccgggaggcccuagagcuucuggauuucaacuauccagaccaguacguucgagaauaugcuguaggcugccugcgacagaugagguaucuucugcaggugguuuucuuuggggcaaggaauaacuuggguggguuugggaugagggugucuccuugaugucucauaagaaagaaaagggcucagaauuauucacaguucaaagcauuugcucauguacuccugccagcuccccaacucaauguuuauacuagaaaaaaaaaaccaaaagcaugcuaggucagaagguccucaagaucacccucagguuugaugacucacugggaggacucagaacucagcacauagucacuuacagauauaauuuauugcagcaaaaggauacagagcaaaauuuaaagagggaaaaagguucauggggugaagucaugaggaaaacaggcauacauaagcuuguaagaguucuuuuccagugaagucaccccaaacacuuuuauuucuaucaggagugaguugugauaauacaagucugcaagggaagcuuguuagagacuucguggccacgguuuuuacgggcagcuaucacauaagcacccucugccuagcauguaccagauuucuauacucccagcaguaaaguggauauacaacauaaaccauuauuugcacaaauaguuuaggugcagugagccacucuuaucaauuagggaggguggugggaauccugaaaucuuaauucccagaugcuagccaugggccaauccuauaagcaggcuuguuagaggauagcagccaagccugcuguguuaccucuuuucuucacacagucuauccacccuccagaauuaagaaauguuaauuuuugucauggguuuaaaauauauauauauauauauauauauauaauauauauauauauauauauauauauauauuuuaagcaaauacauuacaguuaaaguugaaguccucauaguuuccuuauccagucuugauuacuucucuuccuucucagaggcaaacauuaucaugaauuugguguguaugcuucuauaucacauuuuucuguuucauauauaucuaugaaaauauagacauggaauuauuauuacacaaaugugucuugccauaugcauuaguuuauaucaugcuuuuuaaaaauuuggccagauggcugggugugguggcuuaugccuguaaucccugcacuuugggaggcugaggcaggcagaucacuugaggucaggaguuugagaccagccuggccaacauggugaaaccccaucucuacuaaaaauacaaaaaauuagccaggcgugguggccggugccuguaaucucagcuacucaggaggcugaggcagaagaaucacuugaacccaggaggcagagguugcagugggcagagaucguaccacugcacuccagccugguugacagagcgagacuccgucuccaaaaaaaaauaauaauaauucagccagcugugguggcucacaccuauaaucccaucacuuugggagacaaacgcaggcagaucgaugagcccaggaguuugagaccagccuuggcaacaugguuaagccccgucucuaccaaaaauacagagacauuagcugggcguggaggugcgcaccuguggucccagcuacuugggcggcugagguaggaggaucacuugagcccuggaggcggagguugcaggagcugagauggugccacuacacuccagccugggugacagagugagacccugucucaaaaaauaaaauacaaauacauaaauaaauaaaaauucaacaucagguuuuugagguuagucucucccauuauguuuaaaugucauuuauuccuuucacuacuguguaauauucugucauagggauauaucuuauuuaauucauucccuauuaaggaauauuuaaguuucuccacauuucccuauuauaaauaaugcuucagugaacauguuuguacagucucccuuggauggugcauuugugagaaucuaugagauucacugaagaaaugacugucucagacaaugaaguuuauccauuuucuuucuagguucaaaagugaggcuuauguacuuuaugguuuuugaaacauaaaagcccacaaaauaguguggauacuaugauccuuuuuucuuuuuaaaaucguguauguuuuaagcuguguaauagccaaaaguaauuacacagacucaccaauagugcuuacuucuggggagugaaauuagaaaugugagagaagaggaaacagcuuccuauuccuauacuuucuauuuuuuacacuauuuauagguuauauagugggcaugaauuuuacaauaaaccuaaucaaaauuguguuauagauaguuuuaaaaaaugaauucccaguugcuucaccaucugcuuaaguuugcauuggagaccuguuguggaggggccaccugguucuccuugggcugagccaaguguuuuucuuaaacgcauugaucccucugaggagauggcagugauccguguauuccguguagcuaauucuggugguuuuucuauugugaaauuucugguuaugaguuuuugguuuugguauauagugcccuggguuucagucccagauaucugccuuagacuacuaauuccuuaaccauuuauuacccaauacuguggagaguaaguggagcacuuggggcacuugggcuucauaccuuauacugcuggaguugccucugauaggaguguguuuacagguagaaugguuuggagauugacacaaaauagagaaccacuaaccuuaauuaauugagcucaguuaauuacaauguuaucuguuauauuauuucaaugaucaauucccacuuauaaauguauucacuuucucauccuucaaacuauuugaaguuaagauuuuaauuguacauugguuaucugggacaacuuaacccuaauaacagcaaaggaaaauaaauugugaaaguacugauggaauuuuuauuuuaaaaaugauuguuuuacuaagcacaaauuuuuuagcaugaucagaaaucaguauuaaaguaccuaauauuuuugguaacucuuagcugacugaaaauacagucaugaauuuuaacaaucuguaguaguccauuuucacaccauuauaaagaauuaccugagacuggguaauuuauaaaggaaagauguuuaauugacucacaguuccacauggcuagggaggccucacaaaacuuaaaauuaugguagaaggcgaaggagaagcaaguaccaucuucacaagguggcaggaaaagggaaagagcaggggaaaccaccucuuaugaagccaucagaucucaugagaacucacucacugucaugagacuagcauggagggccacauugauucagucaccucccaccaggaugcuccuuugacaugugggaauuauagggauuauaauuugaggugagauuugaguagggacaaaagccagaccauaucacaaucuaauucauuugauuaaaauaucucuaguaucuguucuuugacccucuugacucccuuuuccccaucugaaaucuucagcuuuuuuugugauauuguaacagugguacagugaaggaaagcauguaacaagccuggcccaaaagaaccauuguguuucaacaaguucacauuugauaguuugauaccaagggaucuuuuucuggcacagguuguuugguuacucacugugucuuuuguuucuuucagugaugaagaacuuucucaauaucuuuuacaacuggugcaaguguuaaaauaugagccuuuucuugauugugcccucucuagauuccuauuagaaagagcacuugguaaucggaggauagggcaguuucuauuuuggcaucuuagguaagucuuuuauauuuuacuuugagcccaccaggugcuuuaguaacuauaaacaagcauaauauauuuaauagaaaaauagcugcuuuaguuuuuuucugaaccguuuauaacauuuauaugguuuuggugccuucuccuguuucuugauaccagcacucuugauuuuuaugauuugagauuugacaaaguaauucaguuauccaagacccuuaugugucccuccaugccugcuugauuucuucauuucuuccuuccuuucuuuuuuuuuuuuuuguguguguuuucuaccugcuugauuuuuaacugaaauuaauaauguauugcuauuuuccaguaaaguguacuuauugucuuaauauauuugggcucaaugcagaccuauuuauuucaucuagaaaguugugggugguacugucauuacuaguguuauugagugaagguaaagguauacuauaaugacagcaauuuuauucaauuucuuuauuaaguagguaauuuccagaaauacacgaaccuuacuucaccaaguucauauaagaguaaaaucaggaaugagaacuaaaguuauuccuuuguuuucuaaggaaauuguauuaauagauuucucauuucugacucuguacucagacauuuuuuuucccucccaaucuggacuucauagugcugaaacuaaugcuugucagaaaaaaaaacuaccuuuuuucuuucuuucucucuuucuccuuccuuccuuuucuuuucuuuuucuucuuuucuucuuuuuucuuuucuuugcugagcuucucaaaggcaauaagcucuauaauguugugcucuuaauuuuaguuuuauuucugaauaugguuuucuuauucauauauuuuuuuccacucuuuuuuuuacuuucuuguguuguucuagaaccuuuucuuauuuuuaacuugucuuuucucauucauucagucuuaguuuuuaaaccucucagggaauaacaaaauaaguauuccuuccuuuuucaaauauguacaucacuuuuuaaguaagaaaaaaauuggaauagaugcuaaucagggcauuagucaauuguuuaauaccagucagauuucauagauaccuguuucagccuauugucuuuaaauugguaagauugccuuacccguacaaaagcaaaucagguaagauguacacauuuuagacuucuuggaauaaagaauuaacuaauuauagaauaucauagcuuuugaacuuugaaguauuaacuaacuauagaauaucauagcuuuugaacuuugaaguauuaacuaauuauagaauaucauagcuuuugaacuuugaaguauuaacuaauuauagaauaucauagcuuuugaacuuugaaguuuaacaaauuggaaaguugacccaugucacuaauaauuaugcacaaaguagccaggcgugguggcucaugccuguucccagcacuuugggaggccaagguggauggaucacuugaggccaggaguuuagaccagccuggccacauggcaaaacccugucucuacuaaaaaugcaaaauuagccaggcaugguggcgcaugccuauaaucccagcuacucgggaggcugaggcaggagaaucgcaaguaugaaggggcuggccaccccauccacauucgagccagaaauggggaggggagggaaggggagggaccagcauuuccuucuaaguccaggacucauuuuuugugcacaucacuucaucuugcauccuguuggcuagaaccuagucaccuagcgacaucuagcuacacuuuuuuauuuuaggcaagcuugaacccgguggguggagauugcagugagccgagaucacaccagugcacaccagccugggcaacagagugagacucucaaaaaaggaaggaagggaggaaggaaauaauaaugcacacaaugaccuugccaucauaaguuuauuuuuuguagaauaaagaagucaguauuuauucggugaucugaaguguuugauaaacaaacuguucagauaucauuaacuuucugcaggucagaagugcacauuccugcugucucaguacaauuuggugucauccuugaagcauacugccggggaaguguggggcacaugaaagugcuuucuaagcagguaucagcuuguuuuauuuauucauuuuuucuuuuuuugacagacaacguuuaaagcaugaauaucagcuuguuuuaaucuucauguucaauuugguacuugguguuugaucaguuuuaucaaaugccauuucucccaccacauuauuucauagaagucucaguaacagacaaccugaugaauacauucuuuugucaaaauuuaagucaaaaaaugaaguuucaaugaacuuagcacaaaaauauuaacugaaugcuaccugaaaaauaauuacucggcauuccuaauauauucuauauuaaucccaaagugcuaagaaaugcagaugugaaccaccacacccagccccacccuuuuuuuuuuuuuuuuuuuuugugacagagucucgcucuguugcccaggcuggagugcaauggcacuaucuuggcucacugcgaccuccgccucccggguucaagcgauucuccugccucagccucccgaguagcugggacuacaggcaugcgccaccaugcccagcuaauauuuuguauuuuuaguagagacaggguuucacuguguuggccaagcuggucuugaacuccugaccucgugauccgcccgccucggccucccaaagugcugggauuacaugugugagccaccguaccuggcugccccacccuauuuuuauaucagauuccuaauuuccaguuaaacuacucuuuucuaauucauuugcauugccagaagaacucucauaggcuuccauuagguguuuuuaauauuuaggauuuuucaugauguuaaaaacuuuuucugaucccuuacuuuugaaaagcccauuaaugauuguaauaauagcuaauguuuauucaucacuuauuaugggucauuuauucuuaacaacaacauggaaucaauauuauuaauccucugaauuuuauagaacccugaaauauaucucacaucucugccuauuucccuuguguucauggcuaccauccuaguccaagcuacuauucuuuuucacuggacuucuucauuaacuaucuaaauuguaccccguguuucccuuccuacaucucccccaacauucuauacacagaagauaaagugacauuuuaaaaauguagacuguggccagaugcaguggcucacaccugaaaacccagcacuuugaaaggcuaaggugggaggaucacuuaagcccagaaguuugagacuaaccugcacaacauagugagacccaucucuagaaaaaauuagaagguggcuugcaacuguagucccagcuacuugagaggccgaggugggaggauugcuugagcccaggaauuugagguugcagugagcuaugauuugauuguaccacuacacccuagccugggcaacagagcaagacccugucucaaaaaaagaaguagauuguauuacaucauuucccuuuuaaaaucccuucaauaauuuuucauugcacuaugaguaaaauucaaauuuucugccaaagccuguuaggccauacuuagucauaacuugcuuauugucaucauauaaccauuuuccacacugcauauuuucugggagccucagcuugauguuaaagacaauaaaaggaugauauauguaugaacaaauuauucuaacuccuguuuuuuuuuuuuuuugauugaugaauugugagaggaagacuuuacccuguacauagcuguucuuguuauuacuauaaacuuacaaaaggacaagguguugaaacacuuaaaguauuagacuuauguccaugggguauucaggacacuguuccaggaaguguggauaucaacacaauuagagauggagcaugaaaacuuucaacuguacagacauggaagaaguuucaaauuucacauacuuguaaaaaguuccuguuugcuuagcccaguuuuuaucugguugccuugucaccaguguuuguacagcuccugaaacuguugagaaguagagugaucugugguuuuaacagauggcuaacuugguaaguuucagccaucucaauuuuaucaucaagcugcauagguccuuccuaguuuccugugagcaaggucucagccucuguggaaacugcaugcuugaauucaucucccuacauagucuuagugguuuccuugcauagaagcagaauuuaaaaaugaaaacauguuauaaauuaaaucucuuguucauggaauuucaagccacauuguuuauauuugugauagacauauuuuauaugcuuguuacgguauacuuuuuaauucuauuuuuaacauuuguuuuuuccaguuuuaaugauauacuuguaaaauaagcugcuccuucuuuaugcguggcugaaguuguuaugaauuuuauguacugugacauaaaagacccucaguuauuaaauaauaaaguugaauuuuauuuguuguuauuauuuauuuauuuauuuuauuuuuugugauggagucucacucugucacccaggcuggaguacaguggcaugaucuuggcucacuacaaccucugccuuccagauucaagugauucuccugccucagccucccuaguagcugugauuacaggugugcgccaccacgcuuggcuaauuuuuguauuuuuaguagagaggagguuucaccauauuggccaggcuggucuugaacuccugaccucaagugauccgcccacuucagcuucccaaaauacugggauuacaggcaugagccacugcaccugacccugauuuauuuauuuuuugagacauagucucacuguguugcccaggcuggagaguguagugguacgaucuuggcucacugcagccuccagcucccagguuccagugauucuccugccucagccuccugaguagcugggauuacaggugcacaccaccgugucuggcuaauuuuuguauuuuuaguagauaggggguuucuccauguuggccaggcuggucuugaacuccuggccucaacucauccacuugccucaguuucccaaagugcugggauuacagacgugagccaucacacccagccuaaaguugaauuuuaaacauaaugguuuugauuuaguuggccauuguugauacaccuuguacuacuugcauaaguuuuuuuuuuuacuugcauaaguuuugauagccauaguuauuauaaaaacaaguaauuuagauuugaauaacaaauagcaugucuauauucacacuuuauuauaaaauaauucguucuagcuaugcuguuaauggaaauagaauauauugagauaucauacaagagugaugacaagaaguagauauuaagguugaauagcaagaaccucagaguuacuucuacauagguuuuucucuaauacuaggaaguuggccaaauggacugguuuagguuagugaugucucaaauucuacuauacaaugaauugcagaauuuugaguaguuuaaguuucauauuuaucuucuuucuuucuuucuuuuuuuuuuuuuuuuuuuuuuuuuuugagacaguuucucacucucuuacccaggcuggagugcugcaguggcuuaaucuuggcucacugcaaccuccaccuccaagguuaaagcgauucuuaugccucagccucccaaguagcugggauuacaggcaagugccaccaugcccagcaaauuuuuguauuucuuuuuguagagauaggguuucgccauguugcccaggcuagucucaaacuccugaccucaagugauccagcugccucagccucccaaagugcugggccacauuuaucuucuuaaguacccauagugcgcaccuggcccacauuuaucuuaaguacccauaaucuaagucugcuuuucucgaauuuguaagauuuuguuuaagaaaagguuuaaagaaaguuugaaaaugaugcuauaacaacuguuaaaaauaaguuuauuguauguaaaaugcuuuucguaagucagacacuauuuuuacuucagcugguuauguguguuuaugguuauguguauauguugggagcagguguuauugauugauaugaucacaugauauuauauuacuuuuagucaaaugaauuuuugguguggggaacuuauuuuucagguugaagcacucaauaaguuaaaaacuuuaaauaguuuaaucaaacugaaugccgugaaguuaaacagagccaaagggaaggaggccaugcauaccuguuuaaaacagagugcuuaccgggaagcccucucugaccugcagucaccccugaacccauguguuauccucucagaacucuaguaagugacugugcuuugcgcagugaaucuccuaugaauagcaagcagaaagucacugccuuaugggaguaguagggccagcugucagccucaggaaguagaauauaauuaaggaaggaaaaucuuaaaaguucuccgaggcuaugcuuauauucaauaggauguaugcuuaucagcuaaacuuaccaguggauuuagugaaaguuauuacaaaugaauuuauauuucaauuauauguaauuaaauuuauuuucuauauuacugauuuuuaagaguugacaauccuaauaagcaaaauguugcaaacuguaguaaauuauuuacugauugauuuuccuauuuuaaaauaagaucuugucuugagugaauuuggcaacuuauuucucacuuucucauucccuacaaaaguaauaauggaaaauaauagucuguauucaguauauuaucaguauucaaaugaaucccuuguuaagaaaucaagaauggucucaaaauaguucuaauuuuaauccaaugauuuguucuaauuuuuuauucacuaaauguaauaauguaaaguuaagcaaauaaaaggaaacgagagaaggaauguuaaguggagaaggugagaagggccaaucuuagguuuugaguccagccuaucuggcauuaguauaugccacccaaggcuguccucaugguugcuuuucuaccaagugggacucuucuaagucugacucuucugcagaccugacaggaauaggugaggaguuuucccaagccuaguauauagugguaaaauuauaaucuucuguaucauuacacugaaguugacuaauuuuccccacuugauuucaguguugaaaagugcaaauacauggauuccaaaaugaagccuuuguggcugguauacaauaacaagguauuuggugaggauucaguuggagugauuuuuaaaaauggugaugguaaguacugagauuuuuaacaucaaauuucuuagaauuuuucauuuguugccauuuugcuuuaucugaaaggugauguguaguguaaguguguaacaauuugcagccaggaagguagcuauuaaugguccuaaagucaaguugaacauguccuaaaugcuuuuuuuuucccccucuuauaaaaugauuuauaccauucacuuaaauauacuguccuaaugaaccuucuuuuauuucccccuacaaaauacaaaacgcgccuacuccuuugauuaaaaagcuuaugaaauacaagauauuauuuuuacuuuuuuuuuuuuuuuuuugagacagggucucacugucacccagccuggagugcaauggcacgaucuuggcucacugaaaccuccaccucccaggcccaagugaucauccuaccucagcccccagaguagcuggaacuacaggcacacaccaccacaccugguucacuuuuuguauuuuuuguaaagaugggguuucaccauguugaccagggugguauugaacuccugagcucaagugauuuacccaccccggccuuucaaagugcugggauuacaagcaugagccaccgugcccaggcaaggauauuuucaguaauauauucauacaucuuguuucagugauagcaauauugauuuugcugccauaguuuuguauuuugaugaaaguaccuaacagacccaaaauguguaaaggaaaugccucugaaguaaucauaccagccaauaggcaguggugacuuguuaguuaugugacuacaaacaaggcacagaaaacugauugagcuucagguuuuucauauccuugagaauuauagcaucuguaugucaggguuauuaaaaggaauugagauaacauaagcaaaugugcuuaucagaauaugugcuuacaacuuaaaaagaacucauaggguuuugcuaaacauuuaaugucacuugaccauacaaaugucauuauguggaugucacuaguuucaugugcucucuucccugaaaauacccuuagacaugauaauaaauugaaccauuacaguuuugugaccucgugaugcaguuacuuacgugauucuuaagaacucuccguauagugguaaaagcaagcaagaaggaaaaaauuaaccauguaauuaauguaauacacauacaguguaauacaaacaguauuacagcauacaauuaguaccccugaacccauguguuauccucucggaccucuaguaagugacugugcuuugcgcagugaaucuccugugaauagcaagcagaaagucacugccuuaugggaguaguagggccagcugucagccucgggagguagaauauaaucaaggaaggaaaaucuuaaaaguucuccgaagcuaugcuuauauucaauaggauguaacuuacacauggcaaacaauuuaaaaaaucuuuuaauuuaaugucugaaauaaugucacagggacaugcuauccaaagaguguaauauuuguuauaaaauuagugaaaauauuagcacagaguuuguuaauguuuuuaguuaauucugaguuagucuugaauuaaugaguuacagggcauaaaaggaaaagcacuuguaaugaagcaguuuguuuucccuuagauuuacgacaggauauguugacacuccaaauguugcgcuugauggauuuacucuggaaagaagcugguuuggaucuucggugagaucuagucuuuuuuuuuuuuucagucuaaugucuucccauagcaaaaauaucuagaauuucuuguuaauuccuucccucuuguucuuauuuuuaguuguuguucauaauaauauuuauauagcacuuuagaauguacuuucaaauauguugucuugccuaaacuuuuucaguuuaaaacuacacauguuacugaaauuccagaaagaaggaauagguuugaacuuuaauaagguuuggacagacagccagaauuacauuccaaccuaugguguugaaagauguacugugggucauggcaaugacaaggccagagaaaguccugugccuuuuuauacuuaguccagggacauugauuucucuaccuaccaagggaaaagagaggaaaauguuuaggugcauucucagguuuuuaguuugccaccaucaauagggguagauagugagcggaagagguuuguggugucgugacagaaaaaaggaaacauaaaaucaagccucagacugggaaucguauucacaaugaacagaacaagggguaaauauuuaaagagcccauagaagugaacauaaggaaaagaugugaaaaggcauuuuauaaaaaguauaaaaacaaacuaauaggcauguuggcacacaccuguaaucccagcacuuugggagaccaaagcgggcagaucacuugaggucaggaguuugagaccagccuggcccacauggugaaacccugucucuucuaaaaauacaaaaguuagccaggcguggagcacaugcccguacucccagcuacucugguggcugaggcaugagaaucgcuuaaacccgggaaguggagguugcagggaacagagauugcaccacuacacuccaggcuggaugacaaagugagacucugucucaaaaaaaaaaaacaaaaaaaaaacuaacaugaaaauugucaguuccaauuaagaaguacagauuauaagaacaauugggccgugcaugguggcucacuccuguaauccuagcccuuugggaggccgaggcagguggauugccugaggucccgaguucacgaccagccuggccaacauggugaaacccagcucuacuaaaaauacaaaaaauuaguagguugugguggcaggagccuguaaucccagcuacucgggaggcugaggcaggagaauugcuugaaccugagaggcggaaguugcggugagcgagaucaugccacugcauuccagucagggcaacaagagcgaaacuuugucucaaaaaauuaaaaaaaaaaaagaacaacuggauauccuaacaaagauuuucuuaaaugauaauccagucuagggugcuauugaagcaacaaaaacacagguauuuuuauauacuauuauaaauuaauauaaaccuuaauguaugaaguuaauuuauacucuuuauauccaguauuuccacaauuuacuuuaaaauuggaauuguagacagagauuuauacacaaagauauaguccaguucaucaguguuuucaaauuuauuaccacauauuuuuuuauaacauccucuuguaauuuuaaaaucugugcuaugcugugucuaauauuuuucuucuuccucuuuuuuuuuuuugagacagucucgcucugucacccaggcuggagugcaguggugcgaucucggcucacugcagccuccgccuccugaguucaagugauucuccugccucagccucgcgaguagcugggauuacaggcacccaccaccacgcccggcuaauuuuuguauuuuuaguagagaugggauuucgccauguuugucaggcuggucucaaacuccugaccuugugaucugccugccuugggcucccaaagugcuggaauuacaggcgugagucgccgcccccugucuuuucuucuuuuuauaugcaguuauugucaguuauuauuagagauuugcuuccuuauuaguaugguuucagcugggcuucuaauuuuguugauuuuuuuguuuccuacuuuaucaguuauuacuuuuuuuuuuuuuuuuuuacuuuuguguuuauucuguucucauuuuuuaaaaugaacucuuggcugggugcaguggcuuacgccuguaaucccagcacuuugggaagccaagguggaucacuuucgcucaggaguuugagaccagccugggcaacauggugaaacccugucucuacaauaauaauaauaauaauaauaauaauaauuagccaggcauguuggcaugugccuauagucccagcuacuugggagcugaggagggaggauuucuugagcccaggaggucaaggcugcagugagccaagaucacgcuacugcacuucagcuugugugacaaagugagacccuaaucucaaaaaagaaaaaaaaagaacucuuaacuuuuaaaauggaaauauuuauguacuuucauaauauaucaaacaguauauaaauucuaaauauuucauaauuucuauuuuuaucuuauugacuccugaacuauuuaaaauuacagcuggauacaguggcucuugcuuguaauccuaauauuuuggaaggccaaggugagaggaucgcuugaacccgggaguucaagacuauccugggcaacagagcaagacccuagcucaguaaauaaauagauaaauaaauaaauaaaauuuaauuuccaaaggcauacuuuuuuguucucuuuaugauuucuaauuuuauuguguuguuauuguaucaaguauauguucagaucuauauucucauuaaacuucaguuuugauuugucacuucguagguauguuacaagcuccuauuauaauugacauuugucauugccugccugaaaucuuaucaguuuuuguuuaucuugaucuuauauuuguuuuuucuuuuuuuguuuguuuguuuguuuuuugagucagagucuuacucugucacccaggcuggaguguaguggcaggaucucagcucacugcaaucucugccuccuggguucaagcaauucucauaccucagccucccgaguagcugggauuacaggcacgggucaccaggcuugguuaauuuuuguauuuuuaguagagacgagguuucaccauguuggccaggcuggucucgaacuacuggccucaagcauugaucuuauauuuguaaaucuauacaagguuugauuucuuuuagcuucugugcccuccuuuaucauuaagaaauaugccucuuaaucccuaguaauuuuguuuuagucuguuuuguccaaaauugacauuuguauaccagcuuauuuugguuaguauuuaccuuuguaucuuuuauuuuuaacuuuuauuucauuuuauauuauauuugucuccuguaaauagcauauaguugaauuuuuuugugaggauggauuuacuccaauaugaauguauuuuauuaggaaauuuuaauuguuuauugugauuacuauauacuuauuuauuucuacuaucuuauuguauguuuuauauuuacauccuuguuuuuguccuuuuucucauuuauuuccuuuuauuggauugauagggguuuuaaauuuucauuuucccuuucuauaaaauacuuuuuaaauucuuacuuauuaaaaaaauuuuuuuuagagauagagucucacuguuacccacgcuugagugcacuggcaugaucauagcucacugcugccacaaacuccuugguaacacaauccuagcucacugcagccacaaacuccuggguagcagaaucauagcucacuacagucacaaacuccuggguaccagcaauccucucaccucagcuucuugaguagcuaggacuacaggcacaugccaccaugccuguaaucccaagcacuuugggauuuaaaauuuuuuuugagagacagagucucacuauguugcucucucuggucucaaacuccuggccucaagcgauccucccaccucagucuuacaaguaucugggauuacagacauaugccaccauacccagcucuuauauagaaucuuuauauacuauauuauuuauuuuagggaauauucuuaaguuuuuaaacugcauauuugauuuaacaaguuuuuuuuguuugaaacgggaguuucccucuuguugcccaggccagagugcaauggcacgaucucagcucacugcaaccuccgccucccagguucaagugauucuccugccucagccucccgaguagcugggauuauaggaaugugccaccaugccuggcuaauuuuguaguuuuaguaagacgggguuucuccauguuggucaggcuggucuugaacucccgacuucaggugauccgcccgccuuggccucccaaaguauugggauuacaggcaugagucaccgcgcccagccagauuuaacaaauuccaaaauuaauccauaacuuagcccucuucuugaucauuauagguacuuuaggauaaauucuaccacuuauauuuuaacuaauauuuaacaacuccuuauauuauucguuacagugaauuuuuacuagaauuucuuguauacaauuuuaaauauuucuucauucaccauugcuuuuuguaccauacucccucacuccggguuuugucugaaaaugaauuuauauuacccucaaucuugaguaaggcugggcacgguggcucacgccuguaacccagcacuuugagaggccaagguggguggaucaccugagaucaguaguucaagaccagccugacaaacauggugauaccccgucucuacuaaaaauacaaaauuagugaggcaugguggcacaucccuguaaucccagcuacuggggaggcugaggcaggagaaucucuugaacccaggaaggggagguugcagugagcggagauggcaccauugcauacuccagccugggcaacaagagcgaagcuccaucucaaaaaaaaaaaaaaaaucuugcauaauaguuuagcuggguauggaguuuuuguuuacuauuauugggauacaguauaauugucauaucacaauucacugguuuagaguguacauuucagugguuauaugcauuuucugaguugugcaaccaucacuacaauuaauuuuacaacauuuuuaucaacccuucaaaaacccugcacuccuuagcuguuacccccaacccccucccugaaaccacuccaauucuaggcaaccacuaauuaauggucuauagauguaccuuuuuuggacauuuuauauaaauggaaacacaauauggggccuuugucacuggcuucuuucucuaagcguaauggcuucaaaguguauucauguuuuaacaguaaccaguauuucauuucauugucaaacaauauucuuuugcaaggaugugccacauuuuauuuauccauacaucaguuaaugaauauuuugguugguuucacuauuuugcuauuacaauaacugcuauaaaacuauacauagauaaauguacacaguuaaugcuauaaacauuuguguacaacuuuugagucaaucuguguuuuaaauucuuuugguaaauaccuaggauuaaaauuacuggaacugauguuaacuuuauguucaacuuuuugagaaacuaucaaacuguuucccacacagcugcaucauuuuacauuccaaccagcaauguacaaagguuccaauuucucuucauucucaccaacacuuguuauuguccaucuuuuuuuauuauagccacccuaguagguuugagguguuaucucauuguggauuuaauuugcauuuucccaaugacuaauguuguugagcagcuuuucaugugcuuguugguuauuucuauaccuuuuuuggugaaauguccauuuagauccucugcucauuuguaaauuggguuauuugucuuuuuauuguuaaguuauaagaauucuuuauauauuuuauauacuagacccuucuuagauaaauuauuugcaaauauguuuuucugguuguuuguucacuuuaauuuuuaaauagugugugugguaggaauccaacuuuauucuuuuccauuuagauguauaguugucucagcaccauuuguugaaaagauuauucuuucuucauugaauuaucuuggcaucuaugucaaaaaucaauugauuguacaugugaagguuuuuuccugaacucuaaguucaauucuauaugucugucccuauguauaguuuugauuacuguaaauuaauaauaaguuuugaaaccaggaagaaugaauccuccaaccuuuguucuuucucucuuuucauuuaucugggauuguguuaauuuuuccuuuguuucugaauaagaauuuugcuacuugauagguuuucuuucagcaugucuaauaugucaucccacuuucuucuggcuucccugguuucucaugagaaaucagcuguuaaucuuauuuaagauccuuguaagugaugagucacaucucucuuguuccuuucaagauucucuuuauuuuugguucuugacaguucgauuauaauaugccuacuucuauuagaguuuauucuacuuugaauuaauugagcauccuggacauauauauuauuguuuuucauaaaauuuggggaguuuccagccauaauuuuuucauauauuuuuucugccucucucucucaucuccuucuuaaacgccauuaugcauuuauugcuuugcuuggugguguucuacaggucucuaaggcucuguucuuuuuucuucauuauuuuuucuuuuguuucucugauuggauaauugaccuauccacaaguuugccaauuuuuuauuaugcucauaucugcuguugugucuaccuggugaauuuuaaaauuucaguuauugcccuuuucaacucuggaauuucuguuugauucauuuaaauaauaucuaucuauugauagucuuccuuuguugauacaucauucucacaguuguuuuguuuuguuuuguuuugagauagggucuugugcugucgcccaggcuggagugcaguggcgcggucucggcucacugacaccuccaccucccagguucaaacgauucuccaccucagccucccaaguagcugggauaaugacaagcggccacuacaacuccuggcuaauuuuuguacuuuuaguggagacaggguuucaucacguuggccaggcuggucuugaacuccugaccucaggugauccaccugccuuggccucccaaagugcugggauuacaggugugagccaccgcccccaaccuuauaguucuuuaaacaugguuuccuuuaguucuuugaacauguuuaaaauagggauuuuuaaaucuuuguguaauaaguugaaaauuugauuuuccugaaggacgguuucauugaaugcauuuuuccuguaugugugccaugcuuuuuuguuucuuuguaugucacauacuuuuugccaaaaacuguucacuuuaaauaauuuuacaacucugaaacucagauuccuucucccuucaggauuugucguuguggcuguuuguuuauuuuagugacuuuuuugaacuaauuauguaaaguuuauauuuuuugucauguguggucacugaugucuuuacuuaguuuauuggucagcuaaugguugaccugauuuucuuaaaugccuggaauccaccccucuuccagucugcugaggcacuuuaugcacauguugggucaugccuucaacagucagccuggugguucagaacugugccuuagcccuaacuuucugcuuucacaaagccucaaaguuagccauaguugagagccagggcuuuguaagcucuuuccuuugcauguacacagaccugggaauccacaauaguauccaugcacacggccuucuagauuccuaccaguaauuuuggagcuuuucagugcaccauauggacauguaauuaccuaccuuuuccuuuuaagcuuucaguuagcuuguugguucccccaacuguuauuuacccccaagacagcuacaauguuaaacagaugccucugaguauuuuugagaaacuccccaggaaaaaggcaguucaugcuaggugaggucugagucaggucaaauaaacauaguauuguaagugggaucuuccuggaaacuaccagagaggccaaagaaugacaguucugugggaaucaggcuuugaaggagcuccaacuucauuuuucuuuccucuaguggcugucagacaugcauucaccaugauugugggcuauuuguugucaaggcuaccacauaacugggaaggggguugggacuaggccaugguaaaacaaaacagauucacguugggguguguguguguguauguguguguguacguguguguguguuuuaaauaaacacuuauuggauugcugcaagccuuuguuuuauuuucagaacucuaaaauaguugauuucaacaauuuuugucaguauucuuguugcuuuuauggagaaguagauauucagaguuugauaucauuuggcuauagaaguuugaaauccaaauugacugcuuuccucagaagccuugaggauauuauucauuugucuucuagucucgguuuuuaaaaagucuguucucggucugguuaucgguucuuuguaaguaaugucuuuuuuacaccuuagugcaucaaaaaguuucucuuugccuuugucugcaguacaaucugugcguguguauuucuuuuauuucuuuuuuuuaucaccauuuucauugugccuuuucaaagaagucacaucuuuuaguuucugaaaacuuugaacauuuccuucaguauugcaguucucccacucucauugucuuuuucugcagcucuaguagauuuauauuaaacuuuccuguucucuccuuuaugucucuuaaccuuccauauuuucuaucuuuucauaucuuaucauuauaacaguuuuacucaagucucugugugcucuggcguugagaccaggcugagucuuuucauaucuuuaugugacuuucuuaguaauuuccuauucuuuuccaguucauuaucucugcaacaauguuuacucuccuguauuguauuuuuuuucugcuuagacuuucuauucuuuuucaucucuuucucucucucucuuuuuuuuuuuuuuuuuuuucaacggagucucacucugucacccaggcuggagugcaguggcacgaucuuggcuaacugcaaucuccaccucccagguucaagcgauucuccugccucagccuccccaguagcugggauuacaggaacccaccaccacgcccggcuaauuuuuguauuuuuaguagaggcaggguuucaccauguuggccaggcuggucuugaacuguugaccucaggugauccgccuggcuccaucucccaggucaaagugcugggauuacaggcgugagccaccacgcccagccuaaagucucuuucagauuguucuuuuuuaguucuugggauauuacuuuuucauuuaucugcgugacuuuauucauuuccuuauauaguuaauaauacucaguuuugaauucauuauugauggauaauuauguuuucuguaaagguccuuugcucccuggguugugaauggaucucuaaaaaugaguuuguauuuuguuugagcuguugccaaaggccuguacacacaaucagccaguuuuuauguuaacucccugccuucagaccaucacaccucauagauaguuuauauuuagaucucauaagagagugugggaaggcuugaaguuuugcacuuacaugaaacuuuuuuuuuuucuugccuacccaguuucugggguagaugggaaacuuucaugccacaucaucugaucaaugaaaagauauuucgaguuccaguccucccagaccucaguuuuguguagugugggauaugaugagguuccucuucaaauaaucugaucaaucuuuuguucguuaauuuauagaacccccccacuuuuuuucuccuuuuucuccuuuuuuuuccuuuuugccuuuguuagauccccaggcacaccacaguaccaagcguuaucaguaccagcucacauuccuuuccuuauuuagaaagaggacuaacuuucuagcucauuacagacaccccuuccccuuucucuccacuuuuucuucaugugcccacccuaucuaaaaaaauucagauguuuagccaaccaggauuaguuuagauuguacaacccaaccccagccaauggggaaagaaugcagaggcaggacuugcgucaggaauaaaggcugucgugccccuuuguucaggugugcucucauggcaacuggccaaggaggcaccccucuacgcagaaguaaaauugcuuugcuaagaauccuuuguucaaguguucaguuuccuuaggauuuugaguguuauuccuaacaguucuuugucggguccagauccuaccucaugggccuaaguccgugacuguuuuuggugggcauugaaaugucagccaagucuaacuuccugagccacugcugugagaaaucucuauuuuuggaaccuagaggucuuuuuuucuuucuuuuuuaaccacaccuauuuauaaaaccuuuggacuucaucauuuuuuuaaugugauuuaguaucugcaacaaccuuagucuacaagguugcuggaaacgguuagacgugugaucgacuuuguuccugcaagauuauaauaucuccugauuaauuucuuaaguuucaguuauagucuguuauuaugaaacauauguguauauauauuuuuaaaacuugcaacccuugcuguuuauugacugaaccaggcauuguauuaaguucuucucguaaguaauaucguauaggcuuacauaucuauggggcuauguuauuucuuuuuaacacauuaaaaauuaaaaugcuagagguuuuaaacaaagguuacagaaauauuaaauggcagagcuaaauucaaauccaggacugucagacucuaaauuaaugccuguuuauuauuuuaccagucuggcuaagugagaaaauaaugugguaagacaugucuaguacuacucuuuguuuaucagaguauaauggugccuaaaauaccuaaauuuccuuuuuuuuaaaaaaagaaauaauuuuuuauuuuuagguuuuuccaaguuacacuuuccaguaguguaaagguagaaagagcaauuugggauuguagcugugauuagaauaaagaaaagagaucauaauucaucuaaaaaggacacuguggcuacuacaggugacagauuuuuuucuuuuaaauuaggaggaauuucuaaugcagcuguguaaaaauagaauuaguagcuuugaauagguagcuaguuuuucaaacacucauaagguauacugcauagauaagaggaauaggucauuagaauaaacugucugcuugaggaccauaaacccaguuggaccugggcuaccuguuuuuguaaaugaaauuuuauuggcacacagccacuugguuacauauuauguauggcugcuuuugugcugcaacugcagaguugaguguuuagucuguagugccuaaaauauuuauuaucuggcucauucugggaagaguuuaccaacuccuccuauauaaaguaagcccccaggaauauguuuuuacuugacugaucccacaaaaaaggagggaaacuuuaagcugaaguuuaguaacucauuuguucuuuccaagguuagcacagaagcuacacaguggucuccuuugcuaauuaguagauucaggccauaucaugagcuucauuuaguuaugaaaagcuaagcuaaagacuguuuccuggcauucuuaguuccaucagccuaauugaaaaccccaaccaaguuauucucucuuaguuuugauuuuauuuaucuaaauguaaagcacauuuagcaucaaaugaaguucauugugaccucagacaaugggaggcacccacaugugggagugcuggaaauaaaccuagugucuagcugaugggaagcauugugcgaagaaaaaggaacuugucuguccagugagaucuuugcugacuuuuuguacuuugaccccauguuuuuaaaaaaugaaggacuuuaauuuuuuuuuaaguucauuuccaaacugguaccuuuuucucaccaaaccuuuuuuacuguuucuauaaauauaugugcuccaauguuucuauuuuguuuguuuuuucuuucggccagcuguuuagguuaaagugggucauguagcacacacucuuuuaaggucaaucccaaaucuugagguaccuucuguacauuacuguuuuaguacuuguaacagugccauguuugcaugaaugaaaauacauaaugcucauuuucauuuuucuaugacguuccaaaauacucuuuugauaccuuucaugucagcuuagaucauuuauaagacauugauguguuaggacucccugaccuccuuuggugaagaaguaauaagcaaaucuuauaggcuggcuacauauaaaccuaucuggccguggguagauuugccaguccucugcacacccccacucuaccccaacaaauacaugugaaaucaauuuuuugacaguugccuccauuaagacuucauaucugaauuacacuaauggaguuuacauuuuacauccccccccccuuuuuuuuuuuuuuuuuuugaaacagggucucacuguaucaccccagcuggagugcaguagcacaaucaugguucaccgcaaccucaacuccuugggcucaggugaucuuccaucucagccuccugaguagcugccacaggcaccugucaucacaccuggcuaauuuuuuuacuuuuuguagagacaaaguuucaccauguugcccaggcuggucuuaaacuccuugacucaagcaguccgcccaccuuggccucccaaagugcuaggauuacaggcgugagccaccgcaccuggccuacuucccuuuuaagagaccuauacaaaaguuauuuaaugauaguggugucagcaucucagaggguuggaggaagaagguggaaauaaugcaagcauuagguaaaagauuuaaacuuuucuccuuuggaagccauggcuaagguacuacucagacuuuggucauugugucagagucagaaucagagauaagaaagauaaauaccacauaauaucacucauaaguagaagcuaaauaauauauacacauagaagcaggguguggguugauggguaguggggacuuagagggauggcaugggugguugauggcagguugcuuggugaguacaauguguguugcuacagugauggaugcacugaaggcccugacuucaccacagugcaauauaucaauguagcaaaauuguacuucuaccccaugaauauauacaaguuguaaaacaaauuuuuaaagccagauaacuugcuauauaccuguuuagaguaaggauauggagcugccauccccguguuguagaauuuauuucauuuuuaaauguuugauuuagugugaaagguaacagauugcuacuucagucagagagucugagaaaggaggguaaacauuacugaaauuguagucuuggccuuuguaagaaguguagaaguugagugcagaggguaccuaggugagaugauuagggcuccaagaguuuguccccagcuugacuucugucaaacucucugagaaggauguuuuuuccuucucauugugaacauucuacccucaaggcacugaaagcuuucaucguugccugcuuuugaaaaggaaguuauuggacuucugccuaccuuggcugcaacuggagugagaggagaugcaggaaagugagaaagugcacuuuaaccuggcaguguuugcuuuacauguguuaugucaugauaagaauaaggggucucauuaaaaacauuaaugcugcauuaggagaaugcuucauucucuuauuuuguauuuugacaguucugcccccaaccucauuuugcuagaacuagaaaagugcuuuuauuauuauuuuuuucugagauggaguuuugcucuuauugcccaggcuggagugcaauggugcaaucucagcucgcuguaaccuccgccuccuggguucaagcaauucuccugccucagccuccugaguagcugggauuacaggugccugccaccaugccuggcuaauuuuuuguauuuuuaguagacacaggguuucagcuuguuggccaggcuggucucgaaccccugaucucaggugauccaccugccucggccacccaaagugcugggauuacaggcaugagccaccgugcccggaugaaaagugcuuuuaaaaaagcauaccccgucucuacuaaaaauacaaaaaaaaaaauuagccagacaugguggcaggcgccuguagucccagcuacucgggaggcugaggcaggauaaugacgugaacccgggagguggagcuugcagugagccgagauugcgccacugcacuccagccugggcgacagagcgagacucugucucaaaaaauaaauaaauaaauaaaauaaaaauaaauaaaaaagcauaaaauaauucaauuuuuuugaaggacuuuuagaaacuguuuaauuuuagaaacuaucugauugugauacaugcuaacacacucauauacucccuccuccccacaacacacacacagccucucuuugucgcucauaaaguccuucggaagcuuucucagugcuuuuaggaguaugacagaaguccuuacauggccaacaggaaccugcauggucuuuucaccacuuacugugucuuccucaucuuucuguugugcucccccuugugcucuccuccagcccugcugucauuccuccacauggaagucuuuuuuuuuuuuuuuuuuuuuuugagacagagucucgcucugucgccaggcuggagugcaguggcgcaaucucggcuuacugcaaccuccgccuccuggguucaagcgauucuccugccucagccccccaaguagcugggacuauaggagcacaccaccacguccagcuaauuuuuguauuuuuaguagagacaggguuucaccauguuggccagaucugcugaccuggucgugaucuccugaccuugugauccacccacguuggucucccaaagugcugggauuacaggugugagccaccgcacccggccaggaagucuuuuuugacuccugccauguucuccuggcacuucuuccuuauacagagaucacacaugcacauuguacauuugcucagugaguguagggacugcugcucugguuuucuuguuuguuuguugcuuauuucuguaucaccaggaucuaacacaaugcuugguuagcuguacccgaguauuuacugagugcaugaauuccauccauuguauuuucuguagcuaccugaucuuuauuugaaccuuucaagauaucucauuccauuuugguguucuuauuauaauagaaauuagagaaaauauuugcaaccaaaaugagaaaaagguaauauuaauauacaaagagcucauauaaguuacugaagaaaaugucuaaagcccuaauaaauaggcaaagaauguaaauagcuaagucacaaaagaaaucuuagaaugcuuaaaagauccaggugcaaugguucaugccuguaaucccaacacuuuaggaggccaaggcaguaggaucacuugaagccaggaguuacaagcuuagcaacaaagcaagaccucaucucuacaaaaaacaaaaaaauaaaaaaacuagccaggcguaguggcacucaccuguagucccagcuauucuagagccaagggagggaggauugccuugagcccagggauuugacgcuauggugagcuaugaucgugucacugcacucagccugggcaauaaagagacacacugacucuuaaaaaaaauggccaaaagagaucugagaauaauuaucuuuacuaggcaucaaauaagugcaaaucaaagcaaacugccaccuauuaauugagcaaaacauuuaauugauaaucuauuuuucagaauguauuggucuaguuagaauaucaauucuuaccuuucugacagaugacuaguccuuuguaaauacccagucaccucuuuucaguuaaaguugcugucuccaaggaguuugcaaucuaauuggggagguaaaaucucaacucaagaaaugagaagucagcaugaaaacccauugaugucguauugcuuuugcugcucugaugugguggcucacaccuguaaucccagcacuuugggaggcuggggugagaggaucacuugaacccaggaguucaagagcagccuggguaacauggccaaacccugugucaaaaaaaguuuuuaaaaauuagcccggcgugguggcacaugccuguagucccagcuacucaggaggcugaggugagaggauggcuggaggcuggcaaguagaggcuguaaugaacugagauggugccaccagaaggacggaguuucccuuaaccaagauaauauguauaguggcuagucuggcacauggcacuuacuggguauuccauaaagaguaguuuauuuccccaaaauguagaguaagagugaaagacuuugauccaauguacuucuguccaccuacacaagcaaauagaauguuucaccagaauaauuagacaaaaaauuuuauauguaauuggcacauuggaauccuuguaaauuacuccuucuguuggccaagagauuuacuccuuugguggaacuuguguuuuuccauaugacaauaauauaguaauggcaaguauaucaauaauaauaaaacuuuuuuuaaaaaguaaagggaaaaucuuaccaaauuaauguuucauuuuaaggaaaauaugacucuaugcccauuuuuuuccuuccaggauguugccuuauggcuguuuagcaacaggagaucgcucuggccucauugaaguugugagcaccucugaaacaauugcugacauucagcugaacaguagcaauguggcugcugcagcagccuucaacaaagaugcccuucugaacuggcuuaaagaauacaacucuggguuaguuuauucuguuuaauuaucauuuuucuguacaaacagccaaacaaauacuguaugcucccaauagaagucagcaguguguuagaggaaauauuaguguuuuuuaucuauugcuucauuucuuguuagaacaaaaugacacauagcccuucguaaagucuuguaaauggugaauguugaauucuacuuuaucuaaaucaaauuuuggagccccgcaguaaaguuacaaucuaugaauuuaaguauuuaaagauaacauacugaagccuuuguucaagugcaucagcuucucuaauuaugugaauauaugaacuuaagugaguuuuuaaugaguugguagauugugauuucuccaaacuaaaaaaugcaauguuuggaauuauggcuaugguguuagaaaagcacuaauauauaggaaauaaaagaacuucacagugugagggggaaauggucugcaaguauuuuuggcuaaagacuucagagucagacacauuuuaucgagaacuuguaauaugcaaaucaguuuccaaauuuugaucuuaaggccuugucuccagggaaucucuauuacuuacuucuaauugaaaucagugacuuaaauguuugaaacugcagugcuuaacucuuaaacaugaaauuguagucagucuuuggucaaaacuaacuaaaaugugcccaaccccuagcaugaucuagcaaagccauggucucuucuaaguacugugaacauuagucuacucacagccccaccgaaacacagcucccaggacguuugaauaucuaaggcccaguuauuuaaugucuuugaaggcagcucucucagcccagccccugugaagaccacccacacuccccuuggcugauccacauguucucucauacgguuuuggcagcucuguguucuccucacaauuaaaaaggaaacagagguaugguuugggucucacucuacacgcuuggaggcugaaaaccuuuuuugcuucuguucuuuucucuuguucagggaugaccuggaccgagccauugaggaauuuacacuguccugugcuggcuacuguguagcuucuuauguccuugggauuggugacagacauagugacaacaucauggucaaaaaaacuggccaggugagcugcuccucaggaucugccaagggccuuaguaaugcuauuucuuauguauagcauaaucucuugugcaacucagccagauucuuuugugauucuuagugucauaucuuugucuuuacuucaauuucucacuaccucucguuucauauauagucuacuacauguauucauuuguuugcuugcuugaugguaagcauuuauuuguuuaaaaaauuacuaaaggcugugugugguggcucacgccuguaaucccagcacuuugggaucccgagccggccggauuaccugaggucaggaguuugagaccagccuggucaacauggcgaaaccccgucucuacuaaaaauauaaaaauuagccaggcaugguggcaggcgccuguaaucccagcuacuugggagacugaggcaggagaaucacuugaaccugggaggcggagguugcagugagccgagaucgccucacugugcuccagccugggcaacaagagugaaacuccaucucaaaaaaaaauuauugaaaaaauuuuuguaguuaaaguggccuguucuucaauauaagaaauaguauuugggauacauuuguaccuaacagaaggagcggauaauguacuggauguauuaaauuuaaagauuaccaaugcuauucauauccuuugcccacuuuuugaugggguuguuuguuuuuuucuuguaaauuuguuugaguucauuguagauucuggacauuagccauuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuuaguguuuuagacaugaaguccuugcccaugccuauguccugaaugguaaugccuaaguuuucuucuaggguuuuuaugguuuuaggucuaacguuuaagucuuuaauccaaaagaagacauuuaugcagccaacagacacaugaaaaaaugcucaucaucacuggccaucagagaaaugcaaaucaaaaccacagugggauaccaucucacaccaguuagaauggcaaucauuaaaaagucaggaaacaacaggugcuggagaggauguggagaaauaggaacacuuuuacauuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauauaccauggaauacuaugcagccauaaaaaaggaugaguucauguccuuuguagggacauggaugaaauuggaaaucaucauucucaguaaacuaucacaaggacaaaaaaccaaacaccgcauguucucacucauagaugggaauugaacaaugagaacacauggacacaggaaggggaacaucacacucuggggacuguugcgggguggggggagcggggagggauagcauuaggagauauaccuaaugcuaaaggacgaguuaauggguacagcacaccagcauggcacauguauacauauguaacuaaccggcacauugugcacauguacccuaaaacuuaaaauaaaaaaaaaaaaaaagauuaccaaugcuaaaaaaaaaaaguugggaugaaccccacuugaguuauuuucucuuuuagaacaucauaccuaauuauauaugggagaagggagaacagucgugugaguaauagcauucugggguaccuagggaaucuagaccauguuguuuauaaaguacuuaaguuuucaaaugaaaauuucauuuuucagagugacauauuuguaaacacuuuuuauguuaagcaaaaacagaugagauaucuuagauaauuuuucaguuuagccccccuaggaauucccacauuagaggcauacuagaaugaaaaucucucugggucacugugugaacuuugguucuaugagggacccacaguuuuguaucuccuuggaaaucuggauuaguucuggcuugggcuuugagaguugauguggaaugaauuuguaaugcacuauaauacaugaaugcaccauguacgauugaggaaucucguguccauacuuaaaaggagucccuuggacuuccguccaaucacauuaaacacuuagauuuaucuccauuuucuucuuuuacaccucuaaaacaauaauaaggaauuaagaaauauauaaacucaagaagucaaagaugauaggaaaauaggccacagugggugaaaccuauuaccagacuucggggugauagaaagugagauagagaaguggcagugacuuagcagaacugagaaaauagaaagucaguacuuguaaagggguacgcaagucccauaaaagcucuggaaucagaggcaccauguauacuguucaaggagggauacagaaagaggcugaaacagaacuaguuggcagcuuauauauggaacaguuaggcacucaaguccccuucccuaugccaagaaggagauagauuuauucucugaagaaacugguucugacucaagcacacuuauuucuacagagacuacaagaaagggucccauauuaaaaauggagauggagugaaagucggcguaguaaaugguacaaucugcagccacuuccacuugcuuuauucuaagaacaguggcagccagauguauaguugacccucaucaaaagacuaggugauucuauucuagaaaucugauugguuccauugaaaaguccugcagaucugacaguugagauuucucccuaguuucuauacaaggaaguccaccaaucaacaagcaagccuaccauguacauagaauuuucauucagcuuuuuagugauucauuguuaaauaugaauggucagcuaaggauuaauauacuuuuaaaaaaugacaaaaauugaauauguuuaucauguacgacauauuguuuugaaguaugucuucauuguggacuugauaaauugagcugaccuguguguuaccucacauacuuaucuuuuuuugugaugauaacauuuaaaaccuagucuuucagcaguuuucaggaauacaauauauuguuguuaacuauaguugccauguuguaagacagaucuguugaacuuauuccuccuaagugaaauuuuguauuauuugaccaguaucuccccagcaccugcagccaccauucuacucucuacuggauuagcagacauuuaagggaaaccucuaccaugaaagauagaaaccaaauaagcaaaauagggaagaaaagaaaagaacucugggaaaacaggguaacugcaguaaacagagggugauuuuaaaaaucaaagcaaaaaaauauauuguaucuuuaaaguaauaauaggauucuguuuuuuacaaucagcacauagaggucuugaaaauuagaaauaggaacaaacaaaaaguuaaaauagaaauaguguaaauauuuuguggcaggcauaguuguaagugcuuuauauauaaucuaaugccuucaggccugaugacaaccuuauagaguggcggcaauagccccauuuuacaagugaggauauuaaggcaacagagaguagacauaucaggauuuuaacccuggcaguuuggcucauauucuuuuuuuuuaauccaccaugccuuaauaucuccaaaaaauaugauaaauagagagaagauccagaaacaauagagacucaguccagggagguauacucucagccuaauggauauuccagaaagaaggagaauggcgugaaccugggagguggagcuugcaguaagcugaaaucacgccacugcacucuagccugggcgacagagcaagacuccgucucaaaaaaaaaaaaaaaaaaaaaaaaaaagaagaggaaagaagggcacuuacuaagcaaauaauauacuaagacauuucccagagccaauguucaugaauauccagucaaaauagcacaaaaauuuucugagaauggaagaaaaacacccuuacuaaguaccugcacuaugaaauuucagugcaucagacguaaagagaaagucuuaaaacuuucgcagagacacagcaggccacauaccagaguuuagaagucaaaaugacuuggcuccucaauagcuacauuggcaauuauaagacagugcacguuagccuucauaauuuugagggaaaaugauuucuaaccuaaaauucgauaaccaaacuuuuuuuuuuuuuucugagauggagacuugcucugucgcccaggcuggagugcaguggcgugaucccggcucacugcagccuccgccuccuggguucaagugauucuccugccucagccuccccaggcagcugggggaccacaggcaugcgccaccacgcccagucaaguauaaaggguagaaugaagacauuuuuccaacuugcagggucacaaaacuugucacuccucugcaucuuuucucagaggcugccagaauaaggacaucuaccaaaacaagugccuaaaccaauaauuaucaaguggggugauuuuucacucaggggacauuuguuaauauaugaaaacaguuuuaguugucauaacuggggggugggguaguccaguggauagaggccagggaugcugcuaaacacccauacaggacagaaccccauaucaaagaauuauauggccuaugucagugugugccaguauugagaaacccuggucucaaccaaaagagaaugugaugugggacacaaaacgggcuccaaaugggagaagaggaaagggaaggcccaggaugauggcucugcagcaacaccggagaacaaccagcccagcuagaaaccaguagauuaccugacugucuggaaaacaguuuugaaaaugauuuguagauuuguuguuguuugauuuguagauuuuuaaggagaguuugggaagaauuaaugcuaaggucauagaacacuaagcuaaaugaaugaaugaauacaugcguacaguuuucuaaaggaaaaaaggugaacaugugaaaaauaaaaacacugaauauugauguaaccagaaauuaugacauaaugugccacaguguguagcauuauguuagcauaaaaguacuaaaucuuuaucuuccauaauaagaauaguaauauacaauuagggagcaaaaauaaauauaaacauauuauuuagaaaaauggaggcagacaccaggaaaaacaccuagugagaagaguaagaaguuaccucuaaagaguagcacucaauguggggagcuaguagggcaaggauguacuuuuuuguuguuguuguuguuguugagacagggucuuacucugucacccaggcaagagcguaguggcaucaucauggcccauugcagccucgaccuccuaggcucaagcaauucccccaccucaccccccugaguagcugggaccacaggugugugccacuaugccugacuaauuuuuuccuucauuuguagagauggggucucgcuauguugccuaggcuggccuugaacuccugguuucaagugauccuccugccucagcuucccaaagugcugggauugcagacaugagccaccacaaccaaccuguacucuuuucuuguuauguuuuauagaacuauuugacuuuuuaaaaaucagacauuuuaauucuuuggauguauuuuucuuucuaaagcgucuccuuuuccacuagauaucuacaguuuaauaucaggguuauuuauuauugauuguaaaagucuuaagaguguuagauauggucucuucucaccuggcucagugggcuauaaacagagggagaagggcucagauguggauggguauaguuccugggggucuaggacuauggagguuuugccuuuauauuuggaacccaccagaaaaaugaaggaaauuaaaucccauuuguuuuccagcucuuccacauugacuuuggacauauucuuggaaauuucaaaucuaaguuuggcauuaaaagggagcgagugccuuuuauucuuaccuaugauuucauccaugucauucaacaaggaaaaacaggaaauacagaaaaguuuggccggugaguacugcccuugugccaaggcugaacacuucuaacauuuucuuaucugaccagguggaccagcauuucuuagcugagauauauuuggaucugggagauauucagucugauuauaggaagcuuuugggggaauuugccugucagauuauugugcugguucagaaauucccagauaggagaaacagaaugcuagaaauuuaaaauaauuauuauauuuuauuccaauaauauacuaccuuuuaccuguuucagaacauucucugaaacuauuaagacaguugauaggaagaugcugaaaagacaucugcugucauuguguauggaguacaguaagggaacuagaauucagggcaaauuuuuuaaucucugaucuauuacuggcuaccuacauguucccaagcauaauacuugucuuuuugccuuuguaucaucuuaaaauggggacaaaaauaugaaauuaagggcuacuaugaugguuagagacauaucauguaaccaacacauacuuaacaaaucauugucacuauccuuuauaguucuguuuggguuucugcagaauauaccucagugggucuaguuuucucuuuggcaaaauaaggggauacgauuggaugguccucagccuggcgcgguaggucaugccuguaaucucagcacuuugggaggccaaggcacacagaucacuggaggucggaguuugagaccagccugaccaacauggugaaaccccgucucuacuaaaaauacaaaaaguagccaggugugguggcacacgccuguaaucucagcuacucaggaggcugaggcagaauugcuugaaccugggaggcagaaguugcagugagccaagaucacgccacugcacuccagccugggagacagagcaagguuccaucucaaaaaaaaaacauuggaugaucuucuugagggaccaucuugaagaggagagagagggaaggcaggaugacaggaaggagcaaaagcacugacacugauugaggggacuuuuaaaaaauuaguuucuggaaucagaccacaaauauagaacccagaaguauguucagaaauccuuguggauuauaauuauaacugauuuaauaaucaguucuugugucucauagaauuaaaaagucuagauuauuauuaaaaauguaauagccuuucgucauagaauuucuauuuaguuuuguuuuugaaaaauauaucugugauguuagagagauugauuguuuuauguagauuuuaguccugggacaauuuucgcagaaguaaaaaucagaaaugaaccuuuaguucaguaggaauuuucuuauucuaauagaaagucuagcuguguuuucuuaauuuccuguaugaaaugugcucucuccccucuaacacugugcucaugugguuugcugcaucacccaaagguuccgccaguguugugaggaugcauaucugauuuuacgacggcaugggaaucucuucaucacucucuuugcgcugauguugacugcagggcuuccugaacucacaucagucaaagauauacaguaucuuaagguauaaaaccacuuuuccuucucucuuggacuuugugggcauugagcucaguuuuagcugccuguuuuauucaaguggcugaaggaaguagaacaaagucauuuccucuaagaugguucuuagccaggagggaaagaaucugggaaguacauaaaggaggaauuuuguagaguagcuuguaacccagaagauuuucccaucaguagaaggggcguaaagaagacugguauugggcuguagccuucuuacucacauuacugaaagaccgcagaucaggagcggguugccaccuugauuuuccacagucugccuuuuucuugccaggaucuuaguaggucuugagucaucuuacuggauuugggugguaguggcaagcagcugugcauccugcaguaauuauaaauuauuuucaucuucaaaaaccuuuuggaagaagucauauuaucucccuaucuugggguucugccuccugcagaugauauuuaaauaagaacaugaagcaugcugccugaugguggcuggggaggcacaaccaauccagccuccugcagacuuugauauuugcacaucucuacuaaaguuauauaaaaucauauuuucccccuuccauuuuaggacucucuugcauuagggaagagugaagaagaagcacucaaacaguuuaagcaaaaauuugaugaggcgcucagggaaagcuggacuacuaaagugaacuggauggcccacacaguucggaaagacuacagaucuuaa

SEQ ID NO: 192091 - RNA, 99943 nt, Homo sapiens
guaacggucgcggaggcggggccugacguagcugaucccagccuaaccuggcccggcuggcugcuggugggaggccggcgacugaguaaggugaguggcucucggggcucucagaggcgucggcgugagccccuucccggaguaccccggacuugaccucaccugggccuaaaaguggucagacugacccuugucggggaggagccaucugggacagggucgcgccaauuaaaaaucccugcguaaggguuuggggaucggacaaaacugccuccagucccagcuccccaggcuuuguguucuuuggcuucuccuuuaaugucucagcgccuccgauucuuuauuuguauacuaaagcugguaauucuugccuuacaaggugguugugaggguuaaaugaggcaguaagaguaaagcuuagaaucacgucgggcacagacucgauuuaagcuguagguaauuacuccaucccccaaaaucgacccgggcugaagcgcuaguuuugugucaaacaaccgcgaagguuguuuggggagugaggacucggagcagaagggggcgguuaggcgaauagcacaggugaguaucucuuucuccaguuuauuaaccucauuccggauucaggagaccucugacuuuauacagggccuaauaggaguuuuucaaggugaaaaaugccagaaggcuaagucaccuguaacagagagaccaaucagaguuuccuuuuuuacugccacuuuguuuuucaaucaaugauauuaaacaggcagggcgcaguggcuuacgccuguaaucucagcacuuugggaggccgaggugggcggauccccugaggucaggaguucgagaccacccuggccaacaugaugaaaccacgucucuacuaaaaauacaaaaauuagcugggcaugguggugugcgccuguaaucccagcuacucgggcgggugaggcagcagaaucgcuugaacucgggaggcggagguugcugugagccgagaucgcgccacugcacuccagccugggugacggagcgagacucugucucaaaaauauauguauaauauauuaaacucugugcaggcauuacccauauugguuucaagccucugcaugaguuuuguacuuuaaauauugccaaguagacucuggccuccccugccccgccuuuuggggaagagguggcugacuuggaguuuucccuacagcuuuugcuucaaagcaagguucugccccuucaugucaccucuccugagacagaaugauuugguugagaugacauuccauuuuaacucuuuccuauuugggguaaguucagcucuuucuuaggaacauuaaacagcaaguugcaauauuuuuagaauagagcuuuugcauuuaauaaggaauagagacuucgaaaggguuacauguucauuuauugcaguaauuugaaguauauacuuuugaagaugcuuacagauuuuggugugauucaguugagaaggaacaguuauuggccaugguuuauugucagcuccccucccccaccccaaauggugaaaaaaauaauuaaauuuuaagauauggagcauguuacaaggggcuucagaccuauaaagggcaauuuggcugaaagacucgggaaaccuagaaagugccagaagaugcaauuauguuuuugcuuuucuaugcuuggcuuacuaugccauguacaaaucaacuccuacccuccgacuccuaccccccgacuccuacccccaacaaucuuauuuuaaguguguuaugacaguaauuaaagcuguagcuucuguuuuggcccuagaaagcauuuggucucuuccugugacuuuaaaguuccagaccuuuguccugucacagccuguaguggggaaaaggcugcugcaaacuauuggcccguuuauuucacagaaugguccucugaaaaggagggcuuggucacaggugcaaaugaggaguaguuuuguuccuguguuugcuuuugugaucagugguaguuugucugaggaugcuucauuuuaguauccuugcaaaugagaauauccuaccuguggagccagaagucagaauugaugauagaugaugauagauuuggauacccagcuaaaugucuuaacaagguagggagaggaaagauaagaaggagagagaagagaagggaagaggcauaugauggugagcugggaaggccauuagcaguuauuucaguugugccugcuuuaucugugauuaccaguaccuuggaugccugcucugggaguaacacaagaccauucuuacuaggagguugaacauuucaagauuuuguucuuuuuaucuuuuugaaaccuagaugaagauccaguuucagacaugagacucguugggugaucauuucauugagaucaaccugaaugaccagguguaaagugcaagaguaauaugcuaugacugagguaugucuaauguaacggaugacuccagauguugggaggccauggaaaaaaaucuaauauuuauugaguacuauacuagguucauuacauauauuuccuuuugacuuccugauaauccuaucagguagauauuuuacaacucagcaaagaagcugaagcucagagagguuaaauaccuacuuaagauaacacagaaagcugaucaccaacucuaaucacagucuccauccugcugugugccagacaaugcuuuauguucuuucuauauuaacucuucuaaucuuuaacucgugagcugaguacuuuuauuauccuuauuuuaugaugaggaaauugaagcacacagagauuaguacuguacucuccuggcuguguggcagaauccaugauuugaacccaggcagucuggcuacagagcucugcagguugaguaucccuuaccugcaaugcuuggaacuauguuuuggacuuuuagauuaaaaaaaaaauuggaauauuuguauauacaugagguaucuuguuuagaguuggguaacucuaaacacaaaauucauuuauuguuucauauacagcuuauacacacagccugaagcuaauuuuauacauuuuuaauaguuuuaugcaugaaaugaaguugugacugugaccugucacauaaggucagguguggaauuuucuacuuguggugucaaguuggugcucaaaaaguuuuggauuuuggagcauuuuggauuucaaauauucauauuaggaacguucaacccguaccagcuuuauuuugguuagguuagcauuuccuuuacuuuucuauuuuuuguuauuuaacaaaaucuuuuuagcguaaaaugaaauuuuuguuauaaaucacauaccaaauguauagcuuaauaaauuauuacaggaccauaccauucagguaugccagauccccuccauuacccuaucccagucaaaacuccuguguucccauuuagucaccauucuucuggguuuuauaguuuuguaguaaucacuucccuguuuuuuuuuuauuauuuauuuaugagauagagucucauucuguuguccaggcuggagugcaguggcacgaucucagcugucugcaaccucugucuccuggguucaagugauucuccugccucagccuccuaaguagcugggauuauaggcacacaccaccaggaucggcuauuuuuuuuuuuuuuuuaguauuuuuaguagaaacgggguaucaccauguuggccaagcugcacugugagccuggccuccuaguuuuugauagcuuccuuguuauauaauauauugaacaauuccuaucgcagauaugaaaucagccauuucuuuaaaaugcccggguuucauuuagagggaaauaauauuucaguuacagucugaaugcuaaagauccugaguuagucacuguuucaggcauuucaguagacagagcuaggauaccuguaucugucuauagacacacauguuaaaagauaccuaauguauucuacuuccagucuucagauugagauuacagagcuuuuacuuaacaacuucucuaucacaacuguaacuccuuuuuuccauacugagaaucaugauucucaagaauauaggagaaaauagaauauuccauauuuacucauuauucuguauuauacauaugacaguaucagaacuauauuucugaaaucaccaucaauaugauuacugaaaacauuaaaccuuuuuuuuuuggcuuauguucuucucauuuuuucuucucucucuguuuuaacaguuaugcucuaucugcauugucagaguauauagccauuucauguucugcuuuuucccucuuagccuauuaguucuauuaauauauuuaauguuuaccaccaguguuuaugcugaggucucucuaggcauuuuggcuaccugaagcuaauacauuguuagauuccucgggaaguaauauugucugaguucuuauauauugaucaaaguuuauucuuuuuauacuucaaagucaauuuugcagauauaaagucuuuggcucacacuucuuuuccgugaauuucuuaaauacauuacuccuuuuucuucuggaauaaaguauugguaucaaagucagauuauuaucuaauuuuucuucuucuuauaagucauguggguuuuuuucuuguagauaaccaaauaauuuguuuucuuuuuuucuuuuugagauacagucuuacucugucacccuggcuguagugcagugguaugaucuuggcucacugcagccuccaccuccuggguucaagcaguccucccaccucagccuccugaguagcuaggacuacagguguaugcugccacacccagcuaauuuuuuuuuuuuuuuuucuugagagacaggguuuugccaaguugcccaggcuggucaugaacccaggcucaagugauccaccugccucaggcuuccaaagugcugagauuacaggcaugagccacuacgcccagccaaauuuuuucuuuuucauuaaagucugcuaauaauauuagaauauaucacuguguugguuguuuugggucaguauucucagguacuucauauuuucuuuccauuuguaguuucaaaucuuuuuuuaaauuucaggaaaacuuuauuuuuaaaacagcuuuauugauauauuuaauauacaauaagcugcacauauguaguauaaguuuugacuuacauauacaccuaugaaaccaccccaaucaggauugucaauauauccaucauccccccaaauucccuuguucucguuaguagucucugugucuagccuccaauucucucagcaaccacugaucugcuuucuaucaccacaguugguuuucauuuucuagaguuuuauauaaauggaauguuauaguauguacuauuuuauggcuggcuuucagcguaauuauuuugacauuuauccauguugcacauauucuuuuuuauugcugagggguauuccauccaauggguauaccacaguuugugugucuguucaccugcugcuggacauuugaguuguuuccaguuucuggcuauuauagauaaagcucuuacgaacauuuguguacagucuuuguguggacauaaugcuuucauuucucuuggguaaauucuaggaauggcaugacugggucuuaugguaagugcuuauuaaccuuuuaagaaauagccaaagugauuuacaaagugguuguacuaguuuaaauucccgucggcaguauaugagaguucuaguucccucacauccucgaaaacacuuggucuagucauucuuagccauucuaauauguguaguggugucacaucguguguuuuaauuugcauuucccuccugacuaacaauguuuagcaucuuuuugugugccuagcugccaucuguaugucuucuuuugugaaaugucuauugaaauuuuuugaccauuuuuaaguucaguuguuuacuucuuguugauguuaacuuccuuacuaaguuuugagaguucccuauauauucuggauaugaaccuuuucugauuccugacuauuuucucugaguaugugguuucucuuuucauucucagaauguuauauuuuaaagagcagacauuauuuuuaugaagccccauuuguucuugaauuguaucaugcuuuuggugucauaucauagacauguuugccuaacucaaggccauacaguuuuucuguguuuuucuagacauguugugauuuuaaguuuuagauuuaugucauucauuuuaauuuuuuuguauauggugugagauauggcugaaaguccuguuucuuucucuuuuuuuuguacaugggcaucccauuguucuagcaucauuuauugaaaaaaaaaaacuaucguuuuuccugcuaaauuaccuucguaucuuuggugaaaauuaguuguccauauauguaugagucuguuucuggaaucuauuuaguuucauuaaucuguuugucuaucuugauaucaaugcuauauugucuugauuacuauagcuuuauaaaccuugaaaugauauaguauuaguccuucaacuuuguucuucuuuuucauucauucauuuauuaauuuagagauagggucuugcuuugucacccagccuagagugcaguggcacaaucauagcucacugauuaaacuccuggguucaaguugucuucccaccucagccaccuaaguagcgaggacuacagguucaugccacaaugccuggcuaaucuuuuuuuuguagagauggggucuugcuauguugcccagucuggucuugaauuccugggccucaagcuguccuccugccucagccucccagagugcugggauuacaggugugagccaccauggccagccuguucuuuuucaaaguuguuuugucuuuuauagaucuuuugcagcucuguaugaauuuuaaaaucaggaaaguuuccugaauuauaguuuuuuuaauugguucuguuguuuuaguuuucuuuuucaauuaccacuauuauguguauguuugagcuucuuugccuaucuuugucauuuucauauuucuucuucauuucuuuuuaauuuuuuaaaauuguuuuccuuuuaaucucuauuucucuuaaggcauugucuguagucuuuacucauucauuuuccuucuuuaaucuucauuucagaaauaauuaguuuuuaaaaguuacuaauuucuagauucuaucagcucauuuccaaguuuuauuucuaauuauguuguuuaugucuuacagaguuuuacauguauuuuaguuuguuuuaauauagagguuauaguuccuaucuguuuugugagcacgucuuucuaguauauuuuucuugucuguagagauuuuuuuuaauaugaacuuuuacaauuuaaaauuuuuuuaauuucaugggugcacagauguguauguuuauggguuacaugggauauuuugauacaccauauaauauauaauaaucauaucaggguaaaugagguagccaccaucuuaagcauuuauccuuuguguuagaaacaauccaauuauucucuuuuaguuacuuaaaagugugcaauuauauuauuauugaauauagucaacccauugugcuagcaaauauuagaucuuauucuuuuuuucuauuuuuuuguacccauugaccauccccucuuccuuucagcccaccuguuacucuucccagccuuugguaaccauccuucuacucugugucuccaugaguucaauuguuuugauuuuuggaucccacaaauaaaugagaacaugugauguuugucuuucugugccuggcuuauuucacuuaaaauaaugacuuccaguuccauccauguuguugcaaaugacaggagcucauucuuuuuuuauggcugaguaguacuccauuauguauauguaccagauuuucuuuauccauuugucugucaguggacacuuggguugcuuccaaaucuuggcuuuugugaauaaugcugcaguaaacaugagagugcagauaucucuuuaauaugcugauuuccuaccaaaaauauaaaaaauuggccagugugguggcaugugccuauaaucccagcuacucaggaggcugaggcaggagaaucgcuugaaccugggaggcagagguugcagugagccgagauugugccacugcacuccagccugggcgacagagugagacucaaaaaaaaaaaguuguuucagauccuuauacauccuggcuauuaacccucgucagauggguaguuuacaaauauuuucucccauucuguggguugucucuucacuuuguuguuuccuuugccgugcagaagcuuuuuaacucaaugugaccccaccugucuauuuuugcuuugguugccugugcuugugguauauuacucaagaaaucuuugcccaauccaauguccuggagaguuuccccaauuuuuuuguaguacuuucauaguuugagggcuuagauuuaagucuugauucauuuuuauuugauuuuuguauauggugagagauaggggucuaguuccauucuucugcauauggauaucccagcaccauucauugaagagacuuuucuuuccccaauguauguucuuggcaccuuugucaauaaugaguucacugucaguauguggauuuguuucuggguuuucuguucuguuccauuggucuaugugucuguuuugguggcaguaguaugcuguuuuaguuaauauagcucugcaauauaauuugaagucaguuaaugugauuccuccaguuuuauucuuuuugcucaggauagcuuuggcuauucugggucuuuugugcuuuaaauuuuaggauuauuuugucuauuucugugaagaaugucauugguauuuugcuaggcauuugcauugaaucuguagauugcuuugaguaauauagauauuuuaacaauauugauuguuucaaucuaugaacauggaauaucuuuucauuuuuuuguggccucuucaauuucugucaucaguauuuuauaauuuucauuguagagauguuuuacuucauugguucaguuaauuccuagguguuuaauuuucuuuguggcuauuguaaaugggauuacuguuuugauuucuuuuucagauuguccuuguugguuuauagaaaugcuacugauuuuucuaagcugauuuugugucuugcagcuuuacugaauuuguuuaccaguucaaauagcuuuuugguggagucuucagguuuuuccaaauauaagaucaugucaccugcaaacaaggauaauuugauuucaaauuuugauggccuuuuuuuccuuucucaugucuaacugcuagcuagagcaauuccaguccuuuuucaucucuagcuagagcaauucuaguccuaacuacagcaauuccaguccuuuuucaucucugauuuuauuugaaucuuuuuuccuuucuuccuucauagucuggcuaaagguuugucaauuuuuuauccuuguucuguucuagaucuuagaggaaaggcuuucaguuuuucccgauucagugugauacugccugugggucugucauacauggcuuuuauuauguggagguauguuccuuuuauaccuaguuuuuuuaggguuuuuuuuuuaaaucaugaaggaauguugaauuuuaucaagugcuuuuucaguaucaguugaaacgaucauaugguuuuugucuuucagucuguugauaaugauguaucacauugauugauuugcauauguugaaucauccuuucaucccugggauaaaucccacuuguugaugaugaaugaucuuuuuaauguguuguugaauuugguuugcuaguauuuuguugaagauuuuugcaucaauauuaaucagggauauuggccuguagguuuuucucucucucucucuuuuuuuuuuuuuuuuuugauaugucuuugucugguuuugguaucaggguaauacuggccucauagaaugaguuuggauguauucccuccucuuccauucuucagaauaguuugaguaggguugguguuaauucuuuaaauguuugguagaauucagcagugaagccauggaguccgaggcuuuucuuugcuggaggacuuuuuauuauagcuucaauguuguuaguuguuauuggucuguucagguuuuggauuucuuuaugguucaaucuuaguagguuguuugugucuaggaauuuauccauuucuucuagauuuucuaguuuauugguauauaguugcuccuaguaggcucuaaugauccuuuguauuucugcaguauugguuguaaugucuccuuuuucaucucugauuuugaaucuuuucucuuuuuucuucauuagucuggcuaaggguuuaucaguuuucuacaucuuuucaaaaaaccaacuuuuuguuuuauuguucuuaugucuuauuuguuucaauuucauuauuucugcuguaaucuuuauuauuucuucuacuuucaguuugguuugcucugcuuuucuaguucuaguucauuagguuguuuauuugaaguuuuucuuuucauguaggcacuuaaagcuauaaauuucucucaguacuguuuucacuguaucccauagguuuugguauguucuguuuccauuaucauuuguuucaagacauuuuucaguuuccuucuuaaucucuucauugacccacugaugauucaggagccuauugauuaauuuucauauguuugaauaguuuccaaaauuccuccuguuaacugauuucuaguuuuauuccauuguggucagagaagauacuuuauauuauuccaguuuguuuuuaauguuuuaacacuuguuuuguggccuaacauaugguccauccuugggaaugauccaugugcugaggagaagaauguguauucuucagccauuggaugaaacgucuguaaauaucuguuagguccauuuguucuauagugcagauuaagucagaugauucuuuguugauuuuaugucuggaugaucugucugaugaaagggugguguugaagucuucaacuauuauugaauugagauuuaucucucgagcucuaauaauauuugcuuuauauaucaggguacuccaauguuggguguauaauauuuacaauuguuacauacucuugcugaauugaccuguuuaucauuauauaaugaccuuguuugucucuucuuacaguuuuugucuuaaaaucucuuuugucugauauaaguauagcuacuccugcuauacuggauucauuggcauguaauauccuuuuccauuucuuaauuuucagucuauaugugucuuuauaggugaaguguauuucaguucggccacucuaguguuuugauugugaguuuaguccauuuauguucaauguuauugacaaauagggacuuacuacugucauuuuguuguuuucugguuguuuuguggucuucucuucuuuuuuccuucuuuccuaucuuuuuuuagugaaggugauuuuucuuaggugguauguuuuaauuucuugcuucuuauuuuuuguguauccauuguauguuuuuggauguaaggucaccaugaggcuugaaaauacuaucuuauaauccauuaucuuauuuauuuauuuauuuuuauuuuuuugagauggagucuaguucugucacccaggcuggagugcaguggcaugauuauggcucacugaaaccucuggcuucugaguucaagugauucuccugccucagccucccgaguagcugggacuacaggcacacgccaccagagaauuuuuguauuuuuaguagagaugggguuucacuauguuggccaggcugaucuugaacaugaccuugugaucugcccgccucagccucccaaagugcugggauuaaaggccaccaugccuggcucauuauuuuuuauuuuuuaauuuuuugagauggagucucgcucugucacccaggcuggaguucaguggcgcuaucuuggcucacugcagccuccaccucccagguucaagcgauucuccugccucagccucccgaguagcugggacuaugggcaugugccaccacgccuggcuaauuuuuguauuuuuaguagagacaggguuucaccaucuuggccaggcuggucuugaacuccugaccucgugauccacccaucucggccucccaaagugcugagauuacaggcaugagccacugugcccagacucuguguacuuuugauuacccgugaguuuuguaccuucaaauaauuucugcucauuaacgucguuuucuuucagauuaaaaaaacucccuuuagcauuucuuguaggccaggucugguguugaugaaauuccucagcuuuuguuugucugggaacaaacuuauugcucauucauguuugacguauucuaggguaaaaguuuuuuuugcuucagcauuuuaaauaugucaugccacucuuggccuauacggagcuccauuguauauuauuuguuucuuuucucuuucugcuuacagaauuuuuuuuuucuugaccuugggagcuuauuaaugccuugagguagucuccuuggguuaaaucggcuuaguuuucuacagcuuucuuguacuugaauauugauaucuuucuguggguuuaggaaguucucuguuaucccucugaauacacuuucuuucuuuccuuuuucuuuucuuauucuuuuuuuuuuuuuuuuuuuuugagacaaguuucacucuugucacccugacucaggugcgaucucgggucacugcaaccuuuaccucccagguucaggcgauucuugugccucagucucccgcauaccugggauuacaugcgugugccacugcaccuggcuaauuuuguauuuuuaguagagacaggguuucaccacguuggccaggcuggucuugaacuccugacuacaggugauccacccaccuucaccucucaaagugcugagauuacaggcaugagccacugcgcccggccugaauaaacuuucuaccccuaucucuuucuacuuccucuuuaaggccaauaacucuuagauuugcccuuuugaagcuuauugucuagaucuuauaggcaugauucauucuuuuuucuuuucuuucuuuuuuuuuuuuuuugagauggagucucacugugucgcccagucuggagugcaguggcgggaucucggcucacugcaaccuccaucuccuggguucaagcgauucugccucagccucccgaguagcugggauuacuggcacacgccaccaugcccagcuaauuuuuguauuuuuaguagagaugggguuuuaccauauuggucagccuggucucgaacuccugaccuuaggugauccaccugccuuggccucccagaguguugggauuacaggcaugagccaccaugcccggccuguuuuuuauucuuuuuucucuugucuccucugaccguguauuuucaaauagccuguguucaggcucacugauucuucugcuugaucaauuaugcuaugaagaggcucugaugcauucuucauuaugucaguugcauuucucacacucagaauuucugcuugacuuuaaaaaauuauuucaguuucuuuguuaaauuugucuaauaggauccugaauuccuuaucugugucaucuugaauuucuuugaguuuccucaaaacagcuauuuugaauucuaucugaaaggucacauaucucugucugucugggauuggucccuugugucuuauuuaguuuggugaggucauguucuccuggaugggcuugauacuuguagauguuuguuggugucugggcauugaagaauuagguauuuauuguagucuuuguagucugggcuuguuuguacccauccuucuugggaagacuuuccagugacuugaguguugugaucucaguuuuuggucacugcagcuauauaucugaguuacaggauaccccaagcucaguaaagcugugguuuuugcagacuuacagaguugccaccuugcuggucuuggacaagaucuggaauaauucuuuggauuaccaggcagagacucuugucuucccuugcuuucucugaaacaaauggagucucucugugcugagcugccuggaauugggggaggggugacacaggcaucccuguggccggcccuacugggacuguacuuggucuggccagggccuggaaucagaauccuuggaaaccuaccuggugcucuauucuacugaggcugagcuggugccacaaccaugagaaaagguucuucccauuuuucccuccccuuuccccaggcagagaaggcuccacuugucuaccgccaccacagacccauggggaguacugccaggguaccgccuagguucacuuaaggcccaaggcucuuuagucagcuggugaaugcuaccaggccugggacucaccuuucagggcaguggcuucuccucuggcccagaguagguccagagaagcuaagagccaaagccuggaauugggaaccccaagagcuuucuuaaugcucuuccccaguugggccaaguugguaucuaagcucaagaaagucuucuuuacucuuccgucuacuuuucucaagcagaaggggucuguccucauagccaccacagcugugaaugugcuggaucacagcugaagccagcaugucugagucucacccaaugcccauggcauauacuaccugguuccugcugcugauuauucagugcccaagggcucuuuaaucagcagaugauaaauccugccaggacuggguccuucccuccaaggcagugggcuccuuucuggccaaggaugugucuagaaauguuguuugggagcuagggucuggaaugggggccucauaacucugcucagugcccuauccuacugugacugagcugguauccgaguugcaagacaaaguccucuuuacucuucccucuugucuucucaagcagaaggaaagguuuacuuuuggaacugcaagcugugcugccugggguugggggaggggugaugcaaaugcuccuuuaguugcccuggcuguugucucacuaggucacaugccccucaagagcacuagcucugagcccagcauagcacuaggacuugccuuggaguugcaguccuuguggccuagauaguguuucaaguuuauuuaggaccccagagcacuuuaacucacguuggcaaggcuugcugaaacucaaguucugacuacugggaugggugauuccccucuggcuaggacuggucuaaaugaucccuccaguggguugaauucuuccugguguuguugguacugccuuucaaugcaaaguuccacagucacugcacuuuacuuccccuaagugcacagauucucucucugcgccacauggcuggccguuaccgggggauugggggagaaugguauuggcaauuuauaaaugucuuuccuacccucuucggugccucuuucagccauaugaaguuaaaaccaguuacugugauugcucaccugauuuuuggcucuuaugaaggugcuuuuuuguaaagauaguucuuaaauuugguguuccuguugggaggacaaucgguggaggcuucuguucagucauuuugcuccgccuucaauauuaacuuuugaugggguuagaccucagugcuuuucuuugcucacuuuuauguaaaauuaguuuuucugaacuuuuauaaugguugagaguucaggaaagcuuuucuaacaucuuggacuucuaauauuuuuguguaguguuugaaaauauggcaguuuguuuucugagacuuccugcuucuauuuucuucccuauuuugguguggaucuucccuucucucuuaucccuaucuugcucaguuuugauucuauucccaaaaguuucuucucaucaugggcucugucauggaaauguaacauguccauuuugaguguucacaggguuccagcaucuucuguuuuucuucuaggaaaggguaaaaccccuucugguuucacuuccuguuucauguuagugccauagugaauauuagcgauaccaaugaauuagggaguucucucauucucauaaccaucagacacugccuguagcuuuuuuuucuuccagcacagaugcugguaccaugcagcuuuuauggccguuagugguuugcccucccccacuuauauuuuaguguucgugagaauaacuuuucaccagcuuuugauauaaauaguuagcucucuauaucugccaguuuuguauccacagauucaaccgacugcagauugaaaccugcagauaaggagggccaacgguacuacaccauuuuauugaaggaacuugagcauccauggauuuugguacuugcaggugguucugaaaccaauccccauguauagggaagaccugcuauugcuuuuggguuuuuagcuuugcucucuaguugcuucuguuuuaaugugggaugcagagaugaaaaaacuaggcuguggccaugccgucuucccagaauuguuucuuuauucucuuacuuuuaacugcuuuaauguuuuuauuuuaaguggcuuuuuaguguuuuagaagucuuuuuucccuucaacagcauauagcuugauuuuuaaaaaucuaguuugacagucucuuuuaacuggagccauucaugauuaauguaauuacugauauggauuuaaaucuaccauauugucaaguaccaugugcuuuucucuuuguuuuaccucuugucugcuuguguuucucuucuuuuggguuuuuaaaaauuuuuuuauuuuuuccgaggcagagucucucucugucacccaggcuggagugcaguggcaccaucucgucucacugcaacuuccaucuccuggguucaagugauucuccugucucagccucucaaguagcugggauuacaggcaugagccaccacacccggcuaauuuuuuauauuuuuaguaaagaugggguuuugccauguuggccaggcuagucuugaucuccugacuucgugaucugcccgccuuggccucccaaagugcugggauuagaggcaugagccauugugccugacccuuggguuuauuuauuuauguauuuauuauacuuuaaguucuagaguacaugacagcgugcagguuuguuacauauguauacaugugccauguuggugugcugcacccauuaacucgucguuuacauuagguacuucuccuaaugcuaucccucccccauccccccaccccacgacaggcccuggugugugauguuccccuuccuguguccaaguguucucauuguucaguucccaccuaugagugagaacaugcaguguuugguuuucuauccuugcgauaguuugcucagaaugaugguuuccagcuuuauccaugucccuacaaaggacaugaacucauucuuuuuaauggcugcauaguauuccaugguguauaugugccacauuuucuuaauccagucuaucauugauggacauuuggguugguuccaagauucugguauguugugucuuuguucucauugguuucaaagaacaucuuuauuucugccuucauuuuguuauuuacacaguagucauucaggagcagguuguucaguuuccauguaguugugcgguuuugagugaguuucuuaauccugaguucuaauuugacugcacuguggucugagagacaguuuguugugauuucuguuguuuuacauuugcugaggagugcuuuacuuccaacuaaguggucaauuuuugaauaagugugauguggugcugagaagaauguauauucuauugauuugggguggagaguucuguagaugucuauuaggucugcuuggugcagagcugaguucaaguccuggauauccuuguuaaccuucugucuuguugaucugucucauauugacaguaggguguuaaagucuccuauuauuauugugugggagucuaagucucuuuguaggucucuaaggacuugcuuuaugaaucugggugcuccuguauugggugcguguauauuuaggauaguuagcucuucuuguugaauugaucccuuuaccauuauguaauggucuucuuuaucucuuuugaucuuugcugguuuaaagucuguuuuaucagagacuaggauugcaaccccugcuuuuuuuugcuuuccauuugcuugguagaucuuccuccaucccuuuauuuugagccuaugugugucucugcacaugagaugggucuccugaauacagcacacugaugggucuugacucuuuauccgauuugccagucugugucuuuuaauuggggcauuuagcccauuuacauuuaagguuaauauuguuaugugugaaucugauccugucauuaugauguuaguugguuauuuugcccauuaguugaugcaauuucuuccuagcauugauggucuuuacaauuuggcauguuuuugcaguggcugguacugguuguuccuuuccauguuuagugcuuccuucaggagcucuuguaaggcaggccugguggugacacaaucucuuugcauuugcuugucuguaaaggauuuuauuucuccuucauuuaugaagcuuaguuuggcuggauaugaaauucuggacugaaaauucuuuucuuuaagaauguugaauauuggcccccacucucuucuggcuuguaggguuucggccaagagaucugcuguuagucugaugggcuucccuuuguggguaacccgagcuuucucucuggcugcccuuaacauuuuuuccuucauuucaaccuuggugaaucugacacuuauguguccuaggguugcucuucucgaggaguaucuuugugguguucucuguauuuccugaauuugaauguuggccugucuugcuagguuggggaaguucuccuggauaauauccugaggaguguuuuccagcuugguuccauuccccccaucacuuuuggguacaccaaacagacauagauuuggucuuuucacauagucccauauuucuuggaggcuuuguucauuccuuuuuacuuuuuucucuaaacuucucuucucgcuucauuucauuaauuugaucuucaaucacugauacccuuucugccacuugaucaaaucagcuacugaagcuugugcaugugucacauaguucucgugccaugguuuucagcuccauccggucauuuaaggucuucuuuacacuguuuauucuaguaagcuauucaucuaaucuuuuuucaagguuuuuagcuuccuugugauggguuugaacauccuccuuuagcuuggagaaguuuguuauuaccgaccuucugaagccuacuucugucaacucgucaaagucauucuccauccagcuuuguucuguugcuagugaggagcugcgauccuuuggaggagaagaggcgcuuugauuuuuggaauuuucagcuuuucugcucugguuucuccccaucuuuguaguuuuaucuuccuuuggucuuugaugauggugaccuacagauaggguuuugguguggauguccuuuuuguuaauguugaugcuuuuccuuucuguuuguuaguuuuccuucuaacaguuaggucccucagcugcaggucugugggaguuugcuggagguccacuccagacccuguuugccuggguaucgccagcagaggcugcagaacagcaaauauugcugccugaucuuuccucugaaaucuucaucucagaggggcaccuggcuguaugaggugucagucgggcccuacugggaggugucucccaguuaggcuacacggaggucagggacccacuugaguaggcagucuguccguucucagagcucaaacaccaugcugggagaaccacugcugucuucagagcugucagacagggacauuuaagucugcagaaguuucugcugccuuuuguucagcuaugcccugcccccagagguggagucuacagaggcaggcaggccucuuugagcugcggugggcucuacccaguucaagcuuuccugccgcuuuguuuaccuacucaagccucagcaauggcagaugccccucccucagccaggcugccaccuugcaguucaaucuuggacugcugcgcuagcagugagcaaggcuccaugggcaugggacccacugagccaggcaugggauauaaucuccuggugugccacuugcugagaccauuggaaaagcgcaguguuuggguagcagugucuggauuuuccugguacagucugucacggcuuccuuuggcuaggaauggguaaucucccuacucuugcacuuccugggugaggcaaugccccacccugcuucggcucgcccuuugugggcugcacccacuguccaaccagucccaacgagaugaaccagguaccucaguuggaaacgcagaaaucaccugucuucugcaucagucacacugggagcugcagacugaagccuuucauauuuggccaucuuggaugcccuuggguuuauuuuuaaaaaugcaucauuauagucuuguuuuuccccuuuacuaguuagaaaauuauauacuucuguucaguucuucaguggauguccuagaaauucucaagcauccuuaacuuauacaaaagcccaguguuaacagauaccuuuaccaguguccaccuccauuguaaacaaacuuagaacacuguuacuccauuuacccuacucucagcuaauauauuucuguuacugugcauuuuaauuguacauuuuauacuucacaagaucucauuauguagucuguguuuaaacucgcccauuuuuuugcucuauuuuuuucuacaucucugcuuuuccaucagggagucuucugcaugaagcagcuucuuuagaauuuuuuuacagagcagaugcaaugaacacucucagauuuauuuugugucauguguuugaaaauauauuacuuuugccuuuauuauucguuaaugaauguuuucacuggcuuuggaauuuuagauaagcaauuauuuucuuucagcacauugaagauauuagugucuagguaugacugacuuuuuuuuucuuuuuucuuuuuuuuuuuuacuguaucccaguugcaauauguuggguuucuagaauguguggauuuaugucuuucauugauucucaaauuuuucuuagccauuagcucuucaaaugcuccuucuacuccauucuuuccucuguucuuggguaccaguuaugcauucuguggugggggguuagacaggacagaguguaugugugugugugguauauguguaaaaucccagaaugcuuuauuuccagaggagaacauuauaagauaggguuuauucaaaugagucuuacaaucagcuaucuaagaagucacaaaguuuugacgcaggaaugaccugaauugcccugcaagaguaguggauucuuuuaaauauacuuuucuuuaacuccuuuugcacuuuuugucuuuuuucauuuaggcaacucaaauuuuuuaauugccaauuucuguuucuuuugauucuacaaaaguaacuauguuuccgguagccccuaaaccccaggauuccagucaaccaucagacagacucaugacugaaaaacagguaaacuuaaaauauuuuaagacacugcuucucaaaauaugugccaaagaaugcuacaucuacaaacaggaaaauuugacuuuaaaaggauucuuucucaaauaauuuuaggaaaugcuggguuaaagacuaugaaaugguuuaauuacucuaagacuucacaauauuagucuccaaagggaggauuuaguauacagcauuucauacauacuuaacacuaguuugaugaacauuucauuagacuaguguucuguagcauguacuuuggaaaaugccauucccaacuauuuucagaauuuacaauuacuuuaucuuaaaauguaagagguaucaggaaacaauauguauaaguuaaucauucaaaauaugugacuuuauuauguauagagcauuuuguuuuuaugaguuacaguagaaguucugagacacuaacucagagcuuuuggcuccuaaaacaacaucaauguuaauuuuaguugugucuaccacguaguuaaacucugugaucagaaagacuaaagcauaaaugagagaaaaguuaugagugggaggagauguaaaaaaaaggaggaagaagucaacagucaaaaagaaagacuuguuugacuuugagagugucuuucagggugauucuguuagagucaguuauccagauggacgggcuccuuuuuauaguuagaccuuguccauuugacaaggagcugucugaaauauuggcuccaacuagucagguauguuuugauuuuuuugugacccuagucauuaugaaagugauacuuaggggcuggggcgguggcucacgccuguaaucucagcacuuugggaggccagggcggguggaucaccaggucaggagauccagaccaaccuggcuaacacggugaaaccccaucucuacuaaaaauacaaaaaauuagccgggcgugguggcgggcgccuguagucccagcuacucgggaggcugaggcaggagaauggugugaaccugggaggcagagcuugcagugagccgagaucguaccgcugcacuccagccuaggugacagagcaagacucugucucaaaaagaaagaaaaaagaaagugauacuuagaagugacucaccuuuucuuuucuuuacuauccaguuauuauagccuaguuuacagcuguuuauucugagcagggcuugguuuggcuuaguuaaaucuaaaaccuuagauuuauuugauucacugaaauuacaagguguuuuuguuguuguuguugguuuuguccauugaggccuacauaugaguauucuguauaaugcaacaauuugugcuuauuuacauacuucuagucuauuacuaauuuugcuagaaacaauaaauguguuuuuuggauauuauauaugcauaaacauuuauacuuaaaacuuuugaagaaaaaguucuauucugaaaaugcaggaaauuauauaugagagaauuucuucacuuuauaucuaaaguuaacccuuucuucucuuucuguaauuguagcaggaagaagcagaaugggaaagcauaaaugugcuauugaugaugcauggcuuaaaaccuuugucucuagucaaaagaacagaucucaaagguaauuagauccuauucuugaugcuuaagguaaaaaguuuauuuuuccuuaaaaaauuuuuuuugccuuuuauuuuuacuaucuguauuauauacuuuuuaaauguagaucucaucauuuuugacaaacagucaucacaaaggaugagacagaauuugaaauuguugguggaagaaacaucaugucaacagaacaugauacaggagcuuauagaaacuaaucaacagcuuaggugagaaaauggaaaagauuucuuuugaauuguuuguaugcguucuaaaaauaacugccuugaaaaaaaucuugaaauuuaauuucccauuuugauuaaauauuaaacuaaaaaauauuuuuguagguaaaauuuuaauagguaaaucuuuugguaauagcuuagcauagauguuuaaugguacccuauauuucuucuauuaguuucuguugcaggaugagcaucucaaaucugaaaaucugaaaggcuccaaaaauugaaacuuuuugagcaccaacaugaugcuuaaaggaaaugcuuauuggagcauuuuggauuuuggauuuucagauuugagaugcuuaacuaguaaguaugaugcaaauauuccaaaaucugaaaaaaucugaaauaugaaucacuucugguuccaagcauuuuggauaaagagaaugcaaagaaacuuuagaaaggcaauacauucuuauauggauaugcuugguaauucgauuuauuuuuaauacuaagggaagaaauuguaugucuauuaacuuagaaaugaacuucagcuagagcaaagccgagcagccaaucaagaacaacgagcuaaugacuuggaacaaauuauggaaagugugaaauccaaaauuggugaauuggaggaugaaucacuaaguagggcuugccaccaacagaauaaaauaaaagaucuucaaaaggagcagaaaacuuuacagguacugaguuaugaauucuuagaugaugguuaguuaguacuaaaacagcucauuauggucccaggugacuuccauguuguuugauucagugguuuuuaccuuuuuuggcuuaucacugcuaccuugaaauucucuucacuugguuucuagaauguccuuuauuucccucugaccucacugaucauucucuaauuucuuuugcuguuuuuuuuucucaucucccuaaccucuuaguguuggaauuccccagugcucaguccuuagaucuuuucucuuucuuacauacucugaugcccuuggugaugucaaucuaacauaggauccaaaauuuauauccguagcccaguccucuccccgaauuccagacucauauccagcugccuacuugauaucucuacuggauaucuaauaggcaucuacaacuuuguuuguuuauuuguuuacuuuuuugagacagcgucuggcucugucacccagguuggagugcaguggcgcaaucacagcccagugcaaccucugccuccugcacucaagugauccuuccaccucagccucuggaguagcugggacuacaggcgcaugccaccacgccuggcuaauuuuuauauuuuuuauagagacaggcuuuugccauguuaccuaggcuggucucaaacuccugagcucaagugauccgccugccucggccucccaaagugcugggauuacagguguggggcacugcaccuggcuggcaucuacaacuuuuuaugucuaaaacugaguucuuuuuauagaaauggcaauuuuauaacauuaaauaauuaacucccuaauuuuaaaaaacuauuaaaacuuggguguuuauugugauuaaaagaaaugaaucuuaugcugguaacuaauguuuaguuguaugaguuguuucugaucuuuacuaacauuaugucauuauaaacauugaguccuuauuuuagugguuuugcugacacaacacuauauauacguuugcauaugugaguucaggcuaucuaaaagggagcaguauucaucaggcagggucuggaaguccccucagugugugcuggcaguauuggaaggaucagaugaguuaguauaaauuccauggaguccgagagaauuaaucagagauacuagggggcucuaguaugaggacagaggcaguuggugcucugaccuuguuuaugugccagcuuggggcaggcaguaguagagcugcugguauugaccauaguuucagagaagacauuguuugacaaacuccucuaccauuagaaugcuaaauuuuuagguuggcuuuguuuuuuuuuguguuuuuuuuuuguuuguuuuuuuagacagagucucacucuguuucccaggcugauguggugugcaguggugugaucuaggcucacugcaaccucugccucccggguugaagcgauucuccugccucagccucccaaguagcugggacuacaggcaugcaccaccacgcccggcuaauuguuuguauuuuaguagagaugggguuucacuaucuuggcuaggcuggucuugaacuccugacuucgugauccacccgccucagccucccaaagugcugagauuauaggugugagccacugcgcccggccuagguuggcuuuguuaacaagguugcuuuccucaucaauaguauauuuauaaaaucucucuaaauggagggguauuuuggaaauacuuucuauaugcauugguuuugaccuugcucuuagauauagggcauguggaaaucugaagcucuuuaaaucauugacuuauuggugugaaaaagcagccaucagaagcuguaaaggugcugugccaggucuuuggcugagugaacaaguugagagcaggaagaccaguggucuuuguugggggaagauaucuauuuaucuuucagacagguugagauguaauuaauaacaaauuaaauuauuagaaauacaaagcuuacaaauuuaccaggguuuuaagcacuucaaagaacagauacaugagaguucauugauaaggggugacuugaauguaaugccauguauuuucuaucaaauaguuucaucugucauaaaugauuuaucgugccuuuagcucuuuguuccaggucccaaagauuugucguguagcuuauaaauugguacagaggagguuucaugcuucagucacccauagaaggggaaaggcaaauaugauugaggaguggauaccugggguuggggaaggcuaucugugccaauaugaucaacugaaauuggcuguuuguuuuuuuaagucucugauggguauuuuauagaguguaaacagaaaucagcaaacccaaggaauugccgccccugaauguugcuagguugccucauuucuauuacauacuagucaaacaucucauucuauuauagagaaggaaaaaauauuuuuacuucuacccuuucagauucucagucaggacucuguaacaaaaaacuaacaagugaaaaacaaacaaguuuaugaauauguuuauaucauauauacaugggagaaacccauggauguugggcuuaaagagguugcuagaacuuggacuuccauagcaucuuaacaacagccacccccaauaaauuugcagagaaguggcaagacaaaggaaaaggacuuugagucucuagggaagcaaauugugggaagguaaauauauuaaggacuaaugacagauaagggcuagucaguaaacuugguuauguagaguccucuagugccaccucugggcuaauaaggauccaggguugucacuggauaaauuucuauacagauuuauguccuccuuuaggcuaauaaaggaagggaagagagcuuuucuuguguuaucaucuuaguugccuucaacucagaauaauccuuaugccaaaguggcauguuuugaggugucagcuucuucuauucuucaccauacuaaucaaucuuugcuuucuugagaagaugaaagugccuguggagaauaauuauuucauaguuuaagacacauucuucuauuuuugguauacaguuguuuccaauuuuagaaugguuuagugcugcauguuugguaguugggagaaaggaaacauugguuuuguauguauaugcaaagaggucaaggaaauuugcaaauguuugagguauauugaaagacuuuugggaaaagacaauucaguuggcaugggcuauuaauauaauugauauucaguuuuuuucauucagcauuauuucaggauucacccauguaguugcacauauccauaguuuauuccuuuuuauugcugagaaguacuccauuguauagauauaucacaguuuguuuauccauucaucuguugauggacauuuuaguuucuaguuuuuggcuauuacaaagaaagcucuuguaaacuguauguucaaauauuuguguggacauaugcuuucaguuuucuuggguagauaccuagaauuagaauuccugagucauaugguaaguauacauuuaaguuuuuuuuuuauauauauauauauacuuuaaguucugggguacaugugcagaacaugcagguuuguugcauagguauacacgugccauggugguuugcugcacucaucaacccgucaucuacauuagguauuucuccuaaugcuaucccuccccuagcccccaagccccugacaggccccagugugugauguuccccuugcuguguccauguguucucauuguucagcucccacuuauaagugagaaugugcaguguuugguuuuccauucuuguguuaguuugcucagaauaaugguuuccagauucaaaggacaugcacuccuccuuuucauggcugcauaguauuccgugauguauaugugccacauuuucuuuauccagucuaucauugaugggcauuugaguuaguuccaaguuuuugcugucaugaauagugcugcaauaaacgugugcaugugucuuuauaguagaauuauuuauaauccuuuggguauauacccaguaaugggagugcugggucaaaugauauuucuucugguucuagauccuugaggaaucaccacacugucuuccacaaugguugaacuaauuuacacccccaccaacaguguaaaaguguuccuauuucuccacauccucuccggcaucuguuauuuucugacuuuuuaaugaucgccauucuaaauggcaugagaugguaucucauugugauuuugauuugcauuucucuaaugaccagugauaaugagcuuuuuuucauauguuuguuggccacauaaaugucuucuuuugacaagugucuguucauauccuucacccacuuuuugaugggguuguuuguuuuuuuucuuguaaauuuguguaaauucuuuguagauucuggauauuagcccuuugucagauggguagauugcaaaaauuuucccccauucuguagguugccuguucacucugaugguaguuucuuuugcugugcagaagcucuuuaguuuaauuagaucccacuugucuauuuggcuuuuguugccauugcuuuugguguuuuagucaugaagucuuagcccauuccuguguccucagugguauugccuagguuuucuucuagggauuuuaugguuuaaguguuuauuccaucuugaguuaauuuuuguauaagguguaagaaagggguccaguuucaguuuucugcauauggcuagccaguuuucccagcaccauuuauuaaauagggaauccuuuccccauuucuuguuuuugucagguuugucaaagaucagaugguuguagauguguggugucauuucuguggccucuguucugucccauugaucuauauaucuguuuugguacccuuaccaugcuguuuugguuauauagccuuguaccauaguuugaagucagguaguguguugccuccagcuuuuugcuuagaauuaucuuggcuaugcaggcucuuuuuugguuccauaugaacuuuaaacuaguuuuuuuccaauucugugaagaaagucagugguagcuugauggggauagcauugaaucuauaaauuacuuugggcaauauggccauuuucacaauauugauucuuccuaucuaugagcauggaauguuuuuccauuuguuuguguccucucuuauuuccuugagcaguaguuuguaguucuccuugaaaagguccuuuacaucucuuguaaguuguauugcuagguauuuaauucuccuaguagcaauugugaaugggaguucacucaugauuuggcccuguuugucuauuauugguguauaggaaugcuugugauuuuuucacauugauuuuguauccugagacuuugcugaaguugcuuaucagcuuaaggagauuuugggcugagacaaugggguuuucuaaauauacaaucaugucaucugcaaacagagacaauuugacuuccucuuuuccuauuugaauacccuuuauuucuuucucuugccugauugcccuggccagaacuuccaauacuauguugaauaggaguggugagagagggcaucuuuguuuugugcugguuuucaaagggagugcuucugguuuuugcccauucaguaugauauuggguguggguugucauaauuagcucuuauuauuuugagauacguucgaucaauccccaguuuauugagaguuuuuagcaagaagggcuguugaauuuugucgaaguccuuuucugcaucuauugagauaaucaugugguuuuugucuuugguucuguuuacaugauggauuacauuuauugauuugcaugugucaaaccagccuugcaucccagagaugaagccaacuugaucgugguggauacgguuuuugaugugcugcuggauuugguuugccaguauuuuauugaggauuuucacaucgauguucaucaggguuauuggccugaaauuuucuguuuuuguugugucucugccagguuuugguaucaggaugauguuggccucagaaaaugaguuaggaaggauucccuuaucuucuauugauuggaauaguuucagaaggaaagguaccagcuccucuuuguacaucugguagaauucacugugaauccaucugguccuggacuuuuuuugguugguaggcuauuaauuacugccucaauuucagaacuuguuauuggucuauuuagggauuugacuucuuccugguuuagacuugggaggguguauguguccaggaauuuaucaauuucuucuagauuuucuaguuuauuugcauagacauguuuauaguauucucugauggcaguuuguauuucugugggaucaguggggauauccccuuuaucauuuuuuauugcaucuauuugauucuucucucuuuucuucuuuauuagucuggcuaguggucuauccauuuuguugaucuuuucaaaagaccagcuccuggauucauugauuuuuuugaagaguuuuuugugucucuagcuccuucauuucugcuguaaucuuaguuauuccuugacuucugcuaguuuuugaguuuguuugcucuugcuucucuaguucuuuuaauugugauuuuaggugucgauuuuagaucuuuccugcuuucucuugugggcacuuaguguuauaaauuucccucuacacacugcuuuaaaugugucccagagauucugguacauugugucuuuguucucauugguuucaaagaacaucuuuauuucugcuuucauuucguuguuuacccaguagucauucaaaggcagguuguucaguuuccauguaguugagugguuuugagugaguuucuuaauccuuaguucuaaguugauugcacuguggucugagagacuguuuguuaugauuucuguucuuuugcauuugcugaggaguguuuuacuucuaauuauguagucaauuuuagaauaagugugauguggugcugagaauguauauucuguugauuugggguggagaguucuguagauaucuauuaggucugcaugguccagagcugaguucaaguccuaaauauccuuguuaauuaucugucucauugaucugucuaauauugauagugggguguuaaagucucccacuauuauuuugugggagucugagucucuuuguaggucucuaagaacuuuacuuuaugaaucugggugcuccuguauugggugcauauauauuuaggauaguuagcucuuguugcacugaucccuuuaccauuaugcaaugcccuugucucuuuugaucuuuguugguuuaaagucuguuuuaucagagacuaggauugcaaccccugcuuuuuuuuuuugcuuuccauuuacuugguaaauauuccuccgucccuuuauuuugagcccaugugcaucuuugcaagugagaugggucuccugaauacagcacacugaugggucuugacucuaucuaauuugccaaucugugucuuuuaaguggggcauuuagccguuuacauuuaagguuaauauuguuaugugugaauuugauccuguaauuaugauggcagcugguuauuuugccuguuaguugcugcaguuucuucauagugucgauggucuuuacaguuugguaugauuuugcgguggcugguacugguuguuccuuuccauguuuagugcuuccuucaggagcucuuguaaggcaggccugguggugacaaaauugcucagcauuuguuugucuguaaaggauuuuauuucuccuucacuuaugaagcuuaguuuggcuagauaugaaauucuggguugaauauuuuuuaagaauguugaauauuggcccccacucuccucuggcuuguaggguuucuggagagagaucugguguuagucugaugggcuucccuuuguggguaaccccaaccuuuuucucuggcugcccuuaacauuuuuuccuucauuucaaccuuggugaaucugacaaucacgugucuugggguugcucuucucaaggaguaucuuugugguguucucuguuuuuuucugaacuugaauguuggccuauaauauugcuagguuagggaaguucuacuggauaguauccuaaagaguguuuuccaacuugguuccuuucuccccgucacuuucagguacaauaaucaaacguagauuuggucuuuucacauagucgcauauuucuuggaggcuuuguucauuccuuuucauucuuuuuucucuaaucuuguuuucucgcuuuauuucauuaaguugaucuucaaucucugauauccuuucuucugcuugaucaguucggcuacugauacuuguguaugcuucacgaaguucuucuuuuuuuuuuuuuuuugagacggcgucuugcauugucgcccgggccagagugcaguggcacaaucucggcucacugcaagcuccaucucccagguucacgccauucuccugccucagccucccaauagcugggacuacaggugccugccaccaugcccagcuaauuuuuuguauuuuuaguacagacgggguuucacuguguuagccaggauuucuugaucuccugaccuugugauccacccgccuugaacucccaaagugcugggauuacaggggugagccaccgcacccggccagcuucaugaaguucuuaugcuguguuuuucagcuccaucagguuauuuauguucuucucuaaaccgguuauucuaguuagcaauuugucuaaccuuuuuucaagguucuuagcuuccuugcauuggguuagaacaugcuccuuuagcucagaggaauuuguuauuacccaccuucugaagccuacuucugucaguucgucagacucauucuccauccaguuuuguuuccuugguggugaggaguugugauccuucagagaagaggcguucugguuuuuggaauuuucaaccuuuuugugcugguuucuccccaucuucguagauuuaucuaccuuuugucucugauauugaugaccuuaugauggggucucugaguggacauccuuuuugcugauguugaugcuacuccuuucuguuuguuaguuuuccuucuaacagucaggccccucugcugcaggucugcuggaguuugcuggaggcccacuccagaccccguuugccuggguaucaccagcagagguugcagaacagcaaagauugcugucuguuccuuccucuggaagauucaucccagaggagcaccugccagaugccagcuggagcucuccuguaugaggugucuguuggcuccuacugggaggugucucccaaucaggagacacggaguucagugauccacuugaggaguuaguuugaccuuuagcagagcucgaacgcucugagaucugcugcucgaacgugcuaggagaucugcugcucucuucagagccgucaggccaggacguuuaagucugcugacgcugugcccacaucugccccuucccccaggugcucugucccagggagauggggguuuuaucucuaagccccugacuggggcugcugccuuuuuuucagaggugcccuacccagagaggaggaaucuagagaggcagucuggccacagcagccuugcugagcuguggugcgcuccaucuaguucgaacuucugggcggcuuuguuuauacugugaguaaaacugcuacucaagccucagcagugguggacgccccucaccccaccaagcucaagugucccagguugaccucagacugcugcgcuggcagugagaauuucaagccagcauaucuuagcuugcugggcuccaugggggugggaccugccuacccagaccucuuggcucccuggcuucaguccccuuuccaggggagcaaacgguucugucucacuggcauuccaggugccacugggguaugaaaaaaaaaaaacaaaaacuccugcaccuagcucaguaucuguccaaauggccgcccaguuuugugauugaaacccagggcccugguggcauagacacuggagggaaucuuccggucugcagguugugaagaccaugggaaaagcgcaguaucugggcuagagugcacuguuccucacggcacagucccucccagcuucucuuggcuaguagagcaaguucucuaaccccuuguguuuccugggugaggcaacaccccacccuccuucgguuugcccucugugggcuguacccacuguccaaccaaucccaauuagaugaacacgguaccucaguuggaaacgcagaaaucacccgccuucugcaucgaucucgcuggggagcugcagacuggagcuguuccuauucagccaucuuggcagcaauccucacauuuaaguuuuuaagaaacugucagacuuuuucagaguagcucuaucauuucacauucugaccaauguaugagaauucuaguuucuuuauguccucaucaacacuugguauuugucaccuuaauuuugaugaauauuuucacuggguauagaauuauaaguugguaguuacuuucagcauuugaaaauauuccauugucucuuggauucauuguuucugcugagaauucaauugucaaucuauuugcuguuccuuugaaggcaauuuauaauaucucugacuaccuuuaauauuuuucuccuuguuuuuguuuguuuguuuuuuguuuuugguauagagucuugcucuguugcccaggcuagagugcaguggcacaagcuuggcucacugcacccuccgccuccugggaucaagugauccucccaccucagucaccugaguagcugggauuacaggugugcacccagcuaauuuuuguauguuuaguagagaugggguuucaccagguuggccaggcuggucuugaacuccuggccucaagugaucugcuggcccuggcugcccaaagugcagggauuacaggcgugagccaccaggcucagcuuguuuuuguuuuaaagcauuuuuacuuugugccuaggcgaguuuucuuuugauuuaucuuccuuugauuuugcagcauuucuugagcguguagcuugaugucuuucaucaguuuggguacauucuuagcuauuaugucuucaaauauuguuucugccucauuuucucuuuucaauuugcccaggaguccaauuccauuaguauuuaucauugacuacccuaugucuuucauguuuauucuuuauguuucuuccuuuugucuuuugauacuuuauucuggauauuuucuuucgguuauuguauuuuuuaguuuuagaauuucuagugucuuugcuuugguuuccagcuuucugcugaaauuaucuguuuugugucucugaauauauuaaauuuacuuauuuuaaaaucugugucugauuuugggaacaagauagaggugguguuugcauaauauugugaauguccuaaaugcuacugaauugcucacuuuaaaaugguuaauuuuauguuaugugaacuucaccucaauuuuuagaagucagcaugucugauaauuugacucucugguucucaguggauuacuuuuuauagccugcuguuuuuguagguuuccuuuuaugcuguuuuuacuccuggugugccugguuguuuuuuacugagugcugagcuuuguauaggaacaguuguagaaauaaguugagaucuacugugguguuauuuuacccuagagguaaucaugauugcuucugguagacaucuagguguacuaguaaucugggaucaucuuaauccagcuuuagagauugugaugguuugaaauauaccucagucccaaagaaaacuaguguauuucuaguucaucauuauuccuaggguguagugugagaaguuuccuaggaccuucccuucuuuguuaggccuuugugucuaauuuuuguuucauaucccuggcaggcauaagaaaaaauaucuuuggucaccuucuuagcuucugacaccuuuucaggugucugaaaacacacuugugggaaauguagcuccaaaagcuagacuugcuacuuugaguuuccuuuuucuuuucuuuuuugagacggagucuugcucugucucucagccuggagugcaguggugugaucucagcucacugcaaccuccaccucccagguucacaugauuugcccacuucagccuccugaguagcuggaauuacaggugugcaccagcacgcccaguuaauuuuuguauuuuuaguggaaacaggguuucaccauguuggccaggcuagucucgaacuccugaccucaggcaauccgccugccucggccucgcaaagugcugggauuacaggcaugagccacugugccuggccaguuuucuuuuuucuccagaaucaugguccuguaauuuucauuuccuuguuagcacuuucaaacagauuuaaaaauuuuuugaucaucuuuuuaaaguuuuucucaguaagauaauuggucugaauuaccuagucuauuauuuacagaacaggaguucucuuuuauuuccuuaagcauagaagcauaguuuuaaaauugucugugucugauaacucuaauauuggauguucuuugugggcuugaucuguuaugucuuauuucuuuuuuaaaaauuuuuuauuuccauaggcuuugggguaacaggugguauuugguuacauuuauaauuacuuuaguggugauuugugagauuuggugcaccaagcaguauacacugaacccaauuuguagucuuuuguuccucacucccuuuucacccuuucccucugaguccccaaaguccauuguaucauucuuuguugugggaagucagggaccccaaacagagggacuggcugaagccaugacagaugaauguggauugugaagauuucguggacauuuauuaguuccccaaauuaauacuucuauaauuucuuaugccugucuuuacugcagucucugaacauaaauugugaagauuucauggacgcuuaucacuuccccaaucaauacccuugugauuuccuaugccugucuuuacuuuaaucucuuaauccugucagcugaggaggauguaugucgccucaggacccugugaugauugcguuaacugcacaaauuguuuguagagcauguguguuugaacaaugugaaaucugggcaccuugaaaaaagaacaggauaacagcaauguucagggaauaagagagagaaccuuaaacucugaccgccggugagcugggcggaacagagccauauuucucuucuuucaaaagcaaaugggagaaauaucacugaauucuuuuucucagcaaggaacaucccugagaaagagaaugcgccccugaggguaggccucuaaaauggcccccuuggguguggcugucuucuauggucgagacuguagggaugaaauaagccccagucucccauagcacucccaggcuuauuaggacgaggaaauucccgccaaauaaauuuuggucagaccgguugcucucaaacccugucuucugaaaagauguuaucaaugacaaugaugcccgaaacuucauuagcaauuuuaauuucgccccggucugugguccugugaucucgcccugccuccauuugccuugugauauucuauuaccuugugaaguacgugaucucugugacccacacccuauuuguacacugccuccccuuuugaaaaucccuaauaaaaacuugcugguuuuacagcucaggaggcaucacggaaccuaccgacgugaugucucccccggacgcccagcuuuaaaauuucucucuuuuguacucugucccuuuauuucucaacccggacgaugcuuagggaaaauagaaaagaacuuacgugacugucgggggcagguuccuugauaauucuuuuuuuuuuuuuuuuuuuuuuuugagacagagucucacucugucacccaggcuggagugcaguggcacaaucuaagcucaccacaaccucugccucccggguucaagcaauucuccugcaucagccuccugaguagcugggacuacaggcucccaccaccaugcccagcuaauuuuuguauuuuuaguagagaugggguuucaccauauuggccaggauggucuugaucuccugaccucaugauccacccaccuuagccuccgaaaguguugggauuacaggcgugagccaccgugcccggcccguuguaucuuucucaugccuuugcauugucauagcuuagcucccacuuauaagugagaacauauguucaguuuuccauuccugaguuacuucacuuagaauaauagucuacaauccuguccagauugcugcgaaugccauugauucauucauuuuuauggcugaguaguauuccaucguguauguauaccacaguuucuuuauccacuuguugauugaugggcauuucagcugcuuccacauuuuugcaauugugaauugugcuuuuguauaauguuauacauuauaugaauuguacauuuguguaaugacuucuuuuccucuggguagauacccaguagugggauuguuggaucaaaugguaguucuacuuuuaguucuuuaaugaaucuccacacuguuuuccauagugguuguacuaguuuacauucccaccagcaguguagaaguuuucccuuuucaccacauccacaccaacaucuacuguuuuuugauuuuuugauaaugggcauucuugugggagugaggugguaucacauugugguuuugaucugcauuucccugaccauugguguuguugagcauguuuucauguguuuguuggccauuuguauaucuucuuuucagaauucucuauucauauccuuagcucacuuuuugaugggauuauuuguuuuuucuugcuaauuuguuugaguuucuuguagauucuggauauuaguccuuugucggauguauagauugugaugauuuuuucccacucuguggguuguuugcugacuguuccuuuugcugugcaaaagcucuuuaguuuaauuaagucccaccuauuuaucuuuguguuucauuugcuuuugaguucuuggucaugaaaucuuugccuaauccaaugucuagaaggguuuuucugauacuauauucuagaauuuuuaugguuuaggucuuagauuuaagucauuuaaguccuugauccaucuugaguugauuuuuuuuuuuuuugagauggagucucaaucugucacccagacuggagugcgauggcauacucuuggcucacugcaaccucccccuacuggguagaagugauucuccugccucagccuuccgaguaggugggauuacaggugccugccaccaugaccagcuaauuuauguauuuuuaguagagacaggguuucacaauguucgccaggcuggucuugaacuccugaccucagaugaucuacccgccucccagagugcugggauuacaggcaugaaccacugugucuggccuugaguugauuuuugcauaaggucagagaugaggaucaaguuucauucuucuacauguggcgugccaauuaucccagcaccauuugcacagcaaaaggaacagucagcaaacaacccacagagugggaaaaaaucaucacaaucuauacauccgacaaaggacuaauauccagaaucuacaagaaacucauuugcugaagaggucuuucaccuccuugguuagguauauucuuaaguacuuuauuuuauuuuuacaguaaaagggauugaguuauugauuagauucucagcuuggucacuguugguguauagcagagauacugauuuauguacauuaauuuuguauccugaaacuuugcuaaauucauuuaucaguucugggagcuuuuuagaaaacucuaaggaguuuucuagguauacagucauauugccagugaacagcaguaguucgacuuccucuuuacugauuugggugcccuuuauuucuuucucuugucugauugcucugacuagaacuuccaguauuacuguugaauagaaguggugagaguaggcauccucaucuuguucuaguucucaauagaaguggugagaguaggcauccuuaucuuguuccaguucucaaagggaaugcuuucauaauacuuuuccaguauuauguuggcuguggauuuaucauagauggcuuuuauuacuuugagguaugucccuuguaugcugauucugcugaggguucuaaugacaaaaggaugcuggauuuuuuuuuuuuuuucauauggagucucacucuguuguccaggcuagagugcgguggcaugaucuuggcucacugaaaucuccgccucccagguucaggcgauucuccugccucagucuccugaguagcugggauuacaggcaugcaccaccaugccuggcuauuuuuuguauuuuuaguagagacaggguuucauucaccauguuggccaggcuagucuugaacuacugaccucaggugauccacccaccucagccucccaaaguguugggauuacaggugugagccaccaugccuggccuggauuuuguuaaaugcuuuuucugaguuuaucgagaugaucaugugauuuuuauuuuuaauucuguuuauaugguguaucacauuuauugacuuuuguauguuaaacuaucccugcauaccugguauaagacccacuugaucaugguggauuaucuuuuugauaugcuguugaauucauuuagcucauauuuuguuaaggauuuuugcaucuauguucaucagggauauuugucuguaguuuucuuuuuuuguuauaucuuuuccuaguuuugguauuagggugauacuuucuuuauagaaugauuuagggaggauucccucuuucucugucuuuuggaauagugucaauaggauugacaccaauucuuugaaugucugguagaauucagcugucaaucugucuaguccuggauuuuuuuuuuuuugucuuuuugagauggagucucucucugucgccaaggcuggagugcaguggcccaaucucagcucacugcaagcuccaccuucaggguucacaccauucuccugccucagccucccaaguagcugggacuauaggcacccgcugccacgcccagcuaauuuuuuuguauuuuuaguagacacgggguuucaccguguuagccaggauggucucgaucuccugaccucgugauccacccaccuuggccucccaaagugcuaggauuacaggcgugagccaucgugcccagccgguauuuuuuuuuuugaaggcaguauuucguucucacugcuuguuauuggucugucuaggguuucgaauucuuccugauuuaaacuaggaguugugucuuuuuaggaauuuacccaucuccucuagguuuucuaguuuaugugcguaaaaguuuugauaguagccuugaaugaucuuuuguauuucuguggugucaguuguaauaucucccgcuucauuucuaauucagcuuauuugaaucuucucucuucucuugguucaucuugcuaguggucuaucaauuuuauuuaucuuuucaaggaaccagcuuuuuguuucauuuaucuuuuguauuuuuguuugauuguuucaguuucauuuagcucugcucugaucuugguuauuuccuuucuucugcuggguuugggucagguuuguucuuguuucucuaguuccuugaggugugaccuuagauugucuaguuguguucuuucagacuuuuugguguaagcauuuaagguggugaauuuuccucuuagcaccaccuuuacuguaucccagagguuuugauagguuaugucacuauuaucucucgguucaaagaauuuuugaacuuccaucuugauuuuauuguugacccaaugaucauucaggagcagguuauuuaauuuccauguauuugcauggcuuugaagguaccuuuuggaguugauuuucaguuuuauuccacuguggucugagagaguaauugauauaauuucaauuuucuuaaauuuuuugagacuuguuuuguggccuaucauauggucuaucuuggagauaguuccauaugcugaugaauagaauguauauucuacaguuguuggguagaauguguuguaaauaucuguuaaguuuauuuguuccgggguauaguuuaaauccauuguuucuuuguugauuuucugucuugaugaccugucuagugcugucaguggaguauugaagucccccacuauuauuguguugcugucuaucucauuacuuaggucuaguaguaguuguuucauaaauuugggaacaccaggguuagguacauauauauuuaggauugugauauuuuccuguuggacaaggcuuucuaucauuauauaaugucccuguuugucuguuuuuuaacugcuguugcuuuaaaguuuguuuuguuugguauaagaauagcuacuccuacucgcuuuuguccauuugcauggaaugucuuuuuucaccccuuuaccugacauuuauguaaguccuuauauguuaguugagugucuugaaggcaacagaugauuggugaauucuuauccauugugcaauucuauaucuuuuaaguggagcauuuaggcaauuuacauucaacaucaguaucaagaugugagguacuauuccauucaucaugcuauuuuuugccuguauacuuuggguuuuguuuuauuuuauuuuuuuuuuuuuagauggaguuucacucuugucacccaggcuggagugcaguggcgggauaucggcucacugcaaccucugccuccuggguucaagugauucuccugccucagccuccugaguagcuggaacuacagacacacgccaacaugccuggugaauuuuuguauuuuuaguagagacgggguuucacuauguuggccaggcugaucuugaacuccugaccucaggugauccaccugccucguucucccaaagugcugggauuacaggcaugaaccacugcacccagccagauuuuuuuaauuguauuuuuguuuuauagguccugugacauuuaugcuuugaaaagguucuguuuugauguguuuucaggauuuguuuaaagauuuagagcucuuuuaguaguucuuguauugcuggcuuguuaguggugaauucucucagcauuuguuugucugaaaaagacuaucuuuccuuugugaagcuuaguuucucuggauacaaaauucuuggcugauaauuguuuuguuuaaggaggcuaaauauacggcuccaaucccuucuagcuuauaguuuucugcugagaaaucugcuguuaaucuuauagguuuuccuuuauagguuaccuggugcuuuugccucacagcucuuaagauucuuuccuuugucuugacuuuaaauaaccugaugacaaugugccuaggcaaucuuuuugcgaugaauuucucagguguucuuugagccucuuguauuugaaugucuaggucuuuagcaaggcuggggaaguuuuccucaauuauucccccagagacguuuuccaaacuuuuagauuucucuucuccucaggcaugacaacuauucuuagauuuggucguuuaacauaaucccaaacuucuuggagacuuuguucauuuucuuuuauucuuuuucuuugucauuguuggauuggguuaauucguaaagcuugucuucaggcucugaaguucuuucuucugcuuauucaauucuauugcugagacuuuccagaacauuuugccuuucucuuuguccuuuauuuccugaaguugugauuguuuuuuaauuuaugcaauuggccaggcaugguggcucaugccuguaaucccagcacuuugggaggcugaggcgggcagaucaccugaggucaggaguuugagaccagccuggccaacaugaagaaaucucaucucugcuaaaaauacaaaauuagccaagcgugguggcacaugccuguaaucccagcuacucaggaggcugaggcaggagaauagcuugaaccugggaggcggagguugcagugagccaagaucacuccauugcacuccagccugggugacaagagcgaaacuccgucucaaaaacaacaacaacaaaaaauguaugcaaucuuuucacugaagauuucucuccucauuucuuguaucauuuuuugaauuuuuuaaaaguuggacuucacccuucucuggugccuccuugauuagcuuaauaaucacccuucugaauuauuuucagguaaaucagggauuucuucuugguuuggauccauugcuggugagcuaguguaauuuuuggggaguguuaaagagccuuguuuugucauaucagaauuguuuuucugguuccuucucauuuggguaggcuaugucagugggaaggucuggggcucaaggcugcuguucagauucuuuugucccacgggauguuccuuugauguaauacuaucucccuuuuuccagggauguggcuuccugagagcugagcuguaaugauuguuauuucucuucuggaucuaaccacccagaagggcuaccaggcuccaggcugguacuggggauuaucugcacagaguccuuugaugugaaccgucuucaugucucucagcaguggauaccagcaccugcucugguggaaguggcaugggagugaaauggacucugugaggauuuuuaguuuugguuguuuaaugcgcuauuuuuacacugguugaccuccugccaggagguggcacauucaagagugcaucagcugugguaguauaacggggaucaggcaguaggcagggcccuagaacuccgaagagaauaugcucuuugucuucagcuaccagagcagauagagaaggaccaucauguugggccaggguuaggcgugucugagcucagauucuccuugggcagggcuugcugcagcugcuguggggcauggggguaugggucccagguucaguggaguucuguucccagcaggauuauggcugccucugcugugucaugcagauugucagggaaguuggggaaagcaggaaguuauaggccucacccagcucccacgcaauccaaaaggccggucucacucccaucaugcccacuacccgccccacccaacaacaccaaguuuguuuccaggcagugagugagcagagcugagaauuugccucaggcuaccagccucccagcugagaaagccagcagggcuuccgugccuccccgcuucucaaaucugcacacuagauucaugcccuuccccgaguucggccagaaagcuucacguccgguuggaguuguuagaaaguucagcuggagguuuccuuccuguauggucuuuuaccaguuccucugucagcccucccaaaggaccccugugagacaagucagaaauggcuucccaggggacccagagagcccacagggcuuuucccauuccuuccucuaccccuuuauuuugcucagcucucuaauuugacucagcuccagguaaagucaaauccugucccaugagcuagaccuucagguuccccagugaggguauguauucagggguggacaaucucuccuuuccuacuuucauagcuugggcauucacaauauuuggggugucuccuagguccugcaggagcagucugcuucuuucagagggucuguggauuuucucagcuuuccugauguauuccuguaguaguuuuggagcaaaaguucaugaugugagucuccacccacugcucuguucaucugagugggaacugcaaucuaguccugccuccuaucugccauuuuccccuagaauuuccaugucuuguuucuuuacacuguaguucauggugucuuguuuccuuaugugccugcuuaucugcauaugcagggaauaguauuuuaaaaaguauuaaugggaauuauuugaagccuaagauuaaggcaucuuauuccaaagaguaagcagggucacaaucugguuuccaaucuccuggauauaaccagggaaccucaagccaagaucuuaguuuaaggaguuggagaaaugauaguuuauauauugcauuuuacguaaaaucaaaauccucuuuggaggaaggugcugugcacauaccaugaucuuagaaaggaaaaccaaagaagugaguuuagcuuugggggcuaaaguuuccccaggaguguuuugggauuuuugaaaauugagaugauuauauggcuuuuuuccuuuauugugcuaaugcgguguauuacauugauugauuuuuuguauguugagccaucuuugcauuccaaggauaaauuccacuugguugugguauauaauccuuuuaauaugcuauugaauuuggccugcuaauauuuuguucaggauuuuugcauucauauucauaauagauauucgucuguaguucucuucuuuuuguaguaucucuggcuuugguaucaggauaauguuggccugauacaaugaauuaggagauaucuaacugauuuuuguauacaguaguucccccucauccaugguuuugcuuuuugugauuucaguucccuguggucagucaauugcaguucaaaaauauuaaauggaaaauuccagaaauaaauaguucauaaguuuaaaauuguacacuauucugaguagcaugaugaaaucucacacaaucuuguucagucccauucaggacaugaaucaucccuuuuccaccuuauccacacuguaugugcuaccugcccauuagucacuugguagcugucuugguuaucagaucuacugucauaguaucacaguacuuauuuucagguaacccuuauuuuacuuaauaauaggcccaagaugcaagaggaaugaugcuggcaauuuggauaugccaaagagaagcugugaaguacuuccuuuaagugaaaaggugaaaguucuuggcuuaauaaggaaagaaaaaaaauugcugagguugcuaagaucuauggugagaacgaaucuucuauguuauccugacaaaggaaaaagaaauuaaugcuaguuuuguuaucacaccucaaacugcaacuguuauggccacagugagugauagugcacaguuaagauggaaaaggccauuaauuuguugguggaagucauaagcagaaacucguauguuccaauugauggcaauuggguucaguacuauuugaaguuuugcgcauccacugaggauccuggaauguaucccccauggauaaggaggacuacuguauugcuuuucuauccuacaguuuuguaaaacucaauuucuaguucuaguucauggcuuaacuuguagaaacaggugggacugacacccucaucacuuggcugcagagguccucccuggcuucuagggagggcugaggcagaggauuccuucuggauguaacccaugguacuagaguagccaugagucacauccguuuuuuauuucauuucaauuucauuauuucauuucaauuucauuucauuucauuuuucaucuuauaagaugaaauaguuccagaagcugagaaccuuuuuuccucugaggguugcuaagucucagcaaacauuacaccaugggcacaugaacaugugcuuagacaugaguguccuguuccauaagagauuugugucuguauuauacaggccagguagggaaaaggguuuucacugagucuuuuucauuuaugaauaguauauuaauaagggugauaguguuuuuuguuuuuuuuuauuuguugauuuguuuugagauggagacucgcuuugucacucaggcuggaaugcaguggcaugaucucggcucacugcaaccuccaccugcuggguucaagcaauucuugugccucagccuccugaguagcugggacuacaggcacccaccacuacgcccagcuaaguuuuguauuuucaguagagacgggguuucaccauguuggccaggcugaucgcgaacuccugaccucaagggaucugcccaccuuggccucccaaagugcugggauuacaggcaugagccaccgcaucuggcuaugauagugcuuuuugauaaugagcuuuaaaaggauacugagggauagaagcuagagaauaaggggaaaccaggcaagugauaucuugcugaugacaagagaauaaauuguugaaaauacauauuccuuuguauaaaucuuaggguacauacugacucuuuuuuauugauacauacuagcuauacauauuuucugcugggggaacccgcccccaguauuucaacguagguucuuucuguuuucccuaaguguuggcuggucugagaaaaaagagaaagaguacaaagagaggaauuuuacagcugggccuccggggaugacaucacauauugguagguccaugauguccugagccgcaaaaccagcagguuuuuauuaaagacuuuaaaaggggaggggguguaugaacagggaguaggucacgaagaucacaugcuuuaaagggcaauaaagaucacaaggcaaagggcaaagcaaagaucacaaggcaaagggcaaaauuaguauuacuaaugauggucuguguucagcugugcacauauugucuugauaaacaucuuaaacaacagaaaacaggguuugagagcagagaacugaucugaccucaaauuuaccaggcuggaauuucccaauccuaguaagccugaggguacugcaggagaccaggguguauuucaguccuuaucucaaccgcauaagacagacacucccagagcggccguuuauagaccuccccucaggaaugcauuccuuccccaggguauuaauuauuaauauuccuugcugggaaaagaauucagcgguaucucuccuacuuguacauccauuuauaggcucuccgaaagaagaaaaauauggcucuauucugccugacccugcaggcagucagaccuuaugguugucuuuccuuguucccugaaaaucacuguuauucuguucuuuuucaaggugcacugauuucauauuguucaaacacacauguuuuacaaucaauuuguacaauagugguccugaggugacauacauucucagcuuacaaagauaacaggauuaagagauuaaaguaaagacaggcauaagaaauuaaaagaguauuauuugggaacugauaaauguccaugaaaucuucacaauuuauguucagagauugcaguaaagacagguguaagaaauuauaaaaguauuaauuuugggaacugauaaauguccaugaaaucuucacaauuuauguuccucugcccuggguccaguuggucccaccauuuggggucccugacuucccgcaacaauuuucaugcuacaugagauauuuugacauauucauauaauguguaauuaucaaaucaagguaaaugagauauccaucaccucaaauauuuauauuuuuuuauguuggagacauuagaauucuucucuuccagcuauuuugaaauauauaauagauuauuguuaauauagucaaccuacugugcuaucauauacuacaucuuauuccuucuauguaucuguauuguuguacccauuaaucaaccucucuucauuucccccuucccuccuacuuuuuguagccucuguuaaccacuguuuugcucucucuuucugagaucugcuuuuuugguuuccacauuuaagugagaaugugcaauaguugucuuucagggccuggcuuauuucauuuaacguaaugaccuccauuuucauccauguagcugcaugugacaggauuucauuccuuuuuauggcugaauaauauuccauuuguguacacauaccacauuuucuuuuuccagucauccauugauggacaccuagguugaauucauauuuuggcuguugugaauagugcugcaauaaacaagagaguacagauaccucuucaauauguuuauauauauaauauguguguauauauauacacacacacacacauacauacauacauacauacauacauacacacucuguaguggguuugcuggaucauaugguuuaguuuuuugaggaaccuccauacuguuuuccauaguaguuguacuaguuuucauucccaccuauaguguaccaggauuccucuuucucuauauccucaccaguacuuuuuuuuuuuuugucuuuugaguaauagccauucuaacuggagugagaugauaucucauuguguuuucuuccuuuuuuacugucuuccuuuguggucaagugauuuucuucuuuuuugguuguuuuaauuuuuugcuuuuuuuuuaguguaccuguuuuauuuuugcuuuguaguuaccaugagauuuacaaaaaaacauuuuauagauauaacaaguuauuuuuuaaguuaaggaguuuuuaaaagagauggggauuuuacugugucggccagguuggucuugaacuccuggccucaagcaauucuccugcuuuagccuccgaaaguguggagauuacaggcaugagccugugccuggacaacagguuacuuuaaauagauaucuugccuugaucacaaauaauagaaacaaacaaaggaaaaacuaaaacauucuacacuuuuacuccaucauauuaugacuuuuuguugucucaguuuacaucuuuuuacauuaucuauaccuuaacaaguugcuguaguuauuuugagggggagcuuuuuguuuuuguuuuuucuuuuuuuugagauagggucucacucugucacccagguuggauugcaguggugcaaucucaguucacugcaaccuccacuucccaggcucaagcuauccuccugauagagguggcaacaaaucugaagcagcugcuguaaggaagccagcaguggaggaggugcaggcagggcugcgugcuccauggagcugucaggggcuaggaacaggugaucccaguggggacccugugcucccaggcacagcugcaucugcccagccacagcuugggacuugggcaucccugcgcucuuaugggccuggaaagcccccugcccccucaggcuuggaaguacuugcucccacugccuggccucucuucacucccaguacccacucugguguagagugaaguuguggcugagcacgggugcugucaugacccagucagguguguguacacucggggcagugcugacaugccagcccccuacugccuugguucccccaagacuuuggaugccgacgagcgcagaagggaggcugggagguugagggcagcuuggcaugggccugugaguguccugcagugcagacagccugggcacugcagauggcauguugaugguggugagagguagacagguuccuaggcagaaggggcagguccucagugaaaccucaccuucaagccaaggacagccugaagccuggaggccaggcugccagugccagguggaguccgcaaccuggagugagaacuuccuucaugccuuuuggccaauuggaugaugcuuuuuccaggccuucccauggcuguccauggaccagucagcacauacuuccucccuucugagcccguaaaaacccaaggcucagcuagacucagggacucaucaacucauugggacuaccugacuguggauaggagcugcccacuuagggucuccucucuacugagaguuguucugucacucaauaaggcuucuccccaccuugcucaccuuccaguugucuguguaaccucauucuuccuggacacaggacaagaacuugggacucacugaauggcgggagugaaaggagcuguaacacguuccuggccgacucgccgggcugugcguggugacaaagacaaacugcgugagugaagaguggugaccuuucuaggggcccagaccucaggauuucugagccagaggugcugucacaucauaggccucccacccuccacuggcaccugguggcugcgccaugcaaugggaagcagcuguggggccaggccagcccaggagccacuggccagagcaggguggugggacugaaacagcuguaacacaaaugggcugaaacaugugccaccugaaacacaucccccgacuugcugcgcugcgggugacaaggagagaagaguugugacucuucugggaucccaaaccucagggcucccagagccagggcucugacacacucuaacacccucuuugggccucugugguuccuggcaucucugagcuuucaggcgccccugcauuccccuuguccaggcauuggugcccacagcggaagcugcuugcaguacaucugguccagccacagucucacauggagccagugccugugcugguggcuggagcugccugccucacugcaacagccagugugccuggcugugcacauagccagaccccacauuugcuaacucacacaccccucacugcucugcaccuggcuugcccuuagcaggcauggggucugggcugguagcacaagcugagugcagccugccaggccgagugggcagaauaagcccagcaggugugagcaaaacucaagcagagguaccacuggccacagagguuucuggcuggugaagcgacacacugaggaucuugugaugcucccaccucagccucucaaguagcugggaucauaggugcaugcuacgacacucagcuaacuuuuuguauuuuugguagagauggggcuuugccauauugcccuggcuggucucaaauuccugagcucaagcaaucugccugccucugccucccaaagugcugggauuauaggcaugagccacugugccuagccuacuguuuuaaguagauuugucuuuuaguauucauacuagagauaugacuggauuacacaccacaauuauauuauuagaguauucugcguuugucuguauauucacuuuuaccaauggguuuuauaccuucaaauguuuuuuuguuuuugcaugugguguccuucucuuucauagugaagaacucccuuuagcauuucuuaugagucccuuucaaguguuugcuuguccugguaaaggcuuuaucuccuuuguauuucaaagauagcuuugcugagaauaauauucuugguugacagguuuuuuuuuuucuuuuucuuuuucuuuuucuuuuucuuucagcaccacguugaauauguuauuucacucccuccuggccaauaugcuuucugcugaggauucuauugccagauaaaucagagcuccuuuauauuuuguuuucuucuuuucucuugaugcuuuuaggaucuucucuuugugcuugacuuugagaauguacuuauuuauuaaacuuuuagauuuggguaaaugugaagguuuguuacguagguaaacuuguuucauugggguuuguuauacagauuauuucaucacccaggcauuaagcccaguacccaauaguuaucuuuucuccuucucuuccuucucccacccuccaccccagugucuguuguuaccuucuuuguguucauaaguucucaucauuuagcucccacuuauaagugagaacaaguaguauuugguuuucuguucugcauuaguuugcuaaggauaaugccguucagcuccauccauguucucgcaaaagacaugaucuuguucuuuuuuauggcuauguaguauucuaugguguauauguaccacauuuucuuuauccagucuaccauugaugaguauuucaguugauuccauguuuuugcuguugugaauagugcugcagugaacauucaugcauguuucuuuaugguagaaugauuuguauuccucuggguauauacccaauaaugagauugcugggucaaaugguaguucugcuuuuagcucuuugaggaauugccauacugcuuuccacaaugguuaaaauaauuuacauucccaucaacaguguauaaguguucccuuuccucugcaaccuugccuugccuuauuuuuugacuuuuuaauaauagcuuucugacuggugugagaugguaucucauugugguuuugauuugcauuucucuaaugaucagugauauugagcuuuuuuuuuuuuuuuuuuacauagucuugcucuguugcccaggcuggagugcagugguguggucucggcucacugcaaccuccagguucaagcgauuccccuccuucagccuccugaguagcugggacuacaggcaugcgccaccacaucugaauaauuuacuuuuaguagagaguggguuucaccauguuggccgggcuggucucgaacuccuggccucaggugauccacuugccucagccucccaaaguguugggauuacaggcaugagccaccgcgccuggccuaagcuuuuuuuuuuaauaugcuuguuggcugcauguauaaucuucuuuugaaaagugucuauucuuguccuuugccgacuucuuaaugaauuuguuuuucucuucuaaauuuaguuccuuauagaugcuggccguuagaccuuugucggaugcauaguuucagaugucuccucccauucuguagguuuucuauuuacuuuguuacuuuugcuaugcagaagcucuuaaguuuaauuagaucucauuugucaauuuuugcuucuguugcaauugcuuuuggugucuuugucaugaaaucuuuacucauuccuauguccaguaugguauugccuaggugggaauuuauuauaugccuugggguaggcuuauuugaauugaaucuguuuggugaucucugaccuuccuguucauggauguuuauaucuuuguguaaauuuggauacuuuucuguuacuauuucuuugaauaaguuuucuaccccuugcucuuucucaacuccuucuugaaggccaaugauucuuagauuugcucuuuugagguaauuuucuauauuuuguagguauucuuuuuucuuuuuucuucucuguuuauauucaaguagccugucuucaggcucacugauucuuuccucugcuugauccagucugcuauuaaaagccucuaaugcauuuuucaguucagggaauguauuucucagucccaggauuucuguuuguuuuuuuaaaaguuauuauuucaauaccuuuuuaaaauuucacugauagauuucugaauugauucccuguguuauauuggaguucacugaguuuuugaauccugggcagacagggauuaggaagaagcaaugauuaaggaauauagagauauaacaugaaaauucuuuaacaaugauaaaaagggcugggcaugguggcucacaccuguaaucccagcacuuucggaggccaaggcaggaggaucacuugaggucagaccagccugcccaacauggugaaaccuugucucuacuaaaaauacaaaaacuauccaggugugaugguacgcaacuauccaggugugaugguaauccuagcaacucgggugaggcaggagaaucacuugaacccaggacguggaaguugcaguaagcugagaucaugccacuguacuccagccugggcgacagugagacucugucucaaacaaacaaacgaaaacaaugauaaaagagauuuaacaucacugaaaguuguaaggaaguaaacccuaaaccuccaccccuccauuaaagcaaugauuauaagacuauacuuugaacaauuauaugacaacagauuagcuaaccuagaugaaauggacauauuucuagcaacacagaaauugccaaaacuggcucaagaagaaguaaaaaacuuuaguagauguguaacaauggauuaugucaauaaucaaaaccucugaacaaauaaaggcccagaaccagaugacuuaaaaaaaaagaaaaagaauaaggauucuugaucugaagaaucucaccacacugucucguuagggucagucacuggcuccuuuuuccaucugugggggucaugguucuuuguuagcuguuguuucuuguggacauauaucuaugucuucucauugaaggauuaguuauuucaguuuucacugucuggcuuguuuggguuuuucuuggauauguuuacauagagguucuuuacaauucaccuguugaauuuccuuuaugcuaggucacugcuuccuucuugguacuagaugguggcucauguccagguuugcuacagcucuggcaagcauucagagugcugaugguacuagguuggggagaucccaaaugggauaccccagcuguguggaaaagcuggcuaggguuucauacccagcgaaccuguagaguguaccuccuacaguguggugcugcugaacagccacucugauuuagcaucuucuuuggcugagauaccaagcagauuuugcaggcugggguugcugcuauucccaccuuccaucuuugucuuugguugcucucaguuuuucuugcuauagacacuugugaugcuuucuguggguugaggcaggaacaguucuccugcaaggaacccaagauaguggggaaguuggucuugaucucacuuuuuccaguguagaaacugagucuggggaaaauuuuccacaggcaauuccuugcagauuaggggagaggcaucacaguuacagaaguccgauucucuuaccaucugcuugaaauuuuuucacuucuuuguggucccggggauugucccauccucagauuugaguucugggauauugcugguaauaaucuuggcauuggauauugguuuuugguuuucuguugggggaagugaagccagauugcuucaacuuugccauuuuggugaugucuuucucccugauuauuucuugaugauaauuuccugguuauggacuuacugugaguuugcagucacccacauugcaugaaugccuaaguugacuacaccauuugcaauccccaauuaauauugauucuuuccugauuauuguuuuaauguaaacuuaaacauaaaauuauaccaguuuuauggaaauucuugaguuccuuuacuugguaagaaaugucuugaaugcacgcaauuaugaacuguaguuuccccauuuuauagcuauuugacuuauauuuuuucagguuuaugauauauuaauguuccuggagcuuauacucauuuaaaaacagccucaauacugaaguucuugaaugaaacagcucaguagaaacuaugaagaugccuuuguguacaauacuguuaggauagcauguccuagauguacauaucauaaucauguuuuuaaaaaauaucuuauaggugaagugccagcauuauaagaaaaaacgaacggagcaagaagaaacuauugcuucuuugcaaauggaagucuguagauuaaaaaaggaggaagaagaucgcauugucacucaaaacagaguguuugccuaucugugcaaaagaguuccucauaccgucuuggauagacaguaauuuugcuacauaaauugauauguagcuagauucauuguuguguuuguuuguuuguuuuaccugauauuaucuugggggugguuauaacucuuauaaacuagaaaagccucucucuccuccucuucugcauuguuuuucccugcucauccuguucuuuuuuuuuuuuuuuuuuguucuagagguccuuugaagaauggaauugaacauuuacuaaaaauaacacuaaacuuuuaaauaaauucauaauuaaucagacauuucucaaaauaacugauccuuuuagugaagaauacuauugagagaucgcuguauggguuuugggguugcuuaguuuuauuauguuauugauuuuaggaguuuuuaguggaaagaaccagggacuauauauuuuggagggaaaaaaaaaucaucauugauuuuuuuuuuuaaccuagcugaaguuaagauaguauuuuuauuuaaauucugauuuuacauuuguaacuguugucuuuccuacugaaaaucauucuuaagaacaauauuauaauuauuugcuauauccuauaauacauaaaaauaguuucaaaauaauaaaacuagaauuacuaacaauaagccuacugaaugagauuuaaauuucugggcagcuuucuuugauauuaauauauuccacuauguaugcagucaagauguauauuucuaaaauaucuugaaauacuuguuucucuguguguuugcgucaccaaauuauaaugcaguuagguuuguuucaauuucuuuucaauuuucagggauugcuuuuuaaauuuuuacuuuugaauguguaaacauuuauguaauugcaaaaucaaaacuauucauuauuuauauucagagaaguuguguuuucauuccuguccccuuuauucuauccuauccuuaccuccccuauagguaauugauuuuaaauguuuagaguuauuuuuagcaauauaaguaguauggauauuauauacauauucucucuuauguacuagcaccuucuuuuuuucucuuaacaguuuaaacugauugcauuuuaagcgguauuauauguuuaccuaguaggacuggaaaucuugaauaauuagauguuucuauuuuacaauaaaaauaaaugaggucagauauaaaguaaaaacaaguuaaaacuauagauuuuuugauaauuauuugagagauaaugcacauauauacacauauauaauuuucauccucuugaaggaaaaguaacgacaaacacauaaaaaaacauaaaaauguuagugagaggugugaauaaauagaaaagggaggcuagguaagaaaaauaggagagguaaggaagaacaaaaaggagagaggugagggagagagaacuacagugggaagaagaagagagaaauuggaagggaagaaugaaaaaacaaaaaacaguuaagaugacuggguaagagggugagagaagcacugagagaacuugcaauguaccagaugaagucaggcuaauucagguaugaauuuguccagugggccagagauuuuccacuguuugauuuuugucaaugcaaacuuucaguuugagacacugaaaugaaaaauugugaauuaaaccuauuggaaauacaugaguuguagccacuacagauauuauuaaaaguuacacggguacugggcuaaguaauagggcacacacagaugaggaaagccaugauuccugcauucagugaccugguagucuaguuggguagauagacauauaugcauguaaguaaaauauaaagcagauagugguauguacuauaagguggggcagauaggauacuaagugggugugacauagggagaaauuagugaaagguaagaaugacuacauaggcuucaugaaugaguuaucuuuuuagcuggacuacuaggaacuauagaauauuaauaggaagaggugagagaaaggauguuucaauuagagaaauaugauaacaggaaaagugaauguguuugggacgucaagaguccaagaggucuggaacauaggauacaugagauucugggaagagucuuaagagacaauaugacaauauggaaagugugcuguaacuuugagagacuuaaauuggccgaagaguuugaguucuacuuucuguguggcagggaacauacccaaagauuccugagcaaggagauuaaacccagagacagaaagacaaguuaggaaucgguuguaguaguagagggcuaaugaaggucuuaacuaggaccaaaaaaaagggagagacacugcaaagauggauaggaguuguccagacgaauuggcuauagauguugaaaggaguggaggagucaaagauggccaguuuuuaaacuacauuugaaggaacggggaagaaaccgaugaauucauuuauggauauauacuuaggcaccuucagucauccaaguagacauaucaggccuguuguuaaaagggccaaacuccagagaacuuccaaaguccauauagagaaagaagaggcagaagaggaauuguguuuggguaucaugauaaccaaggaacaaaaguguuucaaggagagggugaucggcaguguugcaugcuuccucauugguuaacuuguuuacuuucccacuauuuuauuugcucagaauucccaguacuuaacauguaauaaguccucccuaaaacuuuauugaagauaauugguuacaaucacucagaaugaaugaaguuuuuuuaugaaggaaaauauuagaaauagaaucauagcauaagggggaaguaggucaagaggauuugugcaggauauaaagauuaaagcauauuuucaggauaaugugaaagcugguauauguuaagaugcggaaggcuugaagagaaaaagaguaauuggggaaggguugaagagaaaaagaguaaucuagaaaguugugacauuaagagcacaauuggcugaauuaguucugaagagggggauggguugguaauauuuucccaagauaggagggaaacaguauauuguucguuuaaaaagaauaacacaugaaagcauaguauuauuuuguuuuucucucauuuuuuaaaucacaaaagcaauaaauguuuauaaaaauucaggccgggcgcaguggcuuacgccuguaaucccagcacuuugggaggccgaggcgggcggaucacgaggucaggagaucgagaccauccuggcuaacacggugaaaccccgucucuacuaaaaauacaaaaaauuagcugggcgugguggcaggcgccuguagucccagcuacucgggaggcugaggcaggagaauggggugaaccuggaagguggagcuuacagugagccaggaugacgccacugcacuccagccugggcgacagcaugacuccaucucaaaaaacaaacaaacaaaaaaaaacaaaaaauaaaaauucaaacaauaugaaaguguauaugguaaaauguaacaaaucugcuugcuuuccuaauccccacaucccagaaauaaccuccucuccuaacaauuugguguguguccuuccuacuguuucucaaaaugagugcuguuggcauuuugagugagacaguucuucuuuguguauuguuguguuguucaccgaugaauuuuuagcauucugcccccucuccaacuagucaauauggcaacauugccccuucauacacccgcuagcuuacaauauuauucucugguuaagaacccacagaguucuuuuucaguauauauacauauucacaucuaacuuuuuucuuuucuuuuuagacaaaaguaaaaaauauacauuugauuaugcaacauuaauuuuuuccaucaucauuccuuguuaaggacauacaaaguuacauuauuuuuucuacuucuccauuauuuucuuuuucuuucuuuuuuuuuuuucuuuuugagauggagucuugcucugucaccaggcuguagugcaguggugcgcucuugacucacugcaagcuccgccucccggguucaagugauucuccugccucagccucccgaguagcugggacuacaggcacucgccacgacgcccagcuaauuuuuuguauuuuuaguagagaugggguuucaccauguuggccaggauagucucgaacugcugaccuugugauccgccugccuuggccucccaaagugcugggauuacaggcuugagccacugcacccagcccauuauuuucuguaguauggaugugccauuauuuauuuaaccuuucuccugauggagaguuaaauuauuucuggcuuuucacucuuaaauaauggugcagugaacaacuuuguucauauugaguugcauccuuugacuuauuucugugggagauauugcuagagguagaauuguugggacaaggaggauaugcauuuaauauguugagauauaauguuuauaguuauuuuuaaaucuauacuuugaaauuaauauaacauaugacuuaguauaguauuugcuuuuugguaagaaucacuuaaauuuuuuaaagccugccagauaaucuguacuuacuuuuacacuguaauuugaaauuauguggugaaacuaguagaugcuguaauaccauaccgcauuuugaaaauaauucaauauucuguuuucuagguugcuuugucuaauugauuacuaugaaucuaaaauuagaaaaauucauacacaaagguacgaguaauccuguauuacaguuuuuaaagguuuuaauccaguauucacaccagaaguuucuguagcuuuugaaacuuuaauauacuauggaaauccaccuaauaugucacugugaaguucuuuuuuauaaagaacuugaagacuguauuuuacaacuuaagucaagauguauuguuguauuuauguuaaauuauguauacuuaauuaucaccaaaguauuggucauagcagaaaugguauuucccuuuauuuucuugaaguauuauaauuuuuucuacugauaugaucuagccccuggguaguuaccaaguauauccgcaaagugcauagaauuagauuggcugccuaucaaaguguaaccuaauuaguaugcagauuuaugugagauaaagauaaaaugucagugaaaaaucaagcuuauagauuaaaacacacuuaucaccugauuaaauaagcauagagauaaauggucuuuggcuaaacuaaaauagcugaaggauaucuaagauauaaucuaaaaugcuuuaauguaaggucacuaaaacaguagcuaaucuuuuuauuauuuauagauggaacaguucuuuuaacaaauauuuauuugagcaccuauuuuguaccauguucuaaguaauuaggaucccauaauaaagcagauaaauucuucacuuuuaugaagcguaugcucuaguauucuugccccaagaauagugacuuuccaaaaucuuggagagaauaauggcagagcucuguggguugcugguugcugauuaucuguaguacuguggggacuccaaaaaaaaaaaaaaaaaggaaaagaagaaggaaggaagggaagaagagagcaacuaauuaaaaagcaacuucuugcuuuauguucuuuucagaaagcagcauuuuaucaaguagcuucagggaccuucugacuuccaaaugaaacugucguuuagaugguggagauucuacaaagauaggacaacuacucaacucggcuguuguagcacaaaaucagccacagauaauauguaaaugaauuggcacagguguguuccaauaaaaauaguuacaaaaccaacagccugcugaauauagccugcagacagcaguuugcugaccccugaucuagaugaugaagaggggauuugggguuuuuaguaagaguagaaaagauuuaacauaacauauccaucaggaaaucuuuuguguagaauaugaugugagagguacuuguagaguucugcaaacgggguucucugacuaaagaugauaaaaaggauugaggccauuggaguggugguauugaauuuaguugucaugaauuuguaaugaaaaucuggggcugaggaaugagugacuuggaaaagaaucacuuuuuaacuuaaaaagcuuuucaucaauugucuagcugaaguaaaguauuuuggccuauacaaauuauccuugggucagauauuuggauuggaugucuuauugagggaaguggaggauaggaagaaaauaggagauacauuaauaaauaauauucuacaaaugagaaaauuugcagcaauaaaaagagucucucuccuaaggagggaguuuuucgggauucauugacugaguggaguuuauauuauaaacucagucuccuuucuaagaguaaguacuaacuugaaagugagauucuggcaauuucaggauagauuuugagaucuacaaauaggauauagguaucaucuaaagaaguaggaguacuguaacaggaggauguaacaauucauugacaaguauuacauuaguaaagaagaugaaagagaagacgggggaagccaggccaagauuuggaggccuaaguaggauaaacaggaagcagaggagaagagcugugacccuguagaacugaagcagcaagaccaaaggaagaagacaggugggacaugggccucucgcaguggcaaaagcuucucugcuuguccauuuuuuuaaggccaguguuguccgaaguuuuuuguuguuguuguuguuuuuaucaucagacuauaugcacauguguaaaauaaacacauugggaauaaaucauuugaacugaaucaauccauugauacuuacuagacuggugauauguuuauguguaauacuagaaaucaugcauguacccagugcacacuaggcuacaauaguaauacuuuaugugauacaauaguuaaagugaaauguaguccuaaacaauaaaguuguguuuaacagaaaaguauuuuauacuacuucaauuuuuaaauuuaagauuuaaugaaauuaaaaguuuaguuccuugguggcauuacccguauuucaaguguuaagcgguaaccacuagcucauguagcuauugguuaccauauaggacaucacagugauaguuaaucaagauugcuaaaaauaaucauacuuauuugcuagcacuuugcauuucacagaguccuucaguaucuuucauuugcuuuuuacaccaguccuguaaaguagaugugacagauacuauuuuacagaugagaaaauaaauucugagagauugacuuauucaaauaauacaacuaguuagugguguuaucaaggcuugaaccaagacuauuaaaucuguugcuuuuuccacuuaugaucuacauuuucuucauauagguuuuuuggugaccuaaauguacuagaaggaaaaaauaguauguggagaaugcauuuuuuaaaagaacauggauguuccaccuauguuucguuuguuuauucagcagugcuuuuucaccuccucuuauauuccauacuuuuucuaggcagugagauacaguggugaauaagacaaaguucugguccucauggaucauauauucuaaguaaaaagagaguaaauggauacuguauguacuauaauauuagauaguaguaguguucuaauaccauucucuaugagaacaaguaggaaauguggauuaauuuuaauucauguuuagauuauuaaacccucauuacauugguuuaauuaguuuuuuucuuugaagauagauuuuucauaaguauacugcauacauauuuucauaggcaauauaaagaagaugaaagucagucagaagaagaaaacgacuacagaaaucuggaugccucaccaacuuauaaaggccuuuuaaugguauggggacugcauaacuaauaaauacuuuuuaauaaacuaaguaaucuaagaaaguuaauuauuuuucuaugaaauguguugcagucauuacagaaucaacucaaggaaucaaaaucuaagauugaugcacuuucaagugaaaagcugaaccuccaaaaagauuuggaaaccaggugagagaaacuuaauuuuuuuuuuuuuuuuccugagacagggucucacucugucacucaggccaagugcaguggugugaucacgucucaccgcagccuugaccuccagggcucaagcaaucuuuccacuucagccucuuaaguagcuggggcuauaggugcaagccaccacacccagcuaauuuuaaaaauuauuuauuuuuaacugagacagagucuuacucugucacccaggcuggagugcaguggcgcgaucucagcucacugcaaccucugucucccagguucaagcgauucuucugccucagccucccgaguagcugggauuacaggugcacaccacgacggcuggcuauuuuguguauuuuuaguaggaugagguuuugccauguuugucaggcuggucucagacuucugaccucaagugauccuuucuccuuggccuccccaaagugcugggauuacagguaugagccaccauccucagccucuaauuuuuuaauuuuuuguuugguagagauggggucuccuuguguugccuaggcuggucuugaacuccuaggcccagugccagaauucccaaaguacuggaauuacaggcaugagccacugcauccggccaauuuuucuucauccuuugaaaaguaaacauacuggaauuuggaauauuaaaugcaccauucuagcuccuuugcucuaaagcuaaucaugaguacauaauauucuuauacucacuuuagucaguucuuucccgugauaacuuaugaaaggaacaagagcacauggguaggcaagggaaaugagaaaauaggaguccacagugaagaagacaaaacuagcuaagaacuucaaauaagcugggcauaguggcuuucaccuguaaucucagcacuucaggaggcugaggcagguggauugcuugaggcaggaauucgagaccagcaugggcaacauggcaaaaccccuucucuacaaaaaauauaaaaauuagcugggugugguggucuguggcuguagucccagcuacuccgaagacugagguggaaggaucacuugaccccaggaagucagggcugcagugagccaugauugugucacuguacuccagccugugugacagagcgagacccugugucaaaaaaaaaaaaaaaaacuucaaauagauucagucuuuuuuuuuuuuuugcuuuuaaaaaauagcuuuauugaguuacaauugauguacaguacacugcauauauguaagguacacaauuuauugaauuuugauauguguauacaccuaugaaacaguuauaauccagauaaucacccuaacaaucacagucaagauaaucgccuuggaggcuaggugcaguggcucauaccuauaauaccagcacuuugggaagcccagguaggaggauuguuugaggccaggaguucgagaccagccugagcaacaugugagaccucaucucuacaaauaauuuuagcccauugagauuuuuuuuuuuuuuuuuuugagacggagucuugcucugucgcccaggcuggagugcuguggcacgauguugggucacugcagccucugccucccgggcucaagugauuucuucugccucagccucccgaguagcugggacuacaggcgcccaucaccacgcccggcuaauuuuuuguauuuuuaguagagaugggguuucaccauguuagccaggauggucucgaucuccugaccucgugauccgcccgccucggccucccaaaguguuaauuacaagcgugagccaccgugcccggccuacaaauaauuuuaaaaauuagccaggccugcgcaaggaugacacgcaaauucaugaagcguuccauauuaaaaaaaaaaaaaaauuagccaggcaugguagcguacuccugcagucccagcuacuaaggaggcugaggugagaucacuugagcccaggaggucaaggcugcagugagcugugaucacaccaccacacuccaaccugggcaacagagacucugucucuuaaaacaaaacaaaacaaaaaacucuaaaaguuaucucuugccccuuuuguaaucccuccugccccucuuugccuuucccugagacaaccacugauuugcuuucaaucauuauacguuaguuuauauuuccuagacuucuuauaaguggagcuauacaauauuuacucuuuuuuugucuaucgucuuucacucagcaugauuauuaucuuaaauuuuuauuuuaauugcuaauugacaaauuacagcuguauauauuuaugaggcacaaagugauguuacgauucaugauuauaaugcagaauaauuaaaucaagcuaauuaacauauccaucaucuaauaccuuuugugguugaaaacauuugaaauuuacucuuauugauuuugaaauguauaauacauuaauauuuacuauauuagauucagucuuuugccagcggaguucucauucucaaauuauacuggaaugccuuguuauucuuauuccugugcugugggaugagaagaaaaguaaaauuuauaauggcacacaacagaaagauauauccagcauagcuacaaaaggaugacacucucuauguugacaguaauaaagaaugaacauuguugagccuuuuuucauucaacaaauauuugaauaccuauaguaaguuagacacugucccaaacucuggggugaacaagggaccaaaacaaauuuccuguucucaauaagcuuauauuuaauggcugggcgugguggcucacaccuguaaucccagcacuuuaggaggccgaagcaggccuccugaggucaagaguuugagaaccagccuggccaacuuggugaaacccugucuuuaccaaaaaaaauacaaaaaucagcccgguguggugguacgcaucgguagucccagcuauucaagaggccaaggugagagaauagcuugaaccugggagguggagguugcaguaagcugaacuugugccacugcacuccagccuaggugacagugugagacccuuucucaaaaaaaacaaaaaacaacaagaaaaaacuuauaccuuaauggagagaaggaccugauaccuagcauaagccauuuauauaaaaugugaaaaccuugaacacaauaauauguaaauuuaugauuauauaaauauguaguaaaaauuuaaaaacauacaugggaauaaugaacaaugaauugaggauagugguucucuaugguaugggaaggagaagaaugacauuaaugagggaauuuuaaguauauguauaaaguuugaguuaagauuugaaucaaaucuguuaauauucaaauuugauaaagcuaggugguggauacaccaggauuuguuauaauguucucuguuuuugucuguauacuugaaauauuucacuauaaaaacaaguaacagauuagcagcaaaaaacgacuaaaaggcuuugaauaagggauuacagagaagaagaaaucuaaauggccaguaaacuccaaauuagcagucaugaaauauuuucagaagcuuaauaaguauauuugugacaaguaacaaaguuuuguaugucguuaauauuuaaguaccuuuaugcuuuuauucaguaaauugaauuaauuuaucauuauuuauuuuccacaggccuacgcagcaugaauuaagacuuuauaaacagcaggugaagaagcuggaaaaagcccuuaagaaaaacgucaaguaauuauauuuuuaccaaaauugccucuuuuauuaggauuuuuuauuuuauuuauuuauuuuuauuuuuauuuuuauuuuauuauacuuuaaggguacaucugcacaacgugcagguuaguuacauauguauacaugugccauguuggugugcuacacccaguaacucgucauuuaacauuagguauaucuccuaaugcuaucccuccccacuccccccaccccauaacaggccccaguguaugguguuccccuuccuguguccauguguucucauuguucaacucccaccuaugagugagaacaugcgguguuugguuuuuuguccuugcgauaguuugcugagaaugaugguuuccagcuucauccaugucccuacaaaggacaugaacucaucauuuuuuauggcugcauaguauuccaugguguauaugugccacauuuucuuaauccagucuaucauuguuggacauuuggguugguucuaagucuuugcuauugugaauagugccacaauaaacauacgugugcaugugccuuuauagcagcaugauuuauuauccuuuggguauauacccaguaaugggauggcugggucaaaugguauuucuaguucuagaaccuugaggaaucaccacacugucuuccacaaugguugaacuaguuuacaguuccaccaacaguguaaaaguguuccuauuucuccacauccucuccagcaccuguuguuuccugacuuuuuaaugaucgccauucuaacuggugugagaugguaucucauugugguuuugauuugcauuucucugauggccagugaugaugagcauuuuuucacgugucuuuuggcugcauaaaugucuucuuuugagaagugucuguucauauccuuugcccacuuguugaugggguuguuugguuuuuuucuuguaaauuuguuugaguucauuguagauucuggauauuagcccuuugucagaugaguagauugcaaaaauuuucucccauucuguaggucgccuguucacucuguucacucugauucacucuguucauucuguucacucugaugguaguuucuuuugcugugcagaagcucuuuaguuuaauuagaucccauuugucaauuuuagcuuuuguugccauugcuuuugguguuuuagacaugaaguccuugcccaugccuauguccugaaugguauugccuagguuuucuucuaggguuuuuaugguuuuaggucuaacauguaagucuuuaauccaucuugaauuaauuuuuguauaagguguaaggaaggaauccaguuucagcuuucuacauauggcuagccaguuuucccagcaccauuuauuaaauagggaauccuuuccccauuucuuguuuuugucagguuugucaaagaucagaugguuguugauauguggcauuauuucugagggcucuguucuguuccauuguucuauguaucuguuuugguaccaguaccaugcuguuuugguuacuguagccuuguaguauaguuugaagucagguagcaugaugccuucagcuuuguucuuuuggcuuaggauugacuuggcaaugcgggcucuuuuuugguuccauaugaacuuuaaaguagauuuuuccaauucugugaagaaagucagugguagcuugauggggauggcauugaaucuauaaauuaccuuggguaguauggccauuuucacgauauugauucuuccuacccaugagcauggaacguucuuccauuuguuuguauccucuuuuauuucauugagcagugguugguaguucuccuugaagagguccuucacguuccuuguaagugggauuccuggguuuuuuaucucuuugaagcaauugugaaugggaguucacucaugauuuggcucucuguuugucuguuauugguguauaagaaugcuugugauuuuugcacauugauuuuguauccugagacuuugcugaaguugccuaucagcuuaaggagauuuugggcugagacaaugggguuuucuagauauacaaucaugucaucugcaaacagggacaauuugacuuccucuuuuccuaauugaauacccuuuauuuccuucuccugccugauugcccuggccagaacuuccaauacuauguugaauaggaguggugagagagggcaucccugucuugugccagguuucaaagggaaugcuuccaguuuuugcccauucaguaugauauuggcuguggguuugucauaaauagcucuuauuauuuugagauaugucccaucaauaccuaauuuauugagcgauuuuagcaugaaggguuguugaauuuugucaaaggccuuuucugcaucuauugagauaauuauaugguuuuugucuuugguucuguuuauaugccggauuacauuuauugauuuguguauguugaaccagccuugcaucccagggauaaagcccacuugacuaugguggauaagcuuuuugaugugcugcuggauuccauuugccaguauuuuauugaggauuuuugcaucgauguucaucagggauauuggucuaaaauucucuuuuuuuguugugucucugucaggcuuugguaucaggauggugcuggccucauaaaaugaguuaggaaggauucccucuuuuucuauugauuggaauaguuucagaaggaaugguaccagcuccuccuuguaccucugguagaauuuggcugugaauccaucugguccuggacuuuuuuugguugguaagcuauuaauuauugccucaauuucagagccuauuauuggucuauucagagauucaacuucuuccugguuuagucuugggaggguguauguguugaggaauuuauccauuucuucuagauuuucuaguuuauuugcguagagguguuuauaguauucuccgaugguaguuuguauuucugugggaucuguggugauauccccuuuaucauuuuuuguugcgucuauuugauucuucucucuuuucuucuuuauuagucuugcuaguggucuaucaauuuuguugaucuuuucaaaaaaccagcuccuggauucauugauuuuuuugaaggguuuuuugugucucuauuuccuucaguucugcucugaucuuaguuauuucuugccuuuugcuagcuuuugaauguguuugcucuugcuucucuaguucuuuuuuuuuuuuuuuaauuuuuuuaguauuuauugaucauucuuggguuuuucucggagagggggauuuggcagggucauaggacaauaguggagagaaggucagcagauaaacaugugaacaaaggucucugguuuuccuaggcagaggacccugcggccuuccgcaguguuugcguccauggguacuugaaauuaggaaguggugaugacucuuaaggagcaugcugccuuuaagcaucuguuuaacaaagcacaucuugcaccgcccuuaauccauuuaacccugaguugacacagcacguuucagagagcaagggguuggggguaagguuauagauuaacagcaucccaaggcagaagaauuuuucuuaguacagaacaaaauggagucuccuaugucuacuucuuucuacacagacacaguaacaaucugaucuuucuuucuuuuccccacauuucccccuuuucuauuugacaaaaccgccaucgucaucauggcuuguucucaaugagcuguuggguacaccucccagacaggguggcggccgggcagaagggcuccucacuucccagacauggcggcggggcagagggucuccccaccccccgagacggggcggccgggcagaggcgcuccucaguucccagacggggucgcggccgggcagaggcacuccucaccucccagaugggguggcggccagguagagaugcuccucaccucccagacagggcggccgggcagaggcgcuccucacaucccagauggggcggccgggcauaggugcuccccacaucccagacaaugggcagccaggcagagacgcuccucacuuccuagacaggaugacggccuggaagaggcacuccucacuucccagacugggcggcugggcagaggggcuccucacaucccagaugaugggcggccaggcagagacgcuccucacuucccagacgggguggcggccgggaagaggcacuccucacuucccagacugggcggcugggcagaggggcuccucacaucccagacgaugggcggccuggcagagacgcuccucacuuccuagauggggugguggccgggcagaggcugcaaucucagcacuuugggaggccaaggcaggcggcugggagguggagguuguagcgagccgagaucaugccacugcacuccagcuugggcagcauugagcacugagugagcaagacucugucugcaaucccggcaccucgggaggccgaggcaggcagaucacucgaggucaggaguuggagagcagcccggccaacauggcgaaaccccgucuccaccaaaaaauacaaaaaccagucaggcguggcagcgcacaccugcaaucccaggcacucagcaggcugaggcaggagaaucaggcagggagguugcagugagccgagaucgcggcaguacaguccagccuuggcaacagagggagacuguggccaagugggagacggagacgagggagagggggagaccgugaaaagggagagggagagggagcucuaguucuuuuaauugugauguuaaggugucaauuuuagaucuuuccugcuuucucuugugggcauuuagugcuauaaauuucccucuacacacugcuuuaaaugugucccagagauucugguauauugugucuuuguucucauugguuucaaagaacaucuuuauuucugccuucauuuuguuauguacccaguagucauucaggagcagguuguucaguuuccauguaguugagugguuuugagugaguuucuuaauccugaguucuaguuugauugcacuguggucugagagacaguuuguuauaauuucuauucuuuuacauuugcugaggagugcuuuacuuccaacuauguggucgauuuuggaauaggugugguguggugcugagaagaaaguacauucuauugcuuugggguggagaguucuguagaugucuauuagguccgcuuggugcagagcugaguucaauuccuggauauccuucuuaauuuucugucucguugaucugucuaauguugacagugggguguuaaagucucccauuauuauugugugggagucuaagucucuuuguaggucucuaaggacuugcuuuaugaaucugggugcuccuguauuggaugcauauauauuuaacauaguuagcucuucuuguugaauugaugccuuuaccauuauguaauggccuucuuugucucuuuugaucuuuguugguuuaaagucuguuuuaucagagacuaggauugcaaccccugccuuuuuuuguuuuccauuugcuuaguagaucuuccuccaucccuuaauuuugagccuaugugugucucugcaugugagaugggcuuccugaauacagcacacugaugggucuugacucuuuauccaauuugccagucugugucuuuuaauuggagcauuuagcccauuuacauuuaagguuaauauuguuaugugugaauuugauccugucauuaugauguuagcugguuauuuugcucguuaguugaugcaguuucuuccuagccucgacggucuuuauaauuuggcaugauuuugcaguggcugguaccgguuguuccuuuccauguuuauugcuuccuucaggagcucuuguaggacaggccugguggugacaaaaucucucagcauuugcuugucuguaaaggauuuuauuucuccuucacuuaugaagcuuaguuuggcuggaugugaaauucuggguugaaaauucuuuucuuuaagaauguugaauauugccccccacucucuucugguuuguagaguuucugcugagagaugagcuguuagucugaugggcuucccuuuguagguaacccgaccuuucucucuggcugcccuuaacauuuuuuccuucauuucaacuuugaugaaucugacaauuaugugucuuggaguugcucuucucgaggaguaucuuuguggcauucucuguauuuccugaguuugaauguuggccugccuugcuagauuggggaaguucuccuggauaauauacugcagaguguuuuccagcuugguuccauucuccccgucacuuucagguacaucaaucagacguagauuuggucuuuucacauagucccauguuucuuggaggcuuuguucauuucuuuuuauucuuuuuucucuaaacuucucuucucacuucauuucauucauuugaucuuccaucacugauacccuuucuuccaguugaucgaaucggcuacugaggcuugugcauucgucauguaguugucgugccuugguuuucagcuccaucagguccuuuaaggacuucucugcauugguuauucuaguuagucauucgucuaauuuuuuuucaagguuuuuaacuucuuugccuuggguucaaacuuccuccuuuagcucggaguaguuugaucuucugaagucuucuucucucaacucgucaaagucauuuuccguccagcuuuguuccauugcuggugaggagcugcauugcuuuggaggaggagaggugcucugauuuuuagaguuuccaguuuuucugcucuguuucuuccccaucuuugugguuuuaucuaccuuuugucuuugaugaugaugauguacagaugggguuuugguguggauguccuuccuguuuguuaguuuuccuucuaacagacaggacccucagcugcaggucuguuggaguucgcuggagguccacuccagacccuguuugccuggguaucagcagcagaggcugcagaacagcggauauuggugcacagcaaauguugcugcccgaucauucuucuggaaguuuugucucagaggaguacccggcugugugagaugucagucugccccuacugggaggugccucccaguuaggcuacucgggggucagggacccacuugaggaggcagucugccaguucucagaucuccagcugcgagcugggagaaccacuacucuauccaaagcugucagacagggacauuuaagucugcagaggauucugcugccuuuuguuuggcuaugcccugccccuagagcuagagucuacagagacaggcaggcuuccuugagcugcggugggcuccacccaguucgagcuuccuggccgcuuuguuuaccuacucaagccucagcaaugucgggcgccccucccacagccucgcugccgccuugcaguuugaucucagacuucugugcuagcaaagagcaaggcuccaugggcguaggacccuccaagccaggugcgggauauaaucuccuggugugcuguuugcuaaggguguuugaaaagugcaguguuagggugggagugacccgauuuuccaggugcugucugucaccccuuucuuugacuaggaaagggaauucccugacccuuugugcuucccgggugaggcgaugccuugcccugcuucggcucacgcucggugcgcugcacccacuguccugcacccacuuuccgacacuccccagugagaugaaccucguaccucaguuggaaaugcagaaaucacccgucuucugcguugcucaugcagggaguuguagacuggagcuguuccuauuuggccaucuuggcuccaccccuauuuauuuuuauuauuuauuuauuuuuugagacggagucuugcucugucgcccaugcuggagugcaguggcacaaucucagcucacugcaagcucugccuccugggcucacgccauucuccugccucagccucccaaguagcuaggacuacagucaccugccaccaccccuggcuaauuuuuuuuuguauuuuuaguagagacgggguuucacuguguuagccacuguguggaucuccugaccucgugauccacccgccucugccucccaaagugcugggauuacaggcaugagucaccgcgcuuggccuuauuuuauuuauuuuuauuacaugucagcuuaugcuaccuacuaguggcuuuggcuuggaccuaccaggcugauggggaaaaugacauuaaaaggggguguuucugguuucacaguuuaagagcaauuucuaccaugcuggauuuggcuauauauuuaagugagaacaaaaaagguaguugccuaaaguaauaaaggacaaagauuuuaaauagaaaauuaucuugggaaguaauggaagaauugcaagagaaucaaugaaauuagaagugacaagccuccaauuuuugcuguugauaauuaugaucugaauguuuuaaagugagcguuaucacacuuuaaaaguaccagaaggaaugcagugagccauuuauaucuacugcuuguacccuuccugacuuugaaaagcaagugcucaguguuucaaagaguugaucucagugauuguguuuucugaagauuaucuauguguacucuuugauucaagggaaugggauuugagaaaguggggaguguugggaugacauauuuugaaagcuaugaguuaauauaugcauuaaauauauuaagucaguuguauuagcauauaugauucaguuuucagcgacagcucuguuuccuccuuccuauggcaacacauaacacagugacaggcaaguaucaugaguauccaggaauuacauacuggguuaaaauaauaggggccaggugcaguggcucacgccuguaaucccagcacuuugggagacugaggcaggaggauugcuugaguccaggaguuugagaccagacugggcaauguagugaguccuugucucuacaaagaauuuaaaaauuagccagguguggcgguacuuaccuguagccccaguuacuuaggaggcugaggugggaagauugcuugagcccaggaggucaaggcugcagugagcugugaucacaccacugcacuccagccugggcaacagagcaagacccugucccuccaccccccguccccccaaaaaaaagauaauagaggaggaaaacuaaacaagaaaagagaaguggaagguucagaaaggaugcaugcauauucaaugaauaauuauucccuuccuacuauuccuugauauuuuguguacuuacaguucuucuuacaucuguuuggcauucuaggcacugguugcagugguaaacaaaauagaaaaggucccugaccucauagagauuacaugaagggagaaagauaaugaaaaaauaagacaauuucgauaugcuauaaguacuaaacguacaaucgugggagaguagccauuauaugaguuuggagaagagaugguagugacauggucaaagguggcaguaguggaggugaugagaaguauuuggaauuggagaauggagguagaacuaauaggacuucaugauggguugaauauagggaguugugggggaaaaggaagagucagaagucucccgaguuuuaaccuugaauaacaaggugguugucagugccacuaaugagauaggagauugagagagaagcaacuaggagaaggaggauguagggaaguaaaaagagaaggcaauaaugagaauugacuguugacucuaaagcaaguguauaacaugcacacacacacguacacauguguaugcacuuacacauacguagagauagauagucuucauuauuaauagauuccauauuuaugaauuugucuaccugcuaaaauuuauuuauaaucacaaauccauacagcaccuguagucauucauggacauguacacaguggcaaauaauuugggucacccaacacacacauguuuaguuuucaaacaagaugaugaucugcccuguuguuugagcucucauacuauaaacaaauguccuuuuguccaucuauuuagugauacuuuuuuuuuuuuuuuuuuuuugcauuucuaugccuuuuguuggugauuucuuuaagauggccucugaguuagugcugaagugcuguuugguguucuuauccacaagaaggcuauaauaugccuuguggaaaaaauacaccuauuagauaagcuuuaucagguaugaguuauagagugcuguuguccaugaguucaauguuaaugaaucaaaaaaauauauauuuuaaaggugucuuuaaauagaaacauacagacaacaagguuauauauugaucauuuaaggaaaaugugaccagacuugcaggacccugacccuguauuuccucuaggagcagugguucaguauuugcuaauucagcauucauagugauuuuauagaacauaacuaccaugaauaaugagaauugauugcauauauauauuguucuuguuguuguuuauuugggcuccggucuuucgagugacuuuuauuauuguccuuuaaaauuaugauucagacccaauuccugcuauauuuuucugcuaaauuuugaagaaaugauguguuuuuguuuuuaauaaaguuuaaaacuuugguaguaucuagacauggaaacaaauuugggaguguuauauaacuugcccaaguuauacagguuacugguauauggaagaacugaacagaaaucagauccuuacccaaucauucugacuccaaaacuuauacucuuagcuaccauacaguuagaacuaaacaaaacacucaaugaaaaaaauuuuuucaagguaaaacuuaaaaaaauuuuacuuugcaagguaaaacuuaacaaaacuuaaaaaagauuuuaaaaacuuaaacuuaaaaaauuuaaaauuaaagaaacuuuaaaaacuuaaaaaaauuuacuuuucaagguaaaacuuuaaaaauuuuuauuucuguagugccagagguagaauauuuuuucaaaguacuacugaugcuggggaaauaauuaaaacuaaaaucuccugucaauccagugaauucucuuuacaaacguaggaaaaaaaagaaacaguuuuauuacugaauucaaucagauucaaucagauugugaugcacauuacaggcaaucuguuagagauauugcaaagacagaaagaaaugucacccuuuuguauagcaaggcagauacaauccauuauauacauguuaauuaucuguauuaaaggaaaaauaaaaacuucuaaugucuuuuugauaaguaagagguuacaacuuggggccaggagccuugacgaaauuccaacagagacagggaaacaagguaccaucuuccgagauguucacauuucaaagaaaugauuccaaagcccccaagaaagacauugcugagauucaaaacuggcaagagccuucuuuagcucuuaauaagauuuauguacaucuuaaagagaguaaaggauuuguaguuacagauuuucuaaaggaaaugcuacaagaaaauggaagaggguauagucucuuuuccuuuuggaaccagagaaaauugaguuuguuuguuuuuuuuuuuuagauuuguaguuaaccaacuuucaaugucaaauaaggcuauuaacaauuuaaugugggagaacauggacucuucuugaguuaguauuacaaacaggcugauuauaaaauuuccuucuuaggaagugauuaaauaagucugucccuauaagauaaacaaagguacuacacuaauuucauuuaauuuuucaauaguauuuauguuuugcuaggggaaaaacaaaauccuacagccacucuguguugagcugacaguccuugaagugguuaggccaaugagucaaagugaaauuaacagucaaacuguuaacuuacugcuauaggauaaacaagaggccaaaaugaaaagggcugacucuucaguguugcauuuuucccuauggaauagcaccaggugaggaacagucugacauacacccagauggggggaaucaucucacugccuaggagcccugcacaaaagauuccugcuauuuuaaaguguagggagaagaaaggcuaggaguagaaaaguacugagucagaguggagaaaaguauuuuaauuaaggcuucuccaccaauaagaagaucuuggauagagguacuugacacaugccucagucuaagcuccaaguaaagaggccccuaaugcaggugacuaggguaggaaugcagaaaugcuuguggcaaggcacuagaauaacaguaguaguaguaguauagcuuucaggaaggaaaggagguggcguguccuugacugcaacugucucgagagauugcagugcacaggcugugcaucaugucugguguggagaggacagcuuucccugcaagagaucuuccaggcagagccuuuguaauuaccuguggcugugccugaaauauaacacauuggauuuuagccaggagcuggacuuuucaccuagagaaacacuugccuucagaguuuggcacuggugcuggguugaagugaaccacccuucuuuucaucacuaacuaucuuagaaaguccuaagauuguaggguaaaagacucggggaacaguauagcuuugagaagcucacauugaugcaccuauguguuuugcauguagcuaaauuaguggaauuuuuaaaaacaaaauuggcaguccuuuuuuuuaacuuguuccugaucuccagcauggaucuuauuccacugugagaucauggaaaagcuccaacagaacacaguuaaaagcuauaaaguuucugcacauggaaaguuaucuuauggagauggcuauacaaaauagauaaaacagcauauuuuaaguuggagguacaguuuucuguuuucucaguguccacaaaaaaacauaguugcugcuguugaauacauggaaugagugucugcaaagcaugugaaguaccccuuaggcacuccuaggggauuuuuauuaucuuucaggcccuuccugacugcucuggauacuguagaacagcucuagcguauuucugaguacaguccaggcagcuacaacacagguuucuaaaaugccaauuaagucauguaaauagaaaaugaggggaucaucagcaauauaacauagaaguuauauuguucaugugugguuuuuccuagacucaaggcacuagaauaacugcaguaauauuuauagccuucaggaaaggggcaagcuuugcuaguacauagacaagugcccuuuuuagcucuaguuuaagaaaauuuagaaugagcagcaguacccugggcuccuucccugacccccagcauuagacagacuauaggcuggaagcaaguugcacuuccuccuuugcccauuuuaaccucagcuucuuuggcccaaggcuccacuucagucuuuaugucuuggcauccauaagccaacauuucuucuuuguugucugugcauuuuuaauauauccugaggcaaucuccagacaugcuugaucuguccaacuuaacuccugaggcaccaauuauuguuuuuauucuccaguucuaaagcuacaucaguuguaaguagucugguuucuaauacuauuuucuccugagcccuguuaauuacuugcaugauuuugcagaaugugaaguuuuucaguaauacuguuaauggcagauauuuucugugagacuaagugaaccaguuuccuaugaguccccagcuuuuacuaaucauugucuuauauaaauagaaaaacaaugggacuaaaugagugaauacauguaaagugcuuagaauuccugcauagagaaggcucucaguaccuacuaguuaucaucauuaggcucccaauaaguuguaguuacugucauuauuaagugaggguaucuauuuauucaucugguuaaugaaaucacauuucauuucccagaguaacugaucaguacaugcaauuauauauuuagguuauugcacugacaguaaaaauguuguauaucuacaguguaacauuuauuaaucagauuugcaaacaauucauugauaaguugaacauuuucaccuaagugaaaggaaguaacauuuaaauucagauauaucaguuuacgucuaguccuucuagaggccauaucagcuuuucuguguccuuuuuuguucuagauaauaugcucauggcacugccuuuaggcaaaacugugaagaaugugaauguaguaaauaggaagucauuuauaauuuggcuugggcauauacucacuagaaagcagagaauagcaacugagugaauauaaggggaauauaugugacugguguagguaauuguagggaaguaguagaaucaaguaagaaaggagucaggagaaauacuguguuaggacugggggggcacgguggcucacuccuguaaucccagcauuuugggaggccaaggcgggcggaucacaaggucaggaguuugagaccagccuggccaacaugguaaaacaccguuucuacuaaaaauaaaaacaacaacaacaacaaaaacugggcaugguggcaugugccuauaaucccagcuacuugggaggcugaggcaggagaauuguuugaacccgggaggcagagguugcagugagcugagaucgugccauugcacuccagccugggcaacagggcgagacuccgucucaaaaaaaaaaaaaaaaaaaaaagauggaaaaagcauuaaauuuguggguggaagacauggacagaaauguguuccaauugauggcaacuggguuugguucugaggucucagguaucuacuggggauccuggaacaauguaucccccacugacaaggggggacuacuguagucucguaauaauccuucaaauuaccccucuucaauuugaguaugccaucaguuuccugcugggacuucaacccacuaaacugacucuaugacucauuaacgaugcgcucugccugcuguuuguaaaauagaauaguaaaacuccaucaugucauuuuccuguugaaaaacaaucaaugauuucucauuuuuuuaugugcuaaaucuaauauccuugggcuagcauucaaaacucuccaugccauuaguccuaacacaguauuucuuuuuuuuuuuggagauggagucucacucugucacccaggcuagagugcaguggcacgaucucaccucacugcaaccccugccucccagguucaggcgauucuuuugccucagccucccgaguagcugggacuacaggcaugcgccaccauauccagcuaaguuuuguauuuguuuuucuuuuuuuuuuuuuuaguagacagggaguuucaccauguugcccaggcuggucucaaucuccugaccucaggugauccugaggucaucuuaacuaagcauguaucacacacuguggcuguaacuuuugcaguuugagguccaacagcaaaacuagcccagauuucuuauuccuucuucacaauuucacagauagaauauucguucucacuguauaucuuagcaaccucagcauacacuuuuuuucuuaaguggagaacuuucaccuuuucacuuaaaggacacacuucaugacuucucuuuggcacaucaaaauugcuaacaugacuacucuugcauuuuggguccauuauuaaguuaaagaaggauuguuacuugaacauaagcacugugguacccaacaguugaucugauaaucaagauggcuacuaagugacuaacugguagguaguguauguauacaguuacagcauggauaagcuggacaaagggaugaaucacauccuaggugggauggagugggacagcaugagauuucaucacacuacucagacuagugagcauuaaaaaaaaauaaaauaaaaaaacuuauuuauuacuggaauuuuccuuuuaauauuuuuggacccugguuuaccuugcauaacuaaaaccauggaaaaugaaacuacggaucagcguguacuacuguacuguuuucaaagccaugaggagggagaagaaagauuacuacagccugucuucuagauauuuggagaaggacaaguguuuacuacuagguggauacacuuauacauaguuguauuucugggugaagagacucuccuuuccccuagcauucuaguagccaccuggaauaauggucuguuggaucuccacgcccucuugacuggcccaggcauugccauuuucuguucuuugccacugguagaauacaaagagagagggaccaaacgucuagcuguuccugcuacaguacccaaaccaguggcccuucccaugcuuccugcucccuuuaucuguagucugugaucuuggagcacguuggauggaagucgcuuccauccuuuguuguauuucucucuugugcugucuuuugugggugcuggggggugguuagaacuuucuucuucaaucugaucucuucugucuucagagauuccuucuaauuugcgauuuauugagagggccuucuaguuuuccagugacaauaugauuuaaaaaauuuuaaacucuggccgggcacgguggcucacgccuguaaucccaacacuuugggaggcugagguggguggaucacgaggucaggagaucgagaccauccugguuaacacggugaaaccccgucucuacuaaaaauauaaaaaauuagccaggcaugguggcgggcgccuguagucccagcuacucaggaggcugaggcaggagaauggugugaacccgggagacggagcuugcagugagccgagauugcgccacugcacuccagccugggugauagagcgagauucugucucaaaaaaaaaaaaaaauuuuuuuuaacucuauauaugcauauauguauguguuuauacauacacauacauacaugugugcacacacacauauaaguaaagugauauaaggcuguugggaggguggcuggaucauugacuuaguuuaucaucuugguccagugucuaggaaguaauuuuguauuaucuugauuuuuuucccccuuuuagauuacaggagcuuauuaaucauaagaaggcugaggacacagagaagaaagaugagcccagcaaauauaaucagcaacaggcccuaauugaccagagauacuuucagguauugaauugauuuuucaugacaaaaagacugauguuugucaugaaucuugguuaucaguugugguguaauaaauuaucaguugguaaggaauacuugcaccucauauuuauguguacuuauucugucuugucuuuccgugacauaacuauuugacuaaaaacauuguagaauucgucuuacuacuuaaaagagacucuggccuaguucaaaggagguuaguaaagagcuuuaugauuuuuaaaaguuucuauaauccuuuucccuacuuuccccauguaagccauuuucccucguauuguuucuguuguuaccauuauuauuaaguaaaucuauuuucuuaggguccuuguauggcuuuuguuuuuguuuagagaccuuaguucaucugaaauuuaauuuucuauauggugugauauagggaaucucaccuuccuaguuuuauagaucauuuauugaauagcugagcaguuaaaccugguaguuuagugacugaacuggacuuucacucacauuuuauuggguacacauaagauuuuuaaguuuuagauuauucauuuuuuuaaaaauuaagauauuuuauuuuuucuaggcugcuauuucuaacuucuccuaaaaagucagaagaucuggcaacaaauuccugcaugguuauuaucacagcagaauuaggccuuucccuugucagauaugagcauguguucuauaguuagcagucccuauucauccuuacgucacucauuuauacucguaccugaauucucugggcauuuguguuugcagucucuaauacgcuacuuuuuucucuacuuuauugaaauaacauuuuaucauagaucauauucauuuauaugcacagauuuguuuuuagauucucuagucuguugcauuucucaacuauuuccauauuuuaauuucuauaguuaaaaguuuuaauagccuuugaggcaaguauccuaucauuaaaaaaauuuuuuuuauuggcuauauuuuuagcacauuuauucuucuggaugaacaguuuuucaaauuaaaaaauaaaucucauugagaugaacuaaaauugaauugacuuuauagauuaauauuuggagaaaugacaccuuaaccuuuuugaaucaucacauucagaaauauguacuuucaucagggucaucuuuuauagucuucaauaaaguguuguguauuuuuaaauuuagcucuugcauauuucuuguuaggaaauaccuuguuauuuccuagguauuuuauaacuuuuauugcuauuguaaaugggaaccaagcaccuuucugaaaacuguuuuguuuuagacuuucuuguaccaguauauaacuggauuucauuuuguuucugagacucaauuugagaggcuuuguccuuuaaaaggggaauucaagccggguaugguggcucaugccuguaaucuuaacacuuugggugaccgaggcaggaggauugcuagagggcaggaguuugagaccagccugggcaauauagugagaccacaucucuagaaaaaaaaaaauuuaauuagcugggcaugguggcuugugccuguaguccuagcacuugagagguugacaugggaagaucacuugagcccaggaauucaacgcugcagugagcuccguucacaccacugcacuccaucuuaggcugcagagugagacucugucaaauaaauauauaaaacaaauauacauacaucaauuugaagugaaauauugaauuauacuaauuuggacuuaaaaagcuucuaaauaaacaucugaaguaauaaacaucuuaagucauauuaccaggaggccuauuaguuauaucuugaaguaugaccagggacaaagauucaagagcaaaaugcuaucuuuauauugugaaacuuuuuauuaaauaggcugaacuugauggugguaauaggaaauggcuuuauucuucucucuuuaaacaugcuuuuugaggucucccuuuuuuuccucggaugauauguaagguagaacccaucacuuauggggagaggguuauagucaaauaguauacuaucuuaauauauuaagauaccuaaaauucaauccaggcaucaaugauauuauuuuuggagacagggucuugcucuguugcccaggcugaagugcauuaucauagcucacugcagccuugaauuccugggcucaagugauccuccugccucaaccucccaaagugcugggauuacaggcaugagccaccacacucagccuggggauugcuguuaauuuccuuaaauagucugauaauguucuugugaguuuguaggagaauaugccuacuuuuaaaagaugcaugcuuuauuauuugagggugaagaguuucuucaaaugguucaccuaaaaauauagauagugagcaaauauggcaaaauacuaacaauuuuugaaccuagguaguguuuguaauaguuaauuuuguuucaacuuuacugcggcauaggaugcccgauauuugguuaaacauuauucuggaugugucugggaaggugcuucuggaugagauugacauccgaaucaguagacuuuaguaaaucagacugccuuuccuaauggggugggccucauccaaugauucaaagcccugaguagaacaaaaggcugaauaagagggagcuccuccucccugacugcuuucaagaugggacacugguuuuuuucuugccuucagacucaaacugaaacauuagcacuugcaggggucucagucugccugcauuuggacugcaaauacccauuaccuuuucugggucuucgcuuacucacugcagaucuugggacuugucagucuucauaauugcaugagccaauuccuuaugauaauuuucuuuguauauuuaaugaaauauguguauauaauauauauagacauaaagcacuccuuuaaaauauauaacuuuguaggcauaggauaaauauuuugacuauauacacuauguuuuuuuaaaggugcuguguagcaucaauucaauuauccacaauccaagagcuccaguaauaauuuauaaacagaccaaagggggaguccaaaauuuuaauaaagaucuuguucaagauuguggauuugagcaucuuguuccuguaauagaaaugugggcagaucaacugacauccuuaaagguaagggguugacuaugauuauaugcuuugaacaucuauuggacucuaugugcuuuauuaauaggacuuaauucagggcuaaaaauuaaauaggguuuaauuuuuuuguuuguguguuaacucuaaagcuaaaaaagcuuauuaucuaaaaccgaaaucuuccuacuuacauaucuauuuuagguacugucuauuugauguugucauuacuguaagcuuuaccuccucuaagauucuaccaaacaagaaauuuugggguuaguuuccuuauugaaaaucuauaguggauccacuuuguacuucuaggcccuucccuguucuaccuucaucugccuccuuuucauaucuccaugcugcgauuuuccuggcccuuaucccucuucagauauaaugucuuauccuucauuuuauuauaauuggggauauuuucucucucuucacacuuuauuuucugucucucagaacugagcuuaucuccauuucugcuuauucucuagaacagauaguaagcuagcagccaacgcuacccuucccuauccuaucucuucauggaagaccacauuuuauuuauagaguuauuguguauuuauugcauagcuucagguuuuuucaguuuuuguuaacuaguuugcugaaagguaaauaguugaaaucaguaguauuuaacuucuuugcccuuuacacuuuagauuuauuaguaacuaauauaauacauagcauaugccuguuaaugaaaaugugauucaauaacaguguuugcaacauaagucuuauuacaugaaguacaaaugaugcagaagauaucuguuaagaauguauaagcuccaugaagacaguguuuuuauuuguucugauauguccccaagauccuccugaugaaugagugcucaauuaauauuuguuaaaaggaaugaagcagaauauuauauuccaagacaacaaaauuggggguggugauguuaauuuuuuuuaaauuucgacuucccuuuuuauauagggcucagacagagcuauacaauacauaaacauuuugauugagugacagugcuagauuaauauacuuacuuuauagaccggaguuccuccagucuguaucucagaagaguguaaaauaauuaguaauaguguaaaucaugguauuuccucaaucacugccugucagaggguucucccaguaggaggaaacagugcugacuccaccuuucuucaucucagaagggauggacuagaaaaagcccuagccuuccuagaagaaaagacuagaagaggaagaagacaaagggaagaaucacacuaauggauaguuauugaucguuuaucaugcuaagccauuaugggaugaacacaagauucagacuaauuagacaaaauauacuaaaaaauaugaaacaaaauguaaucauuuauaucguuaaaggaaaugagugacauaaaaauagauuaccgguugaaguucugagugaaugaugcagauaacuugugcucuagagucuggaggagaaagagaacacucugauuguagcccccaagaagggcuuugccaugguggugaguucuugcuauuguaugguuuucugaggaggaggaggaggcaaggaauucgcuuuauaauuagaauauucugaggacacccaagaagaaauuauuaagaauuaguuacuucugccauuggaguaacucauggauuuugagcagugcuucagauauuaauacuacaguuucaggguccaaauuaagaaacuacaugagauucucugaggccucauaucaaagguuauuugauauguagcaaccucuaaguuugggacaaccaucuucccagauuaguuuuuucccucagguuaaauuuggcuuuaaagaguaagauagguuugagggaugaauggauaagcaaaaugugguauauacauauauugcaauauuauucagccauuaaaaggaaagaaauucugacccuugcaacaugggugaacauuaugaggacauuaugcuaagugaaauaagucagucacaagaagauuccacuuauaugauuccacuuguaugagauacuuagugaaaaucauagagacaaaguagaguggugauggcuagagggaggagggaaaugggaaguuauuguuuaauggguauaaaguuucaguguuacaagaugaaaagaauuauggagauggauggugauguugguugcacaacauuaugaacauauuaacacugaacuuacauuuaaaaauuguuaagauggugaauuuuauggguauuuuacuaguuuuaaaaauuggaagaaaagaaggcugggaaagacauggagccagcugccuccagccuugugucuuuucccuccugccuuuccaagaaaggugaacuacagauguuguagcuuuccccaacccaguacacucuugaauacuuuugcuuugcuauucuccagugcuucagaggccagacguacacgguaggcuggcucaugguaguacuucuacaucuccacaacugggcaauguaaagaaccuaggagacccucuuauauuuuucagagcuuacuugauggacugugcuacaaccauccugucacugcuuaggagaccagaacaucuuuucuucuuagcuuuguaauacucuuuuauucugaagcaaaaauguauuagauuggguaugcuuuuuaccauagauuacuuuauaaaugugccuuguuccuggagcauugguuaauaaagguaucauuaugcuguuacuugcugacuuuuuuuuuuuucaaauucuaguggcauugauuguaaaacauucauuugacauggaauuuauugcuaugaauuacuaaaauaguaacugccuuccuaccaauugaaagguuaaagauaccaauaugugaagucugagccuuaaguggagagugucaagugaaguacuaaaauaaguuagaaaaaggaggaacuucuuguacuucuuucuguucucuagagcugugcugucuaguaugguagccucuagcugcaugugguuauugaucacuugaaagguggcuaguccuaauucagauguguuauaaguguaaaauauacacuggauuuagaagacuuuguaugggaaaaauuaaaauaauugauuuuauauugaaaugauaauauuuuggauauauuggguuaaauaaaauauacuaguacaguuaauaucacauguuucuuuucacuuuccauacuauggcccuagacaacuuaaaauuacuguggcucacauuacauuucuuuuggacagcguuguucuaaaggaccaagcgcugugccauacacauauggauugaguaucccuuauccacagugcuugggccuagaaguauuuugauuaagaauuuuuucagauuuuggaguauuugcagaauauaugccauuugagcaucacugauccaaaaauccgaaauucagaaugcuccaaugagcauuucuuuugaguguccuguuguugcucagaguuucagauuuuggagcauuucagauuuucggacuaggaauucuaaauauuugucgauugaucagucuagagcucuaaacuuucaguagccuugcccauugugcacaguuuaaaaucaauuagggcaccacaacuaggccaagaaaacuaaguggaguauuauaauguagaauacauuuagggaaccuuucacauuaaaaacuugccuggagauacauguuauaacauggauaaaucuuaaaaacauuaugcuaagugagagacgucauucauaaaagacuacuuauuguauaauucccuuuaugcaaaaugccuagaauaggcaaauccauagaaacagaaaauaguuuagagauuaacccuaggagcugcagggaagggaaaauggggaaggaaggacucuuagugggucugagauuucuuuuuggaguaaugaauauguucugaaauuggauagugcugauguuuguacaugugugaaaauauuaaaacuacugaauuguauacuuaggguaaauuuuaugguauaugaauuacaucucaauaaagcuguuauauaacauauucaaaaccaaaauucaagggcaaguuuauucuuuguguaucaacaauucaaaauaaugaaauauuauggaacaauaauaaauaacauaaaauuacuuagagcacucagauucagaauaaucaauauauaauguuuucuguaaagccuguguuuaccuggagaaaccuaauuuuaacugacuuguucuaaauugguaguaguauuuuuauuuaaaaaaaaugaugguuacauauauauuuuuuuaaccuguguaauuauguuuuauuaauuuuauaaaacauauaauauauaaaacuuauaauuuuacuaauuauguucuauuauguuacuauagaaauuauuuaaaucaauaauaccauauaguuucuuuuguuauaaaggauuuguauaaguccuugaaaacacuaucugcagaacugguaccuuggcuuaauuugaagaagcaggaugaaaaugaagguaucaaaguugaagauuuguuguuuauaguagauacuaugcuggaagaaguugaaaauaaggaaaagguaauaccuacaugaacggucaccuucuaauguuucuuaucucaaaaacugauaaauuguggauauugauauuuguucuacuagaguucuauuugucuuuuaaaaguuuuuauuugggauuauuuuaagauaaugaacucuuucuuuuuuaccucuuuuuuggacaggacagcaauaugccacacuuucaaacuuugcaagcuauuguuucucacuuccaaaaguuauuugaugugccuucuuuaaauggagucuauccccgaaugaaugaaguuuauacuaggcuuggagaaaugaacaaugcugugagaaaccuccaagaacucuuagaauuaggugaugaccuaauuugucauuuugggcccccauuuaagaauuuuuaauaaauuaacaaaaaguagauuaaaaaauguuuaagugaaaaauugaggauaacugaagcauaaaauguuugauguauguaauuuuggaaauucucuguuaaaauauccuuuuauuucucuuuugcagauaguucauccucauugugugugcuaguaagcacuguuggaaaacucuguaggcugauuaaugaagaugugaaugagcagguuaugcagguauuaggaccugaagaccuccagagguauuuguuuuaaaaguuuacaaaguaucauccagaauggcugggugugguggcacacgccuguagucccagcuacuugggaggcugaugugggaggaucacuugaacccaggaguuuaaguccagucugagcaaggcagugagacccugucucuaaacaauaaaaauuaaaauaaguauuaucgagaguuccuggaggggugaaauuaaagacuuucaaaacuuauuuaccuucccuguuuggaauagcaucuuuugugugugugugugacuguaagcacacgccaccacgcccagcuaauuuguguguguguguguguguguguagagagagagauagagacaagguugcaccauguugcccagaccagucucaaauuccugggcucaagugauccgccugccuuggccucccaaagugcugggauuacaggugugagcuaccaugcccagccuuggaauagcaucuuuuaaguaacuugacaaucuaagauaaucucaaacccuuagggauggaggaaaugccaaauauuuucaagauaaaaauagauuguaaggccuauaaagaaggucagguacucuucagcauaagccuguuuucaggaaauauuauauauggagaaauucaaaccuuguuagcaacaucauguaaguucugauuauaucaauaaguucuauuuuuaggacacuaccauagaccacugaauaaucauuaauaguauauuuauuugauuagaagauaaauguugaggaguuuuuaaaagacuaggcaucuauaacauaaaagcugguauuuuuagaaaauaucaagacauuguagcuauaguuaaagcaacuuuccccacaccugacccccaauuuuauauuacagcauaugugaagggaaacacacaauauauaccacauaaaccauauguuuugcaaguuuuccuagaagaacccuuacauaaucugacacuuggugcuuuuaaaaggaacauauaucuugcuauuggccuauuucuuccuucccacaguuuuacugacuacugauuuuuuuucuuuuuuucuuuucuuuuuuuuuugagacagagucucacucuguugcccaggcuggagugcaguggcucagucucagcucacugcaaccuccgccucccagguucaagcaauucucaugccucagccuccugaguggcugggguuacaggcaugcgcuaccacacccagcuaauuuuuguacuuuaguagacgugggguuucaccauguuggccaggcuagucucgaacuccugaccucaagugauccuccugccuuggccuccaaagugcugggauuacaggcaugagccacugugcccagccugauauuuuuucuuaauguuuaauaggauacuggguguaaaagccaauuauuuuuagaaaaugcuguaaaagcaugaucuaagaagccuugagcuuaaugggaaauuugccauguuaagaauguuguauauuggcugggcgugguagcucacgccuguaaucccagcacuuugggaggccgaggugggcggaucacgaggucaggagauugagaccauccuggcuaacacggugaaaccccgucucuacuaaaaauacaaaaaauuagucgggcguaguggcaggcacuacaggaggcuacucgagaggcugaggcaggagaauggcgugaacccgggaggcggagcuugcagugagccgagacagcgccacugcacuccagucugggugacagagcaagacucugucucaaaaaaaaaaaaaaaaagaauguuauauaugaauuuaacaaauuuuacauugauauugaaaugcuuuuuuaagaaaagugauauuggauuaacaaaaagcucagaaagaaaagacuguaguaaaugaucauuaaguuuauauuuaaauuagcaauauaguuucuauuuugaaaauguucuguuugcaaucagaugcaagaacccaaaguuagaaaucagguuuaaauugugcauuuuuuaaacagcauuaucuacaaauuggaagaacacgaggaauuuuucccagcauuucaggcauuuacuaaugaucuacuugaaaucuuagguaagaucucugguggugauggugaaauuuugagucuuaaaaugucagugcauuuaagaaaaggguguuccuuggucacuggauuaguauuuuuaccuagugguuggaaaccacuaacaguucuggaaacacauuccuuacaagcaguuagaguuuguuuggauuaguccauagaacagaaacacagacccuuaacagcaauaggaacuaccuuuguuggaggaccuuaucaugagagauggcaucauucuguccaugccuaguuuaacccuggcucugucauugucuaaugagaaauauucuuaggauuuaugaucuuagaagguccuuccucccuccuuuuuuuuucuuaagauaccaccuaucuacaaaauuuuuuaaauauacaaauaauauuuccucucugguuauaugaaguaacauaaagucauaaauaucuguggaaaggaaaagaugaaauauuacacuuauacugagggucagauugagggcuucauuaguaguagugucuccuaaaaggaaaaaauuugcuuaggacucauaaggcaaaauagagaccuuaucuaguuuaaauauaauuacauauggcuauaaaauuauuuaucuuacuauuaagaaugauuuuuaaaguuuuaaagugauguauucaccagugaauuuuuucuguauagcucauuugaaagauuuuuuuuuuuuuuuaaagaauggcucuuugcuuuuagaagaggagaugaagcuugguaugaaaauaagggaaugagucaaugaaaacuugauaagaagaauaagugaaagaaguaucuaauuagaauauauagccuacugaacauaaaggaaguuuugugaccagucuuaugugcaguggggaagcaagggagacaaugagugagcuugcuuuaggcuuguccucauguuuaaaaagaucacagcaagugaaaauguaauuugaaaguuaaacuugagaugagguaugaaacuguauaaguguguugucugauauccugaagagccugguuucauagaauaauaugauucuugcuuugggauugcuauuaacuuaagcagugauguucucaucauucauaaauauuuggcacauuaauaaacauauuuuaauagggugugcugguaacacuuauuucagaaugcuucuauagaaacuuccuuucagauauuaugacacucagcaugguucauaaagaucauuugcuucagaaagccagguuucucuggagaugaauucuguaauuuggucaaaguugaaguucugguguuaaacauuaacauugggaaaguuaaaucuggcaaacaugacaguuuuuuuaauuaauaggugucacuaagcauguaggugcaggguggcauacugaguaacagacauggagaguaccuuuagugaguaaaaaaacaauccauucuuuuucucauguaaauggugugauugacugaggaaauucccauaucggccaagguccuuugcugugagguucauuuguaaggcagguuucucacuuaaugagaaaacagguguaauuucagaaugggcagggggcggagucagggaauaccuugaucuuguaccuuaccacaauguaagggaauuguaaacaaauucucuguuguagguuugcuuauauuguuucuguucccauaucuugaugcuuuguuaguggguucagacaaguauucugacugaagucgggagcuuaaaagaacuaaaugaauaguaggagagcaugggcuauguguguaggcuaagugaagagcaaccaagauccagcuacacaauggagagaguuggaauccaagaaagcaugcuuuauguaagggaacgcguuuauuaaugauggcuuaacagaauaagcuagaaaaaaguguggguaucuagagaaccugccauuguggcuuaccuuaaguagggcugggaucuggauaaugagaaaaaggauuuugcuccuuugguggccaggagcuucagagagugaauucuaacuuaggcugguuggaauaagauagucuuaggaagaaaaaucaaauucagaaagagccugucaaaaaagagccuggauugguuuaucugguaagcuggaccaggcuaagcucuauaauauauuguacuugagguuuguacacucgaugaggcuaucuuuuugauuaggcagauaauuguuuuuuuugagacauagucuugcucucugucacccaggccagagugcagugacgcaaucucagcucacugcaaccucugccucugggguucaagcaauucuccugccucaacuucccaaguagcugggauuacaggugcccacuaccacacccagcuaauuuuuguauuuuuaguagagguggguuuucaccguguuggccaggcuggucuuaaacuccugaccucagaugaucuucccgucucggccucccaaagugcugggauuauaggcaugagccacugcacccagcuggcagauaccuuucaucuuagagugauccacuacuaagaaaucuucccaagaaaauuaaagaggacaagacuguucuaugagaagaaauuccuaaguccucacguggagaccuagggaggagacgccucuaccugggauuucaucauguagaugcacccguguagugauacagaucuaaugagacacuaacauaucacacaugugggcaguuggaucuguuaauaaggacaugcugcuaaugaaguuaauacuagaaucagaggguacuuguggguaugugguaacuuauauaaacagagccccugugaagcaucuguauccgaaucagugauaaucuaucaucacuaucggagaaaaacuucaugugcacaaaagcaccaguauuauugccuuuauguuugggguuugccuuugcauauagguucuuguuucaugugaguuuaccacuagaaaaaguuacucucuuuuauuauuacuguuuuuguauuacagaaauugaugacuuggaugccauuguaccugcaguaaagaaauuaaaaguacuuucauacugaaaacaaaucaaaucauuuuuacuguguaaauuguauucuuaacauuuuguauuuuguaggauugaucuuauuuugagacaaggguuguaaaauguauuugcucucagaauucauccccuucuuaguauuaggucauucuucaucuguauaauuuuuauuaacuuugagauucuuauacagaaaauaguugcaaggguaagguaauuaacuuuagaucccuucauuucuaaagcaauuauugagugcuuaaaauuuaagguuguuuuagaguggaguuugugaguaaaagaggagcccagggagacagauugcaaguaguagguugcaaucuuuuagauucagcuuguaauaaucuuugagccacaccaaaaggaaugccaagggcucucuaaauuuagccaguaggaagcuacugcucuccuggcaaggauuaauuggcacauucuguuaagauaucccucaugacaguugcccuuucaaagcaggaggaagaaaaggaagaaagaaaaacuguuucaucauuucuguuaggguaggaaaugaaucauaggguaaaauggaugaguagauagaagucucucauuuaaaaagugucuuuugcaaucuugauguaaugcacuuuuuauaaggacuugagaucucaaauaaaauuucuguaaagaauuuccaa

SEQ ID NO: 192092 - RNA, 18652 nt, Homo sapiens
aguguugcagaacagacgaggaagcucacugagaauuauccugagcuguguuaacaaacugacagaacacagaauuuuuacucaaaauggauugguuaaacgucuuuaaagauuuuuucaguaaguuaaucuguuuauuaaauccacuguuuucuugaaguugugaauuagauuuucugcuuuuguaaauuuaaaggaaaacucuuauuugguggguuuauguaagcuacuacauuauguguauguaauauaaaccaaaugauuggugauauauccaaaaauuguaguuucgacuugguaaguaaaauaauuuuaaaauguuuuagcaugaauguuuaacaaguagagaaaggauauaaaugguuugaguuugaugcaguucuaauucaguaauuuucaacuuagcacagacauuugaagugaauuaaauaaauuguaaacauuaaaaacauuagauaaaaaggauuaggugaacaaauuucuucauccucaacuuuggaauuaacuuuuuuuuuuuuaacuacuuuuugcuuacuuuuuuuuuagcggaacaguguaaagauaaucuuuaauaaaaacacuaguaaagagaauauuuuuauuuaauuaauguaguauugcuagaaauugauguuuugauuaaugugagauuugauauuuugauaugaguuaugagaacagcuauacaaccaagaggaaaauagugaauucuugacuguuauugaguuugggucaugaaguaaaacuaauaauaauuuauaagagccuaauucugcugauucugcuaguggccuccuuaugaucuuauagugaacuuaauuugaucuccuugaacauuugcuugguguuucuagaaaaaugaacagaggaauuauuauagaagucucuuaugcacaacaagccuaaggaaacaaagaguaaccugacaagagauuccagagaaaagggcaaaagagaaaaggaauaagcacuuuguugaaaaagaauguuguaauuguaaugugaagacucauuuguuagcuuuagugacucccucuggaauaugucucuucuguuuacuuuuuggggaguuacuaaaauuucagaucuuugcauuuuucauuuuuuggguaaguuuuaccuuugaagaacuuacuuauuugcucauucauuuguuuaucaacacauucuuauugagagccuacuccaagccaggcagaaaucauagggugaaaaacuaauacuaacucuagcaaaucuuacauucugguggagagguauaugaugauuguuauuaauaauacaguggauuucauaucuagauuuagucauaagugauguugaccauaaagcaaccagaaaugacauaaaaagaauccauuguggcuaggcguggcagcucaagccuguaaucucagcacuuugggaggccgaaguggguggaucacuugaggucaggaguuugagaccagccuggucaacauggugaaacacugucucuacuaaaaaugcaaacauuagcugggcgugguggcgggugccuguaaucccagcuacuugggaagcugaggcaggagaaucacuugaaaccagagguagaggcugcagugagccaagauugugccacugcaugccagccugggcaacagagcgagacuccaucucaaaaaaaaaaaaaaaaaaagaauccauuguaucauugauacagugauucaauauauaucaucaauacagugguaaaauuauucuuuuugcugagucuuaggaaguugauaguuaaugcauuugcagacugggagucaggauuugaaauuuguaaccaaaauguuucuuugcucaaucccugcagcaaccccaaauuuuuauuuauuuugccaggcaguuugucagaguagagacaggcuauucaucuacuuccuaccugaaugggcuuauaaaguagaagaaacagaguauuaugugcuuuuuguguggcagccagaguaucuuugaaaacaaaaauuguacaauguuuuaaauaaaacaauaaaaaauaauuuauuucauguagaugaagugaacagauggacauauaaaaauuuaaauaaaaaccuguaauggaaggaauaccauauauuuauaugugguauuucuuaguucuguucccagacauaucacuuacaagccauguggccugcaaaauauaacugaacuucucugauuuucuguuccuuguaaaagagagaguugggcaagacuaaaugauccuggaaagucccuucuaacucuaaaagucuuacauccugguaaacaacuaagcagucuuaggugugucauaggaauugagcgaaagcaaugagugagaaauugguuuugaagaaguagaaacaugggaacagaauuguaguugacuaaggaauuagaagaaacagaaaaacuuucuuuggccccauucucaacacuuacucagugauacaggugaaggaaaaacaacaugcuuaaacuaaagaauacugaaaucacuaauaaguacacuggguucagaaauauauuuggaaacuaaaaucaagauagaaauaaacaagaugaauaggaacagacaguauuguaaaacucuacauuaaaauuuuaaaaggaauuguauagauuggugagaaccuagccuggcagcagcuuacaugaguaaaaaacuuaguaagagcugcugugguaauguagguacuaaaacucucaacacaguccauggugacauugauucgagucugagaggugcuuagguggagguaugcucccuuauguguguguuggccaaauaaaacaugauguaauuaauccacuuuugauagauauucuuuaacaaugguauugagaaacuuggaugcuuccaaaugcuggcauccaguauaucaaggauuugcaaaccaggucacauaaggaauaguuauggguacaaagacuugccucagggagcacagcugucauaugaagaaggaauguucacagugcuuaaccagguucuuaagaauucuuguggaguuuauaaugcauuguucugguuaagaaacagugcuauaggaaaagagaaguaaagaccagugggugguagugagggaaagaucagaaauuaucuuuacacuuuuuuuuuuuaauuuaagcaaagcuaacaauaaaaaacugccucagaaugguacacuuccucagugcuuagaucugagcaguuuccuuccaacuacagccagguccagcuauauaaugcaagaauaaagauuuaaguaaucuuuuuuuuuuucuugagacagucuugcucugccacccaggcuggagugcacuggugccaucucagcucacugccacuucugucucucaaguucaaacgauucucgucccucagccucccaagcagcugggacuacaggugcaugccaccacaccuggcuaauuuuuuuuguauuuuuaguagagaugggguuuccccauguuggccaggcaugucucgaacuccuggccucaaguuaucugccugccucagccucccaaagugcugggauuacaugccugagccaccuugcccggccaaguuuaaguaauuuugaaaauuaaacaccauaagcacuagaagguaggaaaauaguaaccaccauugauggaguuccugcuauguacuguaagugcuuuacacauagacuucuaaaaauuuuuuacaagcauuuuaugaauuuauuuuuuuacacaccaccauuguacaaacaaggauacuggagguuuuuuuuuuuaacuuuuaggguuggggguacaugugaagguuuguuacauagguaaauacaugucauggggguuugcuguucauauuauuucuuucuuucuuuuuucugagaccaagucucacucuguugcccagguuggagugcaguggugugaucucggcucacugcaaccucugccuuccagguucaagugauucuccugccucagccucccgaguagcugggauuacaggugccugccaccacgccuggcuaauuuuuguguuuuuaguagagaugggguuucaccauguuggccaggcuggucucgaacucccaaccucaugugauccauccgccucagucucccaaagugcugggauuacaggugugcaccaccgcgccuguccuguuguacauauuauuucaucacccagguauuaagcccaguauccaaucauuaucuuuucuccuacucuccuuugcccacccuuccccuucaagggggaagcauuugguuuucuguuccuguguuagaaauaaaaaagauuaaauaacuugaccaagaucacacaaccaguagcggaacuaaaauuuaaacuuguaucuccuauuaaaguucucauaguagauauuuuauuacuaaagaguagagaauuggagucgguuaagcaauggguuagaaggguuugaugcaaaaaggacuagucaagguuaagaagauuguggugaacugugaggucaggaagugcuaugaccugaguguuugugucccccaaaacuccgcaugaucuuggcucacugcaaccuccgccuccuggguucaaaugauucucaugccacagccacccaaguagcuggaauuacaggugugcgccaccaugacuggcuaauuuuuguauuuuuaguacugacaggguuucgcauguuggccaggcuggucuugaacuccuggccucaggugaucugccugccucggccucccaaaaugcugggauuacagugugagcccccgugcugggccauucuuuuuuugacaauguguaauuagucuuagacauaauguuuuuaaauauaagcuuccagagagaaucauucuagguuuuacugaucuuuugcauuucuuuuaccauacaaaacugugcaaauucugaauuuucaaaaauaucauuugaaacuuagucuguauuuucagguuuaacuuuuuuuuuuuguaugugccucauaucauuauucacuuuuacucaauuugacauuuauugagaaucugcuaugugaaacagccacuguuggcuuuugagcagugaugucaugugauugcagcuuuauuuauaggaagaucagacugguugauauggaugaugggucgacugagggagaaacugaauuaauaaggaaacuaguuuaguggggucacgaaaccucugguacaacauaauaggccugaagaagagugaccauagugagaagggaaaguguuggcaauaaggagauaggauugugaggauuugauguaagacucuuaaaaauuuuuuuaugagguaaaauuuguauaacauaaaauuaaccauuuuaaaguauguaauucaguaguauugaguacauuaacaguguugugcagccaucacuucugauuccaaaauguuuccaucaccccaaaaauagucacucucaaucagucccuggcaauuacuaaucugcuuucugucucuauggauuuaccuauucuggauaauuuauauaaauggaaucauacaguaugugaccuuuugugucuggcuucuuucauuuaguauaauaucuucaaguuuuguccauguuguagcauauaucaguaauucaucccuuuuaugucuaaauaacuuuuuuuuuuuuuuuuuucugagacagagucucgcccugucacacaggcuggagugcagugacgugaucucagcucacugcaaccucugccucuuggguucaagugauucuccugccucagccucccaaguagcugggauuacaggcacaugccaccacgccuggcuaauuuguguauuuuuaguagagaugggguuucaccauguuggccaggcuggucacgaacuccuuaccucaagucaucugcccgccucggccucccaaagugcugggauuacagacgugagccacugugcccggcuggcugaauaacuauuauauguauauaucacauuuuguuuauccacucaucuguucauagauggacauuugaauuguuuccauauuuugguuauugugaacagcguugugauaaacauucauguacaguuauuguuugaauaucuauuuucaguuaaguguauaccuaaaaguggaauugcuggaucguaugguaauucuuugcuuuuugagaaaccaucuguuuuucacaugguggcaccauuuuacauuccaaccaguauuguaagggggauuccaguuucuccauauccuugccaacaccuauuuucuuucuuucuuugcuuauauccauuguaguuggugugagguagggucauugugguuuugauuuacauuucucuaaugacuaaugauauugaggaucuuuucaugugccuguuggccauucguauaccguaguuggaacaaucuuuauucaaguccuuugcccauuuuugaaguaguuguuuuuguuguuggguucuaagaguuguuuauauguucuggauacuagacccuuaucagaauuaugauuugcaaauauucucuucuaauucuguagguugucuuuucacuucuugauaguguguuauacacaaauguuuucaauuuuaaugaaguauaauggaucuuguuuuuuugguugcuuaugcuuuuagugucaguaucuaagaauccauugcuaaauccaaggucacagauauuugcuccuauguuuucuucuaagaguuuuauaguuuuagcucugacauuuggucauuucgaguuaauuuuuauauaugaugugaaguuggaguccaguuucauucuuuuguuuauagauauccauuuguuccaguacccuuuguugaagaaacuauucuuucuucccauugagugaucuuggcaccauugaugaaaaucaauugaccauagauccauggguuuauuuuaggacucucgauucuauuucauugcuguauaugucuguccuuauuccaauaccacacuguuuugauuacuguggcuuuguaguaaguuuugaaaucagaaagggagaguccucccacuugauuuuccuuuuucaagauuguuuugguugcuuaggguccaccuugcaguucugugugaauauuagaaucagccuuuucauuucuguggaaaaaacaaaaugguugaacuuuaguaagaauugcauugaaucuguggauuguuuuggauacuguugccaucuuacacagaauaucuuuccguuuauuuaagucuucuuuaauuucuuucagcgguguuuugcaguguuuaguauaugagucugauacuugguuaaaauuauuccuauguaucuuauucuucuuaaugcuguuauaaauggauuauuuucuuaauuuugucuuugaauuguucauuguuaacguauagaaauacaacugauuuuguguguugaucuugcagcuuugcugaauuuuuuuauucucacucugugugaguguguggguguguguguauucuuuaggauuuucuauuuauaagaucaugucaucuguggauacuuuuuccccucccuaauugcuuugacuagcacuuccaauacaauguuaaauaaaagugguggaaggagagcauccuuguucuugucuuguuccuguucuuacgguggaaaacuuugucuuucaccauugagugugaugucagcuccacaguuuuuugcagaugcccuuuauuauauugaggaaauucccuucuaauccuaguuugcugagcauuguuaucaugaaacgguuuuggauuuuguccaauacuuuuucugcaucaauugagauagucauuuguuuuuuccccuuuguuuuacuaauaugaggugucuuauauugauuuucauauguugaaccacccuugcauaaaucccacuuacucauauacaguccuuuuaauaugcuugcuggauuugguuuuccuaguacaaaugauccuuauuuuucacagauucuguauuugugaauucacuuauuggcuaaaauuuauuuauaagcccaaaguugauaauugcaguguuuuguggacaugugcaguguggcaaaaaugugagucaucugaugugcacauucccaguugaggcaauguucuuccuucuuauuucagcuuucauacuauaaaccaguguccuuugugcagucuauuuaguaccacauuuuuugcauuuuugugcuuguugaugauuuugcuguuuaaaauggcccccaagcauagugaugaaguguugccuagaguucauaaacacaagaaagcugugaauuugcuuauggaaaaaauguguguuagauaagcuucauuuaggcaugaguuauagugauguugugaauucuauguuaaucacaauuuauauuaaagugucuuuaaagagaaacacacauaaaacaggguuguguagugauugguuaacaaaaacaugauuggagccuaacccuguuuuucccuuaggagcugugguucaguauuugcuaauucaguauuuaugguaacuuuauagaacauaacuacugcaaacaaugaaaaucaacugaauuuuguugaggauuuuugcaucuauauuucuaagugauauuagccaguugucuugugauagcuuugguauucuggguaauauuggccucauagaaugaguuaauaaguauucucuccuuuuuucuuuuuagagauguuuuagaagcauugauguuaauuccucuuuaaacguuuaguaaaauccaccagugaaaccaucugguccagagcacauuuuugaugcgagauguuuuguuacugauugaaucuuuuacuuguuauaugucuguucagauuuucuauuuuuuccugagucagcuuugguaguuuguguguuucuuggaauugauguuuuucuucuagguuuuuuaauuuauuggcauacaguuguucauaguauuuguuuauaauccuuuuuaaaauaucuguaaggucuguagaaauguuauuucugauuuuauuuauuugagugucucucuuguuggucuagcuaaagaguuuucaauuuuacugauauuuucaaauaaccacauuuugguuuuguugauuuccucuguuuuucuguucucuuuuguguauaucucugcucugauuuuuauuauuuccuucuuuuugcuuugaguuuaguuuuucuuuuccaguuccuuaagauuaaauuuaaguugguaauucgagaucuuucuucuuuuuuaugcaagcuuuuagggcuauaaauuucccucugagcauugccuuugcugccucccauagguuuuuguauguuguguuuucauuuucauuugucucacaguagugucuaaucuugugaaauuucuuggugaccuauugguuuaagagaguguuaguugccacacacuuguuaauuuuccaguuuuccuuucuguuauugauuucuagguucauuccauuguggucagaaaagauacuuuguaugacuucaaucucaaauuuauugaggccuuuuuuuuuuuuuuuuuuuuuuuaaaauagagacagggucucucuuuguuaccuaggcuggagugcaguagcaugaucauggcucacuguagccuuugaacuccuggguucaagcaauccucccaacucagccuccugaguagcuggaacuacaggaaugcaccaccacaccuggcuaauuauuuuauuuuacuuuuuauuuuuguagagacaaggucucaccaucuugcccaggcugccgucagacuccugggcucaagugaucccccgaccuuggacucccaaaguguuggaauuacaggcuugagccacugugccuggccuauugagccuuguuuuguguccuaauauauggucuaucuugcagaauauuccauguauacuugagaaaaaugugugauauauucugcuuuuguuugaugggauauucucuauaugucuauuaggucuaguugguuuauaguacugcucaaggccucuauuuccuuaaugauuuuucauuuaguucugucccuuacagaaagugggguauugaugucuccaaguauauugaacuauuuuucucccucaauucugucauuuuuugcuuuauaugccuugaggcucucuuguuagguaugcauauauuuguaacuguuacacuucuugauggacugauucuuuuaucaauauaugcuguccuuugucuuuaagucuguguugugugauauauauuuauuuauuuuuagacagucucgcucuguugcccaggcuggagugcaguggcgugaccucggcucacugcaaccuccgccucccagguucaagcgauucuucugucucagccuccugaguagcugggauuacaggcaccugacaucaugccuaacuaauuuuuguauuuuugguagagacggaguuucaccauguuggccaggcuagucuugaacuccugagcucaagugauccacccgccucggcuuccuaaagugcagggauuacaggcaugagacaccgcgccgggccuaugcugugugauauuuauauagccaccccacucucucaguuauccuuuacaugggauaucuucuuccauccuuucauuuucaaaccuauuugcaucuuuguuuggaucuaaagugagugucuugcagauaacaguugcaucauguuauuuuuaaucuauuuacauuuaaaguuauaucugauaaggaaggauuucugcuauuuugcuguuuucauuuacuuuuuuuucuuucaauucuucuauuacugucuucuuuugugauuucuuuuucuuuuuuuuuuuuuuuuuuggagggugggggucagggucucacucugucacccaggcuggagugcagugguggaaucucugcucacugcaaccucugccucccagguucaagcgacacuuauaugucagccucucgaguagcugggacuacaggugcaugccacgaugccuggcuaauuuuuugguauuuuuuugguagagacgaggucucagcauguuggccaggcugaucuugaacuucugaccucaagugauccgcccaccuuggccucccaaagugcugggauuacaggugugagccucugugacuggacuauuuucucuaauauauuguuuuauuacccuucuuguuucucuuucuguauuuuuguuuuuccuuagugguuacccuggggauuaacaucuuagguuuuuaacaaucauguuugaauuaauaccaacuuaguuucaguacuaugcauaacucugcuccuuugcagcuccaucuuuguauauuacaucuuuacacauuaaaauauaugcccauuaaccuagaauugaaauuuuuguuuuaugcauuuguauuuuaaauuguguaggaaagaaaaggagaauuuacaaaaaaaaacugcaauacuacugacuuuuauauuuacuuauguagcuaccuuuaccauuguucuuuauuucuucauaugacuucaaauuacuguccaguguuuuuucauuuuagccuggaggauucucuuuagcacuucuuuuuugagacagucuugcucugucucccaggcuggaguacaguggugcggucuuggcucacuacaaccuccaccucccggguucaagcaauucuccugccucagcuucccgaguagcugggacuacaagcgugugccaccacgcccggcuaauuuuuuguauuuuuaguagagacgggguuucaccauguuggccaggcugguuucgaucuccugaccucgugauccacccaccgcugucucccaaagugcugggauuacaggugugagccccugugcccagccucucuuuagcauuucuuagcacaggucugguagugaugaauuccuuuaguuuuuguuuaucugggaaugucuuauguucuccuucauuuuugaaggacaguuuugcuaaauauagaauucuuuguuggcucuuuugcuuucagcaucagaucagauucuauccccuccccagggcuuauuacugcugcuuauugugagugguuguuguuugcuuguuuagugacuuuacuaaacuacuuuuauaagcucuauauuccuggucauguggggccgcugaagucuauuccauuugcuuaguaaucagcuaggguuuuaacagaguuucguuaaacaccuggagccaaaagaaaaaacaaacaaacaaaagaaaaccucuccccaucuuuacagauggcuuuauguuggggcaguuuuugaccacuuagugaugccauuuauaauucugccuuagccuuugcuuacuguuugcucaaagccugaagaucagccagggugaaagcuuagggucuucuugggccuuuccugaaugugcauccagcccuggccaugugcacguccuucuugauugguauacacaccccuuauuaccccauguauauucuuucccauccccuuucuguccaggcuuuuccaucugucuguuccuugucccaguuguugucccuugccccaggcugcugcauccauuaaaugauuuuugcaaaaaccacccaggaagacucccuaugccugggaaugauucaagucaggcaaagccaaggcaagccauugcucagguccuucagggagcugccagacaaguugaaacccacaaucacaauuguuuaagaaugagaucuguauugcuuccucuggcauuaggagugcagguuacuguccacacagccaucacugacuuggggugugggggauggugggcaggcaacuuaggaugcgauagcacucucuuuaccacaaagcagcaacuucuuucuuuaccaagccuugcccuagauuuuauaaguuuuuuuuuuuuacuagauuccagaguucugcaaaaguugagucugacaguauuuaccagcucauuaauugcauucauugcuuuuugcagggacagugccuuggaguuccuuacucuacuauuuuuggugguaucaccccaaauguagggauuucucugaaggcuaucauuaaccggaaguaagaaaauuaggaaggaagaaguugauuuagggguauagacuggauuauuuuuauuuggacaugaguguuggguuugagguacugauggcacaaucugugggugucuagugacaguuggaauuguaaugccugaauuccagaaaggucuuagagcugcaaagagaucugggaaccuucugcacagaaauuauagaaaaugaaaguguaugauuuccuuggaauagagaggaaggucaaguaugucaucuugugaaacacuuucagcuaaggaauucuucauuuauucauucagcauguuugcugacugcugaauacauaauuuuguuuuuccuuuguuccuacuacugauguauguacugcuaagcguuggagacagaaacgaauaagaucucguuuucugcccucaggaaguucacucauauugaggaagacagacaaguaaacaaguacaaugcaguguuauaauaacaagguuagaggagccuagacagagguaaacaagaauauguaaacagguugggagggaaaauaagaaauucggggaagucaaagaagaagaaaacauaauggagagagugggcugugaucuugguugcugcauauagaguuugagaaggcugaggacuuuaaaaguuacugauuugacaguaaggagagaugacauaagaaugguauucauaagaaugguuuuaauugaguaguuuuguuagaauguuggagacaaaggaucagauaauaaagaguugggagugugaguggugaaaaagucgagggaaaaggaaaaacaaccuuuuuuuuuuuuuuuuuuuuuuuuugagacagagucuugcccugucgccaggcuggaguauagugacgugaucuuggcucacugcaaccuccgccugccagguucaaacgauucuccugccucagccuccugaguagcugggacuacaggugcacaccacugcacccagcuaauuuuuguauuuuuaguagagacgggguuucaccauguuuggccaggauggucucgaucucuugagcuugugaucugcccgccucagccucccagaaugcugggauuacuggcaugagccaccgugcccagccgggaaagacaacuuuuaaaagagugguauaguuuauucuauaggaaaauuggaccaguuagagaaaaaauaaauaaauuaccaaaauguuacgguuuaaaaguuguagcagaguuaaaguaacuucauuuuggaguagaaaagauaugaguguguuuuuagacaauugaagggacuaaauaggaaggaaaacaaggaugucgagagucccaagagagucaggaaagauaguauuaagauccuagaaggaucaggauuuggagacuugagugaagaacgagagugaggauaaugagaguuuugagacaaaaggaauuugagaaguuuuaccuagggaagccucaguuuucuagguaaaguagagcauaaaaucacacgcuaagaaaugggcagcagugaaaaugccugacugaaguugauguagcguacauuuguauugauaguaccauuuggugauuuucucauuucuuucaacacauauguguuaagcauuuacuguguacuaagcacuauacaagauccuugggauucuaucuguaaacaaacaaaacucccuguccuuuuggagguuacauaugacugggguaaggggagaaaaacaaauaauauuuuaaaauaaacauaugagguaaauagagcuaccugggucugggaaccaagaaagcaaaugggaagauuagccagacauaacugcaauuuuauauugcauaucauauucugauuuaagauagaaauaauuuuauuuuuauacagcucauuguagaaucuagcuugcuuaaacuaagacaagaagaguaugggugugguggagccuuuguguacuuagauuguagcuaugaaagaaaucuauauuuacauuuaagagggaauucauuaauuuaggacaacuuuauaauuauguuauauaguuauuucagggccuuugacaagagaaaagauggugaacugucauauaauaacaaauuaaauauuuauuugguuaagaaaaagaaaauuugcaucuuauuuccaaaaagaugauuuuuaacuacauagaaauuuguuauauuuaaaagcuuuaaagaucuauauagaguugaagaucucuuuuuaauaaugaauaaguucauucuuuugguaaucauuuuuuuauauucuccucucauggcccuuuuuaauuucaacaggcauuggaaaagugaaaagaaaaccuagugugccagauucugcaucuccugcugaugauaguuuuguugacccaggggaacgucucuaugaccucaacaugcccgcuuaugugaaauuuaacuacauggcugagagagaggaugaauuaucauugauaaaggggacaaaggugaucgucauggagaaaugcagugaugggugguggcgugguagcuacaauggacaaguuggaugguucccuucaaacuauguaacugaagaaggugacaguccuuugggugaccauguggguucucugucagagaaauuagcagcagucgucaauaaccuaaauacugggcaaguguugcaugugguacaggcucuuuacccauucagcucaucuaaugaugaagaacuuaauuucgagaaaggagauguaauggauguuauugaaaaaccugaaaaugacccagagugguggaaaugcaggaagaucaaugguaugguuggucuaguaccaaaaaacuauguuaccguuaugcagaauaauccauuaacuucagguuuggaaccaucaccuccacagugugauuacauuaggccuucacucacuggaaaguuugcuggcaauccuugguauuauggcaaagucaccaggcaucaagcagaaauggcauuaaaugaaagaggacaugaaggggauuuccucauucgugauagugaaucuucgguaaguugauuuucggagguaaauacaaauagagcucuggguauuuuaaaaaaaagagagagagaaauggagagguuaaguggcuucccuaaaguuaaccagguaacaagcugggacguaacauaagcauaaauguuccaaagcuaaaguccgcauucuuucuagcuaucuauuuugaauaaaagagagcuguggcaguguugcuacacacugaauuauuucgucuugucuaguucuguugauuuugcauuccugauauauuuucuguuucuguugcauuaaacuaaauggagaaaauggaacacuggccucuucauugagaguagaauaauacuauagauuaaacugggaaacauuuaaaaaauugcuauuggaugcaauguguaagaagguagucacuguaguccuuaugacauaggaaaucccugaauuuaaaaaauugauauuaaguuucuucauaaauugguuacuuggaaauuggaaugcacuuuuauuauaaccucaaaaaaccuauuuuagcaguguuugaaaugcauuugcaauaaaagauaaauuauauugcaauacuaguaaacaauaaaacuauaaaaccauaaaaguugaaaaauaauaugguuucauggucucuuuuagauacugcuuaggauauuagaauuugaugacacucauuuuccuuaaaaauggccuuucuuuuuccuugaugaaagauaucacuacuuuuccauuuauuaaaucaugguuaaucuuggcuuugcgugaguauauuuguacaaaagggaauguguaauugcacaaaauuuugaaagaaaauguguggaaguggggugugguggggagagagauuaauugaacuuccugaugugaaguucaggaaaauggggccugugccuaaucccucagaaaagcaguugguuggcaguagggaagagugaugacauccauuuucuguuaguugccugaucuggcucacuguuugaaacuuugggaguaacuguagaaaaagaggcuuuggggguugauauagacuguaacaacaacaacaaaacuaauuaaaaagaagauagcuugaaugcagaauuguauguauuuucuuguggguaauugaguguagauauuagacaaaaugcaauauauaccauuauuuuuagcaguauacuuuuuaagguuagaggucucaaguaggcauauuuuguuuagccuucacaguguuuuuuaaacauuuaaauucauugccgauauuuaaauauuaggauauuuauuauaaaaauucagacuuuagaccauuuaaaauuggaagaacuaccaacauugagacccgguuccugcaaggcaacaaucacagcugagaagucaccacuuguuuagauuggugauacacugucauuuccucugcccaucuaccuuuccacucugacacuuauuuacauuauucuuuuggcucuuguaggcauuugaguuuguagccucuccuuaaaguuuagauuaauucucauuuguguauucuucauuuuugggaauucagcauguuaucucuaagacagcuacuguuagcuacacauugaaaagggguuggguggguaucuuagacuuucucauguguuucucugacuggagagaagauagcucuuguucuucaaauauuuaacuaaaggauuugcugugggugucugcuguuggagccguggguguuaagagacuuuugauuaugcagguuugaauccuggcucuguuguuaacuagauggaugauauuggccaaguuauuaauagcuucuuugagacucaguuuucacauguguaaaaaggguuuguuuugaagaguaaaggagauaaucuauguaaauaauuuaccauggugccuaggacuuaguaagugcuuagauuuuagcuuuuaguuuaauauaaaaauacugauagagggcuuucaaaauguuuacuauauguaucuuuuuuuucucuuuuagccaaaugauuucucaguaucacuaaaagcacaagggaaaaacaagcauuuuaaaguccaacuaaaagagacugucuacugcauugggcagcguaaauucagcaccauggaagaacuuguagaacauuacaaaaaggcaccaauuuuuacaagugaacaaggagaaaaauuauaucuugucaagcauuuaucaugauacugcugaccagaagugacugcuguguagcuguaauuugucauguaauugaagacugagaaaauguuggguccagucgugcuugauuggaaauuguuguuucuaaaucuauaugagaauugacaauaaguauuuuuauuauaacucagcccauacauauauacuauguaugcagugcaucugcauagaacaguuccuuauccuuggccuucuguuuuauuguuuuuuucuuugcuguuuucccuuugcuucuaauauuacaguuuuguauuuuguaaacaaaaaucaaauaaugcauaucagaaucuuuauauggaagaaauccuuuauugccuuuccuuuguuuccuuguaaaggcacccuguucuguuaugguuuuucauuauauaaaauuauuauaucuauauaugacauaugcuaaaauuucuuggagaguguuaaucuuuucugugacuaaauagcaauaauaaguggaaaauuagaaauuauuuccagguauuauauuugucacaggccauuguaaauaccaaguauauugugucugccauaauuuuuaaaaauacauucauugucuucagucauacagcaagacacaugagacauagauuagaaaacauguuguacaauuuuaauuuacaacuguuggaaauaaaaaucacuuaauuuuuuucca

SEQ ID NO: 192093 - RNA, 117061 nt, Homo sapiens
uagguuguuuauaucaaguccuuuuauucugauaccacagaauuaccuugucacaauacagggggagggacacugaaguaccacgaguucucacagagcacagaaggacagcacacaauucacaaggucauguggaggacucgggucauugcacuuacaacuguaaacuuguuuguuugacuuuguacagcacucuuccccccucaaauaaagaaggagagaaggaaagaaagggagagagggaggaggaaggggaaagcaaaaacaagacaugaaagcuagaggaaaagguauugaguggccaccacucuccaggguagugcacuuggagagaaggagcugauuugaccccagaaacugaaugaggcagaaacacacacacacacacacacgcacgcacgcacgcacauacacacaugaucaugugcauacacauacaauaucucacgacugccauggcucuccagugccaccccagugcacauggcagcagggcugcuggcacccagggagacagagauggcaucuccgaggaguuucaguugauuaggccugucccucuaacccuguuggaguccaugaugacaaguauuuacagcauggggguggguaagaggagagcagacgggacaacagggcaggaccaugcuguccuggcaaaggaccugccuggaaaacucccuacaggcuccagaaggcaaggcauaguugccaccacugcuguucuuucacugugggcccucagaccacaugcucugcccaaggauuguaggggagggcugucacugugaagugagugcacugggcccugaagugagcagagagaggaggcaaugcccuugcucaugaugcuggggagagggguauggagaaggccugggcugcaugcuagagacuccuugcccauuuggagaugugucuguugcucucuacuuuccaaggcaccaagugcuggucccucagcuucuggcugcauuguccccagagucacaacugcauccaugcaagggccaggaaggacaguccauggaccagaggccugcuccagccaccuucacagaggggcgaugauguauccuguggguacagugggggaugaggaguggcagaugucagaauuucaaacucagagggcuuggccagaaaggaaauuugcugaaaagucaguacuuuagagccugagacuaggccugcuggaggcugaccuccuaacauuucccugccuguucccuacuucuugucccauccccuggccuguaguggaaaggacuauugccuuggucuccaaggcacauccccacacagaccugguccuggguggccagagguguuaggugauggcuucccucagcccuugcucagauggcugcauucagcccauaccugaucuuugggaugaggcagguauuccauggguggggugaggccaagucccagaaaggcaaggguguuaaguccaacacaaagguuggcagcuuccugucccauccauagcuaccagaggugagcgaggagcccucucugaagggguguguagaucuuauagaaaagcaugagaaaugcggaccccugagaaaugcauggugcaaaccagagcacucuggacgaaggucaggccuugaagggucaggcagguacugccugccgcacuccuggcucaaugguaaaaaagcugaugagcagcgggacgcuugggcuuuggagaagggggugagcagggagcauagguccuggggacagaugcagagagggucacacaggaccuucuguaagauuugcuauugagaaacuucacaagaaacuuagcuugaagccacuguuuauaugaacaguuccagaugaccacugucaacuguucucaccacaagugccaaaggcccagcucuuccugagcauccauugacccccuagcuccagcccagaucuccuggcucacaguccuuugagccuccuagccacagaggagaggcaugaaacaggugcagucaagagcuggggucccucgggcacagccuggcucugcucuugccucugccucucuggcuguggaugccgcccagcucugcccuugcguggugcccucugggaaagggcugucagaugccucuggcucaggguugggguaggaagggaaaaugacagacagacagauauccuacagcaaaccuucagaauguccauacacacacauccugugcaggcuccuaccauugcgucugcucuggggauuccuuuuuaccugcuguccuggacagagaaaacugcaggguaugugggggccuuuuacugccugcccugcagccuggcacgcucaggcaacaauucuggcagguccucacuagcuugugcagaagucagcuagaagugcuccugaaggagagguucugaggcaaaaagaacuccaagcaagagggucaagcauuuaaaauggaugaaaucgugcaaagaggcugcgagcugugcaugcuccacugcaggacaggcggugacucaccuggcagcagcgaguccugccacaggucaaacaugccacagacugagaauuucacacacacaaugggagcaggggugggguggggagggguggggguuuuaugaguguaucuauccaguuucucaauugcauguuugcaauuaacuccuuauacauaacauggaauuuauuaaauauuaacaguugucauugaggguuuauauuucauugcauagaacguuagagaugagacuuguggcugugccccagaugaaaggaggcccccaagggaagagcccuggggaggaaugcugcccaguccaccggauggauagacagugccacauucccccgcacagggcucugggccuuucccuuggcuggcagaaguccuggccccucugcucugaguacacccacuggugauggcuuaagaacgacuggaauugcacaguaaacagaggcgggcugggaggccuccccagaccucgcccugggguugugcucuugguggccugcugcccccuauugcuucuaagucaacauucucccugugcugagcaggggcagagcagagaggaaaccaaaccaucagucacaagguggugguggagggggagaggcaagggagugagccaagagaagagagaaagggggagagagaaacaaaagaaaaauguuuaugagguauacacguaaaucaaacuggaaugauuaaggcuguucuugaaaucaaaagaaauccccagguguacagacgaggagccggcugguugagacaauggcggugccgcugggaugcucacgauggcuagggggauggcuuugagaugguggcagugugcuagcacgcugccacccacgggcugggagaagccucagccggcgcccacgcugcuuuucggugcuauggccucuuauuucagcgaugagacaguguuagguccuaauguuuguaaaguucucccaaccccuggccacauggaggucugcuccgaugucacccagagggcaugugacgggcagggcccugugccacagagggauccgggccagcuggaaugugaaggaaacggagcccagggcccccagcccucagucaaagccccucuccaaggcuguggaaaaacuucuggcaucucggagggagggcagugugugcccaaacucuguguauaacgcacgggaagccuggccggccaggccgcaaaaaggcggcugugggaaguacggcaagacaccaugguggcaggguuucuggagaggguucucccucccaacaagggcugugccuugaagguggugcccugcagagagcagcaucucuggaaagacaaucaaagguccccuggccagugguccgacuuguccagcagaugcuucacccaggcagcugcugugagaaaacaucacguccucaacugaggccugccugccacgucccaccuggugagucuuugggccaaggguuugccagauuguagaugcuugaaagagaaaaggagggagggaggaaggaaagaagaaaagaaaggauucugucaagaauuguagauagcugcuucucacccucacauuccucucagccaucugccugugcuagcggccaccuccucacccacggggugccaugccacucaggcuuggggagaugggugcuugggcagguuggaggucacagagaggacagcaagaaagaagaaucaggucagccaggaagggacacuucuuuuaauguaacaaaaguuccuuuuuuuuuuuuuuuuuuggcuuaagagugauggagaagggauuugguuugaaauggcaaaccucuccaagcccaucucugaaauugccguaaagaauuucaggagagggauacucacggcagcacuguccacuugacccaaucauuagccgaaugcuagaacucaagggagauuucuuuaacuauaaagucaguggucucaguggcccaaccacaccauguggcaggacgcagaacaaagcugugucugugcuuccuuucccugcucaggagccauacccuggccccaaacccaagguagguacugucaugaauccaggccaugggcugucccuccuucccccacuuucagcaccacuugugauuucacaucuguuccagggcaacuccaaggaaacaucagcugagcgggaagccgcaggaagcccgcugugggagggugaaggcaggaagaacgcuaagggcugcacuauggcuacuguaauuagaauaaauuccaggcuccuuacuuggccugcacaacccaccccagcuggcucccacccccuuggacuuuaccccugaccaccucuccccuccacuguggcccuggcuauacuggccuuugcccugucccuggucccaucccagcauccgaucauccgucagugcuguucccuccccuuuuuucaucccaccgcagucguccuccucccucaagcuucccucacauaucuucugcucugagcacuuugucuagagcagaccccacugcuuccauagcucugcuucucuggcuuuauaacacucaucacuuucagaaaguaccuuuuuaauugaauuuuauuuuuaaacuuauuuauucucuaucuccuuuaauggauugucagcuucagagggcagggacuugguuuuguucucugccauauccccagauccuggaagagugccuggcacauaccuggggcuugacaaacauuuguugaauaaauggacggaagccugggccuuuccagggccccacugcuuuuccagagaaagguagccugugagguaucacaccuagcuccuucccucccacaaccagugcuggcccgggcccagcaucugccagccccagggcucccuugaagugaccugcucacugaccgccaggccccgccauggauaacacauacaugcuugugcaccgugagaagcacccugaaggggcaaggagggagaagaggaggguccgagggcuaugggaugauggucagugguccuggcugugcacagagcuguaccaacagccaggugauucuccucccacccaggaugaugcacuuccuccuccucccacagaggcagggccaaggccagggccagggccagggccaggacaggcuccaggaaguggugucccaaccugccuuggccacugcagcccagacagggugagggcucccauccugaggcccuucugcccucucccugagcugacuuagucuggggcugagacucccuuuccucuaugucccuuccugucugccucucuacuccuuccacucuucuauccugugggccacaagcucagccugugaagccaggaguguuuugacuucauucccagagcugcagaugugacucugugggguuuggggacucuaaucucuuccaaguggcuggagcaaaggcaccagcagcagacaucagggaagaagcauguuccccuacaggugccacagacuaccagguccuucaggaugacuuugaacucagugcccagcacauagacuucaaguugugaggugcaguuagccgugcugggcucuucuccaagggugccaccugacuugucuggcaccaucucaggcagcucuguggccccugccucugcgggguagagggcugcugggcccaucgcagcugaaggaaacccaacaggcccuucccaguucacacuugucagaacuggcuagcugucaucagccaggccuuggcccuucaccccuccuccggcccaucucacccugauccugacacucacuguuauacgcagaguccagagcugcgcccaggccucugacuccagagauuuuuccacagcaaugauaccucucuucauuucuucaagagccuguggagcauuuagaggagggcuggagaggaguugcaucccuggaggccuaccuacaacccagugccagcccagugcugugagagcccugcaggggauggcagaugguuugaaagccagggcacuggcccuggcuuuggccccuccuuugcuggggaccccuacuguguuggccccaugguaggggcucugugcacagugucccuccuuuuucuccucccacauucagagaagggaacauugcagcucuggguacugaaccagccgaagacuggacuccucccagaggaccccuucggacuuagagccccacccccacccccagugccucgggccuuucccagaagaggcaagguacaggcugcuuguacucaccaugcugggcauggucaccagaaugaggaaaauuuuuugccaaaagcagagacagcugugacaaagaaagaggagagagccaucaggaaauugggccagaccccucccagucagggccacuuggcauagugaaggcaagcucagcccaaggggcagagauugcccggagaacaacugggcaucagcaggugggcucucuggcuggccucugccugggugacugagucuggaaucaucucacagacccagccuguaccagaguagccacccaccacagaccaguugcaggcagugcauaccuuccgucaguuugccagcuugcucggcugccccgccagggaggaucuuggagaacacgcucuccccaucggcaccuggcuggccggcgggagccccugggguuccuccaggccuggcuccagccuucacaccuaggaggaaagaaaucgccauaaugagcuaugcacggccuggcucuuuagggucuaagagggcaaguacccacgagagaaucugaacacagguacccuauaaggugggaaggugagaaggaggcuagggaaauaaagagaagaagguaagaacaggaagacaaggggugggagaaggcagaaaaaaggagguugaggaagggaaagaagaagaaagggaaaaaaaggcagagaagagcaggaaaggggaaggaaggagggagcaagaagccaugguccccacccugugcucaccagugccuuccugcuucucugcccaaagcugcuugggcccuaaagccccugugcuggugaccucauuggcuuauucuaaccccaggcuuguuuucugcuggggaggucuacagccccuggggcaccuucucagggauuagugagggcaugcagugugggggagcucagggcacaggugguauagagagagaacagccugggugcucugggccacagccaagggugucaaaggauaggcucaccugcagguccagguccuggugcuggcugggccugaggagcccuccccuguugcggugcuuuggcugucccuuuagagccauuugucuguucugcccguggcugcaacacagaaccuauagcuaagauucugcccaugcccagccuggaaccaaggggauguccaagcuucauucauagcaucuucccugguuacaacccaugcaugggagcucugcuuaccgguccugcugguugaggaccuguggcugugcuggggccuggcugaggcuucccugcaggcuggcuggcagcaggggcugagccccgggugguuggcuggcucuguugcugcagccgagccugugucagagccugcugugggggcugcagcccaagaccuugcugcugcugcugugucuguggcuggcgugaugcugccccagaggguauuugccuggaugauggugacugugacugcugugguccuggagcugccugccgaccuugcagcugcggcugcgccugggguucugccuuugacugcagugcagcgggcccggagugggcuugccgggagcccuucuugcugucagaggcaugaugguaugcggaugaagcacgggauggcugugaguacucagcagagcugggauacccaggcugacccuucuucggcauagcuggagcagagcugggcugagaguggggccgggccucauggcgacccaggucccgagcgugugguuuggcagcacgccgucccggcuccucaccaguguggcggccugagugccgcccguggucaccgugccgguguuccuuggcugaggcauggcggccugggccacccucaucaugaggccacaggcccuccucaggggguucaucguagucaugguagcugugccuggcagggccucgcuucugggaggaggaggaaacugcauggcccccguggugccugaaccggucagagcgggcaucccggggcuuaucaaaccaguccgucuccuccuggcccaggugauacgcuucagagaccaaaaacagaauaccaucaacccccgggcuagccgcagggggaggccuagcugaagccaugcaaagaaaccaagagagugggugccacagccacaagcagaucagcaggcccccagcccacccucccgcaaccacggaccagggcacagauggagcaggcaagggcagccugccugcagcagggcccaccagaugaggcgccagaccagacccugcugggacaucuuagggcccagggccccacagguaggcaggccccccagcugcugaguauccgcagaaaucaccccuggcugccauuaccuucgcugucggaaaccacgcaaugggaaucauccaggauguagcccuccucacgcuuauaugcgugggcccgagguccguccuugacauguuccuggacaucaggcauggaguggcuggagcagaacugugggcagguauccccgccgggagggaggggcccuccggcagggcggggccuccccaaaggacugacggggcucuccucuucagaggccuggcuccgcauggggggucguacccggcugugggccauacuuagggaugagggcuuggggcccgcuuuuugaagucgcuccacagccucccguucccuuucguaccccuugccccagccacugaagucguggcuggacagcuucuccccacuguaugcagaaggugcccgggaccggcugcucccgccauaaaugcggucguccuccacugcgucccggcuggacaucccauaguauuuuugcugcucauacacguucuucuugagcccauaggugauuucauccuggaacuuccugccccgagagaccaggcugcugcugacugcaggugggggguaggacgccaggucugacucuacgucuuuggccucuucaauaggcgagaacuuggauaucuuuugcuccaugcccugcuuccggugcuugcugcgcuuugaggagauggcagcuggagccaggcucuuggagggaugcuugggccccaugggcccuggaccauacuucucuacucgagccccaugccuguagucacugucaccauaguaguggguacuggcuggucgaccauugcucuccaugcuccggagguggccacccuucccgcggggaucguaugaguccuccucagauuccucuucuccucuggcauagcagcagggcagugugggcccgucaaggacaccugguucuccaggcuccuucccuggacgcccacugcugccuggccccaggggcuccagccguuggcuaucaggagcaguagaggugcuguccuuggucaguucacugaugucaucaaucauuacguaguuucgaggaacguucugcuccagacugguauagugugagucagagggguaggugggggcugggcucuggcucacacugccacggucaccagcccggggcaccucagggaccuugcccugcucauagccgcugcucacugcugggccacuguagcugguuucagauggggcugaagacaugggcacaacggggcuggcgaucaccucauaguuggugggcaccuucugcuccaagucggcuagcgaugucuggcguggcuucugcaguggggcacggcuaucagcggggacuggaaaaagggugcucugugugguuggcauggguguuuggccugcauaguggccuguggggcggaaagccugcugguuuggcaggccaggcucagcuggguaacuggcaccaggaggaaaggcaggagcuggguacgugcuggggccaggguaggugggggccuggugggcugggaauccguucugaguuggcccaccacugccugcagaauacuguggggcuggaggcuggaagcggggcugcuggaaggcagugggaccagaggggguggcaggagcagcggcaguggcagggaaguccacaaacuggccagcgggaguggugcagcccuggagccgcagcugguugagcucacuguccgauagguagucacgaugcucgccaagaccacgcaaggguggguagucacggccaccccggucuuuggccaaagacucuuugcguugugugauacccaacuccagguacuugagcuuggcgucaaucuccuucuccuccucauccagcucugccugcuucuugcgcaguuugguggacucaugcuccaccagccgcaggucccgguccagcucccggagcaggcuggccuugguagcagggacaguggugggccccgucagcccucgcugcagcaggcuggcugcauacagcuguggggaggccuggccagccaggggaaggugagccuccucuggaggggggcugggcaguguccgcuucaccuugcggaccaggcuguuggguggcaacgccgacaccugagacagagggaagggugggcagcacugagacccaagguguggugacuugauggggugugggguggcagaacccaggccugggcuggggaaggagcuggguuccaucuugcuggugcccugauuuaccaggcagccuggaggccuacccugcccacccauaggccuugguuucuuugccauagagggaagaucugugauuauuuuacagcccuucucuuucccagagcuuugggaagcaggaggguacgggcagauucccuucaugccaauguccuguacuggcccagcacauggcuuugagaaccccugcacaucuccaaugggccugccacccucugccucacauugagguaagaagaguacagcuguggcucuggguuuggggccuagcagcugacagggguugagaucaguggaguaugaacaggaggcauggaguggagaggguccugggcccgccaggcucccuagaggaucaugggaagggacacauguagauuguaugccaaucguggcaggcucugagucauucugcauccugcccuaguccucucuaaaguggaaggcuccucagcugccugcccacccucuuccucuagugcccugcacugcccucugccaaacccucugggcugugcucuuggccugguccccagcucccuccaugucccucggucaaccugcuguucucuggagccaccagugcacccguaaguccuauccagcccuaccuccagcagcauggcuuccuggucaagguucccuaacagugccuaccaugggguccuccuugccuacccuagacacucugcauugccugaagguccacauugccugguaguucacucugucuucucccuuuuucucucgcuccuagccuucccagaaugccccaugcccuuggguuucauggaccacccaaauuccaauauauacugggaagugacuccuauaggauucuuacuuuuuaccuugccaaguaacuaccuaaaaaccucccaccuacauccaccauaugucauaauaaaaauuauagugugcccucaaaauuucagggugggccuuuuauggaauaaauuuagccuuuugaaccccucacucuguugucucuuuucuuauuuuggccacgcaucaugagugccuaucauggccuggucucacauggccagcccaugggaccucugugccugcagccaggaccacccugccucucugaccugcccucccugccagccuagaguccugaucccacccacaccccuauauggccugcauacaccaagacuucacuacccaagauuaucaccuccacaaaccccauucuaaggcuccacuuuucucgucucugugucacacccugaaaaugggcaaaucuaccuuacgaugccucuggcuccugccuccucugccaggucucuuccuucagcccacccucccacauucugcccaggaaacuuuccaaaacaucugcuuugucccaucucacaugccuaaaaccuccagaggcuuccagggucuuuaggaaaagcccauccuccucagccuggcacucaguuguuggcauuaggcccucacaacccucuauucucacuuuggcugcagcccacagccaagccacuucucacaguccccauccaucacuggcaaauaaagccacaaccaaggguaagcuuaugcuucugaauccccuaucuaggggagcagacagauguguaaacagauuuaccgagggccagguaggggcagagaacacccuggggcagagagcacacugcagcccgcugggaugggccucuagugcuaggccauaggggugugggcuuccuguguggcaauggaaaccaggccaggacugagaggacgagagcagccgcgccagguucauaugacugauuuucuuaggaaacacccauagauuaaguuuggaguggaagggguccagacuagaagugagagcugaagaggccuaaagggggagguagcaggggcuggaccagguguggguggugaagggacagugcugggaggaggcugaagcuucuaguaggguauguggcuggaaggcugugggggcccaugugugugucuguaucugccaggcugucugccgggcugcaggcucuuucagaugugcaccagggagcaucugcucauugacucuuuccccugggccucuggggccagagaugccucuacucccaccccagaagaagccccucccugugggggccccucgggcuaggcagagaccccugucccacccuggaacagccccuguucccauaccuggcuacccaguccccccuggugcugguagagggagaaucucucuuuggcagacucuucggcgguggggcugaggggcuuagggucagacagggaccgcugcagggucuucauggggcgaggcagcgucugcuggcggagagcgcugucagccgugaagugcuucuggggacucacgugagcuuuguucagccucucacuggaagcaaaggagguguccaggagccggugaggggacaggggugagacuggugaguagaggaccugaggggacuugggaggcuggcggcucacaagcugugagagagacuccggaggcaggugggccugguacccaaucuccaggggaucuggcuucuuuuuuucaaaucugcccagaggcccuggggugacgaucuggaugccaggcagguaggggcugauggcaguuggcccuacaagcugcggcccggcuacacccugggccugcccaucuggcuccgucuggcaggccaggcucuccccacgcccagucuucucuggcgccgauauguaccugacgaucuccaccuugggaucgguggcagcugugauguggauggcuggagagacccugggcagcuggucaggcuccgucugcacggagcagucacugauggucuggaugcccacgcugcucauggcccucacaguggcagcagcacuggaugaugaggcaguggcaucgugcuugcugucagagccugagucugaguggcggggaagacgagaccugcggcggcgcacuggcugcucccacucagcacugucuucgucguccgucugcacacugcagucagcacuccgccgugcccggcgucgccgacucaagagguagcggcucuccccauccucaucgucugucugcacgcugcugucggcaauccuccugaccacacagggcucagucccagacucuagcucacaggcaucccgcaggcguggcauggagugccgcuucuugaugccacuacggcuggccucccacugcuccuccguuugcagugacaugucugaggcagagcuggggagaccccggugcagcacaggcucacgaggcugcccaaguccuucaggcccugccauggcaaugaaggcugcauguguaagggggggccaauacuggccauucugggccaacucagcagccgcuaggggaggcccucggccaggugccucacaggcugcaggaaagggagccuucugccgcugcuucugcuccucuagcugcugcugcagcugcugcugcagcugcuggaucugcuccagcugcagacgcugcugcgcuagcuguucccgcugcagugcaaauugagccuggcguuccucuugcugcugcugcagcacauggugcuugauggucugcagcuccugcaacucccgcugcaccagcagcugcuccuccucacggugccucugcagcuccacacguucccgcucuagcuccucuugcagccgaaguugucgcagcuucuccaacuccacccgcucccgcucuagcuggagcagcugcuccuguugcuuccgcugccucuccuccugugaugcuuccucuuucucgaacccuggccggcugagggccccacugccacccccaggagcagcaucugcugguggcuucuggccagcuaguggggcaggagcuggggcuccugcagccuccuugauggcagcaggggugguugugggaagaggcucuucccgugcagccccuacuggcaucucuggccuugaagggcccccagccccaggggccuuggcagcagcagguuuccccagauagacaggcccuucugcagguggaacacuggaagcaaugggaaaucuacuuggugcaggauagcgguacagcccuguggguccaagagguacccggggggcaaucaugggcacacgugucagacuggugaguggcacggcugugauuccaccagaugcguaaggccuguacaugccaccacgcaccaugggccgcaggacugaggcaggcuggguggugaugggcaguguugcagcaauugggguauugauagucgaguagaucaugccaucagcugcacguacaguggcuguggacggcagcagcugucugacugcuguuccuuggccugcugcaggcccauacugggccaaguucccaggacuuggguggcccucuggaaaggugggguuaccaaggaguccaggucugaggggaaccagacucuguggagcacugagcccgggcccgugcuggggcugguacugcacaaggucagggccaccaccaccacugccaugccgcccaccauacugguccauggaguugagggcagcgcacaugcgacugauuucacgggcugugguggcacuguacugggccaggcuggccuccuggaagccaacugcaucuccccgugggccguaccuguggucugaguagauguucgacacugagcuauagcgccgcaugggaagcgggugagccaaaaggucuguaggaugacgcagguccgugacugagccauacugcaagcccugcccuagguagcguccauccgcaaagcccaggcuguaggagugcuucagugagcugagguccauagccgagucucguccaggacccuggaagagcugcccgauccucugggcaugguaguugaggccagccucagccaaauuggugucagacauggaggaguacagccuaccaggcaggccuuguggguagggccucugcuccucauggggcccaggccccaccacccccugugcccgguagguugggggcucaggaggcucagggucccggggaccauagaaggggcugcugcuuuggccagguggggcagcaucugccaugcucuucucaggcacacugggggccggguggaaggugccagugcagcugcugccaaaggggagcuuguagaccaugucacagcaugccagcuggcucucaggccucaucccgguaagguccagggcacccgcaggcuccucugggagcaguguggucacagugccugcugugcccucucccaucugcaccaccacuguguguggcuuccuggcaccuggcagagcaugugaccgcagcucugcagggguggcccgguggggcucggcaccuggcucuggcacugggccuggcuugaggccaaugcucugggcggugcccaucugagugaucaaaacgucucuucuggccagaggagcuacuugguuggguagguuauaucuggcaaacuuggccucccugggucuuccccggggcccacuucgguauggggcugucuggacagccugcucuacuuguuugaccugggccaggcacacagggcuacccccacccuggccaaagucaaggcggcucugguaggggucuccauagaccacaggcugcuuuuguugagccaugaacacagacgaggccauggugaugcucacggugguggcaguagcaaggaagguaugcuccugggcauugagguugauaaccaagggcugcacggcggucgacugccguccugggauuggauccagggcaagaccauacuuccucgcuuccacagcaagagaggugagguccaugcccuggucagugaggaugaugggagugggcuugacagcuguacggaggucuaccacugcagugccagggguccuggggccuggcucaacccuagacgucccagggacagaggagauccggcacagggagauguucucagcagggagggcaccccagccauauagugccaggggcccaucugcaccagcacugggcacccguggaaagccagguggcccagguggcucugggggcagcugagacacacucggagguguugucuggcuguagccauggguggugggcuggguuucaguaggugagcagagcggggagguggaggcacuggcauguaccauccuggucuggcuggaggcgucagaugccagcgugaugaccauaaagggagccucuugagaggacuccugccacaccaggcgaggcgugcugggucgaugugguguuuguguacccugggcuaccauaggugauggagugggggcaccagggcuccguggcaugucugaggcaggggcuggacuuggcgucuguguagagaacucugcuguggcccuugggcccaucuugccaggggagaaugugggacucucugagggggaagacggggagagaggugggcuggagcuugcaaaguaggaauaugcccgggaaggcugaggagugccacccucaccgucacucgcacucaagggcuucucucuagcagcucguccagcugcagcaaggccacugggggccugggguagauccucaguuugggacccauaguuugcagugguugggcuguguccauagcugugggcuguggaagauggugaaggacuacgcucggagccugcuggggaggcuggagucauauauccucguggcagcccagcuggacaaggagccacagcugugguggcuggggucccagggcccugggaaaagggcaugccuaucuccuuggaggcugagcugggggaggcaggagagcugugcagcuugaggggguccugagucuccuuugcaaaaugcugagugacacggacaucgggaauaacucggcccccgcugcugucugaggagguggggguagagaaggacacaggggcagcgagcugggugggacugguaccagggguaagggggccaccauuuugcuucauuggguccauguaugcacucucagcauuuagaaacugcuucuccuucuuuuuguccucagcaaaagccaggucucgugaggaggccugccgcaugcggacuaugcucugugaugucugaaggauuucuucguacacggcugcucccaggcuggcuggcgugcccucugcggcaggcugagcagccuggccauacucacggucuguagugucuugauauucgaaggagcccaggccccgggggccugugggcugagaggggccgccaugggguccccgggccccugcugccuggccuugcugccucuggagcagcucagcuuugcgcaucaucuccucauaagccuccucagcgcucuugagcggccguccggaacugggagugguggagcugccggagggugucucgguuggugaguagagggacaugaaggugggcagguuguacucacugccugacuuguaaagccggcuagggccaccauccaaggccucagccucagagucaagggagggugagggugaguacucagagcaggaggagcgguguagcuccuccaucucggccgccugccucagcuccuccgucggggaggcauccucgaugggugacaaguuacuggguggugucuuggagcgcucucgccuccgcugggcccgcaguucuuccuugucccgccgggucuugcgggccgugcugcggaugcgcugcugcuccaccucccgcaucuucucuugcucacgaagcagcuccucuuccucccgcagcuccuccuccucugaggaguccucgaugguggguagcaggggcccgugggagcggugccgggccuugcgcugcugcuuugcuucuucuagacgcugccugcggcuggggcugcugucacuguccuccucuagggaggacagagaggugggagaggugcccgagguguagcuggguguggaggcaggcaauguagaggagugcucaccacgggagcgguccucaggggagcccguuaggcucuccaucuccagcucaggcucccgguccagacuggggucugggccuuggcccagguccaacucaugaccauaacuucccgugcuguugagcucaauggucuugaagcgacggagcccacccugcagggucccacugccaucgguagccucugcugagccucccucagggagcagcuccucauagcccgugguggcauuguggggcaggcgccucuugggcagugcugcugguucuuggcuaggcucaggccugggucuggggccaccuuucugggugccauguuuggccaggccacgcccggagguggcagugucauccuccuccagguugucuuccucggcgcucaucucgagaaucugccgucgcaugaaauccucaucagucaguucugcugcccgggcugggggcugggguggaagaggggacaggccacccucacugcuguccuccacauagucgugccucaauuggcugccaaagucgucugaggacucggcaguguccugcugcucucuccggcgccuccacucagcagagucuucgucuuccuccaggauauccuccagcuccucaucagagucaaaggccucaggcgugauggacaaggaguggggccgcugcuucugcuccucgccaguaccgcuggagaguggcuugcuccgcucacuuggggccaggcccugggccugcagcaaaggccgcaugcugcuccccaccuuguggaucucggaggggcuggguggauguggcccugucaccccugcacuguccagcuguuccaccuccugcugcacgacuccugugaucucacucugggagcuagagaugccgucagaggaauagccugugucacugaggcucugugggcuccgagacgcauccugagaguaaggcuugcccaccagguccugcagcagggugaaaagcagacacugacuccccauggcaaagcucguggugggaacccaauccucccugucaaucccaggacccuggggaagagucuguccauuucccaaggguuuagggcccgccacccacccuaucuccuucuggccuugaauaaccugaagguuccauggcaagcccaaaccagcccuuggucuucaaagagaaacuuuacuagaucaaaggguaucaaaacccagcaaagcaucugacaaggugccagacacagcaccaguguaaaacccacagucuccaagcgugccagaaccucaucuagacuuuccuucuacugugucccuucccuccuguguggccccaaggcaccuguccugagccuacagccucagccacccagggaggcaagccuuuccauagacuguccugucugaaagcuagggucucugggaagugaaugggacugaccuccgccuccccacccuugggggcuucuggaacagccuugacgacagggguggcagguucagcccuccucaccccacucuuuacuuuaggagucgcagggguugggguagucucuggagguggcuucggcaugggcucagcuuuaguggggacucgggucuucuuuuccuggacacugcuuggggucuugcuggguucagaagcccugaggggcuuggccugggggcuggccuugcugggcagagggcuggccuugguggauagagggcuggccuuggcaggcagggggccugaaggcuggcccagccccuguggcccuuucugcuucagaggggauguuccagaugcacggugaggggccccuacagggggcugcugugaggugggcggcggcaggggggucggcucuccuaggcugcccuccaguagccgcuugguuuggcaguucagacagagccacucuguuuucugcaaggaaaugggagaggggguugaugaaaauuaaaaagacacugaaguccucaaauaauauuuccauaacuauuucuguaaccuuagggaggagagaacuuucaaagcauaacaccaaagacauaaggagaaaaagacugaccaauuuacugcccccaaauaacaaauuccccuaccuuuaagaugaacacacacaaagucagaaugcaaguaacaaccccaaagaagaguacuuuccuuaacccacagagaacuuuucaccaggccagaaaagggggagaacugugggggaugggagggccuagcccuaagcacaggggaagcugaggucucaaucugagggagcaaacggcuccuagugggcugguauggaguccagcaguugagaacccuuguggaagaggaguggcauccaagcauggagcacuuccuggaggcacuaugcuuccccugccucccagcucucaggucugacuccauccuuccccacacucuuucccagguaagggcuaugcuagauagggugcagacuccuggggccaggggaggcugucugggaguaacccugcuugguggaggacagaggggcugagcaguccucccugcucaaauccccagcccaagucaccuugucuaaggccagcagagacccucagguagaggccuccuccugcccccagggcucuggacuguuccucugauggggacuaugugugguggcccuugugucaggggcccugcuccuuccagagcuggacugggaucaaauucucaaccaucaguccaccacucucaggauccucuacuguuucaggcccagugcugggggcugaagacagccaugacucagcagacagacaggcacuggcaugcagccuuucuggagcccacaaccccaaacaggucauuuacaaguaugacacagguaucaauggugaagcccccagaacacaagaagcgaaguccaugucucccagccccagcugcuuuguacaggcauaggguuugggcaucucugaggccuaaaugggugauuccugcagcaggucugaggcugacaggggcaugucucccaguagccuccuccagagucagggcuccuccuuggcaggauuugaaguccuucucuggcccacaugggauggagaaugagaguuacaguggagcccagagcagggucccacagacaccugugccuguucuuacucuguggcgcagagccuuagugcuccauccguccugcagggaacucacucaucccaggugccuggacauacaggcucccaccagcaacucugccaccgagguggaccauaagaaccacaaggucacagagccagaggacuggaaaaggaggugaccuuuggcccuugccacccccaggaaggcugacaaccucaguacccucacuucacaugcugccucuggcagccuuggaagccugguacccccagggugccugcccuuagccuggcauccuagggccaccauggcagauaacaugucaaugauucugcccugguuugcuguccacagagagcuacacuccacuucucugcucugggcuucagcagaggcuaggcugggcagguggcagggccuugguguguguugagggacaggccugcuccccaggcugguuacucagggucgagacugcuucucucccacuggagcuucugcucuuccccgaggcccaaccucaugcacaagucccaggcagaggaauggggcaguggcccagcuguggagggggacccuuuagaugcccuacauacauauacucacucuguucucugcacagcccagcccuaacaccacuacugacucccuugaaccuuaucugaugcucaaugugucuccacacaaaaccccacaaggcaguaagugcuggccacuggccaggcccugggcucacuuggccuggcagggugcacccccagaggugccuggggaaaauacagauagguugagaccgagccccagaugaacaggacaugggagagcacagagccugauccaggaacccuagcucacaugcccccagcaucaccuguguacacaauggaaauucccccaugucagaaaggacugugagauggcaaaaugacccuggagagauggcagggcuauaggcagagaucaagagagagagcucuggaaaugaucaaacagccccuuccccagcccuauggucagcaugauggguuuaggaucuaggcccagugggcuggcccaaggcaaugcugcccuaacuccacuuuggagcccugugcacacccaucccauguuaggccucucaaaguuuggauaucugcccuggcccaccuugguggccuggcaaacuccuaaccccaucucuggccugcgaaccccacacagaagcaacagucuaaaugaagcaagucaccuuggaaggguagucuggauggaggaagcagaccuaauguuaagugcucugaccaaaugcuggagaggccagcuugccugagcccagaggcccagcucucagcagagauguuaccuguggucacaugcucccuggugcuuugcuccuucacacauuuauucauggagacagccagguugcagguugccuggcaggcccucuugcuccuggcucugcuauaguaggcagugaggaagggagagcaggcaggaagaggcgugugaaguaagggcuaaaaauaaacauugaccuggcugcuggaggcccuucacaagcccucugggaguggggaagaaggguacagggcacuggggcugguaggaguagagccaggggagaccuggcccaggcccaagucuucuggggaaugagaaucggguggaaggcaggccauguagaaucucugugccugggggcugggacagcuggggucccaauuccuuuauucauucuauucucauuuucuccaaccccaacauaccccuaccuccaucccaaucauucauucccuuauucuuccgcucguuuccauuccgcaauuucaguguucauuccucauucagccauccauucauugcacagcccucucguacucugccucacucagcccaugccagcuccaguccuugggaaagugcugccugcuuaccccuucgccuggccucuuugacaaaagggcaggggauggauaaugggguggcucugaugacuacuucugccucauucccucuguccaguuccuuucuagggcaggaagauacaaauuccccaaggacaaucaucaacuaacagugggagaggcagguguguaugccaucagauggcacucagugguucagggcaucacuauuuaggguaaagaaggggaaacgggaugacugaguuaguggggugcccucuaggcacgugagagcugcugccuucugggaccacuggccauugugccuugugagccaggacagauccugcacugucugccaucaucugaaugaaccuacauuccacguaaucucuucauguguggagcuggccugcaugccaguaugguuauggugacaccguuccagucaaugcccuauggccagcugccuggcccuaaacacccucagcccugcugccagaccagggggcugugaaugagaacuccagagaaaaggaugcccaggggucaucuuggaggacacuggaccacagggauggccaucacuggugcugcuauuccucuccugacucugcgacccugagccucccuguugcuggacaugccuaagcuccuucuuucugggccucuuccucccauaaaauaaacccaccaugguguccccaguguguauccuuguagcugggcuguaacccccucaccccccagcaccaaauguguuuguucccuguggggcaucccucauaccaaaagcuuacaccagccacaggguccauccacacccagauaggggcucauggggacgcuuccuuucucacacagagacccucuuuuaggauacuccuguuccaaaauccuggcuuaagggcugacugugucaggccuugcauaagcaucugagguacagcaucucaccugguucucacggaaaccuaaaagggaguauuguggucccuauucuacaugggaggcaacaggaccucuggccugaugccccugcugcaaccccuaccccaaugagcaagcccagccccauguaucacaggugcaagggacuuugcccagggaggcccgacuucucaagggcacagcuggaauuuuggcaaugaugauauaauaagagacugguaauguuacugucacaauuccaauucaacuaauuucuucacaaacucuauuuugaacugaacgucaauuaaaaauuaagccagagaguacuauuauccuuccaaaagacaaauagguaaaaaaaacuggaaucaacaacucuuaauuaugaaaugacucacuaaauagcacuaugguuauuuuuuuucagaggaaaguucaaaaggaaaaaggauccaauucuacucucuccucuauugugugcucugaacucccaaucuagaaagaagaaagauuucuacagcucagaaauguucaggaaaauuuccaaccuauggggaaaauucccaacccacuggcccagaugguugacuguggccucagguggagucccaggaggucuaacagggcugugggagcuaugaggggggcuccacgggucugucccuucuuugugcacaaagacacagcacagucguucuuaagcaggcaagguccagagagagacagccauggcagacccacccuuaggaccuggagaaggaccugcuggccuuaccaccacacucccaaggcaggguaagugucucuggcaagugcugagaaaucagaaaccucuaaccaagaacacaccaaguaggucacagagaagcacaaaauugcucaggaugccaaguggccauugacugaggugagauccaagacagaccacagccugguuaggggccucagugaagaaaagcaaugcugaagggauggugaacauaucagcaccagccccuugcaagacccaaggcaggugaagcugcacagagguuuuggucauuguguggguaagggaggauaaggacggaaggacuaaggcugugagcaugggugggagagaggccagauucuugugacaguggggaggcagagcuggcagggcuugguccauggagcaggugcagagguuaaagaggaggaggugaggaugaccccgggcugcuggcuugcaucucuggugguggauggugguacagucucuauggugggaaucaugggagaggcauuauggccgccuauccacaccuucccuagaauagcugcaggcccucuggggacagcagcauugauagggagagcuaugagaaaggaguuagagagacuucaucaccccugacugcugucaggagcagccugagcuggggaugagguaggaccaggacuaggaccaggacaucccccagcuuucuuucaggcccaugggacccaucagacccuauggagaugagagugguccuggcuaaggagggggcaguggggcaggacauggagacagcaggaaauugagagaggugugauggggggaacaccggccaucaagagacagaagcuccaggguccaggauagccagaaccaagcagcuaaugagaggccuaggccagaauccagacguuucaucuagucagcgugugaacgaaacucuucuguuugggcagaaucagcacuucccguggccuggcccagggacggccaagaggaacugucaggaacauuuaugcuccuggacagagacaguuuuccccucccauucgugcacauucugcuuaauaaggaaaugugggcugggaggucucuuggggacaggaguccuccaggccaggccaacucagaaguccacuggggcucacagucgcucagugucagugugccccaccugaccagcagugagcuugugccuggaggucucugggcagagcagccagcuaggguucuccuagucuuguggugacacccuggugcaccccuuuccccgagccagugaggcaaacugucgccagugagccaccagaucuagagcuuggagaguuggcuucguggugccuagaagaccagaugggugccacaugaggaggucaguugucuugcucagggcugcccuucccugcauauuggaaaguguggccuuugguggccaaaguagucuuccuagucaugcuggggucccacggggacuccuguggaguccuggcccaagggaagucagaacaaggugccacagaggccauggcaacaucaugcucuccucucuugucccauccugggccaguggugguuugcacuccgcacaccccugugccaccaucagcuacaaauggcucagcccaagagaccagagggcucagguggcuccccaugugcaagaggcagggccuuggcucgaacaucuccuaacgugacacagcugggaaacacauucaucuaucaagacugagggcacucuaaggagacacaccaagcuacgcccaaggcagcaugguaagggucacaugggugacccugggccagggagagugggccacaggacugagggaggagcagaagcagcaucugcuccuggcccaggcuggucuaauucugccagggcaccuucaccuucugagccucuugggcuggacuccaggcuucgagggaacacugaaccuuacacugggccuccugcucccuccugccuagcacugcacagugcucagugcccuucccuggagcaggggcugcggagagaauggccacaaccccaggucugucucaaaccuuccugugggaaagagaagcaucucugagcauccccaguagcagcucuaaggagagcccagccccagccuggguaaaacauguggaccaaaggcugugacuuugacaaguagacgucaacacuuaugaccucagaagagacaaucaagguugaauaccaccuugcugggcuggagccuggacagugggacaugcccugccccauugugagaaagccucccaccccacccuggaugugggacgcaacccucugcaucauggccauucgauccccaccccucugaaggucacagguccauggcagugugggaccucagguucuccuaucugagcaggggagguuggugucuuucaucagggccaugcccaugguagcuggaaauggggaggccagcucagggacucugggaucagccuuagggcacuagucugagucaguaggcaccauuacccccaacucugagugaaaguuaguucugaguagaacuggggccugagguagggacaggaaagggaaugcagccccucugcagcauuaguuguacaggagcagccccauggcugcugcagacccagaacucuuucugguucccaugacacucacuacccaggcccggccucucaucaagguucaagggagcaugcuugguccagcucuuaccuccaccaggugggguguuggguugaagccacacagguugcacaccuggagccugcagguggugcauguguuauaguuggcugggcucuugcugcccacguugagcucggcuuggcacagugggcagauggcccuuuccuucggcauggucuuuggcuuggcagcagccuucgaugcugccugauguucugcucugccaugcuuuggacugguuguucccccaguuuucggcagggcuccagguccagauccaggacccauucuagccccaggcucaguuuuggcuccaggugcuggcccaggcccgggcccugagcccaaggguuuugggccagccuccuugcuggcaucauugaagacgaucuuagguguccccuugcugggggcaggcuggcccugggugucagccucgggcugcacagacaugagggugcucgccuggguuagcagugacgcgccaaggccgaagagcuuaccagugaggcccuccugggucugcucaguggcaccaagcccagcgggcacugcgguggcacuuuuggccggggccucuccugcagguggccugggcucagcuguggaaggcuugguggguugagggggcugaggagacacccuccccaccucuggaggggcagcugcuugggcaggccccggcacugagguggcccuggcugucucagccuggcgggacccaggcugugguccuccugggccccgagaucucucuuggucuggcuuccccaggggcuguuuggccggggagugggcaggagacagggcuggggagugcagcugcugcuggcucuuggagcgaggugcaguggucauguccauucccagagcccucugcaucugacaguucagacagagccacuccuucaccugaggagaaaagcaaaauagucagcaggguggccaggauuggcaguacucauggcccaggucagugcaggccccacagcagccaaggccacuccuagcacaggcaggagcaccaagcccugcucaggcauuucugggcugccagguggcagggcugaaggacagauggcacuccccugcccucuaggaguugccaggcaugugaggcaguggaggcagucccaucccccaccccaccccaaccaccaacucacugccugccagacccuccugcuugagaguccuccccgccacccccuggcagugccucagaucugugcaccccaaccucccgcucggaugaacccaguagccuuccccugcuucccacuucaggccauuugcacauagcagccagacugaucuuuuaaaaccuaacccaagaggaaaggcauggcccuagagcagugcuuauaugcaauggguauucaguaaaaacucacauaaugaauaaauaagugaagaguaauacgugggagaaggaggcauagagaauaaaaagaaaccaugauuccuauccugaagaagcuuagagucuagcugaagaaacaagauacuacagaaugaaaaaucuugagaacaaaauaagcgaggguaaaguaaugcaauguaagugacugauguuaaguagaauuuuuuaaagccuuuuuuuuucccuuaaggaagauagcuuuuuaaagaagugggauaauucaugccuccagagcaaacgagacaugugccgcuauccaugugauaaacacauaguuucccucugccauuagcccugugcagggaugggcacgugaccuggcaaacagagucgguuagagcccuccacguuaucugguaaugaacaacaggagagagggucuuuauucguuuuccuuuggauuacuaaucagaaggauguagcuuugcagcagcaguagucuucuuucccaacauacagagagaugcuaagaaugauguccauagaugguaggagucaacgaaaggagaaaggaguagaucugaugacuucauuccauucccuggaucuggcuaugccccaagucuacccuuggacuuccaguuacaugacccaauaauuuuucuccaaaaacccacauguaaaucagagcaucucaccaauaggaucaaacacucuaaguggauuuccaccacaccuugggaacucuucagcacaacucugugacccaacccagccccaccccagccucccccucucucuggucucuuuuccugccaucuccccuuggcuguuucacugcagacacucuaggcugucugcucugccaagugguccccugagcucauuucuguaccagggccuuuguacuccuuauucccucugcccccuggcccagcuuguuguacagauuucagaugagguaacacuuucccaccaggaccuccucuggccacacaaucuaaaaugcucuccuuuggccaggugcgguggcucacaccuguaauccaggcacuuugggaggcagaggcaggaggaucauuugaggucaggaguucgagaccugccugaccaacauggugaaaccccaucucuacugaaaauaguaagaauuggccaggugugguggcgaacgccuguaaucucagcuacuugggaggcugaggcaggagaauugcuugaacccaggaggcggagguugcaguaagccaagacugugccgcugcacuccagccugggcaacagagugagacuccaucucaaaauaauuaaauaaauaaauaaaaauaaaacacccuccggguacucugugucaaaucacccagcuuauuuucuccauagugcuuauucuuucccaaagugucuacugauuuguuguuuacaaggugucuucugugccccaaagcagcccaugagcucucguugauaggguguucucagggcugcacacaacaugugguacagagcagggcucaucccagaggggcuugcuucauucauccuggcaauuuggucaugcaggucauagcucaacaagguggaagccccgagauuuggugccucaaugaagagucuccuccucaucaaccagagcugaggcuggaggccaagguuguucucugucugugguugcagccagagguucuaaaugcacccuauuggccacccagucaucaccaggggaaggugccgucucaucucuggggcagaaggccccuuuuauuuacccacacguggcuccagcccugcucucugccuugaggccccagggcuacugcuacagguugacuugccaguugggggaccugggcucaggugccuuaucccagcaacccaagggcagcagccaagaagagggagaacacugcacuuuggcaagcacccccuugugccaagcaccacauagggcauguucacaggcauucucucauuuuguccucacaggagagaaaaccaagaucugagauguuuuagcaauguguucucaaugguucccuggcuaggaaguguugcugcuggcaagaucagcccugacagcucugcguagcuccuaaaccacagccuggacagccuggagccuggugccuucuguaguccugccucuuccaaaggccaagucaggcucuagaagucagcacugcaaacccuggcagagccccccaaaggccaaucccaguucuagaaacucuaagaacagugaugccgaggcagugaggugagaagccaucccacuagcugggaacaauuaacccacccaaaugcuuuuuaagaagcaaggcaggccgugcaccguggcucacgccuguaaucccagcacuuugagaggcagaggcgggcggaucaugaggucaggagaucgagaccauccuggcuaacauggugaaaccccgucucuacuaaaaauagaaaaaauuagccgggugugguggcacaugccuguagucccagcuacuugggaggcugagacaggagaaucgcuugaaccugggaggcagagguuguagugagccgagaucaugccacugcacuccagccugggcaacagagcgagacucugucucaaaaaaaaaaaaaaaaagaaaaagaaagaaagaagcaaggcagcuuugucuauguuuggguagagaaagccagagagaaaacaauuucagucccugaacccagucuaaagaccucuuuagaaaggucauucuugggagggaggggcuuauucccaucaaagugagaguuccccagagcaggccauuucuacucauccagagagggacccuggaaggggauuacuccucagaggggaagcucagccucuggcccaggguggcagccacaaauucaguucuucccgugggugcccagcccacacccaacgucccaucucucucauucaccugggcacugcagcaugcccugaggugagacuucuuccugggaaagggaauuuaggagguaaggcuucuuauccugcaacuuuggggugacugucccugggguucugaaucaggcugaacaaaggcacgugccaaaccgccugcacucaccgccagaacuuuccuuuccccagccccugucauccaggcuguggcacaggcaucucaccuaaaauagaacuucuccaagaaaaggcugaaacgccccucagugacucaucgcccagaugggugcagcuauuucuauccagccucuuccagacgguaaggaaccuugaccgcacccuccccacagccccucccaggcucaggcccagcaugcaaggccuccuaaggaggacacuggcugagggagcucucugaggccagcaauacaucccccucucugccuccccgacagauccccagcaguuuccugggaggagcccaaccucagucucuuccuccauacugcaaggccccuauccccacacucagggggauggaggcuguccacgggguagggagagagaugauggcugugcaccccaacccacccgcccacccagccuggguauacaugaauaguucuguggcagacuccacuggccugagugccaguacaguuagagccuuccuuagcugcacacagugaugccuccucaucaagagguugaacccagaaggcucccuguggcuccuaggcccucuccaagcuggcucuccaucagaaucagagggacuauccuuuuaccagugugacaagaagccucagcuaggguucugcugucuaauaccuccaagauccugaucuggcacaugggcaggagaugugcaggcuaccagccacgagccucgugucucaggagccuuccuggggcuacccuaagguggacagcucugucagacauuagcuuugaaugagcugacucuucuugcuagcaaggaagcccaucuugccaucuccaaggacugguagggaccuccauggaagcccgugcaccccgacccagugggggccuaaguggcaguaaggaugggaaggcucagugcaguacaaggucaagaggugguuuaagaggugggggaagcagaagcugcaggaagccuuccuacaggcuuugcagggagccacugccaccugucugcuagggacuuggaaacauaggacccugugggcucuguagcucugagaggacuuucucccugagaagagucuuuuuuagcugcuuccuuacucaaacuauucagugugcagaagggcagcuaagguggcacuggccaaggauccagaggcuuggggcccaagcuggaggcuguaugaacucuaaguugaaugagcagcugugaucugucugcaauggucacucccugguaauuccuccacugggcucuggagcaaggagggcaguucugggaagagcuucuacaucuucccugcaggaacacuggcugcacagagugucucagcccucaagggugggacucagccuugcuugccauaucuggccccaaaggaugcucacaggguggagucuaccucacggucaccuccauggcugucaggaagcucugagagccccccgaagucacauguucucuucccacucgccuccucucacccccccagcagcaaggaaaaggaagguugcagacgucacucagccuucuuccuguggagagccccagcccuaccagggagagcaggcauucaguguuucagaucacucagcacugacaucacgccugaugccgcauuuaugcuuuccauuuugguacaaguugaaacaucacagaaacagcucauaaaggagcccucccugcaggugccaaaucuagagguuccugggagggccccacuggccagugugacuauaugccuuucugggcuaugagucacuggccaggucucaucaggaggaacauaccuucccaugcccccuggacaacaaggacaggccgaugugcagaagggcagcuaagguggcagcugagagggagggagucaggccuagccuggauacucacccugguacagcaauagacauguugccugccccaucuagcaccuuacugucagcuagcugaccucaggcuuaggaagcagguaccacagggucccagugggcagggucacacugauccagagcuggaccagccaggggaggccugugccaaucuaucagagcccugaggaaggucuugggaaccugcccaacaucugaggucaggaucuggggaguggaggcugaaccuaaucgcaccuggggcuagaagaccucacuggcuuggaucuccacgaaagggagaggauccguccccuugcugaucccuggacacaucugucucucugcccucaauaucucuuaacuccucccacacugcucuggacagccccccucccgacccaggaugaucugguguacccuguaacacaccccauccaugacuggccaacuccccugcacccuccccauacacacuccucuuagucaccaguaacccucuccaggagaggcuggacccuuggacuagccucaacuucuccuuaaaauccccaggacccuuugguucaugcccagcuuccccuccuggcuucugcugcccucccuccaggccccuuuauccuggccugcaaguccuuggcccucgccucuuaaacuccugcuaaaugacuuccauggucacuccagaugaccugcaacccacauggggcugagcugcagaccacuucucaaagcucaccgacuggaauaauuaauugcuguacauugcauuauauguaaauuuuagcuaaaaaagagaaaccuuaaauaaauacugaacucuaguuaaugauacgcuugaagugcuuagugggaaguauacugauaucagcgauguacuuuuuuuuuuuuuuuggagggggacagggucugguucugaagugcagugccaugaucauggcucucugcaaccuccaccucccagacucaagugauccucccaccucagccucccgaguagaugggacuacaggcauggcgccaccacacccagcuaauuuuuguauuuuuuuugguagagacaggguuuugccauguuacucaggcugcuccugaaucccugggcucaagcaauccucccaccuucgccucucaaagugcugguauuacaggugugagccaccaugccuggcccacugcaauguacuuugacauucaacaaaaagauggauggauagauggacagacagaagaacaaauagaugguagaauggauacgugauaaagccaggagaggagggguucauuauaaauccagauaguggcuuuguggguguuccuuguacaauucuuucaacaauuuuguaggcuugaaaauauucauaacuugagguuggggguaaaaaugacuugucaaccugguuguucuguuuugcuccacccagcaaggcaucaagagcuccugugaugggcucuuggcaguugacuccccacuacugcucagauauucuccccuccuggaucccuuggcccuccacuugcuggccuuucuacucuucuuugcuuauccuugccagccaccuuugcuggguucuucucagugcuggggagcccagauccugacaccucuucucucuguccacaucucuccuauggcacuuuaaaugucacuauaugcuugugaauaugaaacaaaagucuccaucccaaccugccuguuucaugccagggucuuagauuugucaggcaccuucaacuuggcaauggcccaaacagaaaaauucucuaucuccaucuccuacccuccacauccaauccaauucugucuguuuagccacccaaacacaccaggaaucuaucauggcucuucgcagucaucaucaccacuaccccagccucagccucagcccccucugccacucuggcucccagagcccacccgcuaccccugcaggcuguucuucacauagcagcugggcgggggagggguguauauauauguguguguauguguauguguuguuuuaguguauauguauauauaugcacacacauauauaguguguguuaaaauaaauauuaaauuguaauuuuaaccaucuuaaaguauacaauucaguggcauuaauaauucauaauguguaaccaucaccucugucuauuuccagaggguuuuuaaaauuagcauuauuuuuggccggacacugcggcucacgccuguaaucccagcacuuugggagggugaggcguguggaucacuugaggucaggauuucgagaccagacuggccaauguggugaaaccccauuucuacuaaaaauacaaaacuuagccgggugugguggcacaugccuguaaucccagcuacuugggaggcuggagguagagguugccgugagccaagauugcaucacugcacuugagccugggcgacaaagcgagacuccaucucaaaugaacaaauaaaaaaaaaauuuugcauuguuuuuauugugguaaaauacacauaaauuuacuaccuuaaccauuuuuaaguguacaggucagugguauuguauucauaaugcuguacaaccaucaccaccauucaucuucguaauucuuuccaucuugcaaaucugaaacuguacccgugaaacuccccauucccccuuccuccagcucuuuuuuuuuuuuuuuaaaggcagagucuugcucugucaucaggcuggagugcaguggcacuaucucagcucacugcaaccuccgccuccuggguucaagcaauuccccugccucagccucccaaguagcugggacuacaggcaugggccaacacaccccgcuaauuuuuuuuuguauuuuaguagagaugggguuucaccauguuggccaagauggucucgaucuccugaccuugugauccgccugccucggccucccaaagugcugggauuacaggcaugagccacugcacccggcuccccucuuccuccagcucuugacaacuaccauucuacuuucugucucugugacuuugacuacucugaccaccucauauuugucuuuuugugacuggcuuauuucacuuagcauaauguccuuaagguucguccauguuguaucaugugucagauuguccuuccucuuuaaggcugaaugauauuucguuguguguauguauguauauacauauauuuugcauauuugcucauuugucaaugggcuguugguuguuuucacauuuuagcuauugugaaaaaugcugcugugaacauggguguacaaauaucucuucaagaccuuccuuucaauucauuugaguguauacccagaaguggaauuguuggaucauaugguaauucuauuuauaauuuuuugaggaacugccauacuguuuuccagaguggcuguaccauuuuacauuccuaaaaacagugcacaaggguuccaauuucuccacauucuugccaacauuuauuuauuuauuuuuacagcagccauccuuaacgaguaugagaugguaucucaccguaguuucaauuugaauuucucuaaugauuagucauguugaguaucuuuucuuuuuuucuuuuuuuuuuuuuugagacagagucucgcucaguuguccaggcuggagugcaguggcgugaucuuggcucacugcaaccuccaccuccuagguucaagcgauucuccugccucagccuccugagcagcuaggauuacaagugcccaccaccacacccagcuaacuuuuguauuuucaguagagacagaguuucuccauguuggccagucucaaacucuugaccucaggugauccacccgccucagccucccaaagugcuaggauuacaggugugagccaccauagccgaccuauguugaguaucuuuuagggaguuauuagccauuuguauaucuuccuuggagaaauguuucuucaaguccuuugcccauuuuguuuuucagagacagguucuagcuauuugccuaggcuggucucaaacuccuaggcucaggauacccucccaccuuagccucucaaguaucugggaagacagguguguaucaccacaccugacuccucuuugcucccccccacuuuuuuuuuagacacagucuggcucugucacccaguagugcgaucuugauucacugcaaccuccgccuccugggcucaagcgauucuccugccucagccacccgagcagcugggagcacaggugcccaccaccacgucuggcuuauuuuuuuauuuuuaguagagauggggcuucaccauguugcccaagcuggucucaaacuccugagcucaggcaaucugccugccugagccucccaaaguccugggauuacaggcaugagccacugcgccuggccucuuugcccacuuuuaauuggguuuuuguuuguuuauuucuguuguugaguuguaagacuucucuguauauucuggauaucaaucccuuaucaaauauauaauuagcaaguauuuucucccauucuguggguugccuuuuuacucuguuaauagugccuuuagauguaaaaaauuuuuaaauuuucaugaagucuauuuugucuauuuuuucuuuuguugccugugcuguuggugucauauccaagaaaccacugccaaauccaauguugugaagcuuauccccuauguugucuucuaagaguuuuauaguuuuagcucuuauguuuagguauuugaucuauuuugaguuaauuuuuguauaugauguaaggaaaagguccaacuucauuuuuuugcauguagauauccaguuuucccaacaccauuuguugaaaagauuguucuuucccuacugaauggucuuggcacucuuaucaaaaaucaucugaccguauaugugaggguuuauuucugggcuacguauucuacucuauuggucuauaugucucuaugccaguaccacacuguuuugauuaccguaacuuuguaguaaguuuugaaaucaggaagugugaguucuucagcuuuguucuucuuuuucacaauuauuuuggcuauuugaagggcccuugagauugcaucagagggguguuuuaaaugcacaucugaccuuccuacugccaccuucccaaaccuugggagugcaucaggagaccccagcaagcccagcaggaccugcaugccuucugguccuguccugugguacagcuguccuggaccuuugcuccugaacccucacaugaacaaagcacauccccucaggccuccucuuuuuccaacugccucccauccagcaauucugacauucuacagccuaaugcucucuuuggagaagcccccaauaacuuuuuuuuuuuuuuuuuugagacagagucuuacucugucacccuggcuggagggcaguggcaugaucauggcucauguagccuagauuuucccaggcucaagugaucuucugaccucagccucccaaauacuugggacuacaggcaugcaccaccauguaucuuugcaccauguauuuuuuuuguagagaugggguuucgccauguugcccagacuagucuugaacuccugggcucaagugaucugcccaccucagcugcucaaaguguugggauuacaggugugagccaccaugcccaacuacccccaggaaucuugucucagcaucguaccaacagcacccgccauagcccuccccuccuugaccccagaugugauuguguguuugcuugugugguucuugguggcaguggugccuccugcacuggucugaaggcuucacagagcugagcagcacaucugcuucauuucuaccuguuucuccagugucugggacaguucccggcuaucaauaggacugaaaagcacuguggagggaggcaaggacaggaagaagggagagggcugcccucugacucaguggguuaaacaugccuguccaggccaaaggcugagcaaaauaaagaguagaagcagcaaaaccaacagguuaccagccagcaacugggaacuuuaccaagauuuccuggucccugccucuuccugccucuggcucucuuuccaucaccucccuuuccugccuccccuucuugugccuucuuccacuucuuccaacuccuacuuuauucauggauuucuuuuuuucucuaccauuuuuacugcauuuucuuuuuauucuguuuccuuugcccuuagauaugaaaacaaguguuuuaggaguaaaauuucuuauuuucagaucugaauuaauuuuacauucauucuuagcuuaacuuauggcccucuuccauaacuaaaagguagaauuccaugccuguugucuccucacggccccaguggcuguggccuccacccugcagugguccaagcaaguaagcaggccaaagguccugucuucugggaacauggaccacuucggggcauguacuaagcaacagggcuggcugcuccagagugacuaaaguuuggagaguauuucucuauugacuuggagacuguuuaggucaaaguggcuacucuaaagcaaacugcccaaggacuagcuauucggugggagaaaggccuccugaagggccugccaccuggagauccacuuccauuuuguuuggaggugagcauuggaaggcugggcagacacccuccugggcccaggaaagcagaagacaccuuuaccuccccucaguacacugcuggucccauguccugaaaccugcuccucauuccucucuggcccagguggcaguguggccaggagggaguagagggaaugagacaaggcugcuggcuguagcagagggaucuguacugaacucacagcaccacccccgagccaucuggagcccuggcccuugccggaaagcagugggaugcaggcaggggagagagaggcucggagccacugcacugucucccucccuucuccacgccgcccacccugggaaacugcguaggcucaugguuugccauuggguaggaguuggggaugguauggguuaaauauccuuggcuuggccucagcaaaguccagaccuuggaauggaugagguaagaccaugcuuacuccucuguaguuuuccuagagaggcuuauaaguaauucugacuagagcaaggguggugggaggcagauggaccaccuuggccuggaaggcuggggaugggguggcagcccugcugcuccccacaggggcagagcgugggccccuucacucuagauggugcucugggaggauucagcugaucagacuggaggcucgggcaugcaggcaacccugccucugcaccgcagucacuccugggaugcuguucugaggaugaggacagacuggcaucugcaggagcuccaggccaggaugugcuucuggggcugcucugaguggggcauggaagucccugagaagccuauagaagcaggcuaugccugccccaggccacgguucauauuccccagcaacucacucccauccccacugcccaccccaacugcaucuucucaucuucuacuuagcaggcucaggcccaugccuugucucccucccacccccaacugucagaauagaagccuaacaagggcaacacgggccacccuucuggugcagaaagggguggcgggcccacauguaagucacugaagaacggaaagguggacuagcaggccugagcaggcaugggcauuagcaaaggcacugaugccaauccuuggaauccugcuuuuccuucagagaaaucugacauucaggaaauucaaguauuuguccaaaaccccacaucuacagagagaaaaggagaauggucuuccugccuucuccuugucaguaaggacugaaugcuaacaccucuggcccccuggcaucagugcauugucagagggagggucucuuguggguggugagaaauguucaggccucaaacagaaacacccagucuuucucugugguuucggacagguuaaauuacucgcuugcccugagcuacgaggacuggggauauccagaaagaaauggccuccaccaagaagaguaucugggacugcccuauuuguucugaaccagcuucagccuuagcaaaauggacuauggauggggaaaaugaggcugcaaaucccugggggaaagcuggagaccaagccacuggucuagauccacagcucuuuugcuccagaauaacccagaauaagccaagacuuccuaagacucagucuccucaucuguaaacagggacugugcucugagcuccuuccccaauuuccauacagucucaacaugcucuaggcacucagaaacccagcaaacuacaugggcaggccuccugcucucugcuggaugggcagaauggugaguaccaugucugucuguguaaguguaguagaccuccagcagccuagggcugauaggggaaacuuggguccgcuggccagaaaaacagugauuccagaucucagacacugcugcuagccaaauggagcuaacugugugugauucccaucuccagaucucaucugcuguuucugcagcacucagcuaaaguaauaacucugacugaugccaucauacacaaaaacaaaaacaccaaguccuggugaccacugcccaguggggccaaguucuuucccuccuuucugugcauuuguccucaugcagccauucggcacaacuguucaaucacacuccagaucuacacagcagcuugaguuccaaaccagccaguaagucucuauuagugacacacaugaacaaaguuccauuuucugcggucacauuucaaaguuccaagcacaguuucacuagucaucuuggagaugcccugaaagccuccaugucacuuguguggcccacguccuucucugggacugcuauaucccucuguccacugggaagcugaggaacaacgcauccugccgacacgcccuggacacagcacccaggcugcuggaccuccucaaccaggcucagcgugacuacacuagcagcuccaggcauacuacccagcccacacaggauccccaggacacucuccaguugccagugucugcagugcaucugcgcugggacuggcaguaccucuaccuuuuucuacucugauugggccacuccugggaagugaggaacugaaaaagaaagugagugcuguagcugaguuuccuggaaaaggucacucucucugaccccaucacccacccagacaccuaacuucagaaccagccccuuacacaugcccagaaucucaggccaggcaggaguucagcccagagacaccagggcaaucccagccuucuugacugacauaacaucaaguuagaaguggccaggacagauguagucugacuaggacagaucuaacagcaggugugugagcaaagccugcaaaccuguuuucucaucacauggaagcaugaccaggaaggugaaccugcucuuagcaaagugacaaagagcaacugcacugguucacgaauuaugcuuuaucaccccucaggaagaugugccaaggauuauuuuuuccuuaacaagaacaccacugaaagccaacucuagagaagcgaagguucuaccugaaaaccccagcagagaaggguauucaccaugugugaacuuggagaagggaccaggucagcaauucccaaacugggugccauggaacagcagcuccuaagauguucugugaaagcaagucugggaaaggcugccaaccauagcccuguccuggaacucugugaugccccucaggacacugaaaauccugaggaaucucacagcaaagaaacauuucauuuguccagcccagcauuuguuugaaguauuuggcugagacccacucuucaccaaacacuauggaucugaaguaagugugaggccccaucuucuccuggcccugagccucagcuuccucccagcacaaugaggcagauggacugagugucuccaaggucuuccuacucugcuguuuuuccaggcacagccaaaggcuggcucccuucccaccucauugaagguccugggcuuggagagccuauaggcaggggccaugguuuggugaggaaugggaugcccaccaggagccuggggccaccauguguggcucuuccuuauccccacccaccucacucggaguuguccaggugcugugcugcaucucaagggagcuggaacccagaggggcaaggccagcaugaggaggggaugucccauagcgguacaguccaccugccaagccucccuguuccugugaggggcuucuggcuucucacuggcagaaacacacaggugagcuucccuggccuuaaucguauuguuccaaauucugaacagcaagcacuuaccuaacugaacagugcaggauggccuguuucuaaucacagaugcaauaaucacgagcaugcacgccucuucaggaagcccccacacuccaggagcaacuccaaaggcacugagucaucuccccacaccgacagcuccuuccucagaaucucacacuuaccucucacaaaccacacgucccacacccacagcaccucauggcauauauagacccugaccugugaacaauuauucucacucagcccccucccacaugguccaaacggcuccagcugcuguuaaucccagaggcagccaugcccgugccugcagccagccucucuccauccuauccaaagacggauucuuguggggagaaacagaggcuucuacucccagaggaguaggaggaaaucagcagaccuacucuguucauuuuaaagcgauggccccaacucauuuggugagacaucccacagucauucaaagcauccugaacaaagccaggcuggggcuguggacccagaguccucuuguccucuugggcgaaaaagaagccaaacucacagaaaugguccuacaguggccucuuggugaguguaggacacugucauccuuggugaaugcuugguucccagccugguucuuuaccccaaggucauuucuuuagggaugggguagcugccccaccaccucagguccccagcugacuagaacuaaagccaagaagaggugcuucccagagcccagcuggaaggcaguuuccugccuccccugaaacuuuucuccccucaccagcauccccaucuagggccugcugucaaagacagaggccuccuggccuagaucagggaaauuugccucccucuguguccuagagcugcucauggcccacuccaaaugaguuccauugggaaaaauuguucauaagauugucuuugguccucucgaaggccauuuuuccagaccaaacuuggaccagguuagaaaguaucuucuacucucagacucuacccaagcuuucaggggaugcagaaaucccuugggagaucuggggccaggcccuguucuuugcugccacauccuggaaccaggacacaucccugcaggaggacacaaaugcugguggucaagggaaaugaccaggaaaagagaguuggugaaagaggggaagggaaccaggggagguaugguaaugagguagcaggugaguggggagccggcgcagaagugguuaccugggugagaugaggguugggguugaacccacacugguugcagaccuuguugugacacugggugcagguguugaaguuuggcuggcugggggucgacgugagguccgaagucuugcauaugggacacagcgugcugcugggaaggggggcgaucugagggacggaguagggugaugugggggugcugccucuguccggugacacugagggggaccgcccugaucucuguguccugcugucuaccugcagcguccugcggggaccaucagccuccuggccugcuggucccugugcccuugucucucgggggcucucauggccaggagugguagcagaagccugcuucggaguuggggaagcugcucucugguuacccagggguuccuugggguccagucuccgggaagugcugaaaugacauugaaaaugacuguuagagauacagcuuagagaagcagcuugcggaggucucuaccaagcuaggugacccugccaagccccaucaccacccucuuccuccugcccagaagaaucaucauggcccucauuugcuguguccugugcugagccuugacaagcaucuccaacuugaacccuuggcaccagggcaugaggcaggauuaaaacauguccucucacauucugauaaaguacagacucugauucaguagaucugaguagggccugcauuguaagaagcucuaaggugaugccaauacucucaucugaggcccaugcuuugaauaccaagauucuaaaccuacauguuagaaauaacugggaugggccagguaugguggcucaagccuguaaucccagcacuuugggaggccaaggcagguagaucacuugaggucagaaguucaagaccagccugcccaacauggugaaaccccaucucuacuaaaaauacaaaaauuagcugagcuugguggcgcacaccuguaaacccagcuacaugggaggcugaggugggagaaucacuugaacccaggaggcagagguugcagugagcagagaucgugccacugaacuccagccugggcaacagagugagacccugucuaaaaaaaaaaaaaaaaaggcugggcacguuggcucacgccuggaauccccgcacuuugggaggccgaggcgggcacaucaagaggucgggagaucgaaaccauccuggccaacaugggugaaaccccgucucuacuaaaaauacaaaaaauuagccaggugugguggugggcgccuguaggcccagcuacuugggaggcugaggcagaagaauggcgugaacccgggagguggagcuugcagugagccaagaucgugccacugcacuccagccugggcaacagagcgagacuccauuucaaaaaaaaagaaaagaaagaaauaccuagggugauuuuuaaaauuccgacucccagacugcaccucagucgaauuacauaaaaaucuauggaggcaggacccuggcauuaguauuuuuuccucccuaggugauuccaacaugagcccaaguuacuauauugagauaccauacuggccaaucugcuauauccugccuugaaccccuucagaggcugacccuagauugcuggggaugggggauacugcaaugccuaguuaaugccaucuccuguaucaggggccugccucuacacaaaggagccuuccuucugguagcccucuggcaagccugaugccagaccaaaucuaccaagaugggauaaaguguuacuuuuccacuagugugaagcuggguggggcuggaguuccaggauccagccuugaggaaccacugagugagguccaaugcaucuaacccucaccuccaucccaaucuggcugcaaaggagccaacaguguuggguaguuccaugagguagaaagcaaacugucaggcuaaaugucaaucauauauuccuucuccuuugacccaacuuaaguucaucucugcaauuuuccucuuuuccaguuugaaagaggaugagcacaaaaagccaaagacaaugcuuuauacugcuucccugaaauucucucccugcuuuagucuguacucauuggggugaaugcuggcacucaggaaacagggcugacuugcugagagcaguguggaggcccagccugugcaggagacugcccugguagcugcugccucagugccccaggagaagauucuaaguuugcugcccccaucugaaggccaucugcuugccaaaaagauuuaagagccaacugauagggcagcuuagaacaagccauuucagggggaagaugaggagcccgccuggggacacccaccccaagauacucugcaauccuuccucccuucugaggaacuggcggguagagaaacauauccuuggucuaauaaagacucuccuaaaaaaaagaaacacuauuaaauaguguuuaacauuccugucaucaaccaucaguggcacagaccuaacuauccagucacagacccgccaauugcuucuucagcaagacaaccagaguuugaguccaaccccucagggccaucuuugccaccagcugugaagccuagcauggugguggccacagcaucaguggcccacacugggaaccugggcuucucugggcccuuucaguauacuaauuucuagguauccuaaagaaauauuucccacuuguccaaauuaauaguuucauuuuuuacauaaauuauuuaagacuggaguuuaaaggcagcccuugaaagcaaaucagaagcuacugagagcuuuuuacaacaugugaaugggcuguggcccccucuccagguggugcaagccuucugagaaauguagccauuucuauuguauuuguguugcccaauaaguagcaggcaaucuauauauacagugacuuuuuaaaucaauguuguaucacaauauagucuuucuggagacauuuaggguucuaaacucagcuguggugacagugaauaaacaagcaaugucuucugcacccagcaaagucugcaugcaagggcaguguuccuggcauugaugugcacccacacaccucaugguagccaucaugacaccuggagaucgcgauauauguccacggucuuuguauucucccaucuuccuagaugcuuccuuauauccucuccuugaucuucaagcuuccaaacaccuccuuuugucucuuaacugccacugaugaccugcugaccaucucacaaaaaaagugggacccaccagaagaaaccugcacaaccucagccucccuacuccugucccccaguguucaccugccucccaaucccaaggcccacuucucaccuucacaaauucuccccuauccuucaucauccauuucccccucucuauuggaucauuucaauuaucauacaaacaagcuucucccauccuaaacaacaaaaaaguagaagcagcaguacuuugcuccacuacuccuucagcuacugccccauuucucuccucuucuuuacagcaaaacuccuuaaaauaauuaucuccacuugccuggcaaggugacuugccagguugccaagucauaaucccaacuugggagacugaggcaggaggaucucuugagcccaggagaucaagguuacgguaagcuaggacgacgcugcugugcuccagccugagugacagagcaagacucugucucuaaaauaaauaauaaaagaacugccuccacucacuaccucccacuccucuccucucucccucucaaccuaccccuccaaccuggcuuuugcccaucacuccacagacauuacucaggucacagucaguagggaccuccacaucaucaaauccgacagucacaucucaguuccucaucucauuugaccaucagcagcacuugauccugggugaucacucccuucuuccugaaauaaguucacuauuugccuucgggaauaccaccuucuccugaauuuccuccuccugccuggccacaccuuucuaaucucuucugcagauucuuccucaucugccaaccccagaacaccacuccuuacacuggagagacccagggcucagucuuuacacaaacgugcuucugugaguacucacaaucccuaagucucaagacuuacccagucucagggcuuuaaauccacuuuccacugauacccaccaaaugucuaucucuggcccagaacucugcucugaacucuucaccugucuaacugccaacuccacaucuucacagagaugcccuguaggcaucuccaccuugauacacccaagcugagccccugaucuucccccuaaaugugggccuccuagucucccccuuggugccgucucugccucccuuccugucucauccuaagucaauccagcaguauaucuuguugguuucugaagcuggccacuacuaccuacucccuccuccucaccccaccugguuugagccauucucaguugccaggauaagucuuuuugugugugugugugugagucuccuucuguugcccaggcuggagcgcagugaugcaaucucggcucacugcaauguagcugggacuacaggcgcacaccagcaugcuucgcuaauuuuuuguauuuuuaguagagucggaguuucgccauguuggccaggcuuugaacuccugaccucaagugauccgcccaccucagccucccaaaaugcugggauuacaggcaugagccaccaagcccagccccagaauaaggcuuuaaauacacaagucaggccacuucucugcuuugcuuaagccuugcacuggcuuccuuucccucccaaaggaaaagccaaaagucuuacaauggcccauaaggccccaugagauuuugccccuuucccucuggccucaucucugauuauccucucccugauuccacuucccuuaugccaggcccacuccugacaugugcauuuggccauuggauuugcuguucuuuguuuuuuuuuucuuuuuuuuuucuuuaguuuuguuuuguuuuugagacggagucucacucugucgcccaggcuggaguacagugcugcgaucucagcucacggcaaccuccgccucccggguucaagcaauucuucugucucagccucccaaguagcugggacuacaggcaugugccaccaugcccagcugauuuuuguauuuuuaguagacacgagguuucaccauauuggccagguuggucuugaacuccugaccuugugauccgcccgccucggauuugcuguucuuucugcagacacuugcucccucucaaguuuuugcucugguggcauccuuucagggacacuuacccugaaucuauuuaaaacugugcuugucuccccugccucuuuguucucuguggcacugagcaccuucugacccaucauauaacaaauuuauugcuuuuguauauccuuugggaucccugcauuaaacugccaguucugugugggcacagucuccgugugcuuuccucacagcugugucccagggccuaccacagugccuggcacaaacuggaugcucaauauuuauuuccugaauggggugacuguaagcacuaaaugacucagagcaguaaaauguggccccaaaguuuuaaagcugaggaaacacggcaagugccuggcaugacacucggcccuucucugggucugacuucaugcaggagagaacuucaggaacaauaccuaaaguuccucccuauagcaguuggcuacacccccagccguaccauagaaggcucugcugacaauaauugugguaaugcugaccgagcccucaccaugagccaccugucacauaguaacugcuuuaagccucacagcaaauucacuggauaggaucuauuuugcccauuuuacagaugagaaaacugccacacauaaaaguuaaguaacauacaaagccaucaugacuugcaaaugguggagcugggauuccaauaucuaggccaccaguccauguccuuaaccacaucccacacugccuuucuaggguagcuguagaggggguagaaagcauugcaguuuggguucuuuggauuauuuuuucugaagagcugcuuacguggaagcucccugggaagagguuucaccauuuugcuccccacuauauccuuaggacccagcgccacgcuuggcauugaauggacacucaguaagcacaugcacaacaaccagaacaaugugugaacaguagaaugagcucacagaguggggcugggcuagggccaugacaccauucaccugggacuuaacuagcaacgcugggagacucagagagaaaaugacuccaacaauagauauuuauucauucauucauucaggaauucacauuuacugaccccuggauuaguuccaggcccuauaauagguauugaugguauaaaggaaugauaucucuucaauggaagguggguccacagguguucauauuuuauucuucacaucuuauacauguuguauagguauucuuauauucuuuauaaagucauuuaauauuuaauuaaaauauuuuuuuaaaaaaugauucauauaggaguccaguccuccaagagccucuggucuagaguagagacagaugugcaaacaaaucccugcaagacacacugcugcaugguccagugauggacagaggcagaagucuuugaggaugagaagacauuuaaacugggucuuaaaagaugagcuguucaugccaaggugacagggcaugcuaggcagaggcaacagcaugcacgaagacccagaggcacagcagagcaugcucagucugaguagcuacgcaggauaagcuuggaagacguaagucauuggugcucccagcaccuagaacagcucccagcaaucgugugauaguguguguugaacuaccugagcuaauugggaagcuaaaagcuaaaaugagcacagccuguaagguuuucacauaggggaauguuuagggucucuucaaggagaagaagaugaugagguaggaaaccagugagaauaaggcacuggcccaggagauagucuguguggcaagaggaagggaagguacagcagcagguauucuggcuuuggcuccagggaggaguguuccuuuuaauugagauggggaauccagggagagaagucaauuaguggguaagaaaugggaagcgaaaucacaaaaucacaaguuuggguuugguuugguuguguugagguggggguaggggguaagagacauuaagagaugggucacagcuucaguucaauucagauaaguguagauauuuuuaucugggagaguuacaggucuuguucacagacaauucucaggcuagaaaucacccagaaagcuuuguggggaggaccaaaguucauaggaguagaggagaugucagaaccagagaagucagggaaaggagaaaaaagagaaugaccccacaggguuauagaaguucccaugaggaggagcacucaacaaugccccaugccaugaugagucuacguaugugaaagccgagaagucacaggaagaaaggcuacaccuaugagugccacacaccauaaaugcccaagcccugucccaaaccaguccagcuugggaggggccaguuccuucuccagcugaacacaagggcccaccguggcaggagcuccaggggucauaacugucuguaccacacaccugaacacacauuccaugagagccacagugacuacacccguccaaggccuccucaggagggaagagguaagcccuccaggaggcucuucuuaagagacacaaacaaaggucuccgccaaaauauggccgcugggcaggagaaagaagggaaugaggaaaaagagagggagguguccacaggcaggacccagcccaccccaaggaagacuuggucuuguggauguggccucaucagcagagaggccccuugaggccacugcuccucccagcagccaugggaguccuauugcuggggagggccaggguaaggguguguaagcaaggaggggagaggggugccgccauaaaggagacacaagagacaggaagggcagagagaugaaggaguggcuagaagucaaacagggaagacuagaaaugccuuaucuagggacaaauuauaaaauuauauauauauauauauauauauauauauauauauaauguauuuuauuuuuuauuuuacuuuaaguucugggacacaugugcagaacgugcagguuuguuacauagguauacaugugccauggugguuugcuacaccuauuaacccgucaucuagguuuuaagccccacaugcauuagauauugggacaaauauauuuuuaagauggccaagaaagguaaacaauguacaaacagccagauuucuaccagcuuuucuuccuuucagcauuuaaggcuauuagcugaucagaaacaaucuuaacucagagcuguuugccaaggcaggaaggagcccccuggccacaggagggcugcugggaacgggaacagagaaaauucaguuagccucucccccaccaauccuuaguacccuguggccuccugucccaucccaggaccacugcugggagacauaauccugauugcacuggugagaggcugggcuccccucugucagaagcccccagaaaggcacgaggccagcgucagugacuaaaaaaugcuucagacaccagugacguccauaauggcagaaccaccaggagagauguggcugcccuggugcacagugggaaggagggccugaccaggcugauucagaccagacggaaaagcagccaggcauggagccagugcaggcgccagagggaaaaccaagcugggccccacaaggcagcauuccagagcaugccccccaccgccuucaguugaggauuugaaagaaauguuuuccauuaauaaauggcugucuuugcucaccaggaggggagugaacuuaaagaaacuguuucucuaagucagaguggccagaagagccccacagcuucaaaagagguuuugaugaauucauggcugaccuuucuguaaugggcaauuagggaugggcagaugcugugggaggacccucuccuuugagucccagggcaggaaggacuacugggccacgccagugguuccugugcacccaggcagcaaagcagaggcuguagagcagugggugcuggggccagguccaguguccuagagcuucucucucaggaauggauaugagaaucuagaaaguuuaggcuuagaaaaaaauuccaguuuuugcacaagaaaacauauccuggccugcccagccuucaagccaguggccuccugccuuuuuaaucaugugccucuaucaauacaacauguuucagcaucuccaacauaugaauauucaucuaccaauuauauaaaugcauauuuuuuauaaaacccaccuccccaaguggaaaaguuuuaaaagaugagauagacaauaaauauaaacagaaauuuccauauguucugccuugucccucccguauuccucaaccccuuggcauauguguccuaguugaggccacugcuaagaaaauucuuacacucuuaaucgccaguccuuaaaauagucucuguugguuucccagaccagauucaguccuacccuccaccaggcuccauggaaaguguacuuaggucagugacagggaggcccccagccaucaagggcuggccucaucagcuuccugauuguccuaggggccaaaaagaauuugcagugcugacggcaauagcacaaagguaaggaucuccauaaaacgcagccacagccacagaaagagccugugauugcccaagaagauggcaucaugggcucaaagccucuaaggugcugucugcuggcuggagagggaagguaccacacccaggguuccugggcagggugagaggucaugccauaggcagagcucccuugaggccgacaucuucucuuccuaacuucccagccccuuuauguuguagucccacucugaugguaaguuuccaagacucaaaagaccccagaguaacccagagagcuagguccuugguagagcuggggacaaagcaccaugguggccaugcaucaguauacaccagugacgccagguguauacugaugcacuugggcagacaugcacucaacaccccugagcagacaaacccacaugaaggaaccaucaguguuaccagguaccugccaccuccacucauccuuuccacucagaaaugucuggcaggugggacucuuccuguggccaaauaacaaggcucaauuuguuccaggccagccuguuugggccagaagagaacauguuuaaggcagugagcucugacugcucugauguugcugagagaaagaguccagcaugagacugcaggugggucagcaaggggagaaugugacaagagggacugguaggaacaagacuugcugccauuaaacauaggcuagaagaagcugccagcaucagacggggagaccaccaggagucugaaagcaaggggaauccaggccacaaaugccacaaaaguaaaccuuggggaccucauuccccagcccuggggccugagugggucuacuagauugagaacaucuuucagggaaaauugauuugcuuuugguuuccucugggaccagcuagucuccagaauccagagcaaggauaggaaauaaggguaacauaaggguaacuuuccuuuaaccccaauaaauugguagugaccgccugggaagugggcuugggaaggauucaugggaaagauugucaccaucaauuaagcacaaaggccauggacuugucauccaugauguagaacaaaaccaaacccuuagaccugccucaagugacauccauauucuuguagugucucacuaagaauugcaccaggcccaccucaggccaaauucuagaaagagaccaguagguauacaguagugguucauguggcguuuaccuuugaucuuccccucagucccauuuuuaccucuaucccauggcuuuuccagaauagcaagagcuauauguggccaccagucagcugacgugucaaaugccaugaguucaguauaacuuuaaagacugaaugucggccgggcgcgguggcucacgccuguaaucccagcacuuugguaggccaaggcggguggaucacgaggucaggagaucaagaccauccuggcuaacacggugaaacccugucucuacuaaaaauacaaaaaauuagcugggcgugguggcgggcaucuguagucccagcuacuugggaggcugagacaggagaauggcaugaaccugggaggcagagcuugcagugagccgagaucaagccacugcacucuggccugggcgacagagcgagacuccgucucacaaaaaaaaaaaaaaaaaaaaaaaagacugaaugucucuugcaccauggugccggugacaagcacugugugaaugacggcucaucugagggcaaguaaguaguggugagguuacuacuccuuuaaucacagcaucuccauguaugucuuagggaauuuaucucuagaaguuuuuauucauucauucauuuaaaaagaacucauagaaaccacguuuccugaguucuugaaugucugaacgcaucuucaugaccuuuacacuugaacuacagcugggcauggcgguucaugccuguaaucccagcacuuugggaggccaaggcagguggaucacuugaagucaggaguuugagaccagccuggccaacauggagaaaccccaucucuaccaaaacuacaaaaaaaaaaaaagaaaauuagccaggccugguggcacacaccuguagucccagcuacuugggagguugaggcagaagaaucgcuugaacucaggagguggagguugcagugagcugagacugcaccacuccacuccugccugggcaacagagcaaaaacucugucucaaaaaaaaauaauaauaauaauaauaauaaaaacuugaacaacagguuggcuggauauaaauucuggguuuacacuuucucucccucaggacuucagagauauagcuagccccucuguuuucugucguugauuauuacuguggagagcucugggccagcccuucucucucucucucucucucucucucucucucucucucucucucucgcucuguguguguauauauauauauauaaacuuuuccccucuggaugcaauagagcuauuuuuuucucuuuggaauugagugacaccaccaagauacguuuuuggguugaauauguguguuuuucaaaauucagucuggccuuuuuuguuguuguuguuguuguuuucuuuagauggaguuucacucuuguugcccagucuggagugcaauggcacuaucucuacucacugcuaccuccgccucccagguucaagcaauucuccugccucagccucccaaguagcugggauuauaggcaugugccaccaugcccagguaguuuuuguauuuuuaguagagacgggguuucuccauguuggucaggcuggucugaaacuccugaccucaggugaucugccugccuuggccucccaaagugcugggauuacaggugugagccaccaugccuggccccuggccuuucaaacaaaagauuuauguguucuuuuauuucagggggaaaguuuucuuccauuauaucuuugaauauuuuuguguuccuuuuguuuuguucucuucuccagagauaccaauuauacccauuuugaauuuccuuuguuuuucuauugucugaauugcuggcaacccauaguuuuccccucaccugccacacccugcucaauuccuuggguaauuccaccucccuaguaacuccuuggcaucacacagggcucaaagauacucccuaagcuuauccgcauauguuggcuuugcuaaccaguccaauagaucauaauuuguuuuggcccucuggacucugacaaguguccccuccuaaaauccuccauccuggacugauuuugauccuggacuugaaaaaucauuauuuggccaggcgugguggcucacgccuuuaaucccagcacuuugggaggccgaggcaggcagaucacaaggucaggagaucgagaccauccuggcuaacacagugaaaccccaucucugcuaaaaauacaaaaaauuagccaggcauggcggcaugcgccuguaaucccagcuacuugggaggcuggggaaggaggacggcgugaacccgggaggcggagcuugcagugagccgagauugcaccacugcacuccagccugggcaacagaacgagacucugucucaaaaaaaaaaaaaaucauucuuuguuuguuguauuucagguuacagguguuuguuauuuuuguugaagguaaaguuuucuuuucuguuucuuauuccucuugcaguuuuuggaaggaaaaaaugucuuuuuuccuacuuagucaucagacuuggguaauagcucaucagcaggaaauuccuaggggagcuaggacaggugggagcccaugcugggagccaagagaaauagagggagggaagagaaggcaggcagauggccaggccagagucacuacccagagccaagaccuaggucagcagcuccuugaggagcucccccuaugaucuccuagacucuccagaugacccuggccugggaaaccaaaagaacccaagacauugacauuucucugagaagucacagugcauuccugcacuaagaccuuccuggccuuuccagucuacagugacuggggcacuuuuuaagaguguucuaggccaaccagguaucuccauguguuccccuacuaggcucggcuuucugagggaacgucuaacuggacagguaaauucucaaccaccuuuccacagacuucuaaggagcuuuggccccagugccagcccucuucacauuucccaaccucgucuucugggaguaccauggcucucaaguauagcccaggaguucugaugcagcccaagucacggaggcuccugcuccccagccagccccaggcuuauagacaccugcauuaggaccccgcaugauacaacuuuggguugugcagcaucacaguguucugaccuaggucagcuccuaaagcuaggaagcucaaaucgggagacugaagucauuacauaaagcugagccagcuuuucccagguuccagcuacugcaaauccuacuacuacagccuuuuaccaaggggacaaugcugugcuugucagcucucuucaaaauuuugcuacaaucuggaagucaagacaaacuaagagaaaacugcaagccuuugugacuagggaggaagcaagccacuucccauaguccugccccaaacagggcagaagccaggacuuugacccagaaaccucaaguuccugaccagucaucagacccaauacugaugagagacucagcacucagccugcccuuaggggcugccuggacacaucuuuagcccacaaagauggcuaagggucuacuucacacucagcccugcucuaggcacaggaagagagauacaggccaacaaugcaguuggcaagaucacccaaugucugcaucacuaugcagacacuaaaugcaugcaugaauuugcugaacaucugcugugcucaggggacuggacuggccccagaaacaucccaguguaugaggcaucccagagccuccuguuugagacuuccagggaaacccugccugggaccccuuaauaccuuucuaaugggaagucaguggaauuaaaaaacaaugccuauugucuauuuugugggagaaagaaacaccaagcuaauaucuauucaucccauguuaaaaacuucucuguccagaaaucaggccuacuuguuuuuuuuuuuuuuuuuuuuuugagaugaaauuucgcucuuguugcccaggcuggagugcaguggugugaucucggcucacugcaaccuccaccucccagguucaagcaauucuccugacucagccuccugaguagcugggauuacaggccugagcgaccacacccagcuaauuuuuuguauuuuuaguagagaugggguuuugccauguuggccaggcagaucuugaacuccugaucucaggugauccacccgccuagaaauaacagguaguaaaauaagaaugaaacccucugaacucuaccuuugccuugcaauuucaaauuuauuacaaucaaaagaauacaaagcaaguguucucacacacaaaacuccaucuaucacauacaaaagcaugggaacuugaacgugcauguguguguuuggugggaggggucaguggucugggggcucccagaaggagaaaucaauguggacuggcagagucucagaaaacccuggaggaagccauggggaagaggggugguuccagagaaaagugggccaucuggcuuuccucuacacacagugaccacagaguccucagaguuuggcacagggccuggcccagagcagggcucagugaauguuuguggaaugaaugacccacgggcucgggugauugaucagagaagcagaggcucugugugguagcgguggcuggcacacugggcauagaacacagaggacccacugcaauaaucccggggccugcaagggcaucccaggcugacgauagacaagucugggggagaaaagacucugaagucugguacagagacaugagaguaggcccugcuuaggagucucacucagacagccuguuugaaaaaggccuggcuuuccugugguagcugccacaaucauagucacaugugugaacgcucauaccaguuauauugugcuaagugcucacucuucccaccuaaucccaccauaugcaugucaggcacagcagcauaugcaggguuaccacccgacccuggacacccuugcccacagccuucaaagcacucuaccauguggcuccuccuauccaggcaguuuuuccucuuccugcagugccguuggcagggauaccugaggcuccucaucugaccccaacuucuaacagcucaugcucuauucucuuucuacaaggcaguuuccuuaaaagccaauucaggccaagcgugugguggcucacaccuauagucccagcacuuugggaggcugaggugggaggaucgcuugugccuaggaguuugaaaccagccugggcaacauaggaagaucccaucucuacaaaaaaaaaaaaaaauuagccaagcaugguggcaugugccuguggucccagcuucuugagagccugaggcaaauggaucccuugagccuaggagguugagguugcaguaagcuaugauugcaccacugugcucugcaauccagucuaugugacagagugagacccugucucaaaaaaaaaaaaaaaaaaaaaaagucaauuuaaccuucaaaaccugguuuaagcauccugccgucuaugggcccucaccagauuccucaguucccagaaaucugcuaugccuuccugcagacuuuucauggccucaugcaggagggcuccuugugugcuugugggcccccuuuggccucccucucucuccucaccugcaugcagcaugaagcuaaaugcccagacagggcugaugcuaaggacguauugaccuacugaaugcaauucuuuuuuuuuuuuuuucccgagacggagucuugcucuaucacccaggcuagagugcaguggcacgaucucggcucacugcaaccuccgccuccuggguucaagcaauucuccugccucagccucucaaguagcugggauuacaggcgccugccaccaugcccagcuaguuuuuguauuuuuaguagagacaggguuucaccauguuggccaggagggucuugaacuccugaccucgugauccacccaccucagccucccaaagugcugggauuauaggcgugagccaccacgccaagccugaaugcaauuuuuuauaaggcuuaugaaagacguugagacugauuuaaaaaugccaucucaagacaguaacugagacucaagauuccagcaggaaaaacaucuccucuucuaaauaauacccacugcaacaucaaaggacauuuaaaaaggaaagccauccaccacuuuccagccuuugacauuaccguguccaugguuccacaugccugucagccuaguugcaaaaaaauguacauagaugguggucuguuuuccuuucuugccaacuaugcagucuuuccucugugguuuccuuguuuuucacuucugaagggucuaacucagaaggagaaaucuaauaccuaucuguggcacuuuggcuccugccuuuccuucucucucagcccgugagagucaggaaggugcuggggguucauuucuagauucucccuguggacaauuccacuauuggccacuuggggagauugccucccgcuggcagagaccacccagugagaggcuucccgcaggagaggaccucuaucccuccauacccuccucccauucuucccucccaccucagagauugauucucagucccccucacuguucagccugaugugggguaacagccacgaaggccuggccuaaggccaaaaccucccauccaaggagccaucaaucccuuucagguggcuggacccacccuugacgagaagaggcccucccucugguauacugaccaccaggagcucccuccucuacucucuuccccuuuccagggcucagcgucuagggagcacagauucagggaugcccauguuccuaccugacguguguucacacauugagagcauuaaauucagcuacuguggccuaaauuccaucaagacagaugcugucauaaaggaaauaucugccugagaguggugauuaagaccugagaaaaaagugugaugaacuacugugugcacacgugcauguguguguagugugugcucacacgugagugugcacaugcacugugugcaugugugugugagcaugugacagcauaugugaucacacccuacauggcacguugcuagccacugacuaaugaguaauauacugccaagcaguccugcucccaaagagaagggcaagugcucugagggacuagcccagcccugaaucaccacacccagaaugccugggccagacugagccaacagagggaccagggccaccccagcaugaggaaauacagugccaaaugcccaguaggcacugagaaaaacauuagccuugccuuccucccuuucuuccuucccuggcuugacaacaaguggagugggcaggaagccuggauucugaugccaaaaucuucagaguaguaggaaguaaugagaaguccaggcagcagugcuaagggagagauaaugguagaacuguauggccugugucugacaaaagaggagagaccagggucugagagccaagcucaugcaaagguccgcuggcccagaugaucaggcaagugcaugggggucugcacagcccugcugagggaguaaggagaauauugcaaacugaggcgcccaccaccauguccggcuaauuuuuguauuuuuaguagagaugggguuucaccauguuggccaggcuggucuccaacuccugaccucaggugauccgcccgccucggccucccaaagugcugggauuacaggugugagccaccgugcccagccugcaaauaauauuuuggcauggucagguuuuuacccagcagaaggaaugucuggggaaggugcuggggacucaagguagcuugauaguuccagagaacagagugggguaccugggauggaggaugugaauacagauccaaauacaaaagggggagguggaaggggucagggcuccaaugguggccagagcaccacaaguguguggcuuuacugcaugucagguccucacugggagcuucacggucccuggcacugggcugcacugcagaugcuggcuaccucguagugagcaaggcacacaaggccacucaauucauaggacuugccuuauggugcaggauauaagcaaagaucaagaagacaaauagguaaguccaauucauucagaguaugauaggugcuuagaagaacaauaugaaugagaaaggagagaaacuacccuggugggucagggggcacuucugaaaaggagacaccagagcagagucaugccaaaaauauauauauauuuuuaauauauauuauauauauuuuuaauauauauaauauauauuuuuaauauauauuauauauauuuuauauauaauauauacauauauaauauauguauauauaauauauacauauauaauauauguauauauaauauauauacauauauaauauauguauauauaauauauacauauauaauauauguauauauaauauauacguauauauuauauauuauauguuauauauaaaaaauuauauauuuuuauauaauauauuuauaauuauauauaauauaauauauuauguauauaaauauauauuucuauguauauauaaauauauauuuuuuauuuauauaaauacauauauuuuauuauauauuuauauauauuuauauauaaauagauuuuauaucuauuuauaucuauuuauauagacauaaauauauuuauaucuauauauaaauagauauaaauauauuauauauaaauauauauauuuauaucuauuuauacaaaauauauuuauauauauaaauauauuuauauauuauauauuauauauauuuuuauauauauuuauauauuauauauauuuauauauuauauacauuuauauguuauauauuuuauauauauuauauauaauauauauuacauauauguaauauauauuauauauaauauauauuacauauauguaauauauauuauauuuauauauaauauauaauauauauuauauauaaauauauaauauauauaauauauaauauauauuauauaaaauauauauaauauauauuauauauuauauauauauuauauaauauauauuauauauaauauauauuauauaauauauauuauauauaauauauauuauauaauauauauaauauauauuauauauaaauauaaaauauaaauuauauaaauauauaaaauauauauuuauauauuaaauauauauuuauaaauauauauuuauauauuauauauauuuauaaauauauauauauaauauaauauauaauauauaaaauauauauguauauauauguauauauauauuuuuuugagacagaguuucgcucuuguugcccaggcuggagugcaauggcauggucuccacugcaaccuccaccucccagguucaagcaauucuccugccucagccucccaaguagcuaugauuacaggcacccaccaccaugucuggcuaauuuuuguauuuuuaguagagaugggguuucaccauguuggccaagcuggucucaaacuccugaccucaggugaucugcccaccucagccucccaaagugcugggauuacaggcgugagcuaccgcgcccagccugcaaauauuaauauauugggagaggccaugccaaggcccugggaaggacaucccagaggaagaaaugacagggucuuaggcuuugaggcgggguuguggauugcagguagggagcagcaagcacgccaguguggcugaagggguguagucaggggaaauauggggaggggugggggauguaggugugggaggccugggaaaugggagcagacuguguuccuggacccauucugaaaccucagcaucuuguccagugcucaaauguaugucccugcuccagcuguccaccaggcuguugcaguacucaagaaucuaugcaucauucacacuagccaaaaggugaaagcaaccauguccacugauagaugaauggguaaaaaaaguguguuauauauaugcaauggaguauuauucgacccuuaaaaggaaggaaauucugauacaugcuacaauauggaugaaccuucaagaaacgauaagugaaauuugccagucacaaaaggacaaauacuguagaauuccacuuacacgagguaccuagaauugucaaauucauagagauagaaacuaaaacaguaguuaucaugagcugggggaaaauggggaguuacuacuguucaauggguacagaguuucuguuugggaugaugaaaaaguucuggagauggaugguggugauggcuaaacaacaaugugaauguaucuaauaccacugaacuguacaccuaaaaaugguuaaaaugacacauuuugagcugggcacaguggcauguaccuguagucccagcuacucaggaggcugaggcaggaggaucacuugagcccaggaguugaaggccaaccuggguaacauagugagaccccaucucuuuagaagaaaaaaaaaagguacauuuuaugugacauauauuuuaccacaauaaauaaaacaaaacaagauaaaacaaaagcaaugaaguacugauacaugcauacuacaauguggaugaaccuuaaaaacauuaggccaaguaagagaagccaggcacaaaaggauaccuauuuuaugauuccauuuauaugaacuauccaaaauagauaaauccauagagacagaaagcagacuagugguuagaaggggaggggaaaauggggagcaacugcuuaaugagugugggguuuucuuuugggguggcaaaaaugguuuggaacuagauagaggugaugguugcauaauauugugaaugcauuaaauaccacuggauuguucacuuuaaauugguuaauuuuauaugaugugaauucacagagaaagagagaauccccguguaagaucagagaacccuucuaauggacugcagagauccucaccuuguuccuaccaugagguaggcuucaccuaacacacccacaaaccugcagaccuucauccucuuccugacccauagggucuacucagcacuccucauacaugagggcccucuuagacaaagcuccagucauuugcucauucaauaaucaugguauaaucuaacaggccuacacugccuaggguggcaaccucagcaggcaacuccuaagauacacccuaagaagucaggaaccaaagaaggaauugggcaaggcuggugacaucugcucaccaccacuucaacuggccccauaggaggaacaguuuaccuagguuccacaguagccagguagcaaccaccaacaagaggugggugagucacagaggcaagcacacuuccugugacagcucagaggcuuuccccaggccuagcgcaaagcaggaaggcaucagggugggaccugcggcccucaaguuuccaggcugguuguccuugaggggccagcaguggaggggcaugacuugaggggcccagcccuggccacagauguggaagaccaggccccagcugcccagugagaggcagguauggccaagugggucaggcugaaucugcuggccaagcaugaagugccaggagcaacacugcagggagcugcgugggaugucagcaucuuccgugccaugcccugacucacagcacaccucucccuucacucugcccaugagcgugaucugaagaaggggcagagugugcagaagagaggaggccagacuaugggagaagaucagaaacuggucguuucuuagcaugcgacagacauuuuacacccaucaguuaaucauccucauaacagcacugcacuggaggucuagacgaggaaauugagauuuaaagagagggccagcugcaguggcucacgccuguaaucccagcacuuugggaggccaagcggauggaucacuugaggucagaaguucaagaccagccuggccaacauggugaaaccccaucucuacuaaaaauacaaaaauuagcugggcgugguggugugugccuguaaucccagcuuuucaugaggcugaggcaagagaaucacuugaacccaggaggcggagguugcagugagccaagacagugucauugcacuccagccugggagacagagugagacucuggcuaaaaaaaaaaaaaaaaaaauuuaaagagaggaagugacacauauaaggcagagcaaggcagagcaaggauugguaccuaggucucuccuucccccagcuggugcccuuucccuuguauuguuucaugcuccaugacccuuccugaccugaggcacugccaguugcccuggggcgaauucagucagaaugaguuguccugcugccccagggacacagaggagagcaucagagcacagcaggucaagaggaccugaggaaaucacccugcaauggauguuccucuuucugauccaaggggcaaacucaagggcacuccaaggaaagagcugguggaguucaguggaugaggagcccuuggcuccagccccuaccccaacucacccaaacacaguaggcuaauuaaaggggucccaaguagagaggcucucaggaaacagggcccacuuucccacaucucuacuagggcaaggcuugugucagacaggcagggccagugauggugagcucagggaacaccaaguucuccugcuucucuuauagcucagucauagaacagaacuggggaccacgcaaaagcaacagauggaguccucucuauuucagccaaaugcugugacucauuuaaacaaauccuacaguuuucagaaaucuaauaacuaccuccuuuugaaaaauaaaagaauaaauacuucagaagcaaaccaugcuagugauacauacaaaaacuggaaaacuguucuggugucauucugagacuggauauaaaccagguuacacucaaaaucagccuucacucugaaagcgacaccauggagcagcuucaguaagaaugacggccuccagagaaaucagcuccugguccucccacccaagccuugggcucuauuugccagacuuggcuucacccucaacuuuuuggccaagacacagagccacaagcuggcacuggagggaggugcuauacucagaagacgaaccucaaagaagccaugcucuuauucaggucucuccagucuuccaggcacugguacaccccaugaaaccuuggaaaggaagggagagcugagcacaugggaugcugucacgcccagaaguacaagaaccuccuuaacuccugcacaaccuuauaggggaaggucucacaugugacauccagguggcucuaacgauugccaccugcacugcagaccacuuacucugucccuccaguuuuucuggccauauuucuaagccacuagcugccuuucucuggagcccagggcacucccuacuugccuuccucuuggagaaccaguucuccugucuguuccccuagagggguuucucugagagagcugauaucuaccacuggccacugaccauaucgcaggagcuaaggauaaaaaacuggggcuucuugcccugccuugacuaagccuuggggauggcuccucaccuacuccuuccucauuccuggggggccauucuucugucucagucaccucugucacuggcuccaagaugaggccucuggguuaugacuacagccuccacucauucccagggcuacaggcuccccuccuccaugcaugccauacacaggagccagaagaauuuccuuaacaaaccucagcaaucuucaaggguuccucugccaccuuuauuuacuuauuuauuuuuuagagauggggucuugcucugccacccagacuggagugcagugacaugacugcagcucacuagagccucgaccucccuggcucaagcaauccuccugucucagccuacagagcagcugagauuacaggcacgcuucaccacaaccgacuaauuuuuuuuauuuuuauuuuuaccuuuguggagacagggucuuacuguguugccuaugcuggucccaaaauccugugcuccagccauggaguuuggcuugagcagaagauccuuccaccucagucucccaaaguguuaggauuacaggcauaagccacugcaccugguccucugccaccuuuagacucaagucuaaaugcuuuagccugacauuccaagcccuuggcuucuggucucaccacccuacucaaccucauguacggaaaucccuuaguccagccuuccuuuccagccaggcuggccuccucacagccccugcacgcuccacagauaauuauccuuucgcugacuuccucaccuggacccccauucccuaaacacucccccauuccucugccaacaucccagccccaggcccaggcucaaggccugguucuucaaggccugggcucaggcugccaauucaggaucugccucugaacuccucucucuccuccuccugaacugacacagcauugucgugggaaucaucgacccaccauuucauccccaauucauacauuacacagcaaauuacuugaugaugagcugcuugcuugccucccacugagguuucuucuggcuccuugaauacaaagggccuaucccuguguaggccccagaagcaggccagggccuaagcacacagcaggacucccucacugcuuauacagggaagcaaauucaggauguuuugcuucuuuuuacuccacuggacaaauccuuaacgacagaguccauguuacccacccaggaaaauuccuagggcugugcauggaguaaauaagaauugauaaggaagaacauuuggcuuuauacugaggaguuacaguauauuuuaaaauaacuuaggaaacgacuucuagaaugguggagagaaggggcugguguacacuuucuccaauaaaacaacuuaaguagaggaaauuauaaugaacaaucauuuaaagucucuggaaauuguccuaagggcauacagcaaauggaaaaauauucaaucgagaaagucuacuaaaucuugguaagaacagugagagucugugguguuuggacaacaacucauucccucccccaucccuagcucugucuuaugaaaaugcuauuccagaugcucuacccccagcagguauggccaagaagaugggguccccuuucuucccaguuuccaguuuaagacuacaauuucaccccaagagaggcagaccuccagguuucucaacauccacccucgaaaagguucauguugcugaagcucuauuccagggaaaaauauauccaagaagauaccucuuggggucacugucaaccccagggauuaggaaggcuguggacaugcacuaggccacauucacucaugagcaaucagagcaggauguaaggcagauuugaaaacauuccccaagcaacaaacggcuccaucaauaaaaugaggaagccucaccaguacgaaagaccucagcacaaccucuggccaaacacugauggagcaauaaagcuacucagacccaggggcaaacaggcuuaaaagcaaaauuacacacauccuuagcugccuggaagacucuauacauacccaaggcuccaaccucucagaagcaaucaaaauccaaccugcuaguuucuggcugaauguggggcaaaaauguaaacuccuugaacugugauagcagccuccaaaacaugugcauauccaauacauuaaauauuaaaaaaagaaagaaagauguaguuuuauuucuucuuuucuaaucuauaugccuuuuauuucuuuuucuuauuuuauuugccuuauugcagugacuagaacuuccauuacuauguugaauaacaauagugagaguauaucuuugcuucguacacaguuuuauggggaaagcauucaguuuuucaccauuaaguguaaugguggcggccgggcacgguggcucaugccuguaaucccagcaguuugggaggccgagguggguggaucacuccaaccugggcaaaauagugagacccucucuagaauuuacaaaaaggccaggcauggugccucacaccuguaaucccagcacuuugggaggccaaggcaggaggauugcuugaggccaaaaguucaagggcaaaaaucugacuggucaaagaggcuuaagcacaagauuucaucaauuguugaccuuugaucucucacccaggggugaccccuaggauaaaaaauuaaaacaagaaaaaaaucugauaucagaaguuacacacuucagggaaaacagacuccauagagucaguuuagcuagagucaguuuagucacaucacuaaacaaaugaccaagcaaacaacagcaacaauaucaaacccugaaagaggacagaaucaauaacaaguuguacaauauauuccuuaaaauguccaguuuucaacaaaaaauuaugagacaugcaaagcaacaggaaaguguaacccauucauacacagaaaaccaaguaagcaauagaaacuguuucugagucuagauguugaacucagcaaagacuucaaagcaacaauuacaaauauguucaaagaaccaaagaaaaucacaucuaaaaaauuaaaggaaacuaugaugacaaugucuuaucagauacagauuaucaauaaagagaaauuauaaaaauaaacuagaaauucuguuguugaaaaguacaauaaugaggcugggcgugguggcucacgccuguaaucccagcacuuugggaggccaaggcagguggaucacgaggucaggagaucgagaccauccuggcuaacagagugaaaccccaucucuaauaaaaaauacaaaaaauuagcugggugugguggcagaugccuguaaucccagcuacuggggaggcugaggcaagagaauggugugaacccagaaggcggaguuugcagcgagccgagauugcgccacugcacuccagccuggacgacacagugagacuccgucucaaagaagaagaaaaaaaaaguacaauaaugaaccaagugcaguggcucaugucuguaaucucagcacuuugagaggccaacgcaggaggaucacuugaggccaggaguucaagaacagccugggcaacauagugagacccugucucuacaaaaaaauuuaaaaaugugcugggugugguggggcacaccuguagucccagcuacuggcagguggggagagggggcugaugaaggagaauugcuugagccugggaagucgaggcuguaguaagaugugaacaugucacuucacucuagcccaggugacagagcaagacccugucucuaaaaacagaaaagaaaaguacauuaauggaaaugaaaaaaauccuacauuugagcugguaggagaaagaaacagagaacucaaauauagaucaguaagacugggcaaucugaagaacagagagaaaaaagaauaaagaaaaaugaacagggccucaaagaaaugugggacaccauuaaguauaucaacauaugggaauacaaggaaaagacauaaauuaggaacauaaaaaauguuugaagaaaucaugucugaaaaguucccacauuugaugaaaacauuaaucuaaacauuuaagaagcucaacugucaaucaagaguuuaacauccagcaaaacuaucauucaaaaaugaaagcaaaugguuuaacuuuugaaaauccauuauuguaaaccaccgcaucaacgauauaaggaaaacaauauaauaaucuuaucaacugacacagaaaaaguauuugacaaaagcuaacacccauucaugauuuaaagaaaaaaaaaaguuucagcaauccaggugcaaugguguaggccuguagucccagcuacuuaggaggcugagacagcaugaucacuugauguugggaguucaaagcuguagugugcuaugaucacgucugugacuaagacuacacuccauccugggcaaaauagugagacccucucuagaauuuucaaaaaagccaggcauggugccucaugccuguaagucccagcacuuugggaggccgaggcaggaggauugcuugaggccaaaaguucaagaccagccuaggcaacauagugagacuucaucucuacaaaaaauuaaaauuacaaaaacuuuuuuaauuuaaaaaagucucaucaaguaggaauaacagggaauuauugcaacuucauaaagagcacauacaaaaaaacuauagccaccauuauacuuuuuuuguuuuugagacggagucucgcucugucacccaggcuggaguacaguggugcaaucucggcucacugcaagcuccgccuccuagguucacgccauucuccugccucagccucccgaguagcugggacuacaggcacccgccaccacacccggcuaauuuuuuauauuuuuaguagagacaggguuucaccguguuagccaggauggucccaaucuccugaccucgugauccacccaccucggccucccaaaaugcugagauuacaggcaugagccaccacauccagcugccaccauuauacuuaauggugaaaaacugaaugcuuuccccauaaaacuguguacgaugcaaagauauacucucacuauuguuauucaacauaauaauggaaguucuagucaccacaauaaggcaaauaaaauaaguaaaagaaauaaaaggcauauagauuagaaaggaagaaauaaaacuacauauuucuuuuuuuuaauauuuaaacacaaccacuuggaaaaacuauauauuugcagaugacauaauugucuauguagaacauccuaaagaaccuaccaaaaaaauguaaaauuauuaagucaguucagcaagguugcaggauacaaaauaaacacauaaaagccaaugacacaucuacauacaaacaaugaaggugaagaaaucaaaauaaaaauguaacaccacuuacaauaauuccaaauaaaaugaaauaggaauacacuuaaaaaacauuuacaggggcugggugugguggcucaugccuguaauuucagcacuuugggaggccaaagugggaggaugccuugagcccaggaguucaaggcugcggugagcuaugauuaugccacugcacuccagccugaacaacaaagcaagacacugucucuuuaaaaaaaaaaaauugugaggccgggcgcaguggcucacgccuguaaucccagcacuuugggaggccaaggcggguggaucaccugaggucaggaguucaagaccagccucaacaugcagaaacccugucucuacuaaaaauacaaaauuagccaggggugguggugcaugccuguaaucccagcuacucggaaggcugaggcaggagaauugcuugaaccuaggagguggagauugcagugagccgagaucgugccauugcacuccagccugggcaacaagagcaaaacuccaucucaaaaaaaaaaaaaaaaauuguggccaggcgcaguggcucacgccuguaaucccagcacuuugggaggucaaggcaggcagaucacaaggucaggagaucgagaccauccuggccaacauggugaaacccuaucucugcuaaaauacaaaaaauuagccgggcaugauggugcacgccugugguccuagcuacuugggaggcugagccaggagaaucacuugaaccugggaggcagagacggcagugagccgagauugugccacugcacuccagccuggugacagagcaagcaagacuuggucucaaaaaaaaaaaaaaauuguaggaucuguacguuaaaaauuauaaaaugcugaugaaagaaauuuuaaaaaaacuaaauaaaugggaagauauacuauguucauggacugaacauagucaauguagaaaagauguucauucuucccaaauuaaucuguaaguuuaauucaauuccuaucaaaaucucaguaauuuuuuuacagacauagaaaaacucauucuaaaauuuauguagaaaggcauggacccuggaauacuaaaauaaucuucucaaaaaagaauaaagugggagaaauuauucuacccaauuuaagacuuccuguguagcuacaguaauaaaaacaguauacuacugguggaaggauaaacacauaaaucaauagaggauuuagaauagagaauucagaaauacauccacacagcuauacuaaauugauucuuuauaaagcugcaaaaccaacucaaaggaugaaagacagccuuuucaacaaauggugcuagaacaacuggauauccauauuuguuuuaaaaaauaaauuuuggccuaagcuugaaaccuuauaugagaauuaacuaacaauggcuaauagacuuaaauguuaggaaaaauuucaggaucuacaacuagacaaagaguucuuagacuugauacuaaaagcauaagccauuacaggaaagacugacaaauuagaucucaucaaauuuaaaagguuuugcuuuguuaaagcccaugugaaaagaaugaaaagaaaagcuacagacugggagaauguauuugaaacuacauauuuaauuuuuaaaaacuaguaucuagcggccgggcgugguggcucacgccuguaaucccagcacuuugggaggccaaucgccagaucaggagaucgagaccauccuggcuaacacggugaaacccugucucuacuaaaaauacaaaaaauuaggaaggcgugguggcgggugccuguagucccagcuacucaggaggcugaggcaagagaauggcgugaaccugggaggcggaguuugcagugagccaagaucacgccaccgcacuccagccugggcgauagagcgagacuccaucucaaaaaaaaaaaaaaacaaaaaacaaaacaaaacaaaaaaaaaacuaguaucuagaauauauaaagaacccucaaaacucaacagaagaaaaaaauuuagaaaacagcaaaaaacaugaacagacacacugaagaggauacacacauggcaaaaaguguaugaaaagauguucaacaucauuagccauuauggaaauacaaauuaaaaccacaacaggauucacuacagaccuauaaugauaacuaaaaugaaaaaacaaccaaauacuuacaaagaugcagagagacugaaucacucuuacauugcugguggaaauauaaauggcacaaucaaucuggaaaagcuuggcaauuucuuuaaaaacuaagcaugcaacuaccaaaugacccagcgauuuuauuucuggacauuuauaccagaaaaaugaagacuuguguuugcacaaaaaucugugcaucaauguucauaaaagguuuauuuguaauagaccaacacuggagucagcccagaugaccuucaacagugaaugguugaacaaacugugauacaugcauaccaugaaauacuacucagcaauaaaauggaaugaacuauugacagauacaacaaguggaugaaucucuagggaauuacacugagugaaaaaagccaaccccaaaagguuacacauuguauuauuccacuuauacuacauguuugaaauaacauauuuugcuuuaauggaggauagauuugugguugccagggauuagggaugggguggaaggguugggcaaaacgaggugaauacaguuguaaaaagacaacacaaaggaucccugugcuuggaacugcucaguaucuugacuguggucauagauacacaaaccuacacaagugauaaaauuguauacaacuuaagcacacacaaaugaguacaaguaaaacuagaaaaaucugagaaagauugguggauuuuaugaauauugguuauaauaucauacugcaccauuuugcuaaacauuaccacugcgaaaaauugggcaaaauguaaaaggaaucucucuguauuauuucuuuuuuuuuuuuuugagauggagucucgcucugucacccgggccagagugcagcggcgcuaucucggcucacugcaagcuccgccucccagguucacaccauucuccugccucagccucccgaguagcugggacuacaggcgcccgccaccacgcccggcuaauuuuuuguuuuuaguagagacgggguuucaccguguuagccaggauagucuccaucuccugaccucgugauccgcccgccucagccucccaaagugcugggauuacaggcgugagccaccgcguccggcccucucuguauuauuucuuacagcugcaugugaaauucaauuuuuaaaaaauugagaaauaauuggucgggcacgguggcucacgccuguaaucccagcacuuuggaggcugaggcggguggaucaccugaggucaggagugccagacuagccugguuaacauggcgaaaccccgugucuacuaaaaauauaaaaaucagccaagcaugguggugcgugccuguaaucccagguacucgggaggcugaggcaggagaaucgcuugaacccgggaggcagagguugcagugaguggagaucaugccacugcacuccagcaugggacagagugagacuccaucucaaaaaaauaaauaaauaaauaaauaaauaauugagaaauaauaaucacaauuuuaaaaaaaucaacugucucucucaaauuauccuaucccauugguuugucaguuuuuaaaaauugugaaugagagauguguugauauuucaucauuuuauaauauuacucugucuuuggcucucaacuuuaucagagccagugaucuuuuaaauaacaaauauaaaggcaguuugaaaaucucuggaagaggcugggggcggugguucaugccuguaaucguacccuuugggaggccaagguggguggauggcuuuagcucaggaguuccagaccagccugggcaacaugccaaaaccccaucucuacauaaaauacaaaaauuaguugggcauaguggcacacaucuguagucccagcuacucaagaggcugagguagggaggauggcuuuagccugggaggucgaggcugagaucaugccacugcacuacagccugggugacagagugagacccugccucaaaaaaaaacaaaaacaaaaacaaaaaucuggaagaaauagauuaguuuuaaauaaaggcaaaauaaagauauuaccagauaaacaaaagcaggaaaaaaaauuguugguggcagauugccuuacaagaaauaacaaaguuauuuaggcagaaagcaagugacaccacacaauaccauaauuugaauccacacaaaaagacaaagagugcugguaaagguaauuagguagguaaguacaaaagaaagcauaauugcauauuucaucucuuuuacucucuuaacugaauuaaaaagcaauuccauaaaacaauguguguaugugucuguauuguuucuauguaacauauagaaguguaauauguuugacaaaaagagcacaaaggagguaagugggaacaaagcuguauugaaguaaggaaaugaucagauaguaacuugaacccacaggaaugguaaauaagagggccgauauacaacaaacucuacaaauauacacuugcucuccuuuuauuccucucagcuucuuuuuuucuuuuuuuuuuuugagauggagucucacucugcugcccagacuggaguacaauggugugaucucagcucacugcaaccucugccuccgggguucaagggauucuccugccucccagggcuaauuuuuacuauuuuugguagagacgggguuucaccauguuaguuagccaggcuggucucaaacuccuggucucaagugacccacccaccucggccucccaaaguguugggauuacaggcaugagccacugaaccuggccucucucacccucuuaaaaagaucauauaagguuauauaacauuauauaauauuacauaaagucacaauuauaacuauauaauuauguguaauaauuauuaugcuuuauuggguuuauaacauauguagauauaauauauauaacaauagcacaaaaaugggggaaguaacguagcuguauaggaguaaaguuucuauauuucacuggaauuaaguuagcauuaauuugaaguagauugugauaaauuaagauguguauuguaagcccuaaagcaaccacuaggcacauaauuuuaaaauauauaauuaaaauguuacacuagaaaaugcccacuuaauaaaaaaaaguaguaaauuacaguggaagagauaaauaaaaaagcaugagacaaauaguaaaaaaccaaaaugccagauauaaauccaaccauauuaauaauguuaauuaaaugaaaauggauuaaauaaucuaaaggcagagauuaucagauuuguuuuuuuuaaagaauccaacaaaaggcuaucuaaaggacauauuuuagauucaaagaaacaaauagguugaaauuuuuuuuaaugggcaaagauuaucaugcaaacagcaaccacagacagcuguaauggcuauacuaauaccagaccaaacagacuuuacaacacaaaacaaauguuauugaaaaugaagauuuggcggggcguggugguucacaccuguaaucccagcacuuuaggaggccgaggcgggcagaucacgagguuaagagaucaagaccauccuggccaacauggugaaaccccgucucuacuaaaaauacaaaaauuagcugggcgugguggcacacgacuguagucccaucuccucaggaggcugaggcaggagaaucacuugaaccugggaggcggagguugcagugagcugagauugcgccacugcacuccagccuggcgacagagugagacuccaucucaaaaaaaaaaaacaaagaaaaagaaagaaggaaaaauaaaaugaagauuggccaggcaugguggcucaugccuguaaucccagcacuucaggaggccaaaggcuguuggaucgccugagcucaggagauugagaccacccuggguaacauggugaaacaccgucucuacuaaaauacaaaaaaugagccgggcgugguggcaugcgccuguagucacagcuacuugggaggcugaggcaggagaaucgcuugaaccuggaaggcggagguugcugugagcugagauugcgcaacugcacuccagccugggcgacagagugagacuccaucucaaaaaaaaaaagaaagaaagaaagaaaaagaaaaugaagauugaagauugauaaagaggucaauccauuagaaagauauaacauuuguaaacauauacacauacauagaccuaagaacagagccccaaaauucaugaugcaaaacugacggaauugaagggagaaauagacaauucaacaacaguaauuggauacuucaauacuuuauaauaauggauagaacaacuaggcagaagaucaacaagaaaauaaaaaacuugagcaacacuauaaacuaauuagaacuaacggguauuuaaaaaacacuccacccggccgggcgcgguggcucacgccuguaaucccagcacuuugggaggccgaggcgggcggaucacaaggucaggagaucgagaccauccugaaaccccgucucuacuaaaaaauacaaaaaaaaaaaaaauuuagccaggcgugguggcaggcgccuguagucccagcuacucgggaggcugaggcaggagaauggcguaaacgcgggaggcggagcuugcagugcguggagaucgcgccacugcacuccagccugggcgacagagcgagacucugucucaaaaaaaaaaaaacacuccacccaacaacagcagaaugcgcacucuucucaaauguacacggaacacccuccagauuaggccauaaacuaggccacaaaacaaaccucaaaaaauugaaaagacuugaaaucauacaaugaauguuuucugaacacaauauaauuaaauuagaaaucaauaacagaaauaaauuugcagaauucacaaauaaguguaaauugaacaacacauuccuaaauaacucaugggucagagaagaaaucacaaaagaaauuuuaaaguacuuugagaggaauuaaaaugaaaacacugcauaucaaaacauuggauguagugauagcaguacucagagaaauuucuagcugcaaauaccuauauucaagaaaagaaagauucauuucaauugaugcugaaaaagcauuugaaaaaauucaacaucccuucaugauuuuaaaaaaaacccucaaaaaacuggggauagaaggaacauaccucaaaauaaugaaagccauauacgacagaccuacagcuagugucauacugaacggggaaaaaucgaaagccuuuccucuaagaucuggaacaugacaaggaugcccacugucaucacugcuauucaacauagugaggcaggagaauagggucuggaggaagggaaccuaaggucaauuugcacugacuuccuagaacugaaucaaaaggaaaaucccggccgggugcaguggcucacaccuguaauuccagcacuuugggaagcugaggcaggcagauuaccuaaggucaggaguuugagaccagccuggccaacauggugaaaccccaucucuacuaaaaauacaaaaauuagccgggcgugguagcaggcgccuauaaucccagcuacuugggaggcugaggcagaagaaucgcuugagcccaggaggcgaagguugcaguuagccgagauugcgccacugcacuccagcccaggcgacagagcgagacucuugucucaaaaaaaaaaagaaaagaaaagaaaagaaaagaaaagaaaagaaaagaaaaaccccaacuuucccugcccaaguaacaaaaugacagaaguuacuccuuuugcauggcagaugagaaacagaaaguaccccugauugguccucucccgcaaccaaucagacauuugcauaggguguaacuuuguaacuucacuucagccucugacugaucgccuuccacaaccaaucauacuggucacaggcuaccacuucaucuacacagggagcaaaucaagcaaccaauaggaaacaucuaaagacuauuuaaaccccagaaaauuguguaagcagcacucuugagcugcuugcucuagccugcucgcagucuguggagugcacuuucauuucaauaaaucuaugcuuucauugcuucauucuuucguuuguuuugugcguuuucuccaauucuuuguucaaaaugccaagaaccuggaccacuuguagucaagacccuccaccaguaacaacaguacuuaaguccaaucagacaagagaaagauauaaaggggauccaaaggggaaaggaagaagucaaauuaucccuguuuacugaugauauggucuuauauuuguaaaaacuggaagaugccacaagaaaacuauuagaauugauaaauucaguaaaguugcaagauacaaaaucaacauacaaaaaucaguaguauuucuauuacuauaugccaacagugaacaaugugcaaaagaaauauaaaaaguaaucacauuuacaauaaccacacauaaaauuaaauaccuaggaauuaacuuaaccaaagaaguaaaagaucucuauaaggaaaacuaugaaacacugaagaauuaaauugaagaggacaccaaaaaauggaaaaauauuccauauucauggauuggaagaaucaauauuguuuaaauguccauacuacccaaagcaaucuacaaauuaaaagcaaucccuaucaaacuaucaaugacauucuucacagaauaaaaaaaaauccuaaaauuuauaugaaaccacaaaagacccagaacagccaaagcuauccuaagcaaaaagaacaaagcuggaagaaucauauuaccuggcuucaaauuagacuacagagcuauaguaaccaaaacaacauuguacuggcauuuuaaaaaggcacauacaccaauggaacagaauagaaaacccagaaacaaguccacacaccuacagugaacucauuuuugacaaaggugccaagaacacacacuggagaaaagacaguaucuucaauaaauggugcuggggguaggguauggugucucacaccaguaaucccagcacucugggaagcugagauggacggauugcuugaguccaggaguucaagaccagccugggcaacauggugaaacccugucucuacugaaaauacacaaaauuggcuggugugugccuguagucccagcuacccaggaggcugagguugaggcugcagugagccaugauugugccauugcacuccagccugggcaacagagugagacccugucucagaauaaauaaauaaguaaauagauaaugauagauagauagauagauagauagauagauagauagagcugggaaaacuggauauccauaugcugaagaaugaaacuagaccccuaucucucaucauauacaaaaauaaaaucaaaauggauuaaggacuuaaauauaaguccucaaacugugaaacuacuauaggaaaccauaggggaaaaucuccaggcaaaacuuucuugaccaauacccaacaagcacaggcaacuaaaacaaaaauggacaaauggaaucacaucaaguuaaaaagcuucugcacagcaaaggauacaaucaaaaaagugaaggaacaaccuacagaauggaauaaaauauguacaaacuaaccaucugacaagugauuaauaaccaaaauauauaaggagcucaaacaacuauauagaaaaaaaucuaauaauccgaucaaaaaugaacaaaagaucugaauagacauuucucaaaagaagacacacgaauggcaaacaggcauauaaaaagguauucaacaucauugaucaucagagaaaugcaaaucaaaacuaaaugagguaucaucucaccccaguuaaaauggcuuuuauccaaaagacaggcaauaacaaaugcuggcaaggauguagagaaaagggaacccuuguacacuguuagugggaauguaaauuaguacaaccacuaugaagaacaguuuggagguuucucaaaaaacuaaaaauugggguuagacgcagcgcccaggggcggcugaagaaacgugagggguguggacaaauccuccaagauuuaacuuccaaggaaaccggcggcggaccggguggaggaggcaaggauguguggccagugcacacggagugcaaggccgccuaguugggagccgcaagagccugccugguguggcaggcacacgaaacccaaucccugucuguccgcugcggccugggaagggagcgccggccucaccagaggaagaagcacgaggggaggaguuccgagaggaaauaauuagugaaauaugugcagaagauacugggauguggauuuaauuccggauggacaguggugcuucugauucccucagucuguuuccccacccacgaucuccucuuuccuugaccuagacacaccaaaaauaauucaauaaaauaaaaauuaaaauuaaaaaaaaaacaacuaaaaauugggcuaccauaugauccaucaaucccaccacuggguauccacccaaaagaaaggaaaucaauauauugaagagauaucugcacuccugaguuugucgcagcacuguuuauaauagcuaagauuucgaagcaaccuaggugucuaacaacagcugaauggauaaagaaaauguggcacguauauacaguggaguacuacucagccauaaaaaaagaaugagauacagucauuugcaacaauacggccagaacuagagaucauuauguuaaaugaaauaagccaggcacagaaagacaaacaucgcauguucucacuuauucgugggaucugaaaaucaaaacaauugaacccaugaacauggagaagagaaggauaguuaccagaggcugggaaggguagugggagggugguggaagaggugaggaugguuaauggguacacaaaaaaauaguuagaaagaaugaauaagaccuacuauuugauagcacaacaaggugacuauagucaauaauaacuuaauuguauauuuuuaaauaacuuaaagaaugugauuggauuguuuguaacucaaaggauaaaugcuugaggggauggauaccccauucuccauggugugcuuauuucacgaugcaugccuguaucaaaacaucucagguaccuuauaaauauauacaccuacuaagugcccaaaaaaaugaaaaauagaaaauaaaacaaaaaagagaaaagaccucaaaccaauaaccuaaacuuccgacuuaauacuuagaaaaagaagagcaaacuaaacacaauguaaauauaaugaagaaaauaauaaagauuagaggugaaauacagaauagaaaauagagaaagacaauaaaaccaaaagaugguucuuucaaaagauaaaaaaaaaaucaauaagccuucuuuuaacaaagaaaaaaagauucaaaugacuaaaaucagaaauaaaagaaaggauguuacuaccaaucuuaaauaaauuaaaaggauuggccgggcgugguggcucacgucuguaaucccagcacuuugggaagccgagguggguggaucacgaggucaggagaucgagacccuccuggcuaacacggugaaaccccgucucuacuaaaaauaaaaaaaauaaaaauaaaaauuagcugggcaugguggugggcaccuguagucccagcuacucagaaggcugaggcaggagaauggagugaacucgggaggcagagcuugcagugagccgagaucgcgccacugcacuccagccugggcgacagugcgagacuccaucuugauaaauaaauaaauaaauaaauaaaucggauugcaagagaauacuaugaacaaccacacauccuuagguaauuuagaugaaauugacaaauuccaagaugcaaacuaucaaaacugacucaggaagaaaugaaaaaucggaauagaccuauaacacauaaauaaacugaauaaguaauuuuaaaacuucccacaaagaaaagcuuaugcucaguugucuucacuggugaauccuacuaaccauugaaaaagaauuuauuuuuuaaaaauuuuauuuuauaacagacagggucuugcucugucauccaggcuggaaugcagugacacaaucauagcucacugcagccucgaacuccugaguucaagugauccucccaccucagccucccacagugcugggauuagaggcaugagccacugugcccagccaaaaauaaauuaauaucaacaaagauacuacaagaaaacuacagaucaauuuuccuuaugaaaagagaugcaaacauccuuaagaaaauacuagcacacugaauucagcagcauauuagaaguauuguacauccuucuauugggcuuuauuucuggaaugcaagguugacugaacauccaaaaaucaaucaauguuccagacacaguggcucacaccuguaaucccagcacuuugggaggccgaggugggcaaaucacuugaggccaggaguuugagaccagccuggccaauauagugaaaccccaucucuacuaaaaauacaaaaauuagccaggaguaguugcacgcaccuguaaucccagcuacucuggaggcugaagcaggagaaucucuugaaccugggaggcagaggcugcagugggccaagauugcaccacugcacuccagccuugggaacagagcaagacccugucucauaaauaaauaaauaaauaaauaaauaaauaaauguaauacaccauauuaauagaaugaagggaaugaagggaagaaacuauauguuuaccucaauugaugcagaaaaagcauuugacaaaagucaauacacuuucaugauucaaaagacuuaagcuagaaauagaagggaacuuucucaauaugauaaggacuauuuaugaaaaguucacagcuaacauaauacucaauagugaaaaauuagaagcuuucccuuuacaaucagaaacaagacaacgaugugcaaggaaguuuuaccauuucuaucuaacauaguacuggaaguccuagucagagcuauugggcaagaaaaaaaauaaauaaaggacauccaaauuggaaaagaagaaguaaaauuaucucuaccugcagaccacaugaucuuacauguagauaacccuaaacaggccacaaaaaaguuagaacuaauaaacaacuucagcaaaacugaaggauauaaaaucaacacacaaaaggcaguucauuucagcugggccuguaguuccaguuccucaguaggcugaagcaagaggguugcuugagcccagaaauuugagccuguaguguguuaugacugcaaauguaaauagccacugaacuccagccugggcaacacagcaagacccugucuugaaaacaaaaauaggcaaaggacuugaacagacauuucucuaaagauuuacaaauggccaauaagccauugauuagaaaaaugcaaaucaaaacuacaauaagauaccacuucacacucuuuaggcuauuacuaaaaacaaacaaaauaaacagaaaauaacaaguguugacaaggacguggaaaaauuggaacccucauacaaugaugguggaaauguaaaacgguacagcugcuacagaaaaauuuuuggcagcgccucgaaaagccuaacauaaaauuaccauaugauccaggaauuccacucuuagguuuauauccagaggaaguaaaaccagggacuugaacagauacuugaaugccaauguuuauuacaccauuauucacaauauaguagcccccacuuauccucaggggauauguuccaagacccccaguagaugccuauauacacaaaguuuguuuuuuuuuguuuuguuuuuuggguuuuuuuuugagacagagucuugcucucucuucaggcuagagugcaguggcgcgauuucggcucacugcaaccucugccuccuggguucaagcaauucuccugccucagccucccaaguagcugggacuacaggcgcgugccaccaugcccagcuaauuuuuguauuuuuaguagagacaggguuucaccauguuggccaggauggucucgaucuccugacuuugugauccgcccaccucggcuuccccaagugcugggauuacaggcguaagccaccaugcccagccuuguuuuuuccuacauauacaaaccuaugaugaaguuuaauauauaaauuaggcacaauaagagauucacaauaacuaauaauaaaauagaacaguuauaacaauauacuguaauaaaagcuauaugaauguguucucucaaaauaugauuguaccauaccguggguaacuaaaaccacagaaagcaagaccgcagauaaggggggacuacuggagucaaaaaguagaaacaacccaagugcccaucaauaaauggauaggccaggcgcaguggcucaugccuguaauuccagcacuuuaggaggcugaggugggcagaucacuugaggucaggaguucaagaccagccuggccaacauggcgaaacccagucuuuacuacuaaaaauacaaaaauuagccuggcaugguggcacacuucuguaggcccagcuaccugggaggcugaagcaugagaaucacuugagcccgggaggcagagguugcagugagccaagauuacaccacugcacuccagccugagugaugagagcaaaacccugucucaaaaagaaaaaaaaaaaaaaguuaacaggcgcugaagaaaggggucaauggggaggugcugguuaauggucagaguuuggggugauuaaaaauuuuagaaauagauaguggugaugguugcacaacaugaaucaugaauauacaguaauuaaugccacuaaauuguacacuuaaaaugguuaaaauggcaaauuuaugauauuuauauuuuaucaccauuuuuaaaagauuaauaaugugaccaggcacaguggcucaugccuguaaaucccagcacuuugggaggcagaggcaggaggauugcuugaguacaguagcucgagaccagucuagacuauauaguaaaaccugauaucuacaaaauauuaaaaaauuagccagacaugguggugcaugacuguagucccuuugggaggcugagaugagaggacugcuugagcccgggaggcugagaugagaggacugcuugagcccaggaggcugaggcugcagugcgucaugaucgcaccacugcacuccagccucggugacagagcaagauccuaaaaaaauuuauaauguaauacguaauaaaccacugaauuauacucuuuaaauggguaaauuuucuggcauauuaauuauaucucaauaaaacugucuuaagauuucauauuaaucuuucacaaacucuuccaaaaaauagaacaggauaaaacacuucucaacucauuccaugaggccacaauuacccugauaucaaaaccacacauaaauuggaugugguggcacaugccuguagucccagcuacucaggggaauaaggugggaggaucacuugagcccaggaguuugaaucuagccucaggaacauaaugagacccuguaucuaaauaaaaugaaauaaacaaaauaaaauaaucaaauuaaauuuguaaaaaaacagacauaaacaucacaagaaaacuuuagaccaauauaucuuguuacuauagaugcaaaaauuauaaacaacuacuagcaaaacaaauccggugacauauagaaaggauuuaauauaauaaccaaaugaauuuuucucagacaugcaauuauggcuuaacaucuaaaaaaucaauuaauauagcauauuaauagaaugauggacaaaaaccaucuaucaagauuacaaaaacuacaugaucaucuugauagaugcagaaagcauuucauaccuuuuccaauucaauaccuuuuuaugcuuaaaaaaauuuaacagacuagaaauagaaaggaauuucaauuuuuuaaagcgcaucuagccaggugcgguggcucacaccuguaaucccagcaccuugggaggccgaggcugguggaucaugaggucaggaguucgagaccagccugaccaacauggugaaacccugucucuacuaaaaauacaaaaaaaaaagaaagaaagaaaaaaucagcugggcguggugacgggcgccuguaaucuuagcuacuuaggaggcugaggcaggagaauugcuugaacccuggagucggaggcugcagugagcagagauccugccacugcacuccagccugggcaacagugcgagacuccgucucaaaaaaaaaaaaaauuguaaagcgcaucuaugaaaaacccauaccuaaaaucauacuuauugauaaauggauaaaaugugguacauccauacaaugaaauaucacugggcaauaagaaggaaagaaguaacuggcugagugcaguggcucaugccuguaaucccagcacuuugggugccugagacaggaggaucacuugaagccaugaauuugagaccagccugggcaacauaggaagauucugucacuuaaaaaaaaaaaaaaaauuagccaggcaugguggugcaugccuguaguccuagcugcuugggaggcugaggugggaggaucucuugagcccaggaguuugagguuacaguaagccaugaucauaccacuguacuccagccuccauguccucugggugacagaguaagauucccucucuaaacaaauaaaugaauaaaggaaugaagugcugauacacacuacaucuuacauccuggaugagccuuggaaaacacacuaagugaaagaagccaaacccccaaaacacacauugcaugauuccauuuauaugaaauguccagaauaggcaaaucuagagagguggauaguagauuagugguuaccuuaggccuggaggauagauagaggggggaagaauggaaagugacauuuuggguaugggguuucuucuugugggugaugaaaauguucucaaauuguagcuuugggccaggugcggugguucacaccuguaaucccagcacuuuaggaggccgacacggguggaucacgagaucaggagauugagaccacauggcuaacacggugaaaccccaucucuacuaaaaauacaaaaaauuggccgggcaagguggugggcaccuguagucccagcuacucgggaggcugaggcaggagaauggcgugaacccaggaggcggaacuugcagugagcugagaucgcaccacugcacuccaggcugagcgacagagcgagacuccgucuuauaaaaaaaaaaaaacuguagcuuugguuguagaacucuaagugcacuaaaaaccauuggauggcacaguuaaaaugagugaauucuaugguaagugaauuauaucucagaaagauauuuuuaaaagaguaacuagccaggcacaguggcuugugccuauaaucccaguuacuugggaggcuguggcagcauugagggcaggaguuugagaccauccuaggugggcaacaaggacgguccugucuuuaagaaaaggauagccgagccuacagcccccaaauaugcaauauucguuucuaaauuguaagcauguauuagugugcuaauguauuaagcauccacaaaauuagaaaauaacaagugauguuuaaaaugaaaaaagaaaacuuaggugugaaaccuguaaugauuuaaaugccuuucacugcugggaaucaggacaguaaccccgcuacccccagcaguucucagcucacucuauguagcaggcucuuccuuuacauaauaccugccuaacaaccacacagguggguauucuuaucauuuccauuuuuuccaagaaaacuaaagauuaaagaaacaaagcaagcugacgcguuggcucaugccuguaauuccaccacuuugggaggccgaggcggguggauuacuugaggugaggaguuugagaccagccugggcaacaugguaaaaccccaucucuacuaaaaauacaaaaauuagccaggcaugguggugcaugccuguaaucccagcuacuugggaggccgaggcaggagaaucgcuuuaaccugggagguggagguugcaguaagccaugaucaugccacugagcuccagccugggcgacagugcgagacucugucucacaaaaaaaaaaaaagaaagaaaagaaaagaaaaaagaaacaaagcagcugaaggucaacagaaaaacaggcagcaaggcuaggaccuggccugggaacuccuggccuccaagcccugcucucacaaucucaacccucugaaaugaagugcuuccucugaaaugcaccaagaaggccaguuccuaggaaacaugucuccuagcuguuugccauuucauagaagauaaaaaauguucccaguaggguagaauuugaguuaaaacccaggaacaaacucuuguaauuugauugccuagaaauucaaaauucauauuccugggguaaauuuagaggcagaagccucucacaagccauagggaaacaagcaagauagcgaagaaauucgggagcaggacauaauuaguagccaacauuaaguacugccuagaacaguguuuggcauguaacaggugcucaauacauauuuguugaauaaaugaaugacuccaagcacuaucgugcccuggaaaggaggucugacccaagguggagauggacugcacuagaaaaaaauuucaaauuccaaacaccaaaaccuuuggagaagaguuccagagagaugggaaccacccuccuuccggauugggguugagucucugaagggacacaggcagcauauaccaauguagggcaccaucuggcaucaagaagaaaggcaggaugcuggcugcaaaugacuacucaugcugcaauggcccugcucccagggaaccucugaaagcagucuucugcucagaugaguaugagccugagcaaggcagacugcccagauaugaggguaugaauaaagaaagugaggccaugcucaguggcucacgccuguaaucccagcacuuugggaggcugaggugggugaaucaccugaggccaggaguucaagaccagccuggccaacauggugaaaccccaucucuacuaaaauuucaaaaaauuagccgagcaucauggugggugccuguaauccuagcuacuugggaggcugaggcagaagaaucacuuuaacccaggagauggagguugcagugagcugagaucgugccacugcauuccagccugagugacagagcaagacucugucucaaaaaaaaaaagaaaaaagaaaaaagaaaaaaaaagaaaagugaauucacaccucuuaccaaggaagaaacagggaauuucccagauauuccugcauucaagagacagcccuggccagaaagggagacaagagccuggaagcucccuggaauccaaaggcagaaccuaggugacaaggccacuguccuccccaagcaggaugcugcugcagcucacagugcccucagagauggagcaaguaggaauccagcuagaacagaagauauagugguuuacuuggagauucaccugggacacaggaguacccaacagccccaaaaggcaccagcgguuacucuaauucaguaagagacaacaccuugucucuuacaaaaguuaucugggaccaaaacagcuaauucucugaaaagugggaggguggggagaaguaucucccguauuguucagugaaaaaagcaaggugcaaagcaaugcauuuaguaugaucuuucuucaaaaaaguaugcguguguauauucacaauagguucacagauauaaaugcauauuucuaggaucuucuaaaaagauccuauaaucuucuaaaaagauccuagaaauaugcccagaaaaguaauaaugcuggaaaaggaaggggcaguggaaguugacccaagguggagauggacugcacuagaaaaaaaggggcaguggacguuguacuucaauauaugacugaauuguuugaauauuacuccaagaaugugucugugucuuacuuguauauauauauauauauauacacacacacacacauauauauacauauauauacuauauauauacacauauauauguauauauauuugacucugucucaaauauauauauacgcauauauauuuacaucuauacacacauauauuuacauauauacacacauauauuuacauauauauacacacacauauauauuuacauauauacacauauauauauuuacauauauacacacauauauauuuacauauauauacacauauauauauuuacauauauauacacacauauauauuuacauauauauacacacacauauauauauuugagacagagucucacucucuugcccagguuagagugcagugcugcgaucucggguuacugcaaccucugccucccggguucaagugauucuccugccucagccucccuaguagcugggaucacaggugcccaccaccacgcccggcuaauuuuuguauuuuuaguagagaugggauuuugccauuuugcccaggcugaucuucggcaacucaagccugaccucaagugaucugcccgccuuggcaucccaaagugcuaggauuacaggcgugagccaucacgcccggccuuacuuguauaauuuuuuaaaauuuuaagccaaaagaaaaaauuccagaagagucucaucaacauagucaaaacucaaaaguacugacauaccagaacucagaagaguaauauaaaaaagggacaccagcugggugcgguggcucaugccuguaaucccagcauuuugggaggccaaggcaggcggaucacuugagguccggaguucaagaccagccuggccaacauggugaaaccccaucucuacuuaaaaagaaaaaaauaaaaauuagcugagcaugguggcacacgccuguagucccagcuacucgcuggggcaagagaaucacuugaacccaggagguggagguugcagugagccgagauugugccacugcacuacagccucggugacagagugagacucugucucaaaaaaaaaaaaaaaaaaaaaaagaaaccccaccucuacuaaaaacacauaaauuagccaggcaugguggcaggcgccuguaaucccaguuacuaggcaggcugaggcaggagacucgcuugaacccaggaggcagagguugcagugagccgagaccacgccauugcacuccaacuguggucaggggugucauggucaccugaaaaaagcuaccaugugcaggcuuuccugcccccaccccugcaaugcacuuccuguggggaaccugccagaguaugaucccuggucagcagucaaaccugacuguaccucuaguccugaugacuccugggaaagagauaauaauuucacuaugcauccaaaaacauguuuuuaaaaguacuauuagcuggucacaguggcucacgccuauaaucccaaaacuuugggaggcugaggcaggcagaucgcuuuagcccaggaguucaagaccagucugggcaacauggcgaaaccccaucucuacaaaaaaaaaaaaaaaauacaaaaauacaaaaauuagccagauguggcgacgcacaccucuagucccagcuacuugggaggaugaggugagaggauugcuugagcccgggaggcugaggcugcaaugggcugugacugcaccacugcacuccagccugggcaacggagcaagaccccaucucaaaaacagaaaggcugggcgcaguggcucaugccuguaaucccagcacuuugggaggccgaggcgggcggaucaccugaggucgggaguucgagaccagccugaccaacauggagaaaccccguuucuacuaaaaauacaaaauuauccggguaugguggcacaugccuguaaucccagcuacucaggaggcugaggcagaagaaucgcuugaacuuaggaggcagagguuguggugagccaagauugcgccauugcacuccagccugggcaacaagagcaaaacuccgucucaaaaaaaaaaaaaaaaaccagagagaaaguacugcugcuaccucucuaccucuccucaugggggcaacaacuauuuuggugcccucucauaguggcaggagcaacuagcuggacaaacaaccccaaagcagggaggggcagugagcuccuguuggagcccagaggaaaaagcuggggaggaguuagaggggacaggaaagacagaacaaccagucccagcaaucauagcaggaggauguccuggcuagaaguaggcuguguguaccauugccagaacaugucccuuugcuccccuccaucuuucugguccaucuuccacugaaaaggcauguccuauuucuuugaucaugagccucagggccuuugcaugugugguuccaccugccuagaaggcuugaccccccuuuccuccccaccuaccuauuuccuugacuccuauucaccccucagacacacaucacacaugucuucaccuggcaucacugccucagggcauuaguucucauggcuucugguccuacuccuucaauagaauuuugauuuguaugugauuaaaguuagucucucccauuaggcccuuaucuccuugagaauagggcugcaccagcuuugcucaccgcuacauccaagacccuggcauugcaccuaggaaagacggaguggagaagucuccaugagccugggucccucagguacucugagacuuggccucccccagucucggaguaccugagagucauccccaaaagagguacuuggcagaggcugccuauucaccggccuuccuccuuucuucugcacacacagcugagggaucugaggagcccaugaaaaugcaagguggcugggcgcgguggcucaugccuguaaucccagcaccuugggaggcuuaggcgggcggaucacaaggucaggagaucaagaccauccuggcuaacauggugaaacccugucucuacuaaaaauacaaaaaauuagccgggcgugguggcgggugacuguagucccagcuacucgugaggcugaggcaggagaauggcgugaacccgggaagcggagcuugccgugagccgagaucgcgccacugcacuccagccugggcgacagagcaagacaccgucucaaaaaaaagaaagaaaguagauacaggggaugguuucccugauuccucauucuuguccaagaccuggcugcaaacuauccuugaguuccaaaggauaccacucugaucuuauaauaucacccacuuucgaccugaggcuguccaaguuggauugugauauuuuccccuaaauguguuccuugauccaucacccacucccuacucagcugcucccacugacuucaaggcccuagggagcccaaaccuggguuugaguagagguuccauucccaaacaaaagacuuuuuaagaucucuuauggacaauaaacaaaaucauuuauuuuugucccaaaaaguuuuuaugucagauuaauucaaucuccaucauguuauaaacuaaaguuuucccaagaaaagagcuccuacaaguccaauggucaacacuguuucaguauucaaugcuauauucagacuguguugugcucauacagucugugggauccaaccugcugacuguuguguuuccgcugugaacucagagccugcgcagacucugauacacagcaggggcuaaaugcuuguugaaugaauggacaaagaaacaauauucucaaaaugauaugugcucuggggagcaaagccuucucugaggauaaagcagggucucuggaaaagcuaauuuauugggguauggggaguugguguugcuaccucuaucccuuaugccuaaacccacccccacugcaugccaucgaauaauaaucaguacacguuaccagaaucacuuacauggugugggucuuacuccugauggcugugugcuccauaugcaucuagaacaugucggcuuguuuacagaguuaucccccauguccauggcaguuggaggaagaaagggaugaacaaucucuguccucauucccuacuauacccugaggccucuggggccuggcucagagugagugcacuaccaaagugggcuguuccaaguagucucacuguggcagaggcuuugccaccaaacuccauccuaugaguccugggcucuucuggcccuggagccuuauaccccaaagcuacuugaagcugcccacccccgucuccccaaccccagucuacucuacccagaggccugugcccugcaacaggggcaggaaguaugccauucuuacccacuggaugcccugacccuucacuggacacaugaaagcuuucuuauuccaaaguagccagggagauucaccaagcagaggcuggagcuaggaaacccaggcuccucuucccuguccugccccugacuugcugugggaugcuuggaaaugcccacuaccucucuggaauuaguauuuccaucccaccagugcucuuaacucucuauuggccagagcuacacagaauuaaaaaaaaagcacaguguauuuuuaaaauuccucaguuacuacuaaguacuguuacuaucuuuucaaaagcaaugccugucgcuaucugaacuucuuguuuuuuccugagccacuaguagggacuaaggaaaaggaagcugaaggagugugacugaggcccacauucccugccaaacuuugcuggaaggcucagcucugguacuccuggggucacuuccacuccauuucacaggccugggagccccagagucaguguucaugugggacugcagguagcacaggaugcuuuccaaaaaggcaaaacuucuaguuuccucuuucuucuugccucugaaaacaaguuauuugcacuaccaggcaggcucagaggagugagccuggaaggggagguauugccuuggcauuggaagggaagguguugcccccaagaguccccaccaggcucucuggcuaauuugaauacagggagaacauguuugcuuuccucacucaacacucagggguguagagguuuuucuuuguuucuuacuaucuagaaaaggaggugauuguguagcucuggcgucugccccuggaacuuuggauggucuucccagggcuccucacccccaacugggggccugaguagggacagcacagaggcuggugccugcugcucuucagucucuguuuccacggcucaaaccaaaguaaacaacagaauggccauguaggugcaaaguaccaaugacagcauggacccuugggugggcuccaacacucacccuaauaaagcuggggaggaaggggcggaguggaggcaggcaaaguggcaaaccgggucuguugggagcaccagaucaagccucccuguucugucugcucccuuccucccuuucuuccacuggcuuagccugcaucauagcuccccaaaagugcccuggcaggaaacccccuucugacucugcucuaugggugguguaucuuaggcugccaggcaaucagugcuaaguaccaucauuugcaaaaagugcuuucagcacaggaggggagcagagaugagugcuuggccauugggaaaguccuauuccagucuguuggcuuccgagccagcuucgugugcuacagccugcauccugaucccuaaguccagagaaauauacaucccaaagucaaauuaugauaucucugcucagcugcccaacagcaaaucacaaccccagagcagcagccccagaccuggaacucccucccuccugcccucuucccaauacucaaaaucugucaaggggcgccugucccacacgacugucacuccagcugaaggccaacacccuccaccuggcuucaugaaguuuacugaacaggagugagggcuaaagagucaaagugacacuuuuccuauagugagagacuuuucucuguggcucugguggccugagcuucaucucugacuagcugcagauucuagagccaauagaaugagccaggccuuucaagugaacugcccagucugagccuuaaauucuauaaucuguuuuagcagcugucugugaagaugaggauggacgacaguaggccccugagcccuccaagcgucccccacugagucagagcucccagaggucaggaacuauacccucaaucaaguuuaacucaaacaugaucuaggguaauaaauaagggcauaaucuaccuguucaucuuucuauccucagcccugggcauggaaccugacaucaacuaguaggcacuuaauggcaggccucaugcugagugcuuucauuuccaauguuucauuugauaagguaaauauuuguuuaauugaaugcacuugauucacucucuuggaacccuaguauugccucaauuuccuccucucccuuaucucuuuuucaggguacuuguaggaaccagguggcauuaauauuaaagcacuugcaggugaagugcuacuuuauuuuuccaacccagacuugaauacccagcugccuaccuaacaucucacuugggugccucuaaaaaacaacuuguccaagaacaaacuccuggucuaggcccauuccuccuccucccuguguacaccagaugcccaggccaaaacucagagcuccuccugacuccucucuucaacucuucacagccaaccauucagcaauccuucuggcucaauuuccagaauauauucagaaguugagcacuuuucaucacucuuacuacucagccccuucccaccucccuguccugcaaaaccccgcaccccaccaugaucauccucucaugccugaauauuauugcuucugccuuuggcucucagucuuagcaacacagagaaaaacaacuuauacauuuaccauuuugcuucagcaauccuacuucuaggaaacuaucgcacagacacacugguaaaauuacaaaaugccacauuuuccagauuccucacugugcuucuuuuuguaagagcaaaagacuggacacagcccaauguccauagauaaaccauggcauauccacauggugaggcacagugcagaugcaaaaaggaaucaggaggauuucuauauucugcuacagggugaucuucaagauugauuacauggaaaaaagcaaaguacagaagaguacuuagagucugcuaccuuuuacauaaaaaagaaagguaaacaaauauauuuuucccuuaaauuugcaaaaagaaacagugggaaaaaucugauaaaaacuguuucuuaucagaaaggcaaagagaauaaaguagagggaacaagauggaauuagacuucucucaauauaucuuguuuuauuuggaaucauaggaaagcuuuauauaauuuuuaaaaauuaaauuuuaaaaaaguacgguauaugccauuguuguuuucaauucuuuacuuuccaucgauuucuguucucugccaugugucuuugcaguuccuccaacuagaggcagaauauauuuuuuccagcuguggcagacuguauuuuccaaaaauggucucagcaagauuuccagucccacauguacugacagaguccacguccccuccuuuuaaaccuaggcaggaucuugugacuguguuaguaaacagaauguggcagaagugacacugcaugucucuuaagacuaaaucauaaaagucaguacggucuuccaccugucucccaaccccuaccuugcccucuccccacccuuggaacucagcaaccaugcuaugaggcagcccaaaugagcccacauggagaaaucauauggagaagcccuggggcucccagcuaacagccagcaucgacucucaaacauauaauugaugagccuucagaagauucuaaucucuggccuucaagucuuccagcugaaacuccagacauugugaaguagaaacacacuccauucuacugugcucugcccaaauuccugaccugcagaaucugugaccagaauaguggcuguuuuccacuacuaaguuuuggguuaacauguuacacagccauaguaacugcaauacaacuccuugacuugggcuuaaccaugaauugcuugacuacaggaauguuagcagaugugucaucaggucagaggcuugaaaugugcugugagguuaggcacacccucuugugugucucucaucuccguaagaagaacaugccccagcuagacugcuguccagggaagaugagagacacacugaucugaccuggacccaacugcagccuggagcccggucuagaucagugaauucuagccagcaugcagaugcaugagugagaauaaaaaauugcuauuugaagcuacugaguuugggcugguuuauugugcagaaugacgguaacaacagaaaacugaucaaaaaguaauccuuacaaauuaaaggcaaacugggaaaaaagagcuuaauuuuauauccucuuaaucagauaaccacagaguagaaucauuucuaauaacucuaaaacagagaacuauauaucccugaaaagggauaaccuaagggcaaagggaaccagaaggaagucuuaaacuacauucaugaguauuaucauuaauaaaaauaucuacauuauuauuuaaaaacaauccauugaaaggagcaucaagcauggagauucaacccaguuuggagggcaucuucaggguaggacugugucuuuuuccuucuuguguuccugcuauugacugcaauguuuaauaaauguuuggugcauuaaaaaaaagguugacagauaauuuuuauagaagaauuucagcuaauuuugcaaccuguuaugaaauaauggaucuagcuaaggaucauuagugaaugcuaaauucaucaggcaaaaaaaaaacugauaaggacuuuauaauggauuaaucacugauacuaccugaauccccuaauccuuuuuuuuuuuuuuuuuuuuuuccugaaacacagucuuacucugucacccaggcuggagugcaguggcacgauuucagcucacugcagucuugaccucccaguuucaagugaucuucccaccucagccucccgaguagcugggaccacagacaugugccauuaugccuggcuaauuuuuuuguauuuuuguagagauggggucucacuacguuguccaggcuagucucaaacuccugggcucaagcaaucugcccaucccagcuucccaaagugcugagauuacaggggggagccacugcacccaggccugauccaucuuuucaucacuaaaguaggucaaggagacagacauacugccuccuucugggauacaauaggaaguacacaauaccaaugaaguguucuuuccaaaaagauugaaucuauucugaucuagaucuaacuaccaguuuauaggaaauaaaaggacacuaggaagcaagaaaauaacuucaagaggaugugcuuaggcaaaaccaaaaugagagauagucuaggauaaauguccugaugucuucaccaaauaaauggauuugaaaacaaaaggagcaaggagacuguuagaaacuuacagaacauaucaaccaaaugcaauauguagacguuguuuggauacuguuugaacaaacuaaaaugucauuuuuggggccaggcacaguggcucaugccuguaaucccaacacuuugggaggccgagguaggcagaucaccugagguaaggcguucaagaccagccuggccaacauggcaaaaccccgucucuaguaaaaaaauacaaaaauuagucaggaaugguggugugcaccuguagucccagcuacucgagaggcugaggcagggagaauugcuugaacccgugagguggagguuacagugagucaagauggcgccgcugcacucuagccuaggcaauagggcgagacuccgucucaaaaaaaaauacauuaaauaaaauaaaaugucauuuuuggaacaauaaagaaaaauuaaauauggacuggguauuggguuauaguaagaaauuaaaguuaacuuuguugguugugauaaaugccauugaauuaaauaguaaagcacccucuaacuacuagagguacauccuaaacuauucaugagugaaaugauauauuucuauuuugaaugaaaauccuggccgggcgcgguagcucacgccuguaaucccagcacuuugggaggccgaggcggguggaucacgaggucaggagaucgggcccauccuggcuaacacggugaaaccccgucucuauuaaacauacaaaaaauuagcugggaguaguggcgggcggcuguagucccagcuacuccggaggcugaggcaggagaauggcgcgaacccagggggcagagcuuguagugagcugagaucgcaccacugcacuccagccugggcgacgacagagcgagacucugucucaaaaaaaaaaaaaaaaaaaaaauuagcugggcguggugggugggugccuguagucccagcuacucgggaggcugaggcaggagaauggcaugaacccuggaggcagagcuugcagugagccgagaucccgccacugcacuccagccugggugacagagugagacuccgucucaaaaaaaaaaaaaaaaaaagaaaauccucuaguccaaaaaaaaaaaguggaggaauauagauaaaacaaguuggcaaaaugcuaaucauuguugaagcuacgugguagguuugcaggagagacuucagccuaccauccuuucuucuucuuuucuucuuuuuuuuuuuuaccuuucuccuuuuauguguguuugaaauuuucaucugcagagcacuugcugcuccuagagauaccuacccuacagagccaaaggccaaugcaccccaaagacaggccagcauaacauggcugaccaggaaaggacaaaucugcacaaggguuuccucugcagagcacaggggcugccauggcuagggugcaaggggugguugccucuccaauccaaccguagcugucaugucaccugaacuaugagugacauagucugaaggacaaggggcauuccucuugcagcaugagaacacccuuccuacacauuuaugagaguuuucaggcagcuacucccacuacucagccaucaucacuccaaaccugagcuggcaaggccuuggccuugagcauccaacacuggccaccccacuccaggucagaugcagggguuuagaaaguaggcucacagggccuaggaaggggagaaguucucacaguaugguuccugaaacaaguacauugccuuaguuauuacccccaguucauggaacacagucagguuccaaaagagucucacuagguuggaaaggaucucuaaguauaaccagagaaaacauagcagagacucaugcaggccuccacagauucacacuugggcuguguaaguccaggauggaaggccccagacuucgugugaagaugcccagcaugaggcuggauaagugugggaguagcugcccaaaagcucucauaaagguguaggaaggguguucucaugcugugagagggaaggccccgcauccuucagacuaugucacucauaguccaagugacaugcugagcccuggacccuguucucuaaggccucucuguacuuuuaggauacugacagccuugggcagggcaguccaggcuggcaagggucucagagucccaucacagccacaggagcuggagaagugaaguccagagaagaaaaucaggauugaggaaguaagcgcagggaccucagcccuggcacguggcagguacagugagcgccugcuaaaccugugagcaaaaauaagucagcggugcuggagagcagagccaagaccagcagauaggagguguaaggaaaccugauucagacaaacaggaaaaaagaacucuccagcaguagaaucaucugccugagaagaaccaaaggccacugaucuuggguguucacaccaagggagagcuguagccccuacagaguaugacagcagacauucuggcauuuguuggggguuggauacaaugcucaaaauaaaaggauaucagagcaaacauauaaccuacugaagccaaaccacacuucggaaggaagcagccucacauaccggacuuugacauuggaggagaucuggccugagcccacagaacccacacagcugcagaagcugcagagagaaccacauguaucucuucauucuacaaaugaaggagucugcccaaacuggagucugaagaucuaaagucucuuucaggcuagcccuucccaugccccacccuuccccaucacaaagcguuugccaaccccagcuccccuggaaaucauggcccacuggcugcugccagagcaccuguaggaaguagguggaacaacacucaggagauaagcagccgagcacagcugagaacagggagccugcagcaggcucugcaggucuggguaggagccuugcuggcuggccaaccaacccagcacaaggaggccaucaguuuuccgagagccccugccuaccagaagcaacccagagguggguugccagccagccccgccccuggcuccaggcuugaaugugcagucaucuuguccauucugaaaaaucucugccacacaauggaagagcaagccucuucauuuagagcugcuacaaaguaaacuaaaaagugcacaauguacuuuugauuuagaccuuguuuucuaugcucaauagagcugaagaaaaaugggaagcaucacccuuccuuuuuacacauuucacagaaaucagcugucagagcuggaagggacuguggagaucaucuaguuaaaucucucauuuuacagaugaaaaaaccaaggacauacccaacgugcauagccaaguuuaggcaaugccaggauugauuaaaaccugaauuucugacccccagccagcaugcuuccacuauucuucuuccuccacaucauccuacccugcccuuugcucaaauguccuacuuucugacccuuucccacuccucaaagccuuucccaucaucuugcuaaaucucccaucuucacagaggaggaggcggggaagugacacaguucuccacagcauucggcauuuugguuugcuaaagucugcuagcuggcuguucuucuacaucacuccucuuaggccuuuggagcuucccaacagaauacgugaauguuaugaauguguuuuguaagcuguaaaauaccauacaaauauaugcucuacuauuuuagaacaugaaauaaugcaaccccuuuuaaucauacucucauuucucuuaccucugugagacaaagagaaggcaggagcaaacucuaauuuaaggaagaagaaguugaggcuaaagaucuggacaagaguucucucuccccacaccaugggccccuuuagggcagagccuauuuuaugcuccuucuuuuauuccucacacuucacccagggauagguauccaaaagauguucagcagaguuuccugaauacauggauaaaauuucacuuuaaaauuguuccauuucuauguagaaucuaacuguaaaaauccccacaaacacucccauacacaaaaaaguguaggugacacaguaggagguagaagggaagguugaggagauguuucaguuagauaggaggaauaaauucaagagaucuaggcugggcaugguggcuggcucacaccugcaaucucagcacuuugggaggcugaggcagauggaucacuugaggccaggaguucaagaccagccuggcuaacauggugaaacccagucucuacuaaagaugcaaaaauuagacgggcaugguggcacacacuuguaaucccagcuacucgggaggcugagacaugagaaucacuugaucccaagaggcagagguugcagugagcugagaucacgccacugcacuccagccugggcgacagagugagacuuugucucaaaaaaaaaagaaaagaaaaaauaacaacaacaagagaucuacuguacaacacggugacuauagcuaacaccaauguauugcauucuuguaaauuucugcuaauagauuuuaagcauccucaccacaaaaaugguaaguauguuaagucaugacuauguuaauucacuugacuuagccauuccauaauaugucauaauauguacauauuucaaaacaucagguuguauauaauaaauauauagugcauaauuuuugucaauuuaaauaauuaauuaaaaaaauuuuuuuaaugggagugacccuuguuaccugccugcaaacacaaauguaacaguguaacuauuaggaaauuuccucaccuacccuuucucccaagaacccaaaugccuuaaugguucuuccagcaucuuugggagguuuggcuccccacacaagccaguggcauugaagagcucgggcuccucuggauacagggguuagucccagauaggacuggguggggugauccuugcugcugaggcucuuggaucuccucaguguuugggaccaagauccaaaagccaucccuucuauuuccccucagggaaaaucucuucuucaccguuggcccugacagcagccucacccacuuuaggggcaaccaggccucuccaggccauucaagauuugaucugauccuggggugaucuagagcucccuggaggcuucccaugugccuccaugugacccucuuguuagaaagaaguaggggccccaggucucugcuagagcaaagcucucuuuagaacccuaugugcccguaaagacgaauaauaggaaggagagaucacagcagcccuguggccagccugggagcccaaggcacaacacagaugugucagggaguaucccauuccacagcagagcugaccagaaccuaaaauauaagacaaaugggccaagagaaugcuagggggcaacagacccccacuagaagcccgaucuguacagaaggaaccacagagagugagacaccaaaauucuaucaccccuaccacaggcaggagcccacaggccagugucccaauucacuccacagcuucaaccacugugcuagugagaggagauggcagaggucccuccagaaaaggagcucgggcaagugcuacaaaugcaggaucaauaccagcaugacaugcuccuggcaccaaaugaaaggacugagcaggagucccccacagcuagauuguucaccaagucccagcuuacccagagggccucauguccuaaagugacagucagcccuugcuguaggcaugcagggcuuagccaccauuuuaccauuuaaaaagucaguccccaggcaguaaguaaagucaggacaggcagggccugcagaagcugaauggccaagcagguggaauaagaaauaaaacaccuagcagaaugucugugaugaggcagucauucaguaaugguagucauaacugcuauuacaguguugccaaccuaccuucacaguuagccccaacuuacugcacauggcccacaggcuccagcaacagguuccccucacauagcccacacauaguaggucuggccuuccacacccccacaacuaacaagaggaaagggcccaauucagaaaugcaggaccugugauaaggggaaagauuuauuaagcccccaaaugugaguaggaggcuuccuacucacauaugcagggagggcucccccacacuggggugaaaggcaugacuuuucugggggaaaaaaaaaacaacuuuccucugaaagcuuugacuucuuaaacucagaaccaaacugacucagaggaaggagaucuuuagaaaaggaacagaaaagugguccacugcauuguucuuuggcucccaauuagcccaaacccugguucugcuuucagugaacucucagccucuccaugucugaagccuucaauaaacucuuuuuuaaaaagcuagaauuucuugaccaaaagaauaaaauuugaaucugauuagcuucuagacagaauucucaguuuacaagaaaaacaugggacagaggaacaucuuaaaugacaccacagggaugcaaucagcauaauccugaauaugagaaaccacaggacaaaugucauaguucucuaauaauaaacugcaaggagcaaaaaggagagaaaauacauaaagaaacuagacagaugcaucagacaaauucaauguguagacccuguuuagaucacaauucaaaccaauaauaaaaguaaauucauaagacaaucagaaaaguagaauccugacugaauauuugcugaguuuaagaagagaucauuaucuuauuuagauguggcuguggugcugugguuauguucaugcaaagcccuuauuucuuggaaauacaaacugaaauacugaugaugaaauuuugggaugucuggaauuugcuucucuaggggguaggaugugagagagauaaauuaaacucaauuggccauaaguugaugauggcaguggcuaagcaaugggaacacaaaaguucauuagaccauuuccucuacuuucauguauguuugaaauuuuccauaguaaaaaaaaaauguuuaagauagcauuucucggccaggcacaguggcucaugccuguaaucccagcacuuugggaggcugaggcgggcagaucaccugagcucaggaguuugagaccagccuggccaacauggugaaaccccgucucuacuaaaaauacaaaaauuagcugggucugguggugggugccuguaauaccagcuacucaggaggcugaggcaggagaaucgcuugaacccgggaggcagagguugcagugacccgagaucgcgccacugcacuccagccugggcgacagagcaagacucugucucaaaaaacaaaaaacaaacaaacaaaagacaguauuucuccuccuaaugucuccauuacauuuuuacauuuuuuaaaucaacagcaccuuauuagucuuaaugaugcugugagcaacuguauuaucaaaaguagccugcuuucccuggagaaaugcaaaaaugguugcccucuggguaaaauuuugacaucgucaccauucagauguaaggucacuuuaauucacacuccaugacauacccucugugagauccagccacuggggacaaagaagaucucuaagugacaaaggagcauuauuuccagaccuggcaauuauguccuuucauuuuaucuuuacaaguuagugccagauuuuucuagaggcugaguuggcugauauaauguaacaagucugacuaaucccagaccagagauacuaugccugacaaauccauuuugaaaaaggaauucgggguaugguucucagagcagccuugcccaccuuccaguaaacaaccagguucucugugccuagcugccuuuggcuuagggugucugucucaauaacauaugggccaggagugaagagaggcgacuuuggcauugauuacgcauucugaugggcaaugauggagaagggccucuguuggcuuugcccuggcuuucccccaccacccugcacucagccucauucucugcucacugucccugccuguguagaccacauucuuuaugccauuuaucucuaucucuaccucucuuaacccagucauuuuuccagccuuacaucucuaccucuccuaaagcuuagcugugccucuccacucuucccaauuaacaacccuguaagcacugcuuauuugacauuucucagauacugagcugcccacagugucucucuuaggguucuuccaugauuuggcucuucaagagcuaucugaccaaccagucugugaggugcugaaggacagggaagcacuauauauccuuuccauaccauccacaaagccaauaacugugcuugcucuugacagcugacaaauacaccuuagcugaucgacuagauaucaauuugcaaacaucaaaacaugugcaaguugggccgggugcaguggcucccgccuguaaucccagcacuuugggaggccgaggcagguagaucacaagguuaggagaucgagaccacggugaaaucccaucucuacuaaaaguacaaaaaauuagcugggugcgguggugggcgccugcagucccagcuacucgggaggcugaggcaggagaauggcgugaacccagaagguggagcuugcagugagcggagaucgugccacugcacuccagccugggcgacagagcgagacuccaacucaaaaaaaaaaaaaaaaaaaacugacaggugcaaguccacagagcugguguaaacuagacaggcugccacuggucuacauggcuccuucguguaauuauuuuaaaaaguacuuucugggguacugauaaaguucugucuugaucugguagugugucacgaguguauguauaaauaaaaucccaucaauauguguguuccacuguacauuaggcauaucuccauaaauaaguaaaugaauuaacgagugaaugaugccccuucaucuaagaggaugcagccuacaccagggcacacagcuuggagaguggagccuggguuagaguucagcuuucucccaaaccagcacuccuuggaaaaggcacagauuauauaauuguacauggccacccugacaccagaagcagagagcccuuccuugagggacucuccaaugcccaaagcuccacaucaucccgacgggcuaagaggcaccacuauggguguggcagcacugcuacucaugggauucaagucaggcucuucagcagcaaaugcuggagccacccccucacagaguccaacucagcucaguaugaggaugaaaagacuaauucagccugggaugacaagguaauauggcaauagcauuuaacucccccagaaucaucucccuuuuaccuggccuucuacccaccucuaugagguuucugacugccccgaaauucaaaaucuuacugaaagcaaauaugucuuugugcuaaugcucuuuccugaaugcccagaagcacauucacagggcuuuuuccccaucaaugggccaaucuguucagcagcaucuuagaacaugcuaaauuuggcaucagguaucugagaugcucuagugagaggaaguagaagccauugcaauacuaaaggagagauaagccauggagcugcugcucagcugaggugcuaugauaaaaugaauaucagcuggaggaguaaaucccaccuccuaauggucucugguucugagcuuuggggacaaauagccagcucaccuccugagucugauagucacaggaccucagcaccacaggcucagguaugagccuugcccacagccagguaagagauugugugacuacuaaauccaucaggaguccgugguucgccucacccacagcaguucaugggucugccugcagcagaauguacagaugaaguacaaaugaaacacuaaaaaggcauaugagcaauagacaucagccuccuuccggucccucugagcugcccaggucuuuccagaauuucauaugauuggcucugcaacaucugauaaacuacaagcagagcagccuguuugguuaucagaagagaaaugacaaauuccccauacagggaacucucaauaacaagguguuuuuccauucagcuacagaagcuuucccuuggaaggagaacacuaaagccugggugagccucccucaagcuaaaacccaaacagcaacucaacaugcagcaaaauggacaguguuugcagugcuaagagcugugugcuauccaacugcauuacuauuauagcuaguauaaaauggacaaaucccaccucuaaaaaggaugcucacaggcugaccugucugccgcagguuucaagcuacuaacagccuuucauuacuguuaguugucuaagaaaugacuucugaggaaauaaacacacaagaggcacagucgggcagccaaagaauaaaaaauuaugcguccucaguuuaugugcuuccacacagaaaagccagggcaacauauaucagcagacccacauggagcuggaagcaccucccucccacccccuggggguuuugcuacuccccaagccuauuuggugcaaagauaaugccuuccauuuuaucgugucaucucuuaguaguuuuccugaguuuucagucuacugacuuauuauauauuggcauucccuuacagccuucauugccacuugacuguuuuugcaggaccuggguuggcauacauuuaaaacaaacugguuucacaguauuuaaucagauauguucuguuuaaagcauucuguguggguuucagcuuuuccacugguuugaucuaaaucauaagguaacgagaacauaucuggugcuggaugacucaauagcauuuuugcuucaccccaaaauguuucccuaaaccuuggugaaagcacaugauccuauuaguauuguugggccuaaauaagcaccucuugguguccagugggcaauuuuccuuucccccaaaggugauuacagccacuaaaugcccaaggaaagcccaagaccaaguucaugguucaacuauuuucaucucucuguuccucgcagugacacuuaucuucccugacagccacucccauugugcuguuuucucggcccagcacaauggacacaugcagacaccagcagacagggaggacguuuuccaucccauugcucuccugugcggagggaccagguuaagguuacauaagccccuccugagcagucaggcccgagcguuggggagaagcgaauuugggguucgugacggagucacggucugcaggccccgacugacccugcgcucgucauccugccacgccaaggcggggcagcuggaaaggaagggccgcuucccgcgaccacccaguucacgccaauccggcaggguucagagugcggccggacgucgaaccucgcuguccacacuagaucgcgggauccugggcccgggucccggccucaggcugcagcucaccgccccccgggcgccgagacacgcgcuuaccugcccgggccagggccgggaccggggccggggccggggccagggaccggugguaccgcggucgaccgcgcugcucccgccgcggggagcuguccgccaccggccggugcugaaggcggcuuuccugcgccggggccggggccggggcccgggccggggccggcgccgccgggcggcagcggcccgucgccagcgccgcccuccaggcugaccucguugcccauggcgggcaggcgggcgggcggggucggggucgcgcugcgcccgggccggcggcucccgggcggugcucacacucucggcgccgccgcugccgccgccaucucccagcucggcuc

SEQ ID NO: 192094 - RNA, 117061 nt, Homo sapiens
gagccgagcugggagauggcggcggcagcggcggcgccgagagugugagcaccgcccgggagccgccggcccgggcgcagcgcgaccccgaccccgcccgcccgccugcccgccaugggcaacgaggucagccuggagggcggcgcuggcgacgggccgcugccgcccggcggcgccggccccggcccgggccccggccccggccccggcgcaggaaagccgccuucagcaccggccgguggcggacagcuccccgcggcgggagcagcgcggucgaccgcgguaccaccggucccuggccccggccccggccccggucccggcccuggcccgggcagguaagcgcgugucucggcgcccggggggcggugagcugcagccugaggccgggacccgggcccaggaucccgcgaucuaguguggacagcgagguucgacguccggccgcacucugaacccugccggauuggcgugaacuggguggucgcgggaagcggcccuuccuuuccagcugccccgccuuggcguggcaggaugacgagcgcagggucagucggggccugcagaccgugacuccgucacgaaccccaaauucgcuucuccccaacgcucgggccugacugcucaggaggggcuuauguaaccuuaaccuggucccuccgcacaggagagcaaugggauggaaaacguccucccugucugcuggugucugcauguguccauugugcugggccgagaaaacagcacaaugggaguggcugucagggaagauaagugucacugcgaggaacagagagaugaaaauaguugaaccaugaacuuggucuugggcuuuccuugggcauuuaguggcuguaaucaccuuugggggaaaggaaaauugcccacuggacaccaagaggugcuuauuuaggcccaacaauacuaauaggaucaugugcuuucaccaagguuuagggaaacauuuuggggugaagcaaaaaugcuauugagucauccagcaccagauauguucucguuaccuuaugauuuagaucaaaccaguggaaaagcugaaacccacacagaaugcuuuaaacagaacauaucugauuaaauacugugaaaccaguuuguuuuaaauguaugccaacccagguccugcaaaaacagucaaguggcaaugaaggcuguaagggaaugccaauauauaauaagucaguagacugaaaacucaggaaaacuacuaagagaugacacgauaaaauggaaggcauuaucuuugcaccaaauaggcuuggggaguagcaaaacccccagggggugggagggaggugcuuccagcuccaugugggucugcugauauauguugcccuggcuuuucuguguggaagcacauaaacugaggacgcauaauuuuuuauucuuuggcugcccgacugugccucuuguguguuuauuuccucagaagucauuucuuagacaacuaacaguaaugaaaggcuguuaguagcuugaaaccugcggcagacaggucagccugugagcauccuuuuuagaggugggauuuguccauuuuauacuagcuauaauaguaaugcaguuggauagcacacagcucuuagcacugcaaacacuguccauuuugcugcauguugaguugcuguuuggguuuuagcuugagggaggcucacccaggcuuuaguguucuccuuccaagggaaagcuucuguagcugaauggaaaaacaccuuguuauugagaguucccuguauggggaauuugucauuucucuucugauaaccaaacaggcugcucugcuuguaguuuaucagauguugcagagccaaucauaugaaauucuggaaagaccugggcagcucagagggaccggaaggaggcugaugucuauugcucauaugccuuuuuaguguuucauuuguacuucaucuguacauucugcugcaggcagacccaugaacugcugugggugaggcgaaccacggacuccugauggauuuaguagucacacaaucucuuaccuggcugugggcaaggcucauaccugagccuguggugcugagguccugugacuaucagacucaggaggugagcuggcuauuuguccccaaagcucagaaccagagaccauuaggaggugggauuuacuccuccagcugauauucauuuuaucauagcaccucagcugagcagcagcuccauggcuuaucucuccuuuaguauugcaauggcuucuacuuccucucacuagagcaucucagauaccugaugccaaauuuagcauguucuaagaugcugcugaacagauuggcccauugauggggaaaaagcccugugaaugugcuucugggcauucaggaaagagcauuagcacaaagacauauuugcuuucaguaagauuuugaauuucggggcagucagaaaccucauagagguggguagaaggccagguaaaagggagaugauucugggggaguuaaaugcuauugccauauuaccuugucaucccaggcugaauuagucuuuucauccucauacugagcugaguuggacucugugaggggguggcuccagcauuugcugcugaagagccugacuugaaucccaugaguagcagugcugccacacccauaguggugccucuuagcccgucgggaugauguggagcuuugggcauuggagagucccucaaggaagggcucucugcuucuggugucaggguggccauguacaauuauauaaucugugccuuuuccaaggagugcugguuugggagaaagcugaacucuaacccaggcuccacucuccaagcugugugcccugguguaggcugcauccucuuagaugaaggggcaucauucacucguuaauucauuuacuuauuuauggagauaugccuaauguacaguggaacacacauauugaugggauuuuauuuauacauacacucgugacacacuaccagaucaagacagaacuuuaucaguaccccagaaaguacuuuuuaaaauaauuacacgaaggagccauguagaccaguggcagccugucuaguuuacaccagcucuguggacuugcaccugucaguuuuuuuuuuuuuuuuuuuugaguuggagucucgcucugucgcccaggcuggagugcaguggcacgaucuccgcucacugcaagcuccaccuucuggguucacgccauucuccugccucagccucccgaguagcugggacugcaggcgcccaccaccgcacccagcuaauuuuuuguacuuuuaguagagaugggauuucaccguggucucgaucuccuaaccuugugaucuaccugccucggccucccaaagugcugggauuacaggcgggagccacugcacccggcccaacuugcacauguuuugauguuugcaaauugauaucuagucgaucagcuaagguguauuugucagcugucaagagcaagcacaguuauuggcuuuguggaugguauggaaaggauauauagugcuucccuguccuucagcaccucacagacugguuggucagauagcucuugaagagccaaaucauggaagaacccuaagagagacacugugggcagcucaguaucugagaaaugucaaauaagcagugcuuacaggguuguuaauugggaagaguggagaggcacagcuaagcuuuaggagagguagagauguaaggcuggaaaaaugacuggguuaagagagguagagauagagauaaauggcauaaagaauguggucuacacaggcagggacagugagcagagaaugaggcugagugcaggguggugggggaaagccagggcaaagccaacagaggcccuucuccaucauugcccaucagaaugcguaaucaaugccaaagucgccucucuucacuccuggcccauauguuauugagacagacacccuaagccaaaggcagcuaggcacagagaaccugguuguuuacuggaaggugggcaaggcugcucugagaaccauaccccgaauuccuuuuucaaaauggauuugucaggcauaguaucucuggucugggauuagucagacuuguuacauuauaucagccaacucagccucuagaaaaaucuggcacuaacuuguaaagauaaaaugaaaggacauaauugccaggucuggaaauaaugcuccuuugucacuuagagaucuucuuuguccccaguggcuggaucucacagaggguaugucauggagugugaauuaaagugaccuuacaucugaauggugacgaugucaaaauuuuacccagagggcaaccauuuuugcauuucuccagggaaagcaggcuacuuuugauaauacaguugcucacagcaucauuaagacuaauaaggugcuguugauuuaaaaaauguaaaaauguaauggagacauuaggaggagaaauacugucuuuuguuuguuuguuuuuuguuuuuugagacagagucuugcucugucgcccaggcuggagugcaguggcgcgaucucgggucacugcaaccucugccucccggguucaagcgauucuccugccucagccuccugaguagcugguauuacaggcacccaccaccagacccagcuaauuuuuguauuuuuaguagagacgggguuucaccauguuggccaggcuggucucaaacuccugagcucaggugaucugcccgccucagccucccaaagugcugggauuacaggcaugagccacugugccuggccgagaaaugcuaucuuaaacauuuuuuuuuuacuauggaaaauuucaaacauacaugaaaguagaggaaauggucuaaugaacuuuuguguucccauugcuuagccacugccaucaucaacuuauggccaauugaguuuaauuuaucucucucacauccuacccccuagagaagcaaauuccagacaucccaaaauuucaucaucaguauuucaguuuguauuuccaagaaauaagggcuuugcaugaacauaaccacagcaccacagccacaucuaaauaagauaaugaucucuucuuaaacucagcaaauauucagucaggauucuacuuuucugauugucuuaugaauuuacuuuuauuauugguuugaauugugaucuaaacagggucuacacauugaauuugucugaugcaucugucuaguuucuuuauguauuuucucuccuuuuugcuccuugcaguuuauuauuagagaacuaugacauuuguccugugguuucucauauucaggauuaugcugauugcaucccuguggugucauuuaagauguuccucugucccauguuuuucuuguaaacugagaauucugucuagaagcuaaucagauucaaauuuuauucuuuuggucaagaaauucuagcuuuuuaaaaaagaguuuauugaaggcuucagacauggagaggcugagaguucacugaaagcagaaccaggguuugggcuaauugggagccaaagaacaaugcaguggaccacuuuucuguuccuuuucuaaagaucuccuuccucugagucaguuugguucugaguuuaagaagucaaagcuuucagaggaaaguuguuuuuuuuuucccccagaaaagucaugccuuucaccccagugugggggagcccucccugcauaugugaguaggaagccuccuacucacauuugggggcuuaauaaaucuuuccccuuaucacagguccugcauuucugaauugggcccuuuccucuuguuaguuguggggguguggaaggccagaccuacuaugugugggcuaugugaggggaaccuguugcuggagccugugggccaugugcaguaaguuggggcuaacugugaagguagguuggcaacacuguaauagcaguuaugacuaccauuacugaaugacugccucaucacagacauucugcuagguguuuuauuucuuauuccaccugcuuggccauucagcuucugcaggcccugccuguccugacuuuacuuacugccuggggacugacuuuuuaaaugguaaaaugguggcuaagcccugcaugccuacagcaagggcugacugucacuuuaggacaugaggcccucuggguaagcugggacuuggugaacaaucuagcugugggggacuccugcucaguccuuucauuuggugccaggagcaugucaugcugguauugauccugcauuuguagcacuugcccgagcuccuuuucuggagggaccucugccaucuccucucacuagcacagugguugaagcuguggagugaauugggacacuggccugugggcuccugccugugguaggggugauagaauuuuggugucucacucucugugguuccuucuguacagaucgggcuucuagugggggucuguugcccccuagcauucucuuggcccauuugucuuauauuuuagguucuggucagcucugcuguggaaugggauacucccugacacaucuguguugugccuugggcucccaggcuggccacagggcugcugugaucucuccuuccuauuauucgucuuuacgggcacauaggguucuaaagagagcuuugcucuagcagagaccuggggccccuacuucuuucuaacaagagggucacauggaggcacaugggaagccuccagggagcucuagaucaccccaggaucagaucaaaucuugaauggccuggagaggccugguugccccuaaagugggugaggcugcugucagggccaacggugaagaagagauuuucccugaggggaaauagaagggauggcuuuuggaucuuggucccaaacacugaggagauccaagagccucagcagcaaggaucaccccacccaguccuaucugggacuaaccccuguauccagaggagcccgagcucuucaaugccacuggcuuguguggggagccaaaccucccaaagaugcuggaagaaccauuaaggcauuuggguucuugggagaaaggguaggugaggaaauuuccuaauaguuacacuguuacauuuguguuugcaggcagguaacaagggucacucccauuaaaaaaauuuuuuuaauuaauuauuuaaauugacaaaaauuaugcacuauauauuuauuauauacaaccugauguuuugaaauauguacauauuaugacauauuauggaauggcuaagucaagugaauuaacauagucaugacuuaacauacuuaccauuuuuguggugaggaugcuuaaaaucuauuagcagaaauuuacaagaaugcaauacauugguguuagcuauagucaccguguuguacaguagaucucuuguuguuguuauuuuuucuuuucuuuuuuuuuugagacaaagucucacucugucgcccaggcuggagugcaguggcgugaucucagcucacugcaaccucugccucuugggaucaagugauucucaugucucagccucccgaguagcugggauuacaagugugugccaccaugcccgucuaauuuuugcaucuuuaguagagacuggguuucaccauguuagccaggcuggucuugaacuccuggccucaagugauccaucugccucagccucccaaagugcugagauugcaggugugagccagccaccaugcccagccuagaucucuugaauuuauuccuccuaucuaacugaaacaucuccucaaccuucccuucuaccuccuacugugucaccuacacuuuuuuguguaugggaguguuuguggggauuuuuacaguuagauucuacauagaaauggaacaauuuuaaagugaaauuuuauccauguauucaggaaacucugcugaacaucuuuuggauaccuaucccugggugaagugugaggaauaaaagaaggagcauaaaauaggcucugcccuaaaggggcccaugguguggggagagagaacucuuguccagaucuuuagccucaacuucuucuuccuuaaauuagaguuugcuccugccuucucuuugucucacagagguaagagaaaugagaguaugauuaaaagggguugcauuauuucauguucuaaaauaguagagcauauauuuguaugguauuuuacagcuuacaaaacacauucauaacauucacguauucuguugggaagcuccaaaggccuaagaggagugauguagaagaacagccagcuagcagacuuuagcaaaccaaaaugccgaaugcuguggagaacugugucacuuccccgccuccuccucugugaagaugggagauuuagcaagaugaugggaaaggcuuugaggagugggaaagggucagaaaguaggacauuugagcaaagggcaggguaggaugauguggaggaagaagaauaguggaagcaugcuggcugggggucagaaauucagguuuuaaucaauccuggcauugccuaaacuuggcuaugcacguuggguauguccuugguuuuuucaucuguaaaaugagagauuuaacuagaugaucuccacagucccuuccagcucugacagcugauuucugugaaauguguaaaaaggaagggugaugcuucccauuuuucuucagcucuauugagcauagaaaacaaggucuaaaucaaaaguacauugugcacuuuuuaguuuacuuuguagcagcucuaaaugaagaggcuugcucuuccauuguguggcagagauuuuucagaauggacaagaugacugcacauucaagccuggagccaggggcggggcuggcuggcaacccaccucuggguugcuucugguaggcaggggcucucggaaaacugauggccuccuugugcuggguugguuggccagccagcaaggcuccuacccagaccugcagagccugcugcaggcucccuguucucagcugugcucggcugcuuaucuccugaguguuguuccaccuacuuccuacaggugcucuggcagcagccagugggccaugauuuccaggggagcugggguuggcaaacgcuuugugauggggaaggguggggcaugggaagggcuagccugaaagagacuuuagaucuucagacuccaguuugggcagacuccuucauuuguagaaugaagagauacaugugguucucucugcagcuucugcagcuguguggguucugugggcucaggccagaucuccuccaaugucaaaguccgguaugugaggcugcuuccuuccgaagugugguuuggcuucaguagguuauauguuugcucugauauccuuuuauuuugagcauuguauccaacccccaacaaaugccagaaugucugcugucauacucuguaggggcuacagcucucccuuggugugaacacccaagaucaguggccuuugguucuucucaggcagaugauucuacugcuggagaguucuuuuuuccuguuugucugaaucagguuuccuuacaccuccuaucugcuggucuuggcucugcucuccagcaccgcugacuuauuuuugcucacagguuuagcaggcgcucacuguaccugccacgugccagggcugaggucccugcgcuuacuuccucaauccugauuuucuucucuggacuucacuucuccagcuccuguggcugugaugggacucugagacccuugccagccuggacugcccugcccaaggcugucaguauccuaaaaguacagagaggccuuagagaacaggguccagggcucagcaugucacuuggacuaugagugacauagucugaaggaugcggggccuucccucucacagcaugagaacacccuuccuacaccuuuaugagagcuuuugggcagcuacucccacacuuauccagccucaugcugggcaucuucacacgaagucuggggccuuccauccuggacuuacacagcccaagugugaaucuguggaggccugcaugagucucugcuauguuuucucugguuauacuuagagauccuuuccaaccuagugagacucuuuuggaaccugacuguguuccaugaacuggggguaauaacuaaggcaauguacuuguuucaggaaccauacugugagaacuucuccccuuccuaggcccugugagccuacuuucuaaaccccugcaucugaccuggagugggguggccaguguuggaugcucaaggccaaggccuugccagcucagguuuggagugaugauggcugaguagugggaguagcugccugaaaacucucauaaauguguaggaaggguguucucaugcugcaagaggaaugccccuuguccuucagacuaugucacucauaguucaggugacaugacagcuacgguuggauuggagaggcaaccaccccuugcacccuagccauggcagccccugugcucugcagaggaaacccuugugcagauuuguccuuuccuggucagccauguuaugcuggccugucuuuggggugcauuggccuuuggcucuguaggguagguaucucuaggagcagcaagugcucugcagaugaaaauuucaaacacacauaaaaggagaaagguaaaaaaaaaaaagaagaaaagaagaagaaaggaugguaggcugaagucucuccugcaaaccuaccacguagcuucaacaaugauuagcauuuugccaacuuguuuuaucuauauuccuccacuuuuuuuuuuuggacuagaggauuuucuuuuuuuuuuuuuuuuuuugagacggagucucacucugucacccaggcuggagugcaguggcgggaucucggcucacugcaagcucugccuccaggguucaugccauucuccugccucagccucccgaguagcugggacuacaggcacccacccaccacgcccagcuaauuuuuuuuuuuuuuuuuuuuuugagacagagucucgcucugucgucgcccaggcuggagugcaguggugcgaucucagcucacuacaagcucugcccccuggguucgcgccauucuccugccucagccuccggaguagcugggacuacagccgcccgccacuacucccagcuaauuuuuuguauguuuaauagagacgggguuucaccguguuagccaggaugggcccgaucuccugaccucgugauccacccgccucggccucccaaagugcugggauuacaggcgugagcuaccgcgcccggccaggauuuucauucaaaauagaaauauaucauuucacucaugaauaguuuaggauguaccucuaguaguuagagggugcuuuacuauuuaauucaauggcauuuaucacaaccaacaaaguuaacuuuaauuucuuacuauaacccaauacccaguccauauuuaauuuuucuuuauuguuccaaaaaugacauuuuauuuuauuuaauguauuuuuuuuugagacggagucucgcccuauugccuaggcuagagugcagcggcgccaucuugacucacuguaaccuccaccucacggguucaagcaauucucccugccucagccucucgaguagcugggacuacaggugcacaccaccauuccugacuaauuuuuguauuuuuuuacuagagacgggguuuugccauguuggccaggcuggucuugaacgccuuaccucaggugaucugccuaccucggccucccaaaguguugggauuacaggcaugagccacugugccuggccccaaaaaugacauuuuaguuuguucaaacaguauccaaacaacgucuacauauugcauuugguugauauguucuguaaguuucuaacagucuccuugcuccuuuuguuuucaaauccauuuauuuggugaagacaucaggacauuuauccuagacuaucucucauuuugguuuugccuaagcacauccucuugaaguuauuuucuugcuuccuaguguccuuuuauuuccuauaaacugguaguuagaucuagaucagaauagauucaaucuuuuuggaaagaacacuucauugguauuguguacuuccuauuguaucccagaaggaggcaguaugucugucuccuugaccuacuuuagugaugaaaagauggaucaggccugggugcaguggcuccccccuguaaucucagcacuuugggaagcugggaugggcagauugcuugagcccaggaguuugagacuagccuggacaacguagugagaccccaucucuacaaaaauacaaaaaaauuagccaggcauaauggcacaugucuguggucccagcuacucgggaggcugaggugggaagaucacuugaaacugggaggucaagacugcagugagcugaaaucgugccacugcacuccagccugggugacagaguaagacuguguuucaggaaaaaaaaaaaaaaaaaaaaaaggauuaggggauucagguaguaucagugauuaauccauuauaaaguccuuaucaguuuuuuuuuugccugaugaauuuagcauucacuaaugauccuuagcuagauccauuauuucauaacagguugcaaaauuagcugaaauucuucuauaaaaauuaucugucaaccuuuuuuuuaaugcaccaaacauuuauuaaacauugcagucaauagcaggaacacaagaaggaaaaagacacaguccuacccugaagaugcccuccaaacuggguugaaucuccaugcuugaugcuccuuucaauggauuguuuuuaaauaauaauguagauauuuuuauuaaugauaauacucaugaauguaguuuaagacuuccuucugguucccuuugcccuuagguuaucccuuuucagggauauauaguucucuguuuuagaguuauuagaaaugauucuacucugugguuaucugauuaagaggauauaaaauuaagcucuuuuuucccaguuugccuuuaauuuguaaggauuacuuuuugaucaguuuucuguuguuaccgucauucugcacaauaaaccagcccaaacucaguagcuucaaauagcaauuuuuuauucucacucaugcaucugcaugcuggcuagaauucacugaucuagaccgggcuccaggcugcaguuggguccaggucagaucagugugucucucaucuucccuggacagcagucuagcuggggcauguucuucuuacggagaugagagacacacaagagggugugccuaaccucacagcacauuucaagccucugaccugaugacacaucugcuaacauuccuguagucaagcaauucaugguuaagcccaagucaaggaguuguauugcaguuacuauggcuguguaacauguuaacccaaaacuuaguaguggaaaacagccacuauucuggucacagauucugcaggucaggaauuugggcagagcacaguagaauggaguguguuucuacuucacaaugucuggaguuucagcuggaagacuugaaggccagagauuagaaucuucugaaggcucaucaauuauauguuugagagucgaugcuggcuguuagcugggagccccagggcuucuccauaugauuucuccaugugggcucauuugggcugccucauagcaugguugcugaguuccaaggguggggagagggcaagguagggguugggagacagguggaagaccguacugacuuuuaugauuuagucuuaagagacaugcagugucacuucugccacauucuguuuacuaacacagucacaagauccugccuagguuuaaaaggaggggacguggacucugucaguacaugugggacuggaaaucuugcugagaccauuuuuggaaaauacagucugccacagcuggaaaaaauauauucugccucuaguuggaggaacugcaaagacacauggcagagaacagaaaucgauggaaaguaaagaauugaaaacaacaauggcauauaccguacuuuuuuaaaauuuaauuuuuaaaaauuauauaaagcuuuccuaugauuccaaauaaaacaagauauauugagagaagucuaauuccaucuuguucccucuacuuuauucucuuugccuuucugauaagaaacaguuuuuaucagauuuuucccacuguuucuuuuugcaaauuuaagggaaaaauauauuuguuuaccuuucuuuuuuauguaaaagguagcagacucuaaguacucuucuguacuuugcuuuuuuccauguaaucaaucuugaagaucacccuguagcagaauauagaaauccuccugauuccuuuuugcaucugcacugugccucaccauguggauaugccaugguuuaucuauggacauugggcuguguccagucuuuugcucuuacaaaaagaagcacagugaggaaucuggaaaauguggcauuuuguaauuuuaccagugugucugugcgauaguuuccuagaaguaggauugcugaagcaaaaugguaaauguauaaguuguuuuucucuguguugcuaagacugagagccaaaggcagaagcaauaauauucaggcaugagaggaugaucaugguggggugcgggguuuugcaggacagggaggugggaaggggcugaguaguaagagugaugaaaagugcucaacuucugaauauauucuggaaauugagccagaaggauugcugaaugguuggcugugaagaguugaagagaggagucaggaggagcucugaguuuuggccugggcaucugguguacacagggaggaggaggaaugggccuagaccaggaguuuguucuuggacaaguuguuuuuuagaggcacccaagugagauguuagguaggcagcuggguauucaagucuggguuggaaaaauaaaguagcacuucaccugcaagugcuuuaauauuaaugccaccugguuccuacaaguacccugaaaaagagauaagggagaggaggaaauugaggcaauacuaggguuccaagagagugaaucaagugcauucaauuaaacaaauauuuaccuuaucaaaugaaacauuggaaaugaaagcacucagcaugaggccugccauuaagugccuacuaguugaugucagguuccaugcccagggcugaggauagaaagaugaacagguagauuaugcccuuauuuauuacccuagaucauguuugaguuaaacuugauugaggguauaguuccugaccucugggagcucugacucagugggggacgcuuggagggcucaggggccuacugucguccauccucaucuucacagacagcugcuaaaacagauuauagaauuuaaggcucagacugggcaguucacuugaaaggccuggcucauucuauuggcucuagaaucugcagcuagucagagaugaagcucaggccaccagagccacagagaaaagucucucacuauaggaaaagugucacuuugacucuuuagcccucacuccuguucaguaaacuucaugaagccagguggaggguguuggccuucagcuggagugacagucgugugggacaggcgccccuugacagauuuugaguauugggaagagggcaggagggagggaguuccaggucuggggcugcugcucugggguugugauuugcuguugggcagcugagcagagauaucauaauuugacuuugggauguauauuucucuggacuuagggaucaggaugcaggcuguagcacacgaagcuggcucggaagccaacagacuggaauaggacuuucccaauggccaagcacucaucucugcuccccuccugugcugaaagcacuuuuugcaaaugaugguacuuagcacugauugccuggcagccuaagauacaccacccauagagcagagucagaaggggguuuccugccagggcacuuuuggggagcuaugaugcaggcuaagccaguggaagaaagggaggaagggagcagacagaacagggaggcuugaucuggugcucccaacagacccgguuugccacuuugccugccuccacuccgccccuuccuccccagcuuuauuagggugaguguuggagcccacccaaggguccaugcugucauugguacuuugcaccuacauggccauucuguuguuuacuuugguuugagccguggaaacagagacugaagagcagcaggcaccagccucugugcugucccuacucaggcccccaguugggggugaggagcccugggaagaccauccaaaguuccaggggcagacgccagagcuacacaaucaccuccuuuucuagauaguaagaaacaaagaaaaaccucuacaccccugaguguugagugaggaaagcaaacauguucucccuguauucaaauuagccagagagccugguggggacucuugggggcaacaccuucccuuccaaugccaaggcaauaccuccccuuccaggcucacuccucugagccugccugguagugcaaauaacuuguuuucagaggcaagaagaaagaggaaacuagaaguuuugccuuuuuggaaagcauccugugcuaccugcagucccacaugaacacugacucuggggcucccaggccugugaaauggaguggaagugaccccaggaguaccagagcugagccuuccagcaaaguuuggcagggaaugugggccucagucacacuccuucagcuuccuuuuccuuagucccuacuaguggcucaggaaaaaacaagaaguucagauagcgacaggcauugcuuuugaaaagauaguaacaguacuuaguaguaacugaggaauuuuaaaaauacacugugcuuuuuuuuuaauucuguguagcucuggccaauagagaguuaagagcacuggugggauggaaauacuaauuccagagagguagugggcauuuccaagcaucccacagcaagucaggggcaggacagggaagaggagccuggguuuccuagcuccagccucugcuuggugaaucucccuggcuacuuuggaauaagaaagcuuucauguguccagugaagggucagggcauccaguggguaagaauggcauacuuccugccccuguugcagggcacaggccucuggguagaguagacugggguuggggagacgggggugggcagcuucaaguagcuuugggguauaaggcuccagggccagaagagcccaggacucauaggauggaguuugguggcaaagccucugccacagugagacuacuuggaacagcccacuuugguagugcacucacucugagccaggccccagaggccucaggguauaguagggaaugaggacagagauuguucaucccuuucuuccuccaacugccauggacaugggggauaacucuguaaacaagccgacauguucuagaugcauauggagcacacagccaucaggaguaagacccacaccauguaagugauucugguaacguguacugauuauuauucgauggcaugcaguggggguggguuuaggcauaagggauagagguagcaacaccaacuccccauaccccaauaaauuagcuuuuccagagacccugcuuuauccucagagaaggcuuugcuccccagagcacauaucauuuugagaauauuguuucuuuguccauucauucaacaagcauuuagccccugcuguguaucagagucugcgcaggcucugaguucacagcggaaacacaacagucagcagguuggaucccacagacuguaugagcacaacacagucugaauauagcauugaauacugaaacaguguugaccauuggacuuguaggagcucuuuucuugggaaaacuuuaguuuauaacaugauggagauugaauuaaucugacauaaaaacuuuuugggacaaaaauaaaugauuuuguuuauuguccauaagagaucuuaaaaagucuuuuguuugggaauggaaccucuacucaaacccagguuugggcucccuagggccuugaagucagugggagcagcugaguagggagugggugauggaucaaggaacacauuuaggggaaaauaucacaauccaacuuggacagccucaggucgaaagugggugauauuauaagaucagagugguauccuuuggaacucaaggauaguuugcagccaggucuuggacaagaaugaggaaucagggaaaccauccccuguaucuacuuucuuucuuuuuuuugagacggugucuugcucugucgcccaggcuggagugcaguggcgcgaucucggcucacggcaagcuccgcuucccggguucacgccauucuccugccucagccucacgaguagcugggacuacagucacccgccaccacgcccggcuaauuuuuuguauuuuuaguagagacaggguuucaccauguuagccaggauggucuugaucuccugaccuugugauccgcccgccuaagccucccaaggugcugggauuacaggcaugagccaccgcgcccagccaccuugcauuuucaugggcuccucagaucccucagcugugugugcagaagaaaggaggaaggccggugaauaggcagccucugccaaguaccucuuuuggggaugacucucagguacuccgagacugggggaggccaagucucagaguaccugagggacccaggcucauggagacuucuccacuccgucuuuccuaggugcaaugccagggucuuggauguagcggugagcaaagcuggugcagcccuauucucaaggagauaagggccuaaugggagagacuaacuuuaaucacauacaaaucaaaauucuauugaaggaguaggaccagaagccaugagaacuaaugcccugaggcagugaugccaggugaagacaugugugaugugugucugaggggugaauaggagucaaggaaauagguagguggggaggaaaggggggucaagccuucuaggcagguggaaccacacaugcaaaggcccugaggcucaugaucaaagaaauaggacaugccuuuucaguggaagauggaccagaaagauggaggggagcaaagggacauguucuggcaaugguacacacagccuacuucuagccaggacauccuccugcuaugauugcugggacugguuguucugucuuuccuguccccucuaacuccuccccagcuuuuuccucugggcuccaacaggagcucacugccccucccugcuuugggguuguuuguccagcuaguugcuccugccacuaugagagggcaccaaaauaguuguugcccccaugaggagagguagagagguagcagcaguacuuucucucugguuuuuuuuuuuuuuuuugagacggaguuuugcucuuguugcccaggcuggagugcaauggcgcaaucuuggcucaccacaaccucugccuccuaaguucaagcgauucuucugccucagccuccugaguagcugggauuacaggcaugugccaccauacccggauaauuuuguauuuuuaguagaaacgggguuucuccauguuggucaggcuggucucgaacucccgaccucaggugauccgcccgccucggccucccaaagugcugggauuacaggcaugagccacugcgcccagccuuucuguuuuugagauggggucuugcuccguugcccaggcuggagugcaguggugcagucacagcccauugcagccucagccucccgggcucaagcaauccucucaccucauccucccaaguagcugggacuagaggugugcgucgccacaucuggcuaauuuuuguauuuuuguauuuuuuuuuuuuuuuuguagagaugggguuucgccauguugcccagacuggucuugaacuccugggcuaaagcgaucugccugccucagccucccaaaguuuugggauuauaggcgugagccacugugaccagcuaauaguacuuuuaaaaacauguuuuuggaugcauagugaaauuauuaucucuuucccaggagucaucaggacuagagguacagucagguuugacugcugaccagggaucauacucuggcagguuccccacaggaagugcauugcaggggugggggcaggaaagccugcacaugguagcuuuuuucaggugaccaugacaccccugaccacaguuggagugcaauggcguggucucggcucacugcaaccucugccuccuggguucaagcgagucuccugccucagccugccuaguaacugggauuacaggcgccugccaccaugccuggcuaauuuauguguuuuuaguagaggugggguuucuuuuuuuuuuuuuuuuuuuuuuugagacagagucucacucugucaccgaggcuguagugcaguggcacaaucucggcucacugcaaccuccaccuccuggguucaagugauucucuugccccagcgaguagcugggacuacaggcgugugccaccaugcucagcuaauuuuuauuuuuuucuuuuuaaguagagaugggguuucaccauguuggccaggcuggucuugaacuccggaccucaagugauccgccugccuuggccucccaaaaugcugggauuacaggcaugagccaccgcacccagcuggugucccuuuuuuauauuacucuucugaguucugguaugucaguacuuuugaguuuugacuauguugaugagacucuucuggaauuuuuucuuuuggcuuaaaauuuuaaaaaauuauacaaguaaggccgggcgugauggcucacgccuguaauccuagcacuuugggaugccaaggcgggcagaucacuugaggucaggcuugaguugccgaagaucagccugggcaaaauggcaaaaucccaucucuacuaaaaauacaaaaauuagccgggcgugguggugggcaccugugaucccagcuacuagggaggcugaggcaggagaaucacuugaacccgggaggcagagguugcaguaacccgagaucgcagcacugcacucuaaccugggcaagagagugagacucugucucaaauauauauauguguguguauauauauguaaauauauauguguguauauauauguaaauauauauauguguauauauauguaaauauauauguguguauauauguaaauauauauauguguauauauguaaauauauauguguguguauauauauguaaauauauguguguauauauguaaauauauguguguauagauguaaauauauaugcguauauauauauuugagacagagucaaauauauauacauauauauguguauauauauaguauauauauguauauauauguguguguguguguauauauauauauauauauacaaguaagacacagacacauucuuggaguaauauucaaacaauucagucauauauugaaguacaacguccacugccccuuuuuuucuagugcaguccaucuccaccuugggucaacuuccacugccccuuccuuuuccagcauuauuacuuuucugggcauauuucuaggaucuuuuuagaagauuauaggaucuuuuuagaagauccuagaaauaugcauuuauaucugugaaccuauugugaauauacacacgcauacuuuuuugaagaaagaucauacuaaaugcauugcuuugcaccuugcuuuuuucacugaacaauacgggagauacuucuccccacccucccacuuuucagagaauuagcuguuuuggucccagauaacuuuuguaagagacaagguguugucucuuacugaauuagaguaaccgcuggugccuuuuggggcuguuggguacuccugugucccaggugaaucuccaaguaaaccacuauaucuucuguucuagcuggauuccuacuugcuccaucucugagggcacugugagcugcagcagcauccugcuuggggaggacaguggccuugucaccuagguucugccuuuggauuccagggagcuuccaggcucuugucucccuuucuggccagggcugucucuugaaugcaggaauaucugggaaauucccuguuucuuccuugguaagaggugugaauucacuuuucuuuuuuuuucuuuuuucuuuuuucuuuuuuuuuuugagacagagucuugcucugucacucaggcuggaaugcaguggcacgaucucagcucacugcaaccuccaucuccuggguuaaagugauucuucugccucagccucccaaguagcuaggauuacaggcacccaccaugaugcucggcuaauuuuuugaaauuuuaguagagaugggguuucaccauguuggccaggcuggucuugaacuccuggccucaggugauucacccaccucagccucccaaagugcugggauuacaggcgugagccacugagcauggccucacuuucuuuauucauacccucauaucugggcagucugccuugcucaggcucauacucaucugagcagaagacugcuuucagagguucccugggagcagggccauugcagcaugaguagucauuugcagccagcauccugccuuucuucuugaugccagauggugcccuacauugguauaugcugccugugucccuucagagacucaaccccaauccggaaggagggugguucccaucucucuggaacucuucuccaaagguuuugguguuuggaauuugaaauuuuuuucuagugcaguccaucuccaccuugggucagaccuccuuuccagggcacgauagugcuuggagucauucauuuauucaacaaauauguauugagcaccuguuacaugccaaacacuguucuaggcaguacuuaauguuggcuacuaauuauguccugcucccgaauuucuucgcuaucuugcuuguuucccuauggcuugugagaggcuucugccucuaaauuuaccccaggaauaugaauuuugaauuucuaggcaaucaaauuacaagaguuuguuccuggguuuuaacucaaauucuacccuacugggaacauuuuuuaucuucuaugaaauggcaaacagcuaggagacauguuuccuaggaacuggccuucuuggugcauuucagaggaagcacuucauuucagaggguugagauugugagagcagggcuuggaggccaggaguucccaggccagguccuagccuugcugccuguuuuucuguugaccuucagcugcuuuguuucuuuuuucuuuucuuuucuuucuuuuuuuuuuuuugugagacagagucucgcacugucgcccaggcuggagcucaguggcaugaucauggcuuacugcaaccuccaccucccagguuaaagcgauucuccugccucggccucccaaguagcugggauuacaggcaugcaccaccaugccuggcuaauuuuuguauuuuuaguagagaugggguuuuaccauguugcccaggcuggucucaaacuccucaccucaaguaauccacccgccucggccucccaaagugguggaauuacaggcaugagccaacgcgucagcuugcuuuguuucuuuaaucuuuaguuuucuuggaaaaaauggaaaugauaagaauacccaccugugugguuguuaggcagguauuauguaaaggaagagccugcuacauagagugagcugagaacugcuggggguagcgggguuacuguccugauucccagcagugaaaggcauuuaaaucauuacagguuucacaccuaaguuuucuuuuuucauuuuaaacaucacuuguuauuuucuaauuuuguggaugcuuaauacauuagcacacuaauacaugcuuacaauuuagaaacgaauauugcauauuugggggcuguaggcucggcuauccuuuucuuaaagacaggaccguccuuguugcccaccuaggauggucucaaacuccugcccucaaugcugccacagccucccaaguaacugggauuauaggcacaagccacugugccuggcuaguuacucuuuuaaaaauaucuuucugagauauaauucacuuaccauagaauucacucauuuuaacugugccauccaaugguuuuuagugcacuuagaguucuacaaccaaagcuacaguuuuuuuuuuuuuauaagacggagucucgcucugucgcucagccuggagugcaguggugcgaucucagcucacugcaaguuccgccuccuggguucacgccauucuccugccucagccucccgaguagcugggacuacaggugcccaccaccuugcccggccaauuuuuuguauuuuuaguagagaugggguuucaccguguuagccauguggucucaaucuccugaucucgugauccacccgugucggccuccuaaagugcugggauuacaggugugaaccaccgcaccuggcccaaagcuacaauuugagaacauuuucaucacccacaagaagaaaccccauacccaaaaugucacuuuccauucuuccccccucuaucuauccuccaggccuaagguaaccacuaaucuacuauccaccucucuagauuugccuauucuggacauuucauauaaauggaaucaugcaauguguguuuuggggguuuggcuucuuucacuuaguguguuuuccaaggcucauccaggauguaagauguaguguguaucagcacuucauuccuuuauucauuuauuuguuuagagagggaaucuuacucugucacccagaggacauggaggcuggaguacagugguaugaucauggcuuacuguaaccucaaacuccugggcucaagagauccucccaccucagccucccaagcagcuaggacuacaggcaugcaccaccaugccuggcuaauuuuuuuuuuuuuuuuaagugacagaaucuuccuauguugcccaggcuggucucaaauucauggcuucaagugauccuccugucucaggcacccaaagugcugggauuacaggcaugagccacugcacucagccaguuacuucuuuccuucuuauugcccagugauauuucauuguauggauguaccacauuuuauccauuuaucaauaaguaugauuuuagguauggguuuuucauagaugcgcuuuacaauuuuuuuuuuuuuugagacggagucucgcacuguugcccaggcuggagugcaguggcaggaucucugcucacugcagccuccgacuccaggguucaagcaauucuccugccucagccuccuaaguagcuaagauuacaggcgcccgucaccacgcccagcugauuuuuucuuucuuucuuuuuuuuuuguauuuuuaguagagacaggguuucaccauguuggucaggcuggucucgaacuccugaccucaugauccaccagccucggccucccaaggugcugggauuacaggugugagccaccgcaccuggcuagaugcgcuuuaaaaaauugaaauuccuuucuauuucuagucuguuaaauuuuuuuaagcauaaaaagguauugaauuggaaaagguaugaaaugcuuucugcaucuaucaagaugaucauguaguuuuuguaaucuugauagaugguuuuuguccaucauucuauuaauaugcuauauuaauugauuuuuuagauguuaagccauaauugcaugucugagaaaaauucauuugguuauuauauuaaauccuuucuauaugucaccggauuuguuuugcuaguaguuguuuauaauuuuugcaucuauaguaacaagauauauuggucuaaaguuuucuugugauguuuaugucuguuuuuuuacaaauuuaauuugauuauuuuauuuuguuuauuucauuuuauuuagauacagggucucauuauguuccugaggcuagauucaaacuccugggcucaagugauccucccaccuuauuccccugaguagcugggacuacaggcaugugccaccacauccaauuuaugugugguuuugauaucaggguaauuguggccucauggaaugaguugagaaguguuuuauccuguucuauuuuuuggaagaguuugugaaagauuaauaugaaaucuuaagacaguuuuauugagauauaauuaauaugccagaaaauuuacccauuuaaagaguauaauucagugguuuauuacguauuacauuauaaauuuuuuuaggaucuugcucugucaccgaggcuggagugcaguggugcgaucaugacgcacugcagccucagccuccugggcucaagcaguccucucaucucagccucccgggcucaagcaguccucucaucucagccucccaaagggacuacagucaugcaccaccaugucuggcuaauuuuuuaauauuuuguagauaucagguuuuacuauauagucuagacuggucucgagcuacuguacucaagcaauccuccugccucugccucccaaagugcugggauuuacaggcaugagccacugugccuggucacauuauuaaucuuuuaaaaauggugauaaaauauaaauaucauaaauuugccauuuuaaccauuuuaaguguacaauuuaguggcauuaauuacuguauauucaugauucauguugugcaaccaucaccacuaucuauuucuaaaauuuuuaaucaccccaaacucugaccauuaaccagcaccuccccauugaccccuuucuucagcgccuguuaacuuuuuuuuuuuuuucuuuuugagacaggguuuugcucucaucacucaggcuggagugcagugguguaaucuuggcucacugcaaccucugccucccgggcucaagugauucucaugcuucagccucccagguagcugggccuacagaagugugccaccaugccaggcuaauuuuuguauuuuuaguaguaaagacuggguuucgccauguuggccaggcuggucuugaacuccugaccucaagugaucugcccaccucagccuccuaaagugcuggaauuacaggcaugagccacugcgccuggccuauccauuuauugaugggcacuuggguuguuucuacuuuuugacuccaguaguccccccuuaucugcggucuugcuuucugugguuuuaguuacccacgguaugguacaaucauauuuugagagaacacauucauauagcuuuuauuacaguauauuguuauaacuguucuauuuuauuauuaguuauugugaaucucuuauugugccuaauuuauauauuaaacuucaucauagguuuguauauguaggaaaaaacaaggcugggcaugguggcuuacgccuguaaucccagcacuuggggaagccgaggugggcggaucacaaagucaggagaucgagaccauccuggccaacauggugaaacccugucucuacuaaaaauacaaaaauuagcugggcaugguggcacgcgccuguagucccagcuacuugggaggcugaggcaggagaauugcuugaacccaggaggcagagguugcagugagccgaaaucgcgccacugcacucuagccugaagagagagcaagacucugucucaaaaaaaaacccaaaaaacaaaacaaaaaaaaacaaacuuuguguauauaggcaucuacugggggucuuggaacauauccccugaggauaagugggggcuacuauauugugaauaaugguguaauaaacauuggcauucaaguaucuguucaagucccugguuuuacuuccucuggauauaaaccuaagaguggaauuccuggaucauaugguaauuuuauguuaggcuuuucgaggcgcugccaaaaauuuuucuguagcagcuguaccguuuuacauuuccaccaucauuguaugaggguuccaauuuuuccacguccuugucaacacuuguuauuuucuguuuauuuuguuuguuuuuaguaauagccuaaagagugugaagugguaucuuauuguaguuuugauuugcauuuuucuaaucaauggcuuauuggccauuuguaaaucuuuagagaaaugucuguucaaguccuuugccuauuuuuguuuucaagacagggucuugcuguguugcccaggcuggaguucaguggcuauuuacauuugcagucauaacacacuacaggcucaaauuucugggcucaagcaacccucuugcuucagccuacugaggaacuggaacuacaggcccagcugaaaugaacugccuuuuguguguugauuuuauauccuucaguuuugcugaaguuguuuauuaguucuaacuuuuuuguggccuguuuaggguuaucuacauguaagaucauguggucugcagguagagauaauuuuacuucuucuuuuccaauuuggauguccuuuauuuauuuuuuuucuugcccaauagcucugacuaggacuuccaguacuauguuagauagaaaugguaaaacuuccuugcacaucguugucuuguuucugauuguaaagggaaagcuucuaauuuuucacuauugaguauuauguuagcugugaacuuuucauaaauaguccuuaucauauugagaaaguucccuucuauuucuagcuuaagucuuuugaaucaugaaaguguauugacuuuugucaaaugcuuuuucugcaucaauugagguaaacauauaguuucuucccuucauucccuucauucuauuaauaugguguauuacauuuauuuauuuauuuauuuauuuauuuauuuaugagacagggucuugcucuguucccaaggcuggagugcaguggugcaaucuuggcccacugcagccucugccucccagguucaagagauucuccugcuucagccuccagaguagcugggauuacaggugcgugcaacuacuccuggcuaauuuuuguauuuuuaguagagaugggguuucacuauauuggccaggcuggucucaaacuccuggccucaagugauuugcccaccucggccucccaaagugcugggauuacaggugugagccacugugucuggaacauugauugauuuuuggauguucagucaaccuugcauuccagaaauaaagcccaauagaaggauguacaauacuucuaauaugcugcugaauucagugugcuaguauuuucuuaaggauguuugcaucucuuuucauaaggaaaauugaucuguaguuuucuuguaguaucuuuguugauauuaauuuauuuuuggcugggcacaguggcucaugccucuaaucccagcacugugggaggcugaggugggaggaucacuugaacucaggaguucgaggcugcagugagcuaugauugugucacugcauuccagccuggaugacagagcaagacccugucuguuauaaaauaaaauuuuuaaaaaauaaauucuuuuucaaugguuaguaggauucaccagugaagacaacugagcauaagcuuuucuuugugggaaguuuuaaaauuacuuauucaguuuauuuauguguuauaggucuauuccgauuuuucauuucuuccugagucaguuuugauaguuugcaucuuggaauuugucaauuucaucuaaauuaccuaaggaugugugguuguucauaguauucucuugcaauccgauuuauuuauuuauuuauuuauuuaucaagauggagucucgcacugucgcccaggcuggagugcaguggcgcgaucucggcucacugcaagcucugccucccgaguucacuccauucuccugccucagccuucugaguagcugggacuacaggugcccaccaccaugcccagcuaauuuuuauuuuuauuuuuuuuauuuuuaguagagacgggguuucaccguguuagccaggagggucucgaucuccugaccucgugauccacccaccucggcuucccaaagugcugggauuacagacgugagccaccacgcccggccaauccuuuuaauuuauuuaagauugguaguaacauccuuucuuuuauuucugauuuuagucauuugaaucuuuuuuucuuuguuaaaagaaggcuuauugauuuuuuuuuuaucuuuugaaagaaccaucuuuugguuuuauugucuuucucuauuuucuauucuguauuucaccucuaaucuuuauuauuuucuucauuauauuuacauuguguuuaguuugcucuucuuuuucuaaguauuaagucggaaguuuagguuauugguuugaggucuuuucucuuuuuuguuuuauuuucuauuuuucauuuuuuugggcacuuaguagguguauauauuuauaagguaccugagauguuuugauacaggcaugcaucgugaaauaagcacaccauggagaaugggguauccauccccucaagcauuuauccuuugaguuacaaacaauccaaucacauucuuuaaguuauuuaaaaauauacaauuaaguuauuauugacuauagucaccuuguugugcuaucaaauaguaggucuuauucauucuuucuaacuauuuuuuuguguacccauuaaccauccucaccucuuccaccacccucccacuacccuucccagccucugguaacuauccuucucuucuccauguucauggguucaauuguuuugauuuucagaucccacgaauaagugagaacaugcgauguuugucuuucugugccuggcuuauuucauuuaacauaaugaucucuaguucuggccguauuguugcaaaugacuguaucucauucuuuuuuuauggcugaguaguacuccacuguauauacgugccacauuuucuuuauccauucagcuguuguuagacaccuagguugcuucgaaaucuuagcuauuauaaacagugcugcgacaaacucaggagugcagauaucucuucaauauauugauuuccuuucuuuuggguggauacccaguggugggauugauggaucauaugguagcccaauuuuuaguuguuuuuuuuuuaauuuuaauuuuuauuuuauugaauuauuuuuggugugucuaggucaaggaaagaggagaucguggguggggaaacagacugagggaaucagaagcaccacuguccauccggaauuaaauccacaucccaguaucuucugcacauauuucacuaauuauuuccucucggaacuccuccccucgugcuucuuccucuggugaggccggcgcucccuucccaggccgcagcggacagacagggauuggguuucgugugccugccacaccaggcaggcucuugcggcucccaacuaggcggccuugcacuccgugugcacuggccacacauccuugccuccuccacccgguccgccgccgguuuccuuggaaguuaaaucuuggaggauuuguccacaccccucacguuucuucagccgccccugggcgcugcgucuaaccccaauuuuuaguuuuuugagaaaccuccaaacuguucuucauagugguuguacuaauuuacauucccacuaacaguguacaaggguucccuuuucucuacauccuugccagcauuuguuauugccugucuuuuggauaaaagccauuuuaacuggggugagaugauaccucauuuaguuuugauuugcauuucucugaugaucaaugauguugaauaccuuuuuauaugccuguuugccauucgugugucuucuuuugagaaaugucuauucagaucuuuuguucauuuuugaucggauuauuagauuuuuuucuauauaguuguuugagcuccuuauauauuuugguuauuaaucacuugucagaugguuaguuuguacauauuuuauuccauucuguagguuguuccuucacuuuuuugauuguauccuuugcugugcagaagcuuuuuaacuugaugugauuccauuuguccauuuuuguuuuaguugccugugcuuguuggguauuggucaagaaaguuuugccuggagauuuuccccuaugguuuccuauaguaguuucacaguuugaggacuuauauuuaaguccuuaauccauuuugauuuuauuuuuguauaugaugagagauaggggucuaguuucauucuucagcauauggauauccaguuuucccagcucuaucuaucuaucuaucuaucuaucuaucuaucuaucauuaucuauuuacuuauuuauuuauucugagacagggucucacucuguugcccaggcuggagugcaauggcacaaucauggcucacugcagccucaaccucagccuccuggguagcugggacuacaggcacacaccagccaauuuuguguauuuucaguagagacaggguuucaccauguugcccaggcuggucuugaacuccuggacucaagcaauccguccaucucagcuucccagagugcugggauuacuggugugagacaccauacccuacccccagcaccauuuauugaagauacugucuuuucuccaguguguguucuuggcaccuuugucaaaaaugaguucacuguagguguguggacuuguuucuggguuuucuauucuguuccauugguguaugugccuuuuuaaaaugccaguacaauguuguuuugguuacuauagcucuguagucuaauuugaagccagguaauaugauucuuccagcuuuguucuuuuugcuuaggauagcuuuggcuguucugggucuuuugugguuucauauaaauuuuaggauuuuuuuuuauucugugaagaaugucauugauaguuugauagggauugcuuuuaauuuguagauugcuuuggguaguauggacauuuaaacaauauugauucuuccaauccaugaauauggaauauuuuuccauuuuuugguguccucuucaauuuaauucuucaguguuucauaguuuuccuuauagagaucuuuuacuucuuugguuaaguuaauuccuagguauuuaauuuuaugugugguuauuguaaaugugauuacuuuuuauauuucuuuugcacauuguucacuguuggcauauaguaauagaaauacuacugauuuuuguauguugauuuuguaucuugcaacuuuacugaauuuaucaauucuaauaguuuucuuguggcaucuuccaguuuuuacaaauauaagaccauaucaucaguaaacagggauaauuugacuucuuccuuuccccuuuggauccccuuuauaucuuucucuugucugauuggacuuaaguacuguuguuacugguggagggucuugacuacaagugguccagguucuuggcauuuugaacaaagaauuggagaaaacgcacaaaacaaacgaaagaaugaagcaaugaaagcauagauuuauugaaaugaaagugcacuccacagacugcgagcaggcuagagcaagcagcucaagagugcugcuuacacaauuuucugggguuuaaauagucuuuagauguuuccuauugguugcuugauuugcucccuguguagaugaagugguagccugugaccaguaugauugguuguggaaggcgaucagucagaggcugaagugaaguuacaaaguuacacccuaugcaaaugucugauugguugcgggagaggaccaaucagggguacuuucuguuucucaucugccaugcaaaaggaguaacuucugucauuuuguuacuugggcagggaaaguugggguuuuucuuuucuuuucuuuucuuuucuuuucuuuucuuuucuuuuuuuuuuugagacaagagucucgcucugucgccugggcuggagugcaguggcgcaaucucggcuaacugcaaccuucgccuccugggcucaagcgauucuucugccucagccucccaaguagcugggauuauaggcgccugcuaccacgcccggcuaauuuuuguauuuuuaguagagaugggguuucaccauguuggccaggcuggucucaaacuccugaccuuagguaaucugccugccucagcuucccaaagugcuggaauuacaggugugagccacugcacccggccgggauuuuccuuuugauucaguucuaggaagucagugcaaauugaccuuagguucccuuccuccagacccuauucuccugccucacuauguugaauagcagugaugacagugggcauccuugucauguuccagaucuuagaggaaaggcuuucgauuuuuccccguucaguaugacacuagcuguaggucugucguauauggcuuucauuauuuugagguauguuccuucuauccccaguuuuuugaggguuuuuuuuaaaaucaugaagggauguugaauuuuuucaaaugcuuuuucagcaucaauugaaaugaaucuuucuuuucuugaauauagguauuugcagcuagaaauuucucugaguacugcuaucacuacauccaauguuuugauaugcaguguuuucauuuuaauuccucucaaaguacuuuaaaauuucuuuugugauuucuucucugacccaugaguuauuuaggaauguguuguucaauuuacacuuauuugugaauucugcaaauuuauuucuguuauugauuucuaauuuaauuauauuguguucagaaaacauucauuguaugauuucaagucuuuucaauuuuuugagguuuguuuuguggccuaguuuauggccuaaucuggaggguguuccguguacauuugagaagagugcgcauucugcuguuguuggguggaguguuuuuuuuuuuuugagacagagucucgcucugucgcccaggcuggagugcaguggcgcgaucuccacgcacugcaagcuccgccucccgcguuuacgccauucuccugccucagccucccgaguagcugggacuacaggcgccugccaccacgccuggcuaaauuuuuuuuuuuuuuguauuuuuuaguagagacgggguuucaggauggucucgaucuccugaccuugugauccgcccgccucggccucccaaagugcugggauuacaggcgugagccaccgcgcccggccggguggaguguuuuuuaaauacccguuaguucuaauuaguuuauaguguugcucaaguuuuuuauuuucuuguugaucuucugccuaguuguucuauccauuauuauaaaguauugaaguauccaauuacuguuguugaauugucuauuucucccuucaauuccgucaguuuugcaucaugaauuuuggggcucuguucuuaggucuauguauguguauauguuuacaaauguuauaucuuucuaauggauugaccucuuuaucaaucuucaaucuucauuuucuuuuucuuucuuucuuucuuuuuuuuuuugagauggagucucacucugucgcccaggcuggagugcaguugcgcaaucucagcucacagcaaccuccgccuuccagguucaagcgauucuccugccucagccucccaaguagcugugacuacaggcgcaugccaccacgcccggcucauuuuuuguauuuuaguagagacgguguuucaccauguuacccaggguggucucaaucuccugagcucaggcgauccaacagccuuuggccuccugaagugcugggauuacaggcaugagccaccaugccuggccaaucuucauuuuauuuuuccuucuuucuuuuucuuuguuuuuuuuuuuugagauggagucucacucugucgccaggcuggagugcaguggcgcaaucucagcucacugcaaccuccgccucccagguucaagugauucuccugccucagccuccugaggagaugggacuacagucgugugccaccacgcccagcuaauuuuuguauuuuuaguagagacgggguuucaccauguuggccaggauggucuugaucucuuaaccucgugaucugcccgccucggccuccuaaagugcugggauuacaggugugaaccaccacgccccgccaaaucuucauuuucaauaacauuuguuuuguguuguaaagucuguuuggucugguauuaguauagccauuacagcugucugugguugcuguuugcaugauaaucuuugcccauuaaaaaaaauuucaaccuauuuguuucuuugaaucuaaaauauguccuuuagauagccuuuuguuggauucuuuaaaaaaaacaaaucugauaaucucugccuuuagauuauuuaauccauuuucauuuaauuaacauuauuaauaugguuggauuuauaucuggcauuuugguuuuuuacuauuugucucaugcuuuuuuauuuaucucuuccacuguaauuuacuacuuuuuuuuauuaagugggcauuuucuaguguaacauuuuaauuauauauuuuaaaauuaugugccuagugguugcuuuagggcuuacaauacacaucuuaauuuaucacaaucuacuucaaauuaaugcuaacuuaauuccagugaaauauagaaacuuuacuccuauacagcuacguuacuucccccauuuuugugcuauuguuauauauauuauaucuacauauguuauaaacccaauaaagcauaauaauuauuacacauaauuauauaguuauaauugugacuuuauguaauauuauauaauguuauauaaccuuauaugaucuuuuuaagagggugagagaggccagguucaguggcucaugccuguaaucccaacacuuugggaggccgaggugggugggucacuugagaccaggaguuugagaccagccuggcuaacuaacauggugaaaccccgucucuaccaaaaauaguaaaaauuagcccugggaggcaggagaaucccuugaaccccggaggcagagguugcagugagcugagaucacaccauuguacuccagucugggcagcagagugagacuccaucucaaaaaaaaaaaagaaaaaaagaagcugagaggaauaaaaggagagcaaguguauauuuguagaguuuguuguauaucggcccucuuauuuaccauuccuguggguucaaguuacuaucugaucauuuccuuacuucaauacagcuuuguucccacuuaccuccuuugugcucuuuuugucaaacauauuacacuucuauauguuacauagaaacaauacagacacauacacacauuguuuuauggaauugcuuuuuaauucaguuaagagaguaaaagagaugaaauaugcaauuaugcuuucuuuuguacuuaccuaccuaauuaccuuuaccagcacucuuugucuuuuuguguggauucaaauuaugguauuguguggugucacuugcuuucugccuaaauaacuuuguuauuucuuguaaggcaaucugccaccaacaauuuuuuuuccugcuuuuguuuaucugguaauaucuuuauuuugccuuuauuuaaaacuaaucuauuucuuccagauuuuuguuuuuguuuuuguuuuuuuuugaggcagggucucacucugucacccaggcuguagugcaguggcaugaucucagccucgaccucccaggcuaaagccauccucccuaccucagccucuugaguagcugggacuacagaugugugccacuaugcccaacuaauuuuuguauuuuauguagagaugggguuuuggcauguugcccaggcuggucuggaacuccugagcuaaagccauccacccaccuuggccucccaaaggguacgauuacaggcaugaaccaccgcccccagccucuuccagagauuuucaaacugccuuuauauuuguuauuuaaaagaucacuggcucugauaaaguugagagccaaagacagaguaauauuauaaaaugaugaaauaucaacacaucucucauucacaauuuuuaaaaacugacaaaccaaugggauaggauaauuugagagagacaguugauuuuuuuaaaauugugauuauuauuucucaauuauuuauuuauuuauuuauuuauuuuuuugagauggagucucacucugucccaugcuggagugcaguggcaugaucuccacucacugcaaccucugccucccggguucaagcgauucuccugccucagccucccgaguaccugggauuacaggcacgcaccaccaugcuuggcugauuuuuauauuuuuaguagacacgggguuucgccauguuaaccaggcuagucuggcacuccugaccucaggugauccacccgccucagccuccaaagugcugggauuacaggcgugagccaccgugcccgaccaauuauuucucaauuuuuuaaaaauugaauuucacaugcagcuguaagaaauaauacagagagggccggacgcgguggcucacgccuguaaucccagcacuuugggaggcugaggcgggcggaucacgaggucaggagauggagacuauccuggcuaacacggugaaaccccgucucuacuaaaaacaaaaaauuagccgggcgugguggcgggcgccuguagucccagcuacucgggaggcugaggcaggagaauggugugaaccugggaggcggagcuugcagugagccgagauagcgccgcugcacucuggcccgggugacagagcgagacuccaucucaaaaaaaaaaaaaagaaauaauacagagagauuccuuuuacauuuugcccaauuuuucgcagugguaauguuuagcaaaauggugcaguaugauauuauaaccaauauucauaaaauccaccaaucuuucucagauuuuucuaguuuuacuuguacucauuugugugugcuuaaguuguauacaauuuuaucacuuguguagguuuguguaucuaugaccacagucaagauacugagcaguuccaagcacagggauccuuuguguugucuuuuuacaacuguauucaccucguuuugcccaacccuuccaccccaucccuaaucccuggcaaccacaaaucuauccuccauuaaagcaaaauauguuauuucaaacauguaguauaaguggaauaauacaauguguaaccuuuugggguuggcuuuuuucacucaguguaauucccuagagauucauccacuuguuguaucugucaauaguucauuccauuuuauugcugaguaguauuucaugguaugcauguaucacaguuuguucaaccauucacuguugaaggucaucugggcugacuccaguguuggucuauuacaaauaaaccuuuuaugaacauugaugcacagauuuuugugcaaacacaagucuucauuuuucugguauaaauguccagaaauaaaaucgcugggucauuugguaguugcaugcuuaguuuuuaaagaaauugccaagcuuuuccagauugauugugccauuuauauuuccaccagcaauguaagagugauucagucucucugcaucuuuguaaguauuugguuguuuuuucauuuuaguuaucauuauaggucuguagugaauccuguugugguuuuaauuuguauuuccauaauggcuaaugauguugaacaucuuuucauacacuuuuugccauguguguauccucuucagugugucuguucauguuuuuugcuguuuucuaaauuuuuuucuucuguugaguuuugaggguucuuuauauauucuagauacuaguuuuuuuuuuguuuuguuuuguuuuuuguuuuuuuuuuuuuuugagauggagucucgcucuaucgcccaggcuggagugcgguggcgugaucuuggcucacugcaaacuccgccucccagguucacgccauucucuugccucagccuccugaguagcugggacuacaggcacccgccaccacgccuuccuaauuuuuuguauuuuuaguagagacaggguuucaccguguuagccaggauggucucgaucuccugaucuggcgauuggccucccaaagugcugggauuacaggcgugagccaccacgcccggccgcuagauacuaguuuuuaaaaauuaaauauguaguuucaaauacauucucccagucuguagcuuuucuuuucauucuuuucacaugggcuuuaacaaagcaaaaccuuuuaaauuugaugagaucuaauuugucagucuuuccuguaauggcuuaugcuuuuaguaucaagucuaagaacucuuugucuaguuguagauccugaaauuuuuccuaacauuuaagucuauuagccauuguuaguuaauucucauauaagguuucaagcuuaggccaaaauuuauuuuuuaaaacaaauauggauauccaguuguucuagcaccauuuguugaaaaggcugucuuucauccuuugaguugguuuugcagcuuuauaaagaaucaauuuaguauagcuguguggauguauuucugaauucucuauucuaaauccucuauugauuuauguguuuauccuuccaccaguaguauacuguuuuuauuacuguagcuacacaggaagucuuaaauuggguagaauaauuucucccacuuuauucuuuuuugagaagauuauuuuaguauuccaggguccaugccuuucuacauaaauuuuagaaugaguuuuucuaugucuguaaaaaaauuacugagauuuugauaggaauugaauuaaacuuacagauuaauuugggaagaaugaacaucuuuucuacauugacuauguucaguccaugaacauaguauaucuucccauuuauuuaguuuuuuuaaaauuucuuucaucagcauuuuauaauuuuuaacguacagauccuacaauuuuuuuuuuuuuuugagaccaagucuugcuugcucugucaccaggcuggagugcaguggcacaaucucggcucacugccgucucugccucccagguucaagugauucuccuggcucagccucccaaguagcuaggaccacaggcgugcaccaucaugcccggcuaauuuuuuguauuuuagcagagauaggguuucaccauguuggccaggauggucucgaucuccugaccuugugaucugccugccuugaccucccaaagugcugggauuacaggcgugagccacugcgccuggccacaauuuuuuuuuuuuuuuuugagauggaguuuugcucuuguugcccaggcuggagugcaauggcacgaucucggcucacugcaaucuccaccuccuagguucaagcaauucuccugccucagccuuccgaguagcugggauuacaggcaugcaccaccaccccuggcuaauuuuguauuuuuaguagagacaggguuucugcauguugaggcuggucuugaacuccugaccucaggugauccacccgccuuggccucccaaagugcugggauuacaggcgugagccacugcgcccggccucacaauuuuuuuuuuuuaaagagacagugucuugcuuuguuguucaggcuggagugcaguggcauaaucauagcucaccgcagccuugaacuccugggcucaaggcauccucccacuuuggccucccaaagugcugaaauuacaggcaugagccaccacacccagccccuguaaauguuuuuuaaguguauuccuauuucauuuuauuuggaauuauuguaagugguguuacauuuuuauuuugauuucuucaccuucauuguuuguauguagaugugucauuggcuuuuauguguuuauuuuguauccugcaaccuugcugaacugacuuaauaauuuuacauuuuuuugguagguucuuuaggauguucuacauagacaauuaugucaucugcaaauauauaguuuuuccaagugguuguguuuaaauauuaaaaaaaagaaauauguaguuuuauuucuuccuuucuaaucuauaugccuuuuauuucuuuuacuuauuuuauuugccuuauuguggugacuagaacuuccauuauuauguugaauaacaauagugagaguauaucuuugcaucguacacaguuuuauggggaaagcauucaguuuuucaccauuaaguauaaugguggcagcuggaugugguggcucaugccuguaaucucagcauuuugggaggccgagguggguggaucacgaggucaggagauugggaccauccuggcuaacacggugaaacccugucucuacuaaaaauauaaaaaauuagccgggugugguggcgggugccuguagucccagcuacucgggaggcugaggcaggagaauggcgugaaccuaggaggcggagcuugcagugagccgagauugcaccacuguacuccagccugggugacagagcgagacuccgucucaaaaacaaaaaaaguauaaugguggcuauaguuuuuuuguaugugcucuuuaugaaguugcaauaauucccuguuauuccuacuugaugagacuuuuuuaaauuaaaaaaguuuuuguaauuuuaauuuuuuguagagaugaagucucacuauguugccuaggcuggucuugaacuuuuggccucaagcaauccuccugccucggccucccaaagugcugggacuuacaggcaugaggcaccaugccuggcuuuuuugaaaauucuagagagggucucacuauuuugcccaggauggaguguagucuuagucacagacgugaucauagcacacuacagcuuugaacucccaacaucaagugaucaugcugucucagccuccuaaguagcugggacuacaggccuacaccauugcaccuggauugcugaaacuuuuuuuuuucuuuaaaucaugaauggguguuagcuuuugucaaauacuuuuucugugucaguugauaagauuauuauauuguuuuccuuauaucguugaugcggugguuuacaauaauggauuuucaaaaguuaaaccauuugcuuucauuuuugaaugauaguuuugcuggauguuaaacucuugauugacaguugagcuucuuaaauguuuagauuaauguuuucaucaaaugugggaacuuuucagacaugauuucuucaaacauuuuuuauguuccuaauuuaugucuuuuccuuguauucccauauguugauauacuuaauggugucccacauuucuuugaggcccuguucauuuuucuuuauucuuuuuucucucuguucuucagauugcccagucuuacugaucuauauuugaguucucuguuucuuucuccuaccagcucaaauguaggauuuuuuucauuuccauuaauguacuuuucuuuucuguuuuuagagacagggucuugcucugucaccugggcuagagugaagugacauguucacaucuuacuacagccucgacuucccaggcucaagcaauucuccuucaucagcccccucuccccaccugccaguagcugggacuacaggugugccccaccacacccagcacauuuuuaaauuuuuuuguagagacagggucucacuauguugcccaggcuguucuugaacuccuggccucaagugauccuccugcguuggccucucaaagugcugagauuacagacaugagccacugcacuugguucauuauuguacuuuuuuuuucuucuucuuugagacggagucucacugugucguccaggcuggagugcaguggcgcaaucucggcucgcugcaaacuccgccuucuggguucacaccauucucuugccucagccuccccaguagcugggauuacaggcaucugccaccacacccagcuaauuuuuuguauuuuuuauuagagaugggguuucacucuguuagccaggauggucucgaucuccugaccucgugauccaccugccuuggccucccaaagugcugggauuacaggcgugagccaccacgcccagccucauuauuguacuuuucaacaacagaauuucuaguuuauuuuuauaauuucucuuuauugauaaucuguaucugauaagacauugucaucauaguuuccuuuaauuuuuuagaugugauuuucuuugguucuuugaacauauuuguaauuguugcuuugaagucuuugcugaguucaacaucuagacucagaaacaguuucuauugcuuacuugguuuucuguguaugaauggguuacacuuuccuguugcuuugcaugucucauaauuuuuuguugaaaacuggacauuuuaaggaauauauuguacaacuuguuauugauucuguccucuuucaggguuugauauuguugcuguuguuugcuuggucauuuguuuagugaugugacuaaacugacucuagcuaaacugacucuauggagucuguuuucccugaaguguguaacuucugauaucagauuuuuuucuuguuuuaauuuuuuauccuaggggucaccccugggugagagaucaaaggucaacaauugaugaaaucuugugcuuaagccucuuugaccagucagauuuuugcccuugaacuuuuggccucaagcaauccuccugccuuggccucccaaagugcugggauuacaggugugaggcaccaugccuggccuuuuuguaaauucuagagagggucucacuauuuugcccagguuggagugauccacccaccucggccucccaaacugcugggauuacaggcaugagccaccgugcccggccgccaccauuacacuuaauggugaaaaacugaaugcuuuccccauaaaacuguguacgaagcaaagauauacucucacuauuguuauucaacauaguaauggaaguucuagucacugcaauaaggcaaauaaaauaagaaaaagaaauaaaaggcauauagauuagaaaagaagaaauaaaacuacaucuuucuuucuuuuuuuaauauuuaauguauuggauaugcacauguuuuggaggcugcuaucacaguucaaggaguuuacauuuuugccccacauucagccagaaacuagcagguuggauuuugauugcuucugagagguuggagccuuggguauguauagagucuuccaggcagcuaaggauguguguaauuuugcuuuuaagccuguuugccccugggucugaguagcuuuauugcuccaucaguguuuggccagagguugugcugaggucuuucguacuggugaggcuuccucauuuuauugauggagccguuuguugcuuggggaauguuuucaaaucugccuuacauccugcucugauugcucaugagugaauguggccuagugcauguccacagccuuccuaaucccugggguugacagugaccccaagagguaucuucuuggauauauuuuucccuggaauagagcuucagcaacaugaaccuuuucgaggguggauguugagaaaccuggaggucugccucucuuggggugaaauuguagucuuaaacuggaaacugggaagaaaggggaccccaucuucuuggccauaccugcuggggguagagcaucuggaauagcauuuucauaagacagagcuagggaugggggagggaaugaguuguuguccaaacaccacagacucucacuguucuuaccaagauuuaguagacuuucucgauugaauauuuuuccauuugcuguaugcccuuaggacaauuuccagagacuuuaaaugauuguucauuauaauuuccucuacuuaaguuguuuuauuggagaaaguguacaccagccccuucucuccaccauucuagaagucguuuccuaaguuauuuuaaaauauacuguaacuccucaguauaaagccaaauguucuuccuuaucaauucuuauuuacuccaugcacagcccuaggaauuuuccuggguggguaacauggacucugucguuaaggauuuguccaguggaguaaaaagaagcaaaacauccugaauuugcuucccuguauaagcagugagggaguccugcugugugcuuaggcccuggccugcuucuggggccuacacagggauaggcccuuuguauucaaggagccagaagaaaccucagugggaggcaagcaagcagcucaucaucaaguaauuugcuguguaauguaugaauuggggaugaaauggugggucgaugauucccacgacaaugcugugucaguucaggaggaggagagagaggaguucagaggcagauccugaauuggcagccugagcccaggccuugaagaaccaggccuugagccugggccuggggcugggauguuggcagaggaaugggggaguguuuagggaauggggguccaggugaggaagucagcgaaaggauaauuaucuguggagcgugcaggggcugugaggaggccagccuggcuggaaaggaaggcuggacuaagggauuuccguacaugagguugaguaggguggugagaccagaagccaagggcuuggaaugucaggcuaaagcauuuagacuugagucuaaagguggcagaggaccaggugcaguggcuuaugccuguaauccuaacacuuugggagacugagguggaaggaucuucugcucaagccaaacuccauggcuggagcacaggauuuugggaccagcauaggcaacacaguaagacccugucuccacaaagguaaaaauaaaaauaaaaaaaauuagucgguuguggugaagcgugccuguaaucucagcugcucuguaggcugagacaggaggauugcuugagccagggaggucgaggcucuagugagcugcagucaugucacugcacuccagucuggguggcagagcaagaccccaucucuaaaaaauaaauaaguaaauaaagguggcagaggaacccuugaagauugcugagguuuguuaaggaaauucuucuggcuccuguguauggcaugcauggaggaggggagccuguagcccugggaaugaguggaggcuguagucauaacccagaggccucaucuuggagccagugacagaggugacugagacagaagaauggccccccaggaaugaggaaggaguaggugaggagccauccccaaggcuuagucaaggcagggcaagaagccccaguuuuuuauccuuagcuccugcgauauggucaguggccagugguagauaucagcucucucagagaaaccccucuaggggaacagacaggagaacugguucuccaagaggaaggcaaguagggagugcccugggcuccagagaaaggcagcuaguggcuuagaaauauggccagaaaaacuggagggacagaguaaguggucugcagugcagguggcaaucguuagagccaccuggaugucacaugugagaccuuccccuauaagguugugcaggaguuaaggagguucuuguacuucugggcgugacagcaucccaugugcucagcucucccuuccuuuccaagguuucaugggguguaccagugccuggaagacuggagagaccugaauaagagcauggcuucuuugagguucgucuucugaguauagcaccucccuccagugccagcuuguggcucugugucuuggccaaaaaguugagggugaagccaagucuggcaaauagagcccaaggcuugggugggaggaccaggagcugauuucucuggaggccgucauucuuacugaagcugcuccauggugucgcuuucagagugaaggcugauuuugaguguaaccugguuuauauccagucucagaaugacaccagaacaguuuuccaguuuuuguauguaucacuagcaugguuugcuucugaaguauuuauucuuuuauuuuucaaaaggagguaguuauuagauuucugaaaacuguaggauuuguuuaaaugagucacagcauuuggcugaaauagagaggacuccaucuguugcuuuugcgugguccccaguucuguucuaugacugagcuauaagagaagcaggagaacuugguguucccugagcucaccaucacuggcccugccugucugacacaagccuugcccuaguagagaugugggaaagugggcccuguuuccugagagccucucuacuugggaccccuuuaauuagccuacuguguuugggugaguugggguaggggcuggagccaagggcuccucauccacugaacuccaccagcucuuuccuuggagugcccuugaguuugccccuuggaucagaaagaggaacauccauugcagggugauuuccucagguccucuugaccugcugugcucugaugcucuccucugugucccuggggcagcaggacaacucauucugacugaauucgccccagggcaacuggcagugccucaggucaggaagggucauggagcaugaaacaauacaagggaaagggcaccagcugggggaaggagagaccuagguaccaauccuugcucugccuugcucugccuuauaugugucacuuccucucuuuaaauuuuuuuuuuuuuuuuuuuagccagagucucacucugucucccaggcuggagugcaaugacacugucuuggcucacugcaaccuccgccuccuggguucaagugauucucuugccucagccucaugaaaagcugggauuacaggcacacaccaccacgcccagcuaauuuuuguauuuuuaguagagaugggguuucaccauguuggccaggcuggucuugaacuucugaccucaagugauccauccgcuuggccucccaaagugcugggauuacaggcgugagccacugcagcuggcccucucuuuaaaucucaauuuccucgucuagaccuccagugcagugcuguuaugaggaugauuaacugauggguguaaaaugucugucgcaugcuaagaaacgaccaguuucugaucuucucccauagucuggccuccucucuucugcacacucugccccuucuucagaucacgcucaugggcagagugaagggagaggugugcugugagucagggcauggcacggaagaugcugacaucccacgcagcucccugcaguguugcuccuggcacuucaugcuuggccagcagauucagccugacccacuuggccauaccugccucucacugggcagcuggggccuggucuuccacaucuguggccagggcugggccccucaagucaugccccuccacugcuggccccucaaggacaaccagccuggaaacuugagggccgcaggucccacccugaugccuuccugcuuugcgcuaggccuggggaaagccucugagcugucacaggaagugugcuugccucugugacucacccaccucuuguuggugguugcuaccuggcuacuguggaaccuagguaaacuguuccuccuauggggccaguugaagugguggugagcagaugucaccagccuugcccaauuccuucuuugguuccugacuucuuaggguguaucuuaggaguugccugcugagguugccacccuaggcaguguaggccuguuagauuauaccaugauuauugaaugagcaaaugacuggagcuuugucuaagagggcccucauguaugaggagugcugaguagacccuaugggucaggaagaggaugaaggucugcagguuuguggguguguuaggugaagccuaccucaugguaggaacaaggugaggaucucugcaguccauuagaaggguucucugaucuuacacggggauucucucuuucucugugaauucacaucauauaaaauuaaccaauuuaaagugaacaauccagugguauuuaaugcauucacaauauuaugcaaccaucaccucuaucuaguuccaaaccauuuuugccaccccaaaagaaaaccccacacucauuaagcaguugcuccccauuuuccccuccccuucuaaccacuagucugcuuucugucucuauggauuuaucuauuuuggauaguucauauaaauggaaucauaaaauagguauccuuuugugccuggcuucucuuacuuggccuaauguuuuuaagguucauccacauuguaguaugcauguaucaguacuucauugcuuuuguuuuaucuuguuuuguuuuauuuauugugguaaaauauaugucacauaaaauguaccuuuuuuuuuucuucuaaagagauggggucucacuauguuacccagguuggccuucaacuccugggcucaagugauccuccugccucagccuccugaguagcugggacuacagguacaugccacugugcccagcucaaaaugugucauuuuaaccauuuuuagguguacaguucagugguauuagauacauucacauuguuguuuagccaucaccaccauccaucuccagaacuuuuucaucaucccaaacagaaacucuguacccauugaacaguaguaacuccccauuuucccccagcucaugauaacuacuguuuuaguuucuaucucuaugaauuugacaauucuagguaccucguguaaguggaauucuacaguauuuguccuuuugugacuggcaaauuucacuuaucguuucuugaagguucauccauauuguagcauguaucagaauuuccuuccuuuuaagggucgaauaauacuccauugcauauauauaacacacuuuuuuuacccauucaucuaucaguggacaugguugcuuucaccuuuuggcuagugugaaugaugcauagauucuugaguacugcaacagccugguggacagcuggagcagggacauacauuugagcacuggacaagaugcugagguuucagaauggguccaggaacacagucugcucccauuucccaggccucccacaccuacaucccccaccccuccccauauuuccccugacuacaccccuucagccacacuggcgugcuugcugcucccuaccugcaauccacaaccccgccucaaagccuaagacccugucauuucuuccucugggauguccuucccagggccuuggcauggccucucccaauauauuaauauuugcaggcugggcgcgguagcucacgccuguaaucccagcacuuugggaggcugaggugggcagaucaccugaggucaggaguuugagaccagcuuggccaacauggugaaaccccaucucuacuaaaaauacaaaaauuagccagacaugguggugggugccuguaaucauagcuacuugggaggcugaggcaggagaauugcuugaaccugggagguggagguugcaguggagaccaugccauugcacuccagccugggcaacaagagcgaaacucugucucaaaaaaauauauauauacauauauauacauauauauuuuauauauuauauauuauauuauauauauauauuuauaaauauauauaauauauaaauauauauuuauaaauauauauuuaauauauaaauauauauuuuauauauuuauauaauuuauauuuuauauuuauauauaauauauauuauauauauuauauaauauauauuauauauaauauauauuauauaauauauauuauauauaauauauauuauauaauauauauauaauauauaauauauauuauauauauuuuauauaauauauauuauauauuauauauauuauauauuuauauauaauauauauuauauauuauauauaaauauaauauauauuacauauauguaauauauauuauauauaauauauauuacauauauguaauauauauuauauauaauauauauaaaauauauaacauauaaauguauauaauauauaaauauauauaauauauaaauauauauaaaaauauauauaauauauaauauauaaauauauuuauauauauaaauauauuuuguauaaauagauauaaauauauauauuuauauauaauauauuuauaucuauuuauauauagauauaaauauauuuaugucuauauaaauagauauaaauagauauaaaaucuauuuauauauaaauauauauaaauauauaauaaaauauauguauuuauauaaauaaaaaauauauauuuauauauacauagaaauauauauuuauauacauaauauauuauauuauauauaauuauaaauauauuauauaaaaauauauaauuuuuuauauauaacauauaauauauaauauauacguauauauuauauauacauauauuauauauguauauauuauauauacauauauuauauauguauauauauuauauauacauauauuauauauguauauauuauauauacauauauuauauauguauauauuauauauaaaauauauauaauauauauuaaaaauauauauuauauauauuaaaaauauauauaauauauauuaaaaauauauauauauuuuuggcaugacucugcucuggugucuccuuuucagaagugcccccugacccaccaggguaguuucucuccuuucucauucauauuguucuucuaagcaccuaucauacucugaaugaauuggacuuaccuauuugucuucuugaucuuugcuuauauccugcaccauaaggcaaguccuaugaauugaguggccuugugugccuugcucacuacgagguagccagcaucugcagugcagcccagugccagggaccgugaagcucccagugaggaccugacaugcaguaaagccacacacuuguggugcucuggccaccauuggagcccugaccccuuccaccucccccuuuuguauuuggaucuguauucacauccuccaucccagguaccccacucuguucucuggaacuaucaagcuaccuugaguccccagcaccuuccccagacauuccuucugcuggguaaaaaccugaccaugccaaaauauuauuugcaggcugggcacgguggcucacaccuguaaucccagcacuuugggaggccgaggcgggcggaucaccugaggucaggaguuggagaccagccuggccaacauggugaaaccccaucucuacuaaaaauacaaaaauuagccggacaugguggugggcgccucaguuugcaauauucuccuuacucccucagcagggcugugcagacccccaugcacuugccugaucaucugggccagcggaccuuugcaugagcuuggcucucagacccuggucucuccucuuuugucagacacaggccauacaguucuaccauuaucucucccuuagcacugcugccuggacuucucauuacuuccuacuacucugaagauuuuggcaucagaauccaggcuuccugcccacuccacuuguugucaagccagggaaggaagaaagggaggaaggcaaggcuaauguuuuucucagugccuacugggcauuuggcacuguauuuccucaugcugggguggcccuggucccucuguuggcucagucuggcccaggcauucuggguguggugauucagggcugggcuagucccucagagcacuugcccuucucuuugggagcaggacugcuuggcaguauauuacucauuagucaguggcuagcaacgugccauguagggugugaucacauaugcugucacaugcucacacacacaugcacacagugcaugugcacacucacgugugagcacacacuacacacacaugcacgugugcacacaguaguucaucacacuuuuuucucaggucuuaaucaccacucucaggcagauauuuccuuuaugacagcaucugucuugauggaauuuaggccacaguagcugaauuuaaugcucucaaugugugaacacacgucagguaggaacaugggcaucccugaaucugugcucccuagacgcugagcccuggaaaggggaagagaguagaggagggagcuccugguggucaguauaccagagggagggccucuucucgucaaggguggguccagccaccugaaagggauugauggcuccuuggaugggagguuuuggccuuaggccaggccuucguggcuguuaccccacaucaggcugaacagugagggggacugagaaucaaucucugaggugggagggaagaaugggaggaggguauggagggauagagguccucuccugcgggaagccucucacuggguggucucugccagcgggaggcaaucuccccaaguggccaauaguggaauuguccacagggagaaucuagaaaugaacccccagcaccuuccugacucucacgggcugagagagaaggaaaggcaggagccaaagugccacagauagguauuagauuucuccuucugaguuagacccuucagaagugaaaaacaaggaaaccacagaggaaagacugcauaguuggcaagaaaggaaaacagaccaccaucuauguacauuuuuuugcaacuaggcugacaggcauguggaaccauggacacgguaaugucaaaggcuggaaagugguggauggcuuuccuuuuuaaauguccuuugauguugcaguggguauuauuuagaagaggagauguuuuuccugcuggaaucuugagucucaguuacugucuugagauggcauuuuuaaaucagucucaacgucuuucauaagccuuauaaaaaauugcauucaggcuuggcgugguggcucacgccuauaaucccagcacuuugggaggcugagguggguggaucacgaggucaggaguucaagacccuccuggccaacauggugaaacccugucucuacuaaaaauacaaaaacuagcugggcaugguggcaggcgccuguaaucccagcuacuugagaggcugaggcaggagaauugcuugaacccaggaggcggagguugcagugagccgagaucgugccacugcacucuagccugggugauagagcaagacuccgucucgggaaaaaaaaaaaaaaagaauugcauucaguaggucaauacguccuuagcaucagcccugucugggcauuuagcuucaugcugcaugcaggugaggagagagagggaggccaaagggggcccacaagcacacaaggagcccuccugcaugaggccaugaaaagucugcaggaaggcauagcagauuucugggaacugaggaaucuggugagggcccauagacggcaggaugcuuaaaccagguuuugaagguuaaauugacuuuuuuuuuuuuuuuuuuuuuuugagacagggucucacucugucacauagacuggauugcagagcacaguggugcaaucauagcuuacugcaaccucaaccuccuaggcucaagggauccauuugccucaggcucucaagaagcugggaccacaggcacaugccaccaugcuuggcuaauuuuuuuuuuuuuuuguagagaugggaucuuccuauguugcccaggcugguuucaaacuccuaggcacaagcgauccucccaccucagccucccaaagugcugggacuauaggugugagccaccacacgcuuggccugaauuggcuuuuaaggaaacugccuuguagaaagagaauagagcaugagcuguuagaaguuggggucagaugaggagccucagguaucccugccaacggcacugcaggaagaggaaaaacugccuggauaggaggagccacaugguagagugcuuugaaggcugugggcaaggguguccagggucgggugguaacccugcauaugcugcugugccugacaugcauauggugggauuaggugggaagagugagcacuuagcacaauauaacugguaugagcguucacacaugugacuaugauuguggcagcuaccacaggaaagccaggccuuuuucaaacaggcugucugagugagacuccuaagcagggccuacucucaugucucuguaccagacuucagagucuuuucucccccagacuugucuaucgucagccugggaugcccuugcaggccccgggauuauugcaguggguccucuguguucuaugcccagugugccagccaccgcuaccacacagagccucugcuucucugaucaaucacccgagcccgugggucauucauuccacaaacauucacugagcccugcucugggccaggcccugugccaaacucugaggacucuguggucacuguguguagaggaaagccagauggcccacuuuucucuggaaccaccccucuuccccauggcuuccuccaggguuuucugagacucugccaguccacauugauuucuccuucugggagcccccagaccacugaccccucccaccaaacacacacaugcacguucaaguucccaugcuuuuguaugugauagauggaguuuugugugugagaacacuugcuuuguauucuuuugauuguaauaaauuugaaauugcaaggcaaagguagaguucagaggguuucauucuuauuuuacuaccuguuauuucuaggcggguggaucaccugagaucaggaguucaagaucugccuggccaacauggcaaaaccccaucucuacuaaaaauacaaaaaauuagcuggguguggucgcucaggccuguaaucccagcuacucaggaggcugagucaggagaauugcuugaaccugggagguggagguugcagugagccgagaucacaccacugcacuccagccugggcaacaagagcgaaauuucaucucaaaaaaaaaaaaaaaaaaaaaacaaguaggccugauuucuggacagagaaguuuuuaacaugggaugaauagauauuagcuugguguuucuuucucccacaaaauagacaauaggcauuguuuuuuaauuccacugacuucccauuagaaagguauuaaggggucccaggcaggguuucccuggaagucucaaacaggaggcucugggaugccucauacacugggauguuucuggggccaguccaguccccugagcacagcagauguucagcaaauucaugcaugcauuuagugucugcauagugaugcagacauugggugaucuugccaacugcauuguuggccuguaucucucuuccugugccuagagcagggcugagugugaaguagacccuuagccaucuuugugggcuaaagauguguccaggcagccccuaagggcaggcugagugcugagucucucaucaguauugggucugaugacuggucaggaacuugagguuucugggucaaaguccuggcuucugcccuguuuggggcaggacuaugggaaguggcuugcuuccucccuagucacaaaggcuugcaguuuucucuuaguuugucuugacuuccagauuguagcaaaauuuugaagagagcugacaagcacagcauuguccccuugguaaaaggcuguaguaguaggauuugcaguagcuggaaccugggaaaagcuggcucagcuuuauguaaugacuucagucucccgauuugagcuuccuagcuuuaggagcugaccuaggucagaacacugugaugcugcacaacccaaaguuguaucaugcgggguccuaaugcaggugucuauaagccuggggcuggcuggggagcaggagccuccgugacuugggcugcaucagaacuccugggcuauacuugagagccaugguacucccagaagacgagguugggaaaugugaagagggcuggcacuggggccaaagcuccuuagaagucuguggaaaggugguugagaauuuaccuguccaguuagacguucccucagaaagccgagccuaguaggggaacacauggagauaccugguuggccuagaacacucuuaaaaagugccccagucacuguagacuggaaaggccaggaaggucuuagugcaggaaugcacugugacuucucagagaaaugucaaugucuuggguucuuuugguuucccaggccagggucaucuggagagucuaggagaucauagggggagcuccucaaggagcugcugaccuaggucuuggcucuggguagugacucuggccuggccaucugccugccuucucuucccucccucuauuucucuuggcucccagcaugggcucccaccuguccuagcuccccuaggaauuuccugcugaugagcuauuacccaagucugaugacuaaguaggaaaaaagacauuuuuuccuuccaaaaacugcaagaggaauaagaaacagaaaagaaaacuuuaccuucaacaaaaauaacaaacaccuguaaccugaaauacaacaaacaaagaaugauuuuuuuuuuuuuugagacagagucucguucuguugcccaggcuggagugcaguggugcaaucucggcucacugcaagcuccgccucccggguucacgccguccuccuuccccagccucccaaguagcugggauuacaggcgcaugccgccaugccuggcuaauuuuuuguauuuuuagcagagaugggguuucacuguguuagccaggauggucucgaucuccugaccuugugaucugccugccucggccucccaaagugcugggauuaaaggcgugagccaccacgccuggccaaauaaugauuuuucaaguccaggaucaaaaucaguccaggauggaggauuuuaggaggggacacuugucagaguccagagggccaaaacaaauuaugaucuauuggacugguuagcaaagccaacauaugcggauaagcuuagggaguaucuuugagcccugugugaugccaaggaguuacuagggagguggaauuacccaaggaauugagcaggguguggcaggugaggggaaaacuauggguugccagcaauucagacaauagaaaaacaaaggaaauucaaaauggguauaauugguaucucuggagaagagaacaaaacaaaaggaacacaaaaauauucaaagauauaauggaagaaaacuuucccccugaaauaaaagaacacauaaaucuuuuguuugaaaggccaggggccaggcaugguggcucacaccuguaaucccagcacuuugggaggccaaggcaggcagaucaccugaggucaggaguuucagaccagccugaccaacauggagaaaccccgucucuacuaaaaauacaaaaacuaccugggcaugguggcacaugccuauaaucccagcuacuugggaggcugaggcaggagaauugcuugaaccugggaggcggagguagcagugaguagagauagugccauugcacuccagacugggcaacaagagugaaacuccaucuaaagaaaacaacaacaacaacaacaaaaaaggccagacugaauuuugaaaaacacacauauucaacccaaaaacguaucuugguggugucacucaauuccaaagagaaaaaaauagcucuauugcauccagaggggaaaaguuuauauauauauauauacacacacagagcgagagagagagagagagagagagagagagagagagagagagagagaagggcuggcccagagcucuccacaguaauaaucaacgacagaaaacagaggggcuagcuauaucucugaaguccugagggagagaaaguguaaacccagaauuuauauccagccaaccuguuguucaaguuuuuauuauuauuauuauuauuauuuuuuuuugagacagaguuuuugcucuguugcccaggcaggaguggaguggugcagucucagcucacugcaaccuccaccuccugaguucaagcgauucuucugccucaaccucccaaguagcugggacuacaggugugugccaccaggccuggcuaauuuucuuuuuuuuuuuuuguaguuuugguagagaugggguuucuccauguuggccaggcuggucucaaacuccugacuucaagugauccaccugccuuggccucccaaagugcugggauuacaggcaugaaccgccaugcccagcuguaguucaaguguaaaggucaugaagaugcguucagacauucaagaacucaggaaacgugguuucuaugaguucuuuuuaaaugaaugaaugaauaaaaacuucuagagauaaauucccuaagacauacauggagaugcugugauuaaaggaguaguaaccucaccacuacuuacuugcccucagaugagccgucauucacacagugcuugucaccggcaccauggugcaagagacauucagucuuuuuuuuuuuuuuuuuuuuuuuugugagacggagucucgcucugucgcccaggccagagugcaguggcuugaucucggcucacugcaagcucugccucccagguucaugccauucuccugucucagccucccaaguagcugggacuacagaugcccgccaccacgcccagcuaauuuuuuguauuuuuaguagagacaggguuucaccguguuagccaggauggucuugaucuccugaccucgugauccacccgccuuggccuaccaaagugcugggauuacaggcgugagccaccgcgcccggccgacauucagucuuuaaaguuauacugaacucauggcauuugacacgucagcugacugguggccacauauagcucuugcuauucuggaaaagccaugggauagagguaaaaaugggacugaggggaagaucaaagguaaacgccacaugaaccacuacuguauaccuacuggucucuuucuagaauuuggccugaggugggccuggugcaauucuuagugagacacuacaagaauauggaugucacuugaggcaggucuaaggguuugguuuuguucuacaucauggaugacaaguccauggccuuugugcuuaauugauggugacaaucuuucccaugaauccuucccaagcccacuucccaggcggucacuaccaauuuauugggguuaaaggaaaguuacccuuauguuacccuuauuuccuauccuugcucuggauucuggagacuagcuggucccagaggaaaccaaaagcaaaucaauuuucccugaaagauguucucaaucuaguagacccacucaggccccagggcuggggaaugagguccccaagguuuacuuuuguggcauuuguggccuggauuccccuugcuuucagacuccugguggucuccccgucugaugcuggcagcuucuucuagccuauguuuaauggcagcaagucuuguuccuaccagucccucuugucacauucuccccuugcugacccaccugcagucucaugcuggacucuuucucucagcaacaucagagcagucagagcucacugccuuaaacauguucucuucuggcccaaacaggcuggccuggaacaaauugagccuuguuauuuggccacaggaagagucccaccugccagacauuucugaguggaaaggaugaguggagguggcagguaccugguaacacugaugguuccuucauguggguuugucugcucagggguguugagugcaugucugcccaagugcaucaguauacaccuggcgucacugguguauacugaugcauggccaccauggugcuuuguccccagcucuaccaaggaccuagcucucuggguuacucuggggucuuuugagucuuggaaacuuaccaucagagugggacuacaacauaaaggggcugggaaguuaggaagagaagaugucggccucaagggagcucugccuauggcaugaccucucacccugcccaggaacccugggugugguaccuucccucuccagccagcagacagcaccuuagaggcuuugagcccaugaugccaucuucuugggcaaucacaggcucuuucuguggcuguggcugcguuuuauggagauccuuaccuuugugcuauugccgucagcacugcaaauucuuuuuggccccuaggacaaucaggaagcugaugaggccagcccuugauggcugggggccucccugucacugaccuaaguacacuuuccauggagccugguggaggguaggacugaaucuggucugggaaaccaacagagacuauuuuaaggacuggcgauuaagaguguaagaauuuucuuagcaguggccucaacuaggacacauaugccaagggguugaggaauacgggagggacaaggcagaacauauggaaauuucuguuuauauuuauugucuaucucaucuuuuaaaacuuuuccacuuggggagguggguuuuauaaaaaauaugcauuuauauaauugguagaugaauauucauauguuggagaugcugaaacauguuguauugauagaggcacaugauuaaaaaggcaggaggccacuggcuugaaggcugggcaggccaggauauguuuucuugugcaaaaacuggaauuuuuuucuaagccuaaacuuucuagauucucauauccauuccugagagagaagcucuaggacacuggaccuggccccagcacccacugcucuacagccucugcuuugcugccugggugcacaggaaccacuggcguggcccaguaguccuuccugcccugggacucaaaggagaggguccucccacagcaucugcccaucccuaauugcccauuacagaaaggucagccaugaauucaucaaaaccucuuuugaagcuguggggcucuucuggccacucugacuuagagaaacaguuucuuuaaguucacuccccuccuggugagcaaagacagccauuuauuaauggaaaacauuucuuucaaauccucaacugaaggcgguggggggcaugcucuggaaugcugccuuguggggcccagcuugguuuucccucuggcgccugcacuggcuccaugccuggcugcuuuuccgucuggucugaaucagccuggucaggcccuccuucccacugugcaccagggcagccacaucucuccuggugguucugccauuauggacgucacuggugucugaagcauuuuuuagucacugacgcuggccucgugccuuucugggggcuucugacagaggggagcccagccucucaccagugcaaucaggauuaugucucccagcagugguccugggaugggacaggaggccacaggguacuaaggauuggugggggagaggcuaacugaauuuucucuguucccguucccagcagcccuccuguggccagggggcuccuuccugccuuggcaaacagcucugaguuaagauuguuucugaucagcuaauagccuuaaaugcugaaaggaagaaaagcugguagaaaucuggcuguuuguacauuguuuaccuuucuuggccaucuuaaaaauauauuugucccaauaucuaaugcauguggggcuuaaaaccuagaugacggguuaauagguguagcaaaccaccauggcacauguauaccuauguaacaaaccugcacguucugcacaugugucccagaacuuaaaguaaaauaaaaaauaaaauacauuauauauauauauauauauauauauauauauauauaauuuuauaauuugucccuagauaaggcauuucuagucuucccuguuugacuucuagccacuccuucaucucucugcccuuccugucucuugugucuccuuuauggcggcaccccucuccccuccuugcuuacacacccuuacccuggcccuccccagcaauaggacucccauggcugcugggaggagcaguggccucaaggggccucucugcugaugaggccacauccacaagaccaagucuuccuuggggugggcuggguccugccuguggacaccucccucucuuuuuccucauucccuucuuucuccugcccagcggccauauuuuggcggagaccuuuguuugugucucuuaagaagagccuccuggagggcuuaccucuucccuccugaggaggccuuggacggguguagucacuguggcucucauggaauguguguucaggugugugguacagacaguuaugaccccuggagcuccugccacggugggcccuuguguucagcuggagaaggaacuggccccucccaagcuggacugguuugggacagggcuugggcauuuaugguguguggcacucauagguguagccuuucuuccugugacuucucggcuuucacauacguagacucaucauggcauggggcauuguugagugcuccuccucaugggaacuucuauaacccuguggggucauucucuuuuuucuccuuucccugacuucucugguucugacaucuccucuacuccuaugaacuuugguccuccccacaaagcuuucugggugauuucuagccugagaauugucugugaacaagaccuguaacucucccagauaaaaauaucuacacuuaucugaauugaacugaagcugugacccaucucuuaaugucucuuacccccuacccccaccucaacacaaccaaaccaaacccaaacuugugauuuugugauuucgcuucccauuucuuacccacuaauugacuucucucccuggauuccccaucucaauuaaaaggaacacuccucccuggagccaaagccagaauaccugcugcuguaccuucccuuccucuugccacacagacuaucuccugggccagugccuuauucucacugguuuccuaccucaucaucuucuucuccuugaagagacccuaaacauuccccuaugugaaaaccuuacaggcugugcucauuuuagcuuuuagcuucccaauuagcucagguaguucaacacacacuaucacacgauugcugggagcuguucuaggugcugggagcaccaaugacuuacgucuuccaagcuuauccugcguagcuacucagacugagcaugcucugcugugccucugggucuucgugcaugcuguugccucugccuagcaugcccugucaccuuggcaugaacagcucaucuuuuaagacccaguuuaaaugucuucucauccucaaagacuucugccucuguccaucacuggaccaugcagcagugugucuugcagggauuuguuugcacaucugucucuacucuagaccagaggcucuuggaggacuggacuccuauaugaaucauuuuuuaaaaaaauauuuuaauuaaauauuaaaugacuuuauaaagaauauaagaauaccuauacaacauguauaagaugugaagaauaaaauaugaacaccuguggacccaccuuccauugaagagauaucauuccuuuauaccaucaauaccuauuauagggccuggaacuaauccaggggucaguaaaugugaauuccugaaugaaugaaugaauaaauaucuauuguuggagucauuuucucucugagucucccagcguugcuaguuaagucccaggugaauggugucauggcccuagcccagccccacucugugagcucauucuacuguucacacauuguucugguuguugugcaugugcuuacugaguguccauucaaugccaagcguggcgcuggguccuaaggauauaguggggagcaaaauggugaaaccucuucccagggagcuuccacguaagcagcucuucagaaaaaauaauccaaagaacccaaacugcaaugcuuucuacccccucuacagcuacccuagaaaggcagugugggaugugguuaaggacauggacugguggccuagauauuggaaucccagcuccaccauuugcaagucaugauggcuuuguauguuacuuaacuuuuauguguggcaguuuucucaucuguaaaaugggcaaaauagauccuauccagugaauuugcugugaggcuuaaagcaguuacuaugugacagguggcucauggugagggcucggucagcauuaccacaauuauugucagcagagccuucuaugguacggcuggggguguagccaacugcuauagggaggaacuuuagguauuguuccugaaguucucuccugcaugaagucagacccagagaagggccgagugucaugccaggcacuugccguguuuccucagcuuuaaaacuuuggggccacauuuuacugcucugagucauuuagugcuuacagucaccccauucaggaaauaaauauugagcauccaguuugugccaggcacugugguaggcccugggacacagcugugaggaaagcacacggagacugugcccacacagaacuggcaguuuaaugcagggaucccaaaggauauacaaaagcaauaaauuuguuauaugaugggucagaaggugcucagugccacagagaacaaagaggcaggggagacaagcacaguuuuaaauagauucaggguaagugucccugaaaggaugccaccagagcaaaaacuugagagggagcaagugucugcagaaagaacagcaaauccgaggcgggcggaucacaaggucaggaguucaagaccaaccuggccaauauggugaaaccucgugucuacuaaaaauacaaaaaucagcugggcaugguggcacaugccuguagucccagcuacuugggaggcugagacagaagaauugcuugaacccgggaggcggagguugccgugagcugagaucgcagcacuguacuccagccugggcgacagagugagacuccgucucaaaaacaaaacaaaacuaaagaaaaaaaaaagaaaaaaaaaacaaagaacagcaaauccaauggccaaaugcacaugucaggagugggccuggcauaagggaaguggaaucagggagaggauaaucagagaugaggccagagggaaaggggcaaaaucucauggggccuuaugggccauuguaagacuuuuggcuuuuccuuugggagggaaaggaagccagugcaaggcuuaagcaaagcagagaaguggccugacuuguguauuuaaagccuuauucuggggcugggcuugguggcucaugccuguaaucccagcauuuugggaggcugaggugggcggaucacuugaggucaggaguucaaagccuggccaacauggcgaaacuccgacucuacuaaaaauacaaaaaauuagcgaagcaugcuggugugcgccuguagucccagcuacauugcagugagccgagauugcaucacugcgcuccagccugggcaacagaaggagacucacacacacacacacaaaaagacuuauccuggcaacugagaauggcucaaaccagguggggugaggaggagggaguagguaguaguggccagcuucagaaaccaacaagauauacugcuggauugacuuaggaugagacaggaagggaggcagagacggcaccaagggggagacuaggaggcccacauuuagggggaagaucaggggcucagcuuggguguaucaagguggagaugccuacagggcaucucugugaagauguggaguuggcaguuagacaggugaagaguucagagcagaguucugggccagagauagacauuugguggguaucaguggaaaguggauuuaaagcccugagacuggguaagucuugagacuuagggauugugaguacucacagaagcacguuuguguaaagacugagcccugggucucuccaguguaaggagugguguucugggguuggcagaugaggaagaaucugcagaagagauuagaaagguguggccaggcaggaggaggaaauucaggagaaggugguauucccgaaggcaaauagugaacuuauuucaggaagaagggagugaucacccaggaucaagugcugcugauggucaaaugagaugaggaacugagaugugacugucggauuugaugauguggaggucccuacugacugugaccugaguaaugucuguggagugaugggcaaaagccagguuggagggguagguugagagggagagaggagaggagugggagguagugaguggaggcaguucuuuuauuauuuauuuuagagacagagucuugcucugucacucaggcuggagcacagcagcgucguccuagcuuaccguaaccuugaucuccugggcucaagagauccuccugccucagucucccaaguugggauuaugacuuggcaaccuggcaagucaccuugccaggcaaguggagauaauuauuuuaaggaguuuugcuguaaagaagaggagagaaauggggcaguagcugaaggaguaguggagcaaaguacugcugcuucuacuuuuuuguuguuuaggaugggagaagcuuguuuguaugauaauugaaaugauccaauagagagggggaaauggaugaugaaggauaggggagaauuugugaaggugagaagugggccuugggauugggaggcaggugaacacugggggacaggaguagggaggcugagguugugcagguuucuucuggugggucccacuuuuuuugugagauggucagcaggucaucaguggcaguuaagagacaaaaggagguguuuggaagcuugaagaucaaggagaggauauaaggaagcaucuaggaagaugggagaauacaaagaccguggacauauaucgcgaucuccaggugucaugauggcuaccaugaggugugugggugcacaucaaugccaggaacacugcccuugcaugcagacuuugcugggugcagaagacauugcuuguuuauucacugucaccacagcugaguuuagaacccuaaaugucuccagaaagacuauauugugauacaacauugauuuaaaaagucacuguauauauagauugccugcuacuuauugggcaacacaaauacaauagaaauggcuacauuucucagaaggcuugcaccaccuggagagggggccacagcccauucacauguuguaaaaagcucucaguagcuucugauuugcuuucaagggcugccuuuaaacuccagucuuaaauaauuuauguaaaaaaugaaacuauuaauuuggacaagugggaaauauuucuuuaggauaccuagaaauuaguauacugaaagggcccagagaagcccagguucccagugugggccacugaugcuguggccaccaccaugcuaggcuucacagcugguggcaaagauggcccugagggguuggacucaaacucugguugucuugcugaagaagcaauuggcgggucugugacuggauaguuaggucugugccacugaugguugaugacaggaauguuaaacacuauuuaauaguguuucuuuuuuuuaggagagucuuuauuagaccaaggauauguuucucuacccgccaguuccucagaagggaggaaggauugcagaguaucuugggguggguguccccaggcgggcuccucaucuucccccugaaauggcuuguucuaagcugcccuaucaguuggcucuuaaaucuuuuuggcaagcagauggccuucagaugggggcagcaaacuuagaaucuucuccuggggcacugaggcagcagcuaccagggcagucuccugcacaggcugggccuccacacugcucucagcaagucagcccuguuuccugagugccagcauucaccccaaugaguacagacuaaagcagggagagaauuucagggaagcaguauaaagcauugucuuuggcuuuuugugcucauccucuuucaaacuggaaaagaggaaaauugcagagaugaacuuaaguugggucaaaggagaaggaauauaugauugacauuuagccugacaguuugcuuucuaccucauggaacuacccaacacuguuggcuccuuugcagccagauugggauggaggugaggguuagaugcauuggaccucacucagugguuccucaaggcuggauccuggaacuccagccccacccagcuucacacuaguggaaaaguaacacuuuaucccaucuugguagauuuggucuggcaucaggcuugccagagggcuaccagaaggaaggcuccuuuguguagaggcaggccccugauacaggagauggcauuaacuaggcauugcaguaucccccauccccagcaaucuagggucagccucugaagggguucaaggcaggauauagcagauuggccaguaugguaucucaauauaguaacuugggcucauguuggaaucaccuagggaggaaaaaauacuaaugccaggguccugccuccauagauuuuuauguaauucgacugaggugcagucugggagucggaauuuuaaaaaucacccuagguauuucuuucuuuucuuuuuuuuugaaauggagucucgcucuguugcccaggcuggagugcaguggcacgaucuuggcucacugcaagcuccaccucccggguucacgccauucuucugccucagccucccaaguagcugggccuacaggcgcccaccaccacaccuggcuaauuuuuuguauuuuuaguagagacgggguuucacccauguuggccaggaugguuucgaucucccgaccucuugaugugcccgccucggccucccaaagugcggggauuccaggcgugagccaacgugcccagccuuuuuuuuuuuuuuuuuagacagggucucacucuguugcccaggcuggaguucaguggcacgaucucugcucacugcaaccucugccuccuggguucaagugauucucccaccucagccucccauguagcuggguuuacaggugugcgccaccaagcucagcuaauuuuuguauuuuuaguagagaugggguuucaccauguugggcaggcuggucuugaacuucugaccucaagugaucuaccugccuuggccucccaaagugcugggauuacaggcuugagccaccauaccuggcccaucccaguuauuucuaacauguagguuuagaaucuugguauucaaagcaugggccucagaugagaguauuggcaucaccuuagagcuucuuacaaugcaggcccuacucagaucuacugaaucagagucuguacuuuaucagaaugugagaggacauguuuuaauccugccucaugcccuggugccaaggguucaaguuggagaugcuugucaaggcucagcacaggacacagcaaaugagggccaugaugauucuucugggcaggaggaagaggguggugauggggcuuggcagggucaccuagcuugguagagaccuccgcaagcugcuucucuaagcuguaucucuaacagucauuuucaaugucauuucagcacuucccggagacuggaccccaaggaaccccuggguaaccagagagcagcuuccccaacuccgaagcaggcuucugcuaccacuccuggccaugagagcccccgagagacaagggcacagggaccagcaggccaggaggcugaugguccccgcaggacgcugcagguagacagcaggacacagagaucagggcggucccccucagugucaccggacagaggcagcacccccacaucacccuacuccgucccucagaucgccccccuucccagcagcacgcugugucccauaugcaagacuucggaccucacgucgacccccagccagccaaacuucaacaccugcacccagugucacaacaaggucugcaaccaguguggguucaaccccaacccucaucucacccagguaaccacuucugcgccggcuccccacucaccugcuaccucauuaccauaccuccccugguucccuuccccucuuucaccaacucucuuuuccuggucauuucccuugaccaccagcauuuguguccuccugcagggauguguccugguuccaggauguggcagcaaagaacagggccuggccccagaucucccaagggauuucugcauccccugaaagcuuggguagagucugagaguagaagauacuuucuaaccugguccaaguuuggucuggaaaaauggccuucgagaggaccaaagacaaucuuaugaacaauuuuucccaauggaacucauuuggagugggccaugagcagcucuaggacacagagggaggcaaauuucccugaucuaggccaggaggccucugucuuugacagcaggcccuagauggggaugcuggugaggggagaaaaguuucaggggaggcaggaaacugccuuccagcugggcucugggaagcaccucuucuuggcuuuaguucuagucagcuggggaccugaggugguggggcagcuaccccaucccuaaagaaaugaccuugggguaaagaaccaggcugggaaccaagcauucaccaaggaugacaguguccuacacucaccaagaggccacuguaggaccauuucugugaguuuggcuucuuuuucgcccaagaggacaagaggacucuggguccacagccccagccuggcuuuguucaggaugcuuugaaugacugugggaugucucaccaaaugaguuggggccaucgcuuuaaaaugaacagaguaggucugcugauuuccuccuacuccucugggaguagaagccucuguuucuccccacaagaauccgucuuuggauaggauggagagaggcuggcugcaggcacgggcauggcugccucugggauuaacagcagcuggagccguuuggaccaugugggagggggcugagugagaauaauuguucacaggucagggucuauauaugccaugaggugcugugggugugggacgugugguuugugagagguaagugugagauucugaggaaggagcugucgguguggggagaugacucagugccuuuggaguugcuccuggagugugggggcuuccugaagaggcgugcaugcucgugauuauugcaucugugauuagaaacaggccauccugcacuguucaguuagguaagugcuugcuguucagaauuuggaacaauacgauuaaggccagggaagcucaccuguguguuucugccagugagaagccagaagccccucacaggaacagggaggcuuggcagguggacuguaccgcuaugggacauccccuccucaugcuggccuugccccucuggguuccagcucccuugagaugcagcacagcaccuggacaacuccgagugagguggguggggauaaggaagagccacacaugguggccccaggcuccuggugggcaucccauuccucaccaaaccauggccccugccuauaggcucuccaagcccaggaccuucaaugaggugggaagggagccagccuuuggcugugccuggaaaaacagcagaguaggaagaccuuggagacacucaguccaucugccucauugugcugggaggaagcugaggcucagggccaggagaagauggggccucacacuuacuucagauccauaguguuuggugaagagugggucucagccaaauacuucaaacaaaugcugggcuggacaaaugaaauguuucuuugcugugagauuccucaggauuuucaguguccugaggggcaucacagaguuccaggacagggcuaugguuggcagccuuucccagacuugcuuucacagaacaucuuaggagcugcuguuccauggcacccaguuugggaauugcugaccuggucccuucuccaaguucacacauggugaauacccuucucugcugggguuuucagguagaaccuucgcuucucuagaguuggcuuucagugguguucuuguuaaggaaaaaauaauccuuggcacaucuuccugaggggugauaaagcauaauucgugaaccagugcaguugcucuuugucacuuugcuaagagcagguucaccuuccuggucaugcuuccaugugaugagaaaacagguuugcaggcuuugcucacacaccugcuguuagaucuguccuagucagacuacaucuguccuggccacuucuaacuugauguuaugucagucaagaaggcugggauugcccuggugucucugggcugaacuccugccuggccugagauucugggcauguguaaggggcugguucugaaguuaggugucugggugggugauggggucagagagagugaccuuuuccaggaaacucagcuacagcacucacuuucuuuuucaguuccucacuucccaggaguggcccaaucagaguagaaaaagguagagguacugccagucccagcgcagaugcacugcagacacuggcaacuggagaguguccuggggauccugugugggcuggguaguaugccuggagcugcuaguguagucacgcugagccugguugaggagguccagcagccugggugcuguguccagggcgugucggcaggaugcguuguuccucagcuucccaguggacagagggauauagcagucccagagaaggacgugggccacacaagugacauggaggcuuucagggcaucuccaagaugacuagugaaacugugcuuggaacuuugaaaugugaccgcagaaaauggaacuuuguucaugugugucacuaauagagacuuacuggcugguuuggaacucaagcugcuguguagaucuggagugugauugaacaguugugccgaauggcugcaugaggacaaaugcacagaaaggagggaaagaacuuggccccacugggcaguggucaccaggacuugguguuuuuguuuuuguguaugauggcaucagucagaguuauuacuuuagcugagugcugcagaaacagcagaugagaucuggagaugggaaucacacacaguuagcuccauuuggcuagcagcagugucugagaucuggaaucacuguuuuucuggccagcggacccaaguuuccccuaucagcccuaggcugcuggaggucuacuacacuuacacagacagacaugguacucaccauucugcccauccagcagagagcaggaggccugcccauguaguuugcuggguuucugagugccuagagcauguugagacuguauggaaauuggggaaggagcucagagcacagucccuguuuacagaugaggagacugagucuuaggaagucuuggcuuauucuggguuauucuggagcaaaagagcuguggaucuagaccaguggcuuggucuccagcuuucccccagggauuugcagccucauuuuccccauccauaguccauuuugcuaaggcugaagcugguucagaacaaauagggcagucccagauacucuucuugguggaggccauuucuuucuggauauccccaguccucguagcucagggcaagcgaguaauuuaaccuguccgaaaccacagagaaagacuggguguuucuguuugaggccugaacauuucucaccacccacaagagacccucccucugacaaugcacugaugccagggggccagagguguuagcauucaguccuuacugacaaggagaaggcaggaagaccauucuccuuuucucucuguagaugugggguuuuggacaaauacuugaauuuccugaaugucagauuucucugaaggaaaagcaggauuccaaggauuggcaucagugccuuugcuaaugcccaugccugcucaggccugcuaguccaccuuuccguucuucagugacuuacaugugggcccgccaccccuuucugcaccagaaggguggcccguguugcccuuguuaggcuucuauucugacaguugggggugggagggagacaaggcaugggccugagccugcuaaguagaagaugagaagaugcaguuggggugggcaguggggaugggagugaguugcuggggaauaugaaccguggccuggggcaggcauagccugcuucuauaggcuucucagggacuuccaugccccacucagagcagccccagaagcacauccuggccuggagcuccugcagaugccagucuguccucauccucagaacagcaucccaggagugacugcggugcagaggcaggguugccugcaugcccgagccuccagucugaucagcugaauccucccagagcaccaucuagagugaaggggcccacgcucugccccuguggggagcagcagggcugccaccccauccccagccuuccaggccaaggugguccaucugccucccaccacccuugcucuagucagaauuacuuauaagccucucuaggaaaacuacagaggaguaagcauggucuuaccucauccauuccaaggucuggacuuugcugaggccaagccaaggauauuuaacccauaccauccccaacuccuacccaauggcaaaccaugagccuacgcaguuucccagggugggcggcguggagaagggagggagacagugcaguggcuccgagccucucucuccccugccugcaucccacugcuuuccggcaagggccagggcuccagauggcucggggguggugcugugaguucaguacagaucccucugcuacagccagcagccuugucucauucccucuacucccuccuggccacacugccaccugggccagagaggaaugaggagcagguuucaggacaugggaccagcaguguacugaggggagguaaaggugucuucugcuuuccugggcccaggagggugucugcccagccuuccaaugcucaccuccaaacaaaauggaaguggaucuccagguggcaggcccuucaggaggccuuucucccaccgaauagcuaguccuugggcaguuugcuuuagaguagccacuuugaccuaaacagucuccaagucaauagagaaauacucuccaaacuuuagucacucuggagcagccagcccuguugcuuaguacaugccccgaagugguccauguucccagaagacaggaccuuuggccugcuuacuugcuuggaccacugcaggguggaggccacagccacuggggccgugaggagacaacaggcauggaauucuaccuuuuaguuauggaagagggccauaaguuaagcuaagaaugaauguaaaauuaauucagaucugaaaauaagaaauuuuacuccuaaaacacuuguuuucauaucuaagggcaaaggaaacagaauaaaaagaaaaugcaguaaaaaugguagagaaaaaaagaaauccaugaauaaaguaggaguuggaagaaguggaagaaggcacaagaaggggaggcaggaaagggaggugauggaaagagagccagaggcaggaagaggcagggaccaggaaaucuugguaaaguucccaguugcuggcugguaaccuguugguuuugcugcuucuacucuuuauuuugcucagccuuuggccuggacaggcauguuuaacccacugagucagagggcagcccucucccuucuuccuguccuugccucccuccacagugcuuuucaguccuauugauagccgggaacugucccagacacuggagaaacagguagaaaugaagcagaugugcugcucagcucugugaagccuucagaccagugcaggaggcaccacugccaccaagaaccacacaagcaaacacacaaucacaucuggggucaaggaggggagggcuauggcgggugcuguugguacgaugcugagacaagauuccuggggguaguugggcaugguggcucacaccuguaaucccaacacuuugagcagcugaggugggcagaucacuugagcccaggaguucaagacuagucugggcaacauggcgaaaccccaucucuacaaaaaaaauacauggugcaaagauacaugguggugcaugccuguagucccaaguauuugggaggcugaggucagaagaucacuugagccugggaaaaucuaggcuacaugagccaugaucaugccacugcccuccagccagggugacagaguaagacucugucucaaaaaaaaaaaaaaaaaaguuauugggggcuucuccaaagagagcauuaggcuguagaaugucagaauugcuggaugggaggcaguuggaaaaagaggaggccugaggggaugugcuuuguucaugugaggguucaggagcaaagguccaggacagcuguaccacaggacaggaccagaaggcaugcagguccugcugggcuugcuggggucuccugaugcacucccaagguuugggaagguggcaguaggaaggucagaugugcauuuaaaacaccccucugaugcaaucucaagggcccuucaaauagccaaaauaauugugaaaaagaagaacaaagcugaagaacucacacuuccugauuucaaaacuuacuacaaaguuacgguaaucaaaacagugugguacuggcauagagacauauagaccaauagaguagaauacguagcccagaaauaaacccucacauauacggucagaugauuuuugauaagagugccaagaccauucaguagggaaagaacaaucuuuucaacaaaugguguugggaaaacuggauaucuacaugcaaaaaaaugaaguuggaccuuuuccuuacaucauauacaaaaauuaacucaaaauagaucaaauaccuaaacauaagagcuaaaacuauaaaacucuuagaagacaacauaggggauaagcuucacaacauuggauuuggcagugguuucuuggauaugacaccaacagcacaggcaacaaaagaaaaaauagacaaaauagacuucaugaaaauuuaaaaauuuuuuacaucuaaaggcacuauuaacagaguaaaaaggcaacccacagaaugggagaaaauacuugcuaauuauauauuugauaagggauugauauccagaauauacagagaagucuuacaacucaacaacagaaauaaacaaacaaaaacccaauuaaaagugggcaaagaggccaggcgcaguggcucaugccuguaaucccaggacuuugggaggcucaggcaggcagauugccugagcucaggaguuugagaccagcuugggcaacauggugaagccccaucucuacuaaaaauaaaaaaauaagccagacgugguggugggcaccugugcucccagcugcucggguggcugaggcaggagaaucgcuugagcccaggaggcggagguugcagugaaucaagaucgcacuacugggugacagagccagacugugucuaaaaaaaaagugggggggagcaaagaggagucagguguggugauacacaccugucuucccagauacuugagaggcuaaggugggaggguauccugagccuaggaguuugagaccagccuaggcaaauagcuagaaccugucucugaaaaacaaaaugggcaaaggacuugaagaaacauuucuccaaggaagauauacaaauggcuaauaacucccuaaaagauacucaacauaggucggcuaugguggcucacaccuguaauccuagcacuuugggaggcugaggcggguggaucaccugaggucaagaguuugagacuggccaacauggagaaacucugucucuacugaaaauacaaaaguuagcugggugugguggugggcacuuguaauccuagcugcucaggaggcugaggcaggagaaucgcuugaaccuaggagguggagguugcagugagccaagaucacgccacugcacuccagccuggacaacugagcgagacucugucucaaaaaaaaaaaaaagaaaaaaagaaaagauacucaacaugacuaaucauuagagaaauucaaauugaaacuacggugagauaccaucucauacucguuaaggauggcugcuguaaaaauaaauaaauaaauguuggcaagaauguggagaaauuggaacccuugugcacuguuuuuaggaauguaaaaugguacagccacucuggaaaacaguauggcaguuccucaaaaaauuauaaauagaauuaccauaugauccaacaauuccacuucuggguauacacucaaaugaauugaaaggaaggucuugaagagauauuuguacacccauguucacagcagcauuuuucacaauagcuaaaaugugaaaacaaccaacagcccauugacaaaugagcaaauaugcaaaauauauguauauacauacauacacacaacgaaauaucauucagccuuaaagaggaaggacaaucugacacaugauacaacauggacgaaccuuaaggacauuaugcuaagugaaauaagccagucacaaaaagacaaauaugagguggucagaguagucaaagucacagagacagaaaguagaaugguaguugucaagagcuggaggaagaggggagccgggugcaguggcucaugccuguaaucccagcacuuugggaggccgaggcaggcggaucacaaggucaggagaucgagaccaucuuggccaacauggugaaaccccaucucuacuaaaauacaaaaaaaaauuagcgggguguguuggcccaugccuguagucccagcuacuugggaggcugaggcaggggaauugcuugaacccaggaggcggagguugcagugagcugagauagugccacugcacuccagccugaugacagagcaagacucugccuuuaaaaaaaaaaaaaaagagcuggaggaagggggaauggggaguuucacggguacaguuucagauuugcaagauggaaagaauuacgaagaugaaugguggugaugguuguacagcauuaugaauacaauaccacugaccuguacacuuaaaaaugguuaagguaguaaauuuauguguauuuuaccacaauaaaaacaaugcaaaauuuuuuuuuuauuuguucauuugagauggagucucgcuuugucgcccaggcucaagugcagugaugcaaucuuggcucacggcaaccucuaccuccagccucccaaguagcugggauuacaggcaugugccaccacacccggcuaaguuuuguauuuuuaguagaaaugggguuucaccacauuggccagucuggucucgaaauccugaccucaagugauccacacgccucacccucccaaagugcugggauuacaggcgugagccgcaguguccggccaaaaauaaugcuaauuuuaaaaacccucuggaaauagacagaggugaugguuacacauuaugaauuauuaaugccacugaauuguauacuuuaagaugguuaaaauuacaauuuaauauuuauuuuaacacacacuauauaugugugugcauauauauacauauacacuaaaacaacacauacacauacacacacauauauauacaccccucccccgcccagcugcuaugugaagaacagccugcagggguagcgggugggcucugggagccagaguggcagagggggcugaggcugaggcugggguaguggugaugaugacugcgaagagccaugauagauuccugguguguuuggguggcuaaacagacagaauuggauuggauguggaggguaggagauggagauagagaauuuuucuguuugggccauugccaaguugaaggugccugacaaaucuaagacccuggcaugaaacaggcagguugggauggagacuuuuguuucauauucacaagcauauagugacauuuaaagugccauaggagagauguggacagagagaagaggugucaggaucugggcuccccagcacugagaagaacccagcaaagguggcuggcaaggauaagcaaagaagaguagaaaggccagcaaguggagggccaagggauccaggaggggagaauaucugagcaguaguggggagucaacugccaagagcccaucacaggagcucuugaugccuugcuggguggagcaaaacagaacaaccagguugacaagucauuuuuacccccaaccucaaguuaugaauauuuucaagccuacaaaauuguugaaagaauuguacaaggaacacccacaaagccacuaucuggauuuauaaugaaccccuccucuccuggcuuuaucacguauccauucuaccaucuauuuguucuucugucuguccaucuauccauccaucuuuuuguugaaugucaaaguacauugcagugggccaggcaugguggcucacaccuguaauaccagcacuuugagaggcgaaggugggaggauugcuugagcccagggauucaggagcagccugaguaacauggcaaaacccugucucuaccaaaaaaaauacaaaaauuagcugggugugguggcgccaugccuguagucccaucuacucgggaggcugaggugggaggaucacuugagucugggagguggagguugcagagagccaugaucauggcacugcacuucagaaccagacccugucccccuccaaaaaaaaaaaaaaaguacaucgcugauaucaguauacuucccacuaagcacuucaagcguaucauuaacuagaguucaguauuuauuuaagguuucucuuuuuuagcuaaaauuuacauauaaugcaauguacagcaauuaauuauuccagucggugagcuuugagaaguggucugcagcucagccccauguggguugcaggucaucuggagugaccauggaagucauuuagcaggaguuuaagaggcgagggccaaggacuugcaggccaggauaaaggggccuggagggagggcagcagaagccaggaggggaagcugggcaugaaccaaaggguccuggggauuuuaaggagaaguugaggcuaguccaaggguccagccucuccuggagaggguuacuggugacuaagaggaguguguauggggagggugcaggggaguuggccagucauggaugggguguguuacaggguacaccagaucauccugggucgggaggggggcuguccagagcagugugggaggaguuaagagauauugagggcagagagacagauguguccagggaucagcaaggggacggauccucucccuuucguggagauccaagccagugaggucuucuagccccaggugcgauuagguucagccuccacuccccagauccugaccucagauguugggcagguucccaagaccuuccucagggcucugauagauuggcacaggccuccccuggcugguccagcucuggaucagugugacccugcccacugggacccugugguaccugcuuccuaagccugaggucagcuagcugacaguaaggugcuagauggggcaggcaacaugucuauugcuguaccagggugaguauccaggcuaggccugacucccucccucucagcugccaccuuagcugcccuucugcacaucggccuguccuuguuguccagggggcaugggaagguauguuccuccugaugagaccuggccagugacucauagcccagaaaggcauauagucacacuggccaguggggcccucccaggaaccucuagauuuggcaccugcagggagggcuccuuuaugagcuguuucugugauguuucaacuuguaccaaaauggaaagcauaaaugcggcaucaggcgugaugucagugcugagugaucugaaacacugaaugccugcucucccugguagggcuggggcucuccacaggaagaaggcugagugacgucugcaaccuuccuuuuccuugcugcugggggggugagaggaggcgagugggaagagaacaugugacuucggggggcucucagagcuuccugacagccauggaggugaccgugagguagacuccacccugugagcauccuuuggggccagauauggcaagcaaggcugagucccacccuugagggcugagacacucugugcagccaguguuccugcagggaagauguagaagcucuucccagaacugcccuccuugcuccagagcccaguggaggaauuaccagggagugaccauugcagacagaucacagcugcucauucaacuuagaguucauacagccuccagcuugggccccaagccucuggauccuuggccagugccaccuuagcugcccuucugcacacugaauaguuugaguaaggaagcagcuaaaaaagacucuucucagggagaaaguccucucagagcuacagagcccacaggguccuauguuuccaagucccuagcagacagguggcaguggcucccugcaaagccuguaggaaggcuuccugcagcuucugcuucccccaccucuuaaaccaccucuugaccuuguacugcacugagccuucccauccuuacugccacuuaggcccccacugggucggggugcacgggcuuccauggaggucccuaccaguccuuggagauggcaagaugggcuuccuugcuagcaagaagagucagcucauucaaagcuaaugucugacagagcuguccaccuuaggguagccccaggaaggcuccugagacacgaggcucguggcugguagccugcacaucuccugcccaugugccagaucaggaucuuggagguauuagacagcagaacccuagcugaggcuucuugucacacugguaaaaggauagucccucugauucugauggagagccagcuuggagagggccuaggagccacagggagccuucuggguucaaccucuugaugaggaggcaucacugugugcagcuaaggaaggcucuaacuguacuggcacucaggccaguggagucugccacagaacuauucauguauacccaggcugggugggcggguggguuggggugcacagccaucaucucucucccuaccccguggacagccuccaucccccugaguguggggauaggggccuugcaguauggaggaagagacugagguugggcuccucccaggaaacugcuggggaucugucggggaggcagagagggggauguauugcuggccucagagagcucccucagccaguguccuccuuaggaggccuugcaugcugggccugagccugggaggggcuguggggagggugcggucaagguuccuuaccgucuggaagaggcuggauagaaauagcugcacccaucugggcgaugagucacugaggggcguuucagccuuuucuuggagaaguucuauuuuaggugagaugccugugccacagccuggaugacaggggcuggggaaaggaaaguucuggcggugagugcaggcgguuuggcacgugccuuuguucagccugauucagaaccccagggacagucaccccaaaguugcaggauaagaagccuuaccuccuaaauucccuuucccaggaagaagucucaccucagggcaugcugcagugcccaggugaaugagagagaugggacguugggugugggcugggcacccacgggaagaacugaauuuguggcugccacccugggccagaggcugagcuuccccucugaggaguaauccccuuccagggucccucucuggaugaguagaaauggccugcucuggggaacucucacuuugaugggaauaagccccucccucccaagaaugaccuuucuaaagaggucuuuagacuggguucagggacugaaauuguuuucucucuggcuuucucuacccaaacauagacaaagcugccuugcuucuuucuuucuuuuucuuuuuuuuuuuuuuuuugagacagagucucgcucuguugcccaggcuggagugcaguggcaugaucucggcucacuacaaccucugccucccagguucaagcgauucuccugucucagccucccaaguagcugggacuacaggcaugugccaccacacccggcuaauuuuuucuauuuuuaguagagacgggguuucaccauguuagccaggauggucucgaucuccugaccucaugauccgcccgccucugccucucaaagugcugggauuacaggcgugagccacggugcacggccugccuugcuucuuaaaaagcauuuggguggguuaauuguucccagcuagugggauggcuucucaccucacugccucggcaucacuguucuuagaguuucuagaacugggauuggccuuuggggggcucugccaggguuugcagugcugacuucuagagccugacuuggccuuuggaagaggcaggacuacagaaggcaccaggcuccaggcuguccaggcugugguuuaggagcuacgcagagcugucagggcugaucuugccagcagcaacacuuccuagccagggaaccauugagaacacauugcuaaaacaucucagaucuugguuuucucuccugugaggacaaaaugagagaaugccugugaacaugcccuauguggugcuuggcacaagggggugcuugccaaagugcaguguucucccucuucuuggcugcugcccuuggguugcugggauaaggcaccugagcccaggucccccaacuggcaagucaaccuguagcaguagcccuggggccucaaggcagagagcagggcuggagccacguguggguaaauaaaaggggccuucugccccagagaugagacggcaccuuccccuggugaugacuggguggccaauagggugcauuuagaaccucuggcugcaaccacagacagagaacaaccuuggccuccagccucagcucugguugaugaggaggagacucuucauugaggcaccaaaucucggggcuuccaccuuguugagcuaugaccugcaugaccaaauugccaggaugaaugaagcaagccccucugggaugagcccugcucuguaccacauguugugugcagcccugagaacacccuaucaacgagagcucaugggcugcuuuggggcacagaagacaccuuguaaacaacaaaucaguagacacuuugggaaagaauaagcacuauggagaaaauaagcugggugauuugacacagaguacccggaggguguuuuauuuuuauuuauuuauuuaauuauuuugagauggagucucacucuguugcccaggcuggagugcagcggcacagucuuggcuuacugcaaccuccgccuccuggguucaagcaauucuccugccucagccucccaaguagcugagauuacaggcguucgccaccacaccuggccaauucuuacuauuuucaguagagaugggguuucaccauguuggucaggcaggucucgaacuccugaccucaaaugauccuccugccucugccucccaaagugccuggauuacaggugugagccaccgcaccuggccaaaggagagcauuuuagauuguguggccagaggagguccuggugggaaaguguuaccucaucugaaaucuguacaacaagcugggccagggggcagagggaauaaggaguacaaaggcccugguacagaaaugagcucaggggaccacuuggcagagcagacagccuagagugucugcagugaaacagccaaggggagauggcaggaaaagagaccagagagagggggaggcugggguggggcuggguugggucacagaguugugcugaagaguucccaaggugugguggaaauccacuuagaguguuugauccuauuggugagaugcucugauuuacauguggguuuuuggagaaaaauuauugggucauguaacuggaaguccaaggguagacuuggggcauagccagauccagggaauggaaugaagucaucagaucuacuccuuucuccuuucguugacuccuaccaucuauggacaucauucuuagcaucucucuguauguugggaaagaagacuacugcugcugcaaagcuacauccuucugauuaguaauccaaaggaaaacgaauaaagacccucucuccuguuguucauuaccagauaacguggagggcucuaaccgacucuguuugccaggucacgugcccaucccugcacagggcuaauggcagagggaaacuauguguuuaucacauggauagcggcacaugucucguuugcucuggaggcaugaauuaucccacuucuuuaaaaagcuaucuuccuuaagggaaaaaaaaaggcuuuaaaaaauucuacuuaacaucagucacuuacauugcauuacuuuacccucgcuuauuuuguucucaagauuuuucauucuguaguaucuuguuucuucagcuagacucuaagcuucuucaggauaggaaucaugguuucuuuuuauucucuaugccuccuucucccacguauuacucuucacuuauuuauucauuaugugaguuuuuacugaauacccauugcauauaagcacugcucuagggccaugccuuuccucuuggguuagguuuuaaaagaucagucuggcugcuaugugcaaauggccugaagugggaagcaggggaaggcuacuggguucauccgagcgggagguuggggugcacagaucugaggcacugccaggggguggcggggaggacucucaagcaggagggucuggcaggcagugaguuggugguugggguggggugggggaugggacugccuccacugccucacaugccuggcaacuccuagagggcaggggagugccaucuguccuucagcccugccaccuggcagcccagaaaugccugagcagggcuuggugcuccugccugugcuaggaguggccuuggcugcuguggggccugcacugaccugggccaugaguacugccaauccuggccacccugcugacuauuuugcuuuucuccucaggugaaggaguggcucugucugaacugucagaugcagagggcucugggaauggacaugaccacugcaccucgcuccaagagccagcagcagcugcacuccccagcccugucuccugcccacuccccggccaaacagccccuggggaagccagaccaagagagaucucggggcccaggaggaccacagccugggucccgccaggcugagacagccagggccaccucagugccggggccugcccaagcagcugccccuccagagguggggagggugucuccucagcccccucaacccaccaagccuuccacagcugagcccaggccaccugcaggagaggccccggccaaaagugccaccgcagugcccgcugggcuuggugccacugagcagacccaggagggccucacugguaagcucuucggccuuggcgcgucacugcuaacccaggcgagcacccucaugucugugcagcccgaggcugacacccagggccagccugcccccagcaaggggacaccuaagaucgucuucaaugaugccagcaaggaggcuggcccaaaacccuugggcucagggcccgggccugggccagcaccuggagccaaaacugagccuggggcuagaauggguccuggaucuggaccuggagcccugccgaaaacugggggaacaaccaguccaaagcauggcagagcagaacaucaggcagcaucgaaggcugcugccaagccaaagaccaugccgaaggaaagggccaucugcccacugugccaagccgagcucaacgugggcagcaagagcccagccaacuauaacacaugcaccaccugcaggcuccaggugugcaaccuguguggcuucaacccaacaccccaccugguggagguaagagcuggaccaagcaugcucccuugaaccuugaugagaggccgggccuggguagugagugucaugggaaccagaaagaguucugggucugcagcagccauggggcugcuccuguacaacuaaugcugcagaggggcugcauucccuuuccugucccuaccucaggccccaguucuacucagaacuaacuuucacucagaguuggggguaauggugccuacugacucagacuagugcccuaaggcugaucccagagucccugagcuggccuccccauuuccagcuaccaugggcauggcccugaugaaagacaccaaccuccccugcucagauaggagaaccugaggucccacacugccauggaccugugaccuucagagggguggggaucgaauggccaugaugcagaggguugcgucccacauccaggguggggugggaggcuuucucacaauggggcagggcaugucccacuguccaggcuccagcccagcaaggugguauucaaccuugauugucucuucugaggucauaaguguugacgucuacuugucaaagucacagccuuugguccacauguuuuacccaggcuggggcugggcucuccuuagagcugcuacuggggaugcucagagaugcuucucuuucccacaggaagguuugagacagaccugggguuguggccauucucuccgcagccccugcuccagggaagggcacugagcacugugcagugcuaggcaggagggagcaggaggcccaguguaagguucaguguucccucgaagccuggaguccagcccaagaggcucagaaggugaaggugcccuggcagaauuagaccagccugggccaggagcagaugcugcuucugcuccucccucaguccuguggcccacucucccuggcccagggucacccaugugacccuuaccaugcugccuugggcguagcuuggugugucuccuuagagugcccucagucuugauagaugaauguguuucccagcugugucacguuaggagauguucgagccaaggcccugccucuugcacauggggagccaccugagcccucuggucucuugggcugagccauuuguagcugaugguggcacaggggugugcggagugcaaaccaccacuggcccaggaugggacaagagaggagagcaugauguugccauggccucuguggcaccuuguucugacuucccuugggccaggacuccacaggaguccccgugggaccccagcaugacuaggaagacuacuuuggccaccaaaggccacacuuuccaauaugcagggaagggcagcccugagcaagacaacugaccuccucauguggcacccaucuggucuucuaggcaccacgaagccaacucuccaagcucuagaucugguggcucacuggcgacaguuugccucacuggcucggggaaaggggugcaccagggugucaccacaagacuaggagaacccuagcuggcugcucugcccagagaccuccaggcacaagcucacugcuggucagguggggcacacugacacugagcgacugugagccccaguggacuucugaguuggccuggccuggaggacuccuguccccaagagaccucccagcccacauuuccuuauuaagcagaaugugcacgaaugggaggggaaaacugucucuguccaggagcauaaauguuccugacaguuccucuuggccgucccugggccaggccacgggaagugcugauucugcccaaacagaagaguuucguucacacgcugacuagaugaaacgucuggauucuggccuaggccucucauuagcugcuugguucuggcuauccuggacccuggagcuucugucucuugauggccgguguuccccccaucacaccucucucaauuuccugcugucuccauguccugccccacugcccccuccuuagccaggaccacucucaucuccauagggucugaugggucccaugggccugaaagaaagcugggggauguccugguccuaguccugguccuaccucauccccagcucaggcugcuccugacagcagucaggggugaugaagucucucuaacuccuuucucauagcucucccuaucaaugcugcuguccccagagggccugcagcuauucuagggaagguguggauaggcggccauaaugccucucccaugauucccaccauagagacuguaccaccauccaccaccagagaugcaagccagcagcccggggucauccucaccuccuccucuuuaaccucugcaccugcuccauggaccaagcccugccagcucugccuccccacugucacaagaaucuggccucucucccacccaugcucacagccuuaguccuuccguccuuauccucccuuacccacacaaugaccaaaaccucugugcagcuucaccugccuugggucuugcaaggggcuggugcugauauguucaccaucccuucagcauugcuuuucuucacugaggccccuaaccaggcuguggucugucuuggaucucaccucagucaauggccacuuggcauccugagcaauuuugugcuucucugugaccuacuugguguguucuugguuagagguuucugauuucucagcacuugccagagacacuuacccugccuugggaguguggugguaaggccagcagguccuucuccagguccuaagggugggucugccauggcugucucucucuggaccuugccugcuuaagaacgacugugcugugucuuugugcacaaagaagggacagacccguggagccccccucauagcucccacagcccuguuagaccuccugggacuccaccugaggccacagucaaccaucugggccaguggguugggaauuuuccccauagguuggaaauuuuccugaacauuucugagcuguagaaaucuuucuucuuucuagauugggaguucagagcacacaauagaggagagaguagaauuggauccuuuuuccuuuugaacuuuccucugaaaaaaaauaaccauagugcuauuuagugagucauuucauaauuaagaguuguugauuccaguuuuuuuuaccuauuugucuuuuggaaggauaauaguacucucuggcuuaauuuuuaauugacguucaguucaaaauagaguuugugaagaaauuaguugaauuggaauugugacaguaacauuaccagucucuuauuauaucaucauugccaaaauuccagcugugcccuugagaagucgggccucccugggcaaagucccuugcaccugugauacauggggcugggcuugcucauugggguagggguugcagcaggggcaucaggccagagguccuguugccucccauguagaauagggaccacaauacucccuuuuagguuuccgugagaaccaggugagaugcuguaccucagaugcuuaugcaaggccugacacagucagcccuuaagccaggauuuuggaacaggaguauccuaaaagagggucucugugugagaaaggaagcguccccaugagccccuaucuggguguggauggacccuguggcugguguaagcuuuugguaugagggaugccccacagggaacaaacacauuuggugcuggggggugaggggguuacagcccagcuacaaggauacacacuggggacaccaugguggguuuauuuuaugggaggaagaggcccagaaagaaggagcuuaggcauguccagcaacagggaggcucagggucgcagagucaggagaggaauagcagcaccagugauggccaucccugugguccaguguccuccaagaugaccccugggcauccuuuucucuggaguucucauucacagcccccuggucuggcagcagggcugaggguguuuagggccaggcagcuggccauagggcauugacuggaacggugucaccauaaccauacuggcaugcaggccagcuccacacaugaagagauuacguggaauguagguucauucagaugauggcagacagugcaggaucuguccuggcucacaaggcacaauggccaguggucccagaaggcagcagcucucacgugccuagagggcaccccacuaacucagucaucccguuuccccuucuuuacccuaaauagugaugcccugaaccacugagugccaucugauggcauacacaccugccucucccacuguuaguugaugauuguccuuggggaauuuguaucuuccugcccuagaaaggaacuggacagagggaaugaggcagaaguagucaucagagccaccccauuauccauccccugcccuuuugucaaagaggccaggcgaagggguaagcaggcagcacuuucccaaggacuggagcuggcaugggcugagugaggcagaguacgagagggcugugcaaugaauggauggcugaaugaggaaugaacacugaaauugcggaauggaaacgagcggaagaauaagggaaugaaugauugggauggagguagggguauguugggguuggagaaaaugagaauagaaugaauaaaggaauugggaccccagcugucccagcccccaggcacagagauucuacauggccugccuuccacccgauucucauuccccagaagacuugggccugggccaggucuccccuggcucuacuccuaccagccccagugcccuguacccuucuuccccacucccagagggcuugugaagggccuccagcagccaggucaauguuuauuuuuagcccuuacuucacacgccucuuccugccugcucucccuuccucacugccuacuauagcagagccaggagcaagagggccugccaggcaaccugcaaccuggcugucuccaugaauaaaugugugaaggagcaaagcaccagggagcaugugaccacagguaacaucucugcugagagcugggccucugggcucaggcaagcuggccucuccagcauuuggucagagcacuuaacauuaggucugcuuccuccauccagacuacccuuccaaggugacuugcuucauuuagacuguugcuucugugugggguucgcaggccagagaugggguuaggaguuugccaggccaccaaggugggccagggcagauauccaaacuuugagaggccuaacaugggaugggugugcacagggcuccaaaguggaguuagggcagcauugccuugggccagcccacugggccuagauccuaaacccaucaugcugaccauagggcuggggaaggggcuguuugaucauuuccagagcucucucucuugaucucugccuauagcccugccaucucuccagggucauuuugccaucucacaguccuuucugacaugggggaauuuccauuguguacacaggugaugcugggggcaugugagcuaggguuccuggaucaggcucugugcucucccauguccuguucaucuggggcucggucucaaccuaucuguauuuuccccaggcaccucugggggugcacccugccaggccaagugagcccagggccuggccaguggccagcacuuacugccuugugggguuuuguguggagacacauugagcaucagauaagguucaagggagucaguagugguguuagggcugggcugugcagagaacagagugaguauauguauguagggcaucuaaagggucccccuccacagcugggccacugccccauuccucugccugggacuugugcaugagguugggccucggggaagagcagaagcuccagugggagagaagcagucucgacccugaguaaccagccuggggagcaggccugucccucaacacacaccaaggcccugccaccugcccagccuagccucugcugaagcccagagcagagaaguggaguguagcucucuguggacagcaaaccagggcagaaucauugacauguuaucugccaugguggcccuaggaugccaggcuaagggcaggcacccuggggguaccaggcuuccaaggcugccagaggcagcaugugaagugaggguacugagguugucagccuuccuggggguggcaagggccaaaggucaccuccuuuuccaguccucuggcucugugaccuugugguucuuaugguccaccucgguggcagaguugcuggugggagccuguauguccaggcaccugggaugagugaguucccugcaggacggauggagcacuaaggcucugcgccacagaguaagaacaggcacaggugucugugggacccugcucugggcuccacuguaacucucauucuccaucccaugugggccagagaaggacuucaaauccugccaaggaggagcccugacucuggaggaggcuacugggagacaugccccugucagccucagaccugcugcaggaaucacccauuuaggccucagagaugcccaaacccuaugccuguacaaagcagcuggggcugggagacauggacuucgcuucuuguguucugggggcuucaccauugauaccugugucauacuuguaaaugaccuguuugggguugugggcuccagaaaggcugcaugccagugccugucugucugcugagucauggcugucuucagcccccagcacugggccugaaacaguagaggauccugagagugguggacugaugguugagaauuugaucccaguccagcucuggaaggagcagggccccugacacaagggccaccacacauaguccccaucagaggaacaguccagagcccugggggcaggaggaggccucuaccugagggucucugcuggccuuagacaaggugacuugggcuggggauuugagcagggaggacugcucagccccucuguccuccaccaagcaggguuacucccagacagccuccccuggccccaggagucugcacccuaucuagcauagcccuuaccugggaaagaguguggggaaggauggagucagaccugagagcugggaggcaggggaagcauagugccuccaggaagugcuccaugcuuggaugccacuccucuuccacaaggguucucaacugcuggacuccauaccagcccacuaggagccguuugcucccucagauugagaccucagcuuccccugugcuuagggcuaggcccucccaucccccacaguucucccccuuuucuggccuggugaaaaguucucuguggguuaaggaaaguacucuucuuugggguuguuacuugcauucugacuuuguguguguucaucuuaaagguaggggaauuuguuauuugggggcaguaaauuggucagucuuuuucuccuuaugucuuugguguuaugcuuugaaaguucucuccucccuaagguuacagaaauaguuauggaaauauuauuugaggacuucagugucuuuuuaauuuucaucaacccccucucccauuuccuugcagaaaacagaguggcucugucugaacugccaaaccaagcggcuacuggagggcagccuaggagagccgaccccccugccgccgcccaccucacagcagcccccuguaggggccccucaccgugcaucuggaacauccccucugaagcagaaagggccacaggggcugggccagccuucaggcccccugccugccaaggccagcccucuauccaccaaggccagcccucugcccagcaaggccagcccccaggccaagccccucagggcuucugaacccagcaagaccccaagcaguguccaggaaaagaagacccgaguccccacuaaagcugagcccaugccgaagccaccuccagagacuaccccaaccccugcgacuccuaaaguaaagaguggggugaggagggcugaaccugccaccccugucgucaaggcuguuccagaagcccccaaggguggggaggcggaggucagucccauucacuucccagagacccuagcuuucagacaggacagucuauggaaaggcuugccucccuggguggcugaggcuguaggcucaggacaggugccuuggggccacacaggagggaagggacacaguagaaggaaagucuagaugagguucuggcacgcuuggagacuguggguuuuacacuggugcugugucuggcaccuugucagaugcuuugcuggguuuugauacccuuugaucuaguaaaguuucucuuugaagaccaagggcugguuugggcuugccauggaaccuucagguuauucaaggccagaaggagauaggguggguggcgggcccuaaacccuugggaaauggacagacucuuccccaggguccugggauugacagggaggauuggguucccaccacgagcuuugccauggggagucagugucugcuuuucacccugcugcaggaccuggugggcaagccuuacucucaggaugcgucucggagcccacagagccucagugacacaggcuauuccucugacggcaucucuagcucccagagugagaucacaggagucgugcagcaggagguggaacagcuggacagugcaggggugacagggccacauccacccagccccuccgagauccacaagguggggagcagcaugcggccuuugcugcaggcccagggccuggccccaagugagcggagcaagccacucuccagcgguacuggcgaggagcagaagcagcggccccacuccuuguccaucacgccugaggccuuugacucugaugaggagcuggaggauauccuggaggaagacgaagacucugcugaguggaggcgccggagagagcagcaggacacugccgaguccucagacgacuuuggcagccaauugaggcacgacuauguggaggacagcagugaggguggccuguccccucuuccaccccagcccccagcccgggcagcagaacugacugaugaggauuucaugcgacggcagauucucgagaugagcgccgaggaagacaaccuggaggaggaugacacugccaccuccgggcguggccuggccaaacauggcacccagaaagguggccccagacccaggccugagccuagccaagaaccagcagcacugcccaagaggcgccugccccacaaugccaccacgggcuaugaggagcugcucccugagggaggcucagcagaggcuaccgauggcagugggacccugcagggugggcuccgucgcuucaagaccauugagcucaacagcacgggaaguuauggucaugaguuggaccugggccaaggcccagaccccagucuggaccgggagccugagcuggagauggagagccuaacgggcuccccugaggaccgcucccguggugagcacuccucuacauugccugccuccacacccagcuacaccucgggcaccucucccaccucucuguccucccuagaggaggacagugacagcagccccagccgcaggcagcgucuagaagaagcaaagcagcagcgcaaggcccggcaccgcucccacgggccccugcuacccaccaucgaggacuccucagaggaggaggagcugcgggaggaagaggagcugcuucgugagcaagagaagaugcgggagguggagcagcagcgcauccgcagcacggcccgcaagacccggcgggacaaggaagaacugcgggcccagcggaggcgagagcgcuccaagacaccacccaguaacuugucacccaucgaggaugccuccccgacggaggagcugaggcaggcggccgagauggaggagcuacaccgcuccuccugcucugaguacucacccucacccucccuugacucugaggcugaggccuuggaugguggcccuagccggcuuuacaagucaggcagugaguacaaccugcccaccuucaugucccucuacucaccaaccgagacacccuccggcagcuccaccacucccaguuccggacggccgcucaagagcgcugaggaggcuuaugaggagaugaugcgcaaagcugagcugcuccagaggcagcaaggccaggcagcaggggcccggggaccccauggcggccccucucagcccacaggcccccggggccugggcuccuucgaauaucaagacacuacagaccgugaguauggccaggcugcucagccugccgcagagggcacgccagccagccugggagcagccguguacgaagaaauccuucagacaucacagagcauaguccgcaugcggcaggccuccucacgagaccuggcuuuugcugaggacaaaaagaaggagaagcaguuucuaaaugcugagagugcauacauggacccaaugaagcaaaaugguggcccccuuaccccugguaccagucccacccagcucgcugccccuguguccuucucuacccccaccuccucagacagcagcgggggccgaguuauucccgauguccgugucacucagcauuuugcaaaggagacucaggacccccucaagcugcacagcucuccugccucccccagcucagccuccaaggagauaggcaugcccuuuucccagggcccugggaccccagccaccacagcuguggcuccuuguccagcugggcugccacgaggauauaugacuccagccuccccagcaggcuccgagcguaguccuucaccaucuuccacagcccacagcuauggacacagcccaaccacugcaaacuaugggucccaaacugaggaucuaccccaggcccccaguggccuugcugcagcuggacgagcugcuagagagaagcccuugagugcgagugacggugaggguggcacuccucagccuucccgggcauauuccuacuuugcaagcuccagcccaccucucuccccgucuucccccucagagagucccacauucuccccuggcaagaugggcccaagggccacagcagaguucucuacacagacgccaaguccagccccugccucagacaugccacggagcccuggugcccccacuccaucaccuaugguagcccaggguacacaaacaccacaucgacccagcacgccucgccugguguggcaggaguccucucaagaggcucccuuuauggucaucacgcuggcaucugacgccuccagccagaccaggaugguacaugccagugccuccaccuccccgcucugcucaccuacugaaacccagcccaccacccauggcuacagccagacaacaccuccgagugugucucagcugcccccagagccaccugggccaccuggcuuuccacgggugcccagugcuggugcagaugggccccuggcacuauauggcuggggugcccucccugcugagaacaucucccugugccggaucuccucugucccugggacgucuaggguugagccaggccccaggaccccuggcacugcagugguagaccuccguacagcugucaagcccacucccaucauccucacugaccagggcauggaccucaccucucuugcuguggaagcgaggaaguauggucuugcccuggauccaaucccaggacggcagucgaccgccgugcagcccuugguuaucaaccucaaugcccaggagcauaccuuccuugcuacugccaccaccgugagcaucaccauggccucgucuguguucauggcucaacaaaagcagccuguggucuauggagaccccuaccagagccgccuugacuuuggccaggguggggguagcccugugugccuggcccaggucaaacaaguagagcaggcuguccagacagccccauaccgaagugggccccggggaagacccagggaggccaaguuugccagauauaaccuacccaaccaaguagcuccucuggccagaagagacguuuugaucacucagaugggcaccgcccagagcauuggccucaagccaggcccagugccagagccaggugccgagccccaccgggccaccccugcagagcugcggucacaugcucugccaggugccaggaagccacacacagugguggugcagaugggagagggcacagcaggcacugugaccacacugcucccagaggagccugcgggugcccuggaccuuaccgggaugaggccugagagccagcuggcaugcugugacauggucuacaagcuccccuuuggcagcagcugcacuggcaccuuccacccggcccccagugugccugagaagagcauggcagaugcugccccaccuggccaaagcagcagccccuucuaugguccccgggacccugagccuccugagcccccaaccuaccgggcacagggggugguggggccugggccccaugaggagcagaggcccuacccacaaggccugccugguaggcuguacuccuccaugucugacaccaauuuggcugaggcuggccucaacuaccaugcccagaggaucgggcagcucuuccaggguccuggacgagacucggcuauggaccucagcucacugaagcacuccuacagccugggcuuugcggauggacgcuaccuagggcagggcuugcaguauggcucagucacggaccugcgucauccuacagaccuuuuggcucacccgcuucccaugcggcgcuauagcucagugucgaacaucuacucagaccacagguacggcccacggggagaugcaguuggcuuccaggaggccagccuggcccaguacagugccaccacagcccgugaaaucagucgcaugugcgcugcccucaacuccauggaccaguauggugggcggcauggcagugguggugguggcccugaccuugugcaguaccagccccagcacgggcccgggcucagugcuccacagagucugguuccccucagaccuggacuccuugguaaccccaccuuuccagagggccacccaaguccugggaacuuggcccaguaugggccugcagcaggccaaggaacagcagucagacagcugcugccguccacagccacuguacgugcagcugauggcaugaucuacucgacuaucaauaccccaauugcugcaacacugcccaucaccacccagccugccucaguccugcggcccauggugcgugguggcauguacaggccuuacgcaucugguggaaucacagccgugccacucaccagucugacacgugugcccaugauugccccccggguaccucuuggacccacagggcuguaccgcuauccugcaccaaguagauuucccauugcuuccaguguuccaccugcagaagggccugucuaucuggggaaaccugcugcugccaaggccccuggggcugggggcccuucaaggccagagaugccaguaggggcugcacgggaagagccucuucccacaaccaccccugcugccaucaaggaggcugcaggagccccagcuccugccccacuagcuggccagaagccaccagcagaugcugcuccuggggguggcaguggggcccucagccggccaggguucgagaaagaggaagcaucacaggaggagaggcagcggaagcaacaggagcagcugcuccagcuagagcgggagcggguggaguuggagaagcugcgacaacuucggcugcaagaggagcuagagcgggaacguguggagcugcagaggcaccgugaggaggagcagcugcuggugcagcgggaguugcaggagcugcagaccaucaagcaccaugugcugcagcagcagcaagaggaacgccaggcucaauuugcacugcagcgggaacagcuagcgcagcagcgucugcagcuggagcagauccagcagcugcagcagcagcugcagcagcagcuagaggagcagaagcagcggcagaaggcucccuuuccugcagccugugaggcaccuggccgagggccuccccuagcggcugcugaguuggcccagaauggccaguauuggcccccccuuacacaugcagccuucauugccauggcagggccugaaggacuugggcagccucgugagccugugcugcaccggggucuccccagcucugccucagacaugucacugcaaacggaggagcagugggaggccagccguaguggcaucaagaagcggcacuccaugccacgccugcgggaugccugugagcuagagucugggacugagcccuguguggucaggaggauugccgacagcagcgugcagacagacgaugaggauggggagagccgcuaccucuugagucggcgacgccgggcacggcggagugcugacugcagugugcagacggacgacgaagacagugcugagugggagcagccagugcgccgccgcaggucucgucuuccccgccacucagacucaggcucugacagcaagcacgaugccacugccucaucauccagugcugcugccacugugagggccaugagcagcgugggcauccagaccaucagugacugcuccgugcagacggagccugaccagcugcccagggucucuccagccauccacaucacagcugccaccgaucccaagguggagaucgucagguacauaucggcgccagagaagacugggcguggggagagccuggccugccagacggagccagaugggcaggcccaggguguagccgggccgcagcuuguagggccaacugccaucagccccuaccugccuggcauccagaucgucaccccagggccucugggcagauuugaaaaaaagaagccagauccccuggagauuggguaccaggcccaccugccuccggagucucucucacagcuugugagccgccagccucccaaguccccucagguccucuacucaccagucucaccccuguccccucaccggcuccuggacaccuccuuugcuuccagugagaggcugaacaaagcucacgugaguccccagaagcacuucacggcugacagcgcucuccgccagcagacgcugccucgccccaugaagacccugcagcggucccugucugacccuaagccccucagccccaccgccgaagagucugccaaagagagauucucccucuaccagcaccaggggggacuggguagccagguaugggaacaggggcuguuccagggugggacaggggucucugccuagcccgaggggcccccacagggaggggcuucuucuggggugggaguagaggcaucucuggccccagaggcccaggggaaagagucaaugagcagaugcucccuggugcacaucugaaagagccugcagcccggcagacagccuggcagauacagacacacacaugggcccccacagccuuccagccacauacccuacuagaagcuucagccuccucccagcacugucccuucaccacccacaccugguccagccccugcuaccucccccuuuaggccucuucagcucucacuucuagucuggaccccuuccacuccaaacuuaaucuauggguguuuccuaagaaaaucagucauaugaaccuggcgcggcugcucucguccucucaguccuggccugguuuccauugccacacaggaagcccacaccccuauggccuagcacuagaggcccaucccagcgggcugcagugugcucucugccccaggguguucucugccccuaccuggcccucgguaaaucuguuuacacaucugucugcuccccuagauaggggauucagaagcauaagcuuacccuugguuguggcuuuauuugccagugauggauggggacugugagaaguggcuuggcugugggcugcagccaaagugagaauagaggguugugagggccuaaugccaacaacugagugccaggcugaggaggaugggcuuuuccuaaagacccuggaagccucuggagguuuuaggcaugugagaugggacaaagcagauguuuuggaaaguuuccugggcagaaugugggagggugggcugaaggaagagaccuggcagaggaggcaggagccagaggcaucguaagguagauuugcccauuuucagggugugacacagagacgagaaaaguggagccuuagaaugggguuuguggaggugauaaucuuggguagugaagucuugguguaugcaggccauauaggggugugggugggaucaggacucuaggcuggcagggagggcaggucagagaggcagggugguccuggcugcaggcacagaggucccaugggcuggccaugugagaccaggccaugauaggcacucaugaugcguggccaaaauaagaaaagagacaacagagugagggguucaaaaggcuaaauuuauuccauaaaaggcccacccugaaauuuugagggcacacuauaauuuuuauuaugacauaugguggauguaggugggagguuuuuagguaguuacuuggcaagguaaaaaguaagaauccuauaggagucacuucccaguauauauuggaauuugggugguccaugaaacccaagggcauggggcauucugggaaggcuaggagcgagagaaaaagggagaagacagagugaacuaccaggcaauguggaccuucaggcaaugcagagugucuaggguaggcaaggaggaccccaugguaggcacuguuagggaaccuugaccaggaagccaugcugcuggagguagggcuggauaggacuuacgggugcacugguggcuccagagaacagcagguugaccgagggacauggagggagcuggggaccaggccaagagcacagcccagaggguuuggcagagggcagugcagggcacuagaggaagagggugggcaggcagcugaggagccuuccacuuuagagaggacuagggcaggaugcagaaugacucagagccugccacgauuggcauacaaucuacaugugucccuucccaugauccucuagggagccuggcgggcccaggacccucuccacuccaugccuccuguucauacuccacugaucucaaccccugucagcugcuaggccccaaacccagagccacagcuguacucuucuuaccucaaugugaggcagaggguggcaggcccauuggagaugugcagggguucucaaagccaugugcugggccaguacaggacauuggcaugaagggaaucugcccguacccuccugcuucccaaagcucugggaaagagaagggcuguaaaauaaucacagaucuucccucuauggcaaagaaaccaaggccuaugggugggcaggguaggccuccaggcugccugguaaaucagggcaccagcaagauggaacccagcuccuuccccagcccaggccuggguucugccaccccacaccccaucaagucaccacaccuugggucucagugcugcccacccuucccucugucucaggugucggcguugccacccaacagccugguccgcaaggugaagcggacacugcccagccccccuccagaggaggcucaccuuccccuggcuggccaggccuccccacagcuguaugcagccagccugcugcagcgagggcugacggggcccaccacugucccugcuaccaaggccagccugcuccgggagcuggaccgggaccugcggcugguggagcaugaguccaccaaacugcgcaagaagcaggcagagcuggaugaggaggagaaggagauugacgccaagcucaaguaccuggaguuggguaucacacaacgcaaagagucuuuggccaaagaccgggguggccgugacuacccacccuugcguggucuuggcgagcaucgugacuaccuaucggacagugagcucaaccagcugcggcuccagggcugcaccacucccgcuggccaguuuguggacuucccugccacugccgcugcuccugccacccccucuggucccacugccuuccagcagccccgcuuccagccuccagccccacaguauucugcaggcaguggugggccaacucagaacggauucccagcccaccaggcccccaccuacccuggccccagcacguacccagcuccugccuuuccuccuggugccaguuacccagcugagccuggccugccaaaccagcaggcuuuccgccccacaggccacuaugcaggccaaacacccaugccaaccacacagagcacccuuuuuccaguccccgcugauagccgugccccacugcagaagccacgccagacaucgcuagccgacuuggagcagaaggugcccaccaacuaugaggugaucgccagccccguugugcccaugucuucagccccaucugaaaccagcuacaguggcccagcagugagcagcggcuaugagcagggcaaggucccugaggugccccgggcuggugaccguggcagugugagccagagcccagcccccaccuaccccucugacucacacuauaccagucuggagcagaacguuccucgaaacuacguaaugauugaugacaucagugaacugaccaaggacagcaccucuacugcuccugauagccaacggcuggagccccuggggccaggcagcagugggcguccagggaaggagccuggagaaccagguguccuugacgggcccacacugcccugcugcuaugccagaggagaagaggaaucugaggaggacucauacgauccccgcgggaaggguggccaccuccggagcauggagagcaauggucgaccagccaguacccacuacuauggugacagugacuacaggcauggggcucgaguagagaaguaugguccagggcccauggggcccaagcaucccuccaagagccuggcuccagcugccaucuccucaaagcgcagcaagcaccggaagcagggcauggagcaaaagauauccaaguucucgccuauugaagaggccaaagacguagagucagaccuggcguccuaccccccaccugcagucagcagcagccuggucucucggggcaggaaguuccaggaugaaaucaccuaugggcucaagaagaacguguaugagcagcaaaaauacuaugggauguccagccgggacgcaguggaggacgaccgcauuuauggcgggagcagccggucccgggcaccuucugcauacaguggggagaagcuguccagccacgacuucaguggcuggggcaagggguacgaaagggaacgggaggcuguggagcgacuucaaaaagcgggccccaagcccucaucccuaaguauggcccacagccggguacgaccccccaugcggagccaggccucugaagaggagagccccgucaguccuuuggggaggccccgcccugccggagggccccucccucccggcggggauaccugcccacaguucugcuccagccacuccaugccugauguccaggaacaugucaaggacggaccucgggcccacgcauauaagcgugaggagggcuacauccuggaugauucccauugcgugguuuccgacagcgaagguaauggcagccaggggugauuucugcggauacucagcagcuggggggccugccuaccuguggggcccugggcccuaagaugucccagcagggucuggucuggcgccucaucuggugggcccugcugcaggcaggcugcccuugccugcuccaucugugcccugguccgugguugcgggagggugggcugggggccugcugaucugcuuguggcuguggcacccacucucuugguuucuuugcauggcuucagcuaggccucccccugcggcuagcccggggguugaugguauucuguuuuuggucucugaagcguaucaccugggccaggaggagacggacugguuugauaagccccgggaugcccgcucugaccgguucaggcaccacgggggccaugcaguuuccuccuccucccagaagcgaggcccugccaggcacagcuaccaugacuacgaugaacccccugaggagggccuguggccucaugaugaggguggcccaggccgccaugccucagccaaggaacaccggcacggugaccacgggcggcacucaggccgccacacuggugaggagccgggacggcgugcugccaaaccacacgcucgggaccugggucgccaugaggcccggccccacucucagcccagcucugcuccagcuaugccgaagaagggucagccuggguaucccagcucugcugaguacucacagccaucccgugcuucauccgcauaccaucaugccucugacagcaagaagggcucccggcaagcccacuccgggcccgcugcacugcagucaaaggcagaaccccaggcgcagccgcagcugcaaggucggcaggcagcuccaggaccacagcagucacagucaccaucauccaggcaaauacccucuggggcagcaucacgccagccacagacacagcagcagcagcaaggucuugggcugcagcccccacagcaggcucugacacaggcucggcugcagcaacagagccagccaaccacccggggcucagccccugcugccagccagccugcagggaagccucagccaggccccagcacagccacagguccucaaccagcaggaccgguaagcagagcucccaugcauggguuguaaccagggaagaugcuaugaaugaagcuuggacauccccuugguuccaggcugggcaugggcagaaucuuagcuauagguucuguguugcagccacgggcagaacagacaaauggcucuaaagggacagccaaagcaccgcaacaggggagggcuccucaggcccagccagcaccaggaccuggaccugcaggugagccuauccuuugacacccuuggcuguggcccagagcacccaggcuguucucucucuauaccaccugugcccugagcucccccacacugcaugcccucacuaaucccugagaaggugccccaggggcuguagaccuccccagcagaaaacaagccugggguuagaauaagccaaugaggucaccagcacaggggcuuuagggcccaagcagcuuugggcagagaagcaggaaggcacuggugagcacaggguggggaccauggcuucuugcucccuccuuccuuccccuuuccugcucuucucugccuuuuuuucccuuucuucuucuuucccuuccucaaccuccuuuuuucugccuucucccaccccuugucuuccuguucuuaccuucuucucuuuauuucccuagccuccuucucaccuucccaccuuauaggguaccuguguucagauucucucguggguacuugcccucuuagacccuaaagagccaggccgugcauagcucauuauggcgauuucuuuccuccuaggugugaaggcuggagccaggccuggaggaaccccaggggcucccgccggccagccaggugccgauggggagagcguguucuccaagauccucccuggcggggcagccgagcaagcuggcaaacugacggaagguaugcacugccugcaacuggucugugguggguggcuacucugguacaggcugggucugugagaugauuccagacucagucacccaggcagaggccagccagagagcccaccugcugaugcccaguuguucuccgggcaaucucugccccuugggcugagcuugccuucacuaugccaaguggcccugacugggaggggucuggcccaauuuccugauggcucucuccucuuucuuugucacagcugucucugcuuuuggcaaaaaauuuuccucauucuggugaccaugcccagcauggugaguacaagcagccuguaccuugccucuucugggaaaggcccgaggcacuggggguggggguggggcucuaaguccgaagggguccucugggaggaguccagucuucggcugguucaguacccagagcugcaauguucccuucucugaaugugggaggagaaaaaggagggacacugugcacagagccccuaccauggggccaacacaguagggguccccagcaaaggaggggccaaagccagggccagugcccuggcuuucaaaccaucugccauccccugcagggcucucacagcacugggcuggcacuggguuguagguaggccuccagggaugcaacuccucuccagcccuccucuaaaugcuccacaggcucuugaagaaaugaagagagguaucauugcuguggaaaaaucucuggagucagaggccugggcgcagcucuggacucugcguauaacagugagugucaggaucagggugagaugggccggaggaggggugaagggccaaggccuggcugaugacagcuagccaguucugacaagugugaacugggaagggccuguuggguuuccuucagcugcgaugggcccagcagcccucuaccccgcagaggcaggggccacagagcugccugagauggugccagacaagucagguggcacccuuggagaagagcccagcacggcuaacugcaccucacaacuugaagucuaugugcugggcacugaguucaaagucauccugaaggaccugguagucuguggcaccuguaggggaacaugcuucuucccugaugucugcugcuggugccuuugcuccagccacuuggaagagauuagaguccccaaaccccacagagucacaucugcagcucugggaaugaagucaaaacacuccuggcuucacaggcugagcuuguggcccacaggauagaagaguggaaggaguagagaggcagacaggaagggacauagaggaaagggagucucagccccagacuaagucagcucagggagagggcagaagggccucaggaugggagcccucacccugucugggcugcaguggccaaggcagguugggacaccacuuccuggagccuguccuggcccuggcccuggcccuggccuuggcccugccucugugggaggaggaggaagugcaucauccugggugggaggagaaucaccuggcuguugguacagcucugugcacagccaggaccacugaccaucaucccauagcccucggacccuccucuucucccuccuugccccuucagggugcuucucacggugcacaagcauguauguguuauccauggcggggccuggcggucagugagcaggucacuucaagggagcccuggggcuggcagaugcugggcccgggccagcacugguugugggagggaaggagcuaggugugauaccucacaggcuaccuuucucuggaaaagcaguggggcccuggaaaggcccaggcuuccguccauuuauucaacaaauguuugucaagccccagguaugugccaggcacucuuccaggaucuggggauauggcagagaacaaaaccaagucccugcccucugaagcugacaauccauuaaaggagauagagaauaaauaaguuuaaaaauaaaauucaauuaaaaagguacuuucugaaagugaugaguguuauaaagccagagaagcagagcuauggaagcaguggggucugcucuagacaaagugcucagagcagaagauaugugagggaagcuugagggaggaggacgacugcggugggaugaaaaaaggggagggaacagcacugacggaugaucggaugcugggaugggaccagggacagggcaaaggccaguauagccagggccacaguggaggggagagguggucagggguaaaguccaagggggugggagccagcugggguggguugugcaggccaaguaaggagccuggaauuuauucuaauuacaguagccauagugcagcccuuagcguucuuccugccuucacccucccacagcgggcuuccugcggcuucccgcucagcugauguuuccuuggaguugcccuggaacagaugugaaaucacaaguggugcugaaagugggggaaggagggacagcccauggccuggauucaugacaguaccuaccuuggguuuggggccaggguauggcuccugagcagggaaaggaagcacagacacagcuuuguucugcguccugccacauggugugguugggccacugagaccacugacuuuauaguuaaagaaaucucccuugaguucuagcauucggcuaaugauugggucaaguggacagugcugccgugaguaucccucuccugaaauucuuuacggcaauuucagagaugggcuuggagagguuugccauuucaaaccaaaucccuucuccaucacucuuaagccaaaaaaaaaaaaaaaaaaggaacuuuuguuacauuaaaagaagugucccuuccuggcugaccugauucuucuuucuugcuguccucucugugaccuccaaccugcccaagcacccaucuccccaagccugaguggcauggcaccccgugggugaggagguggccgcuagcacaggcagauggcugagaggaaugugagggugagaagcagcuaucuacaauucuugacagaauccuuucuuuucuucuuuccuuccucccucccuccuuuucucuuucaagcaucuacaaucuggcaaacccuuggcccaaagacucaccaggugggacguggcaggcaggccucaguugaggacgugauguuuucucacagcagcugccugggugaagcaucugcuggacaagucggaccacuggccaggggaccuuugauugucuuuccagagaugcugcucucugcagggcaccaccuucaaggcacagcccuuguugggagggagaacccucuccagaaacccugccaccauggugucuugccguacuucccacagccgccuuuuugcggccuggccggccaggcuucccgugcguuauacacagaguuugggcacacacugcccucccuccgagaugccagaaguuuuuccacagccuuggagaggggcuuugacugagggcugggggcccugggcuccguuuccuucacauuccagcuggcccggaucccucuguggcacagggcccugcccgucacaugcccucugggugacaucggagcagaccuccauguggccagggguugggagaacuuuacaaacauuaggaccuaacacugucucaucgcugaaauaagaggccauagcaccgaaaagcagcgugggcgccggcugaggcuucucccagcccguggguggcagcgugcuagcacacugccaccaucucaaagccaucccccuagccaucgugagcaucccagcggcaccgccauugucucaaccagccggcuccucgucuguacaccuggggauuucuuuugauuucaagaacagccuuaaucauuccaguuugauuuacguguauaccucauaaacauuuuucuuuuguuucucucucccccuuucucucuucucuuggcucacucccuugccucucccccuccaccaccaccuugugacugaugguuugguuuccucucugcucugccccugcucagcacagggagaauguugacuuagaagcaauagggggcagcaggccaccaagagcacaaccccagggcgaggucuggggaggccucccagcccgccucuguuuacugugcaauuccagucguucuuaagccaucaccaguggguguacucagagcagaggggccaggacuucugccagccaagggaaaggcccagagcccugugcgggggaauguggcacugucuauccauccgguggacugggcagcauuccuccccagggcucuucccuugggggccuccuuucaucuggggcacagccacaagucucaucucuaacguucuaugcaaugaaauauaaacccucaaugacaacuguuaauauuuaauaaauuccauguuauguauaaggaguuaauugcaaacaugcaauugagaaacuggauagauacacucauaaaacccccaccccuccccaccccaccccugcucccauugugugugugaaauucucagucuguggcauguuugaccuguggcaggacucgcugcugccaggugagucaccgccuguccugcaguggagcaugcacagcucgcagccucuuugcacgauuucauccauuuuaaaugcuugacccucuugcuuggaguucuuuuugccucagaaccucuccuucaggagcacuucuagcugacuucugcacaagcuagugaggaccugccagaauuguugccugagcgugccaggcugcagggcaggcaguaaaaggcccccacauacccugcaguuuucucuguccaggacagcagguaaaaaggaauccccagagcagacgcaaugguaggagccugcacaggauguguguguauggacauucugaagguuugcuguaggauaucugucugucugucauuuucccuuccuaccccaacccugagccagaggcaucugacagcccuuucccagagggcaccacgcaagggcagagcugggcggcauccacagccagagaggcagaggcaagagcagagccaggcugugcccgagggaccccagcucuugacugcaccuguuucaugccucuccucuguggcuaggaggcucaaaggacugugagccaggagaucugggcuggagcuagggggucaauggaugcucaggaagagcugggccuuuggcacuuguggugagaacaguugacaguggucaucuggaacuguucauauaaacaguggcuucaagcuaaguuucuugugaaguuucucaauagcaaaucuuacagaagguccugugugacccucucugcaucuguccccaggaccuaugcucccugcucacccccuucuccaaagcccaagcgucccgcugcucaucagcuuuuuuaccauugagccaggagugcggcaggcaguaccugccugacccuucaaggccugaccuucguccagagugcucugguuugcaccaugcauuucucagggguccgcauuucucaugcuuuucuauaagaucuacacaccccuucagagagggcuccucgcucaccucugguagcuauggaugggacaggaagcugccaaccuuuguguuggacuuaacacccuugccuuucugggacuuggccucaccccacccauggaauaccugccucaucccaaagaucagguaugggcugaaugcagccaucugagcaagggcugagggaagccaucaccuaacaccucuggccacccaggaccaggucuguguggggaugugccuuggagaccaaggcaauaguccuuuccacuacaggccaggggaugggacaagaaguagggaacaggcagggaaauguuaggaggucagccuccagcaggccuagucucaggcucuaaaguacugacuuuucagcaaauuuccuuucuggccaagcccucugaguuugaaauucugacaucugccacuccucaucccccacuguacccacaggauacaucaucgccccucugugaagguggcuggagcaggccucugguccauggacuguccuuccuggcccuugcauggaugcaguugugacucuggggacaaugcagccagaagcugagggaccagcacuuggugccuuggaaaguagagagcaacagacacaucuccaaaugggcaaggagucucuagcaugcagcccaggccuucuccauaccccucuccccagcaucaugagcaagggcauugccuccucucucugcucacuucagggcccagugcacucacuucacagugacagcccuccccuacaauccuugggcagagcauguggucugagggcccacagugaaagaacagcagugguggcaacuaugccuugccuucuggagccuguagggaguuuuccaggcagguccuuugccaggacagcaugguccugcccuguugucccgucugcucuccucuuacccacccccaugcuguaaauacuugucaucauggacuccaacaggguuagagggacaggccuaaucaacugaaacuccucggagaugccaucucugucucccugggugccagcagcccugcugccaugugcacugggguggcacuggagagccauggcagucgugagauauuguauguguaugcacaugaucauguguguaugugcgugcgugcgugcguguguguguguguguguguuucugccucauucaguuucuggggucaaaucagcuccuucucuccaagugcacuacccuggagagugguggccacucaauaccuuuuccucuagcuuucaugucuuguuuuugcuuuccccuuccuccucccucucucccuuucuuuccuucucuccuucuuuauuugaggggggaagagugcuguacaaagucaaacaaacaaguuuacaguuguaagugcaaugacccgaguccuccacaugaccuugugaauugugugcuguccuucugugcucugugagaacucgugguacuucagugucccucccccuguauugugacaagguaauucugugguaucagaauaaaaggacuugauauaaacaaccua

SEQ ID NO: 192095 - RNA, 65484 nt, Homo sapiens
aggcagaagccggcggcgcgcggacagccagucggcgccgcgcggagcuggccgcuggauuggcugcaacacucgcgugucaggcgguugcuaggcuccggccgcgcgccccgcccuugcgcucagcgcccucucaccgcccgguacgugcucgcgcgaaggcugcggcgcggcgcucgcgccucuuaggcuuggcgguggcggcggcggcagcuucgcgccgaauccccggggagcggcgguggcggcguccuggggccaggaggagcgaacaccugccgcgguccucccgccggcgcugggugagugcaccgcccgcccuauccgcugugccuggcugcuugggcccccaucccugcugccggcugagccuuccgcggaacaccugcugcugcucgcuguucggcccggggcggggacacggccgcggacguccuugugggugaggaggcggugccgcccgggcggagccgccccuuugcucugggucccgcaggcaaaggcucggagcguucggcugcaaggcccgggccgcgcgccgcggcgaugggccaggccuuagcucggcccgcgcucccgggaacguggagccugcgccuuggccgcggucgugagccgccugcgggccgccucccuggcuuccaauagggguuguggcccaguugggccggauuccgacuguggggagucgagccccgcuagaggcagggaagggcaccgcugccgccacugcucugucagagcugcucagagccuugguggguuccgucauccuuacuugagcuccuuuggaagcuuguuuacuuacuaccuuuucacuuuguauuuggcagaccugguucaccugcgaguguauuuggauagugucuccacagaaaaugucgucucggcuuggaaucuuuuugccauaaauucuaaguuaguuuccuacaaacucaacugguaacuuaaaaugcauccuuuaaucucuauaacuugaaaaguucuuauuuuuguaaaucgaguugcuucagaauuaguuuuaauggugacgaugaaguuuugacugguugaggcaagagccugggacagcaccuucauagcgcagagucuaacuuaagauucuagccugcugcuucccuaaauaagcgaguagaagugacuccuggcauagaagccagacuccgugaagggaaggugguguuuauaggacauaauuccagauaaagagcuggaugugcuuucagguguuuugcaaagucugguguagaugggguauugcaguuuuaucagguucuaugcuuaguuaaguucagagacauuauuuuggaauguuccuguucuaaaaaagaauucaaccguacuacauuuuggaggcauaaaaauccauaguuugaguauggagaaguuuaguugaacuuuuguggguuuuuuuugcugugaacuaaggaagaagagcucauggccuguguccuguauuuuggagaaaucagauuucaguagggaguuggauccaucaugugaagacccuaugggauauaaaagcuugugcugacaugugcuuuuguuaaaagaggcacagugcaaauccucacuguucuuaaaaauugauuuugcaaaaugcauuuauucauuugaacaaauauuuugauucacuaccugccaaauucugugguagauccuagggacccauguaaaagagucugcuucugcccuuaaggaauucaguuuagggggcaguggggaccagggaacccaugauuaauagugucugcccgcuaagcgugcucacauaguagccugaggagagagggaauuccugagcugugguuuucagggccagcaggaauuagugggggacaucaaggccuggacacagggaaccacauguacaugagcaccuaaaauagugcuugggaguccuccagcuuggcaggugcgagcucugggccugccuugugcucaggaguuccaacuuuguaugcggggugcaggagucuggggagccuuuuaaucaguagaguggugugacccagaccuguguuuagaaagauauugcugguggaguggcaggaagagggagggggucaggaccucuggcaguuaagucagcuaacagaggagagguggggagggagaaggagccaucagaaaagagagacugaaaagguaguacagaggggauguccugccaugaugggggaggagcuacauucuggaaugcaugggccagaagaccaagcauaaccaaggauuuaaauuccuuguugacuaccugguauagugaccuacagaguugcuugugucugguuaguguugaggauggugggauuuggagggaccacuuagggaccacuuagacugccgucgaugcauaggaaaggaggccuggcauuugauuauuaaaaacuuuaucgccgggcaugguggcucccaccuguaaucccagcaguuugggaggccgaggcgggcggaucacgaggucaggagaucgagaucauccuggcuaacacggugaaacccccucucuacuaaaaauacaaaaaauuagccgggcgugguggugggcaccuguagucccagcuacucaggaggcugaggcaggagaauggcgugaacccgggaggcggagcuugcagugaguugagauagagccacugcacuccagccugggccacagaucgagacuccgucucaaaaacaaaacaaaaaacaacuuuaucuccaggcagggcgugguggcucacgccuguaaucccagcacuuugggauucugaggcagguggauuaccugaggucaggaguucaggaccagccuggccgacauggugaaaccccgucucuacuaaaaaauacaaaaauuagccaggcaugguggcgggcgccuuuaaucgcagcuacucgggaggcugagacaggagaaucgcuugaacccgggaggcggagguugcagugagcugaaagccugggugacaagagcaaaacucggucucaaaaaaaauaaaaaauaaaacaaaacaacuggccaggcgcgguggcucacgcccguaaucccagcacuuugggaggcugaggcggguggaucacgaggucaggagaucaagaccauccuggcuaacacggugaaacccugucucuacuaaaaauacaaaaaauuagccaggugggguggcgggcgccuguagucccagcuacucauucuccuggaggcugaggcaggagaauggcgugaacccgggaggcggagcuugcagugagcugagauagcgccacugcaguccggccugggcgacagagcgagacuccgucucaaaacaaaaaaaaaacacaaaaaaaacacaaaacuuuaucuccuacuugaaccugggguacugcauuuccucuugcgcacagcaggcaucuuaacccgugagagacaauguguguucauccuuguggaggcaguugagagcauauuucauuucuuuucuuccuuuuuuuuuuuugagacggagucuugcucugucacaucaccuaggcuggaauaaaguggcgugaucuuggcucacugcaaccuccgccucccagguucaagcaauucuccugccucagccucccgaguagcugggaucacaggcacuugccaccacgccaggcuaauuuuuugcauuuuuaguagagaugggguuucaccauguuggccagccuaaucuugaacucuugaucucaggugauccgcccgcgucagccucccaaaguguugagauuacaggcgugagccacugcgccuggccuuuuuuuuuuuuucuucugagacagagucucacucuguuauccaggcuggagugcaguggugggaucuuggcucacugcagccucgaccagccucccuggcucaagcaauccucccaccucagcauccugaguagcuaggaccacaggcgcacgccaucacuccuggcuaauauauguauauauuuuuugagaccgagucuugcucuguugccgaagcuggagugcagugguaugaucucggcucacugcaaccuccgccuccuggguucaagugauucuccugucuugcccucccgaguagcugggacuacaggcgcaugccaccacacccggcugauuuuuuuuauuuuuagucgagaugggguuucaccauguuagccaggguggucuccaucuccugaccuuguggucugcccgccucggccucccaaagugcugggauuacaggcgugagccaccgcacccggcuaauuuuuuuugagguggaguuucgcuccuuugcccaguguggagugaaguggugcgaucuuggcucacugcaaccucugccccuuggguucaagugauucuccugccucagccucccaaguggcugggauuacaggcaugcaccaccacaccuggcuaauuuuuguauuuuuaguagagaugggguuuugccauguugcccaggcugaucucgaacuccugaccucaggugauccacucuccuuggccucccaaaaugcuaggauuacaggcacgagccacugcgcaccgcccugauuuuuguauuuuuuguagaggugggguuucuccauguuucccaggcuggucucgaacuuuugagcucaagcaaucugccuuccucagccuccgaaagugcugggauuacaagccugagccaccaugccuggccuuuuuuuuaaaauuaauuaauuaauuaguuuuuuuuuuuuuuugagacggagucucgcucugucacccaggcugcauggagugcaguggcaugaucucgccucacugcaagcuccgccucccagguucaugccauucuccugucucagccucccgaguagcugggacuacaggcgcccgccaccgcgcccagcuaauuuuuuuguauuuuuaguagagacgggguuucacuguguuaaccaggauggucucgaucuacugaccucuugaucugccugccucggccucccgaagugcugggauuacagacgugagccaccgugcccgguuuuuuuuuuuuaagauggaguuucgcuuuuguuacccagauucgagugcaauggugcgauauugguucacugcaaccuccaccuccuggguucaagugauucuccugccucagccucccgaguagcugggauuacaggcaugcgucagcaugccuggcuaauuuuguauuuuuaguagagacagguuuucuccauguuggucaggcugguaucaaacucccgaccucaagugauccgccugcuucggccuuccaaagugcugggauuacaggcgugagccaccucaccuggccagcuuuuuuuuuuuuuuuuuugagauggagucucacucuguugcccaggcuggagugcauggcgcgaucuuggcuccugcaaccuccaccuccuggguucaugugauucuccugcuucagccucccaaguagcugggauuacagguaugagccaccgugcccagccagcaauuucuauaaauaggaauuuagaguagcuuacaaaauuacaccagccagaagacuuaauuuagccuuaaggaauaggguucucuguuuuccaauuucuuagguuugauagcuaagcauuuucuuuuucuuuuuuuuuuuuuugagacggagucugcucugucacccaggcuggaguguggagugcaguggugcgauccuggcucacuguaagcuccgccuccuggguucaugacauucuccugccucggccucccgaguagcugggacuacaggugcccgccaccacaccuggcuaauauauguauauauauauuuuuuguauuuuuaguagagacgggguuucacuguguuaggauggucuugaucuccugaccucaugaucugcccaccuuggccucccaaggugcugggauuacaggcaugagccacugcacccggccauagcuaagcauuuucuuaguuuuacucaggguccaggguagaaagauggaugagaugcauuaguagaagaucauaaacugagggugucaaaguuggugaagcuggucuguguucuguguugaagugguuaaaucugaacgaacuuuagcaguauguugacuuaauuuauauuuauguuuuaaaagcaggauucuacuggaacaaucagcugcauauuuaaaaaauuacuuuuaugaccaaaugucuuuuaucuugcuugucaugagauacauuuaaugguguugagguuuugggcugggcgcaguggcucacaccuguaaucccaguacuuugggaggccgagccguguggaucaccugagcucaggaguucgagaccagcccguccaacauggugaaaccccuucuuuacuaaaaaauacaaaaauuagcugggcgugguggcgcacaccuguaauccaagcugcuugguaggcugaggcaggaaaauugccugaaccugggagguggagguugcagugagccaaguuugagguuuugcaguguugagguuuuucuucucaguuauaccuuuuugagcuaaucguuuuaaaaaauaccacugucuaaaauacacugaaauuaauuuuacuauuuauaauuuuugguucuggauugacuguacagaaaauguuucauuuucuuacugugaccuuugacaaagaagggugaguaauuuguggugugggcaggagacucaguggcauuccccacuuccucuggaguuggucagugugguauaauucuauuucaguugugggcauucaccaauauuguuuccuccuuuuccugcagggccacugcucuccaggaagauaaggcuuuuaaagcagccuagcacuagaaggugagguaagguacuugaaaagagacauuucugcaaaagaaaguugaggaauaaucacauacuggccaaaaugauaaccacagaauuauauuuauuuauuuuuauuuauuuuuuugagacaaagucuugcucugucacccaggcuggagugcaauggugugaucuuggcucacugcaaccuuugccucccggguucaagcaauucuccugccucagccucccaaguagcugggauuacaggcaugugcccccgcgcccagcuaauuuuguauuuuuaguagagacgggguuucuccauguuggucgggcuggucucgaacucccgacgucaggugaucugcccgccucggccucccaaagugcugggauuacaggggugagccaccgcugcccagcuuauucguuuuugagacaggaucucugucugucacccaugcuggagugcaguggcaugauuacagcucacugcagaccuugaccuccuaggcucaagccauccucccaccuuggccucccauguagcugggacuacaggggcaugucaccaugcccggcuaauuuuuguaacuuuuuguggagaugggaacucacuauguugucugggcugaucucaaaccccugggcucaaacgauccucccgccucagccucucaaagugcugugauuaauagacaugagccuccgcaccugacuuagaauuuuaaaacauuaauaguggaggaaaagcucuauuggauaauacauacauuuaaguaguguggaagauaaaaguggaaagaggcugggugcgguggcucacaccuauaaucccagcacuuugggaggccgaugugcacagaucaacugaggucaggagucugagaccagccuggccaacauggcgaaacccugucucugauaaaaauacaaaaauuagcugggcgugguggcaggugccuguaaucccagcuacuugggaggcugagaaaagagaaucacuugaacaugggagguggagguugcagugagcugagauccugccaucacacuccagccugggcaacaagagugaaacugcaucucaaaaaaaaaguggaaagaaaaggacugggcgugguggcucacaccuguaaucccagcacuuugggaggccgaggcggguacaucauuuuaggucaggaguccaagaccagccuggucgacaugguaaaacccugucucuaguaaaaauacaaaaauuagccaggcgugguggugugcgccuguaaucccagcuaccugggaggcugaggcaggagaauuguuugaaucuugaaucugggaggcagagguugcagugagccgagaucgugcuguugcacuccauccugggcgauggagugagacucugucucaaaaaaaaaaaaaaaagaaaaaaaaguggaaagaaaagagaaaaggagcccgaucucaugccuguaaucccagcauuuugggaggcuaaggugggaggauuacuugaagccaggaguuugagaccagcuugggcaacaaagagagacccugucucuacaaaaaauaaaaaaaaaaaaaaaaauuaguugagugugguggcacguucccuagguacucgggaagcugaggugggggcaucuuuugagcccaagaguuuuuuuuuuuuuuuuuuuuuuuuaaauuuuuuguagagaggguuuugccauguugcccacgcuggccuugaacugcugagcuuaagcgauucaucugccugagccucacaaacugcuggauuacagaugugagccacugggccuuagccuaggaguugaggcugcagugagcuuucaucacagcaaaucacaccacugcacuccagacugggugacaaagugagacccuggcucaaaaaauaaaaaaaugaaaagucucuugucguccccucccuuuuuuuuuuuuuuuuuuuuuuuuuuuuggauacagaaucuugcacuguugccugggcuggagugcaauggcguaaucucggcucauugcaaccucugccucccggguucaagcgauucuccugccucagccucuugaguagcugggauuacaggugcccaccaucacgccgagcuaaguuuuuguauuuucaguagagacgagguuuuacuauguuagccaggcuggucuccugaccuugugauccucccaccucagccucccaaagugcugggauuacaggcgugaggcaucccauuuuauuuuuucuguaaauagggaauacaacacaugguacuaacuugauuaaaaguucaaaaggguuauacaaaggagggaaagaaaccuuccuuccaucuauccccucagccuguuguucaccuuuccagagacaguugugauccccccugauuccuggggucuccuccagagauggcccuuggcaguguucuuaccaaguuugaguauagauuuuuuuuuuuuuuugagacagagucucucucuguugcccaggcuggagugcaguggcucgaucucugcucacugcaaccuccaccuccuggauucaagugauucuccuaucucagccuccugaguagcugagacgacaagugcgugccaccacacccagcuaauuuuuauauauucaguagagacuggguuucaccauguuggccaagcuggucucgaacugaacucaggugaucccguccgucuugaucucccaaagugcugggauuacaggcgugggauucaggccccugcgccggccugaauauaacauuucuuuuuuuuuuuuuuuuuuuuuuuuuuugagaccgagucucccucugucaccugggcuggagugcaguggcucgaucucugcucacugcaaccuccgccuccuggguucaauugauucuccugccucagcauccugaguagcuggcauuacaggcgcgcaccaccacacccggcuaauuuuuuuuuguauuuuuaguagagacgggguuucaguguguuggucaggcuggucucgaacuccugaccucgugauccaccugccucggccccccagagugcugggauuacaggcgugagcccccgcgccagccugaauauaacauucuuuuuuuuuuuuuuugagacugagucucgcucugucacccaggcuggagugcaguggcucgaucucugcucacugcaaccucugccucccggguucaaucgauucucccgccucagcauccugaguagcugggauuacaggugcgcaccaccacacccggcuauuuuuuuuuuuuuuuuuuaguagaggcuggguuucaguauguuggucaggcuggucucgaacuccugaccucguaauccaccugccuuggccccccaaagugcugggauuacaggcgugagccacugugccuggucaugaauauaacauuucuuuuuuuuuuuuuuuuuuuugggagacggacggagucucgcucuaucgcccaggcuggagugcaguggcgcgaucucggcucacugcaaguuccgucuccuggguucacaccauucuccugccucagccucccgaguagcugggacuacaggugccugccaccacgcccggcuaauuuuuuguauuuuuuuaguagagacgggguuucacuguguuagccaggagaccuguuagccagaaaggucucgaucuccugaccucgugauccgcccgccuuggccucccaaagagcugggauuacaggcgugagccacugcguccggcgcauauaacauuucuaaugguuaaucugucccuaauucuuagacaguuugguucuuuuuuuuuguuuuucuucuuauuauuuguuuuagcuauuuccuacaggaaggagguuauuucuuacuuugguuguaauagauaauguugcaauuaacaucucugcauaaaguuuuuuuuuuuuuuuuuuuuuugagacggagucucgcucugucacccaggcuggagugcaguggcacgaucucggcucacugcaagcuccgccucccggguucacgccauucuucugccucagccucccgaguagcugggacuacaguugccuguagccacaccuggauaauuuuuuguauuuuuaguagagaggggguuucacccuguuagccaggacggucucgaucuccugaccucgugauccgcccgcuucggccucccaaagugcugggauuacaggcgugagccaccacgcccggccugcauaaaguuuuuuaaaaguuuuuuguaucauaagaagugaauuguggccgggcgcaguggcuuacgccuguaaucccagcacuuugggaggcugaggcgggcggaucacaaggucaggagauggagaccguccuggcuaacauggugaaaccccgucucuacuaaaaauacaaaaaaaaaaaaaauuagccgggcguaguguuaggcgccuguagucccagcuacucuggaggccgaggcaggagaauggcgugaaccuggaaggcagagcuugcagugagcugagauagugccauugcacuccagccugggcgacagagugagacucugccucaaaaaaaaaaaaaaaaaaaagugaauugugauuuacaguuuuguagaagcacauuuaucaaugucaaguaaggcagauuuguacugauuuuuauuuuuaaguauugugcacguuuucuguagucccuuuucugugacuugcauggauuugugauuuuuauagccauguggagaccuagucucaguguucccugcccuuggggacaugaggagccacagauucauucuugcugaggcagucauggcccuuggauacccuaaguauaggggagugugccaguuguggggagcucaaggaugaaugaagcacuuggaaggauaugucguauucagggaaacaguagccagugcccagcuugauucccuguuuuggcauuuacucuucauuucuauagauguuguuuuuguauaugagguaugagaaucuacaaacaagcaccucuuauagaguucuuucuccuaaucgguacacaguuuucuguaucuauagguuccacaucuguggauuccuccaacuauggauugaaaauauuugggaaaaaaggaugguugcguccguaugaaacaugaauaaacuuuuaucaucgucaucauuuccuaaauguuagaacaacuauuuucauaccauuuacauuguauuauguguuauaaguaauccagggauguuuaaaguauacaggaagauguuuaagggauccagggcugugcaggacgugccuuguuaacaaaauguuuacaagcaguauacuugguaaaagucaucgcuauucucuagucucaauaaacuggggacacagugcauugcggaaaaccacagggaccucugcucuugaaagcgggguauuguccaagguuucuccccaugugauagucugaaauauagccucguggaaugagaaagaccugaccuucccccagcccgacaccuguaaagggucuaugcugagguggauuaguaaaagaggaaagccgcuugcaguugagauagaggaaggccacugucuccugccugcccuugggaacugaaugucuccguguaaaaccugauuguacauuuguucaauucugagauaggagaaaaacugcccuauggggggaggcgagacauguuugcagcaaugcugccuuguuauucuuuacuccacugagauguuuggguggagagaaacauaaaucuggcuuauguguacguccauccagucacaguaccuucccuuaaacuuaauuaugacguagauucuauugcuuacauguuuuuguccuuauuaugaugcaaauauuacaccauuuuauauaagggacuugagcacuuguggauuuugauauccuggaaccaaucccucauggauaccgagggaagaguuuguaaauguauuaaaacaaaguaguggaauuggaaucaaauucuuuugauuuuguagguaucuguguuuagccuuuucacugugcugugaagauuucccccccaggcauccuagggguugaugggagauuuacuuaagauucccaaggcugucuagggcagaagugaaccaguucugccuugguugucauaaacaccucuguuaauuagcucaguuguucuccagggauagauugauucucuagcuagcuuuugccaagaaaaaugauccagucaauaauggaauuccaaauaagauuuccuuuuuauuuggcuauuaaucagaaccugggauaacauccauuuucugggcccugauuuuacuauggaauauuuccauaaaacaugcaugugauuacuguaaauguccuguaaacacuccugcuugggcugguaggucaucuuuuuuuuuuuuuuuuucuuuugagacaguuuuagucuuguugcccaggcuggagugcaguggcgugaucucagcucacugcaaccucugccucccagauucaagugauucuccugccacagccucccaaguagcuggaaugauacaccaugcgccaccacaccuggcuaauuuuuguauuuuuaguagagauggggauucuucauguuggucaggcuggucucaaacugcgaccucagaugaucugccugccucggccuucuaaagugcugggauuacaggcgugagccaccaugccuggacuguaggucaccucuguguccaaucugccagaggucagggauacguugccgucuaggauuuuuuauauuggagaccagucugaugaguagcccuugagcagggacuggauucuaagucuuggagaaaaugaguaaguucuaccucuuaugugagguaugauugaagaaauuguguuuucuuuguuuuuugagaggcagggucuugcccuguugccuaccuggagugugguggcauaaucauagcucacuucagucuugaccuccuagggucaagcaauccucccaccucagccuccugaguagcugggacuacuagcacgugccacuaugcccagcuaauuuuuaaauuuuuuuguagcgauguggucuuggcuauguugcccaggcuggauccuccugccucagccucccaaaguguugggauuacaggcgugagccaccacacccggcccagaagugucuuauauuuuuagacuuuugagcaguguuggaacgauugaauugccugaguggagaaauuugguaggaagagaguagaagagaggcucuuuauuaaagaccuaaaaauagaauucauuaaagucacaaauagauaacaguaggauuccugucugacucucuucugcuuuggguuugugcuaccagcuguugcguuugcuuaccuagaaaauagaauaauauuuugucagaagggucaacaguaugguccuaaaacauuguguuugcaagucugaggaugugcuuuuuccaauuuuaaaaguaguuagaaagugaccagauucuuucauguaggggagaaaucuuagcaggagacguugguucuucugcuuguagugccagcccuaaccugacagguccuguggggaccccugucucuucagagcccugagccuuuuucccuucuaguuggacuuugcugacuagagagggauauccuauguaggccaccugauuaccugauuuaaucagaugguaccucuguuauuuuggagaagagagucuccuuuugauucuaauagcugaagauaaaaauggcuccguaugcuuucuuccuguggagggcucugcugcccugagcugccugugcccuuuacaucugugugaggggguggaggaauguccuggccuccucacuuccauccugcuaugggcuuccaggaagaaugggguccauugugggcuguacccaaaggcacaguccucugccucagugucaggcuuacuguggucucugugcccaguuugcuguggucacugggugccaagggguugggagcucaggaagccauugcugcuuuuuuuuuuuuuuuugagacggagucuugcucuugucacccagccuggagugcaauggcacgaucucugcucacugcaaccuccgccucccagguucaagcaauucuccugccucagccucccgaguagcugggauuacagaugcgcgccaccacauugggcuaauuuuuguauuuuuauuguuauuauuuuauuuuauuuuauuugagacggagucucgcucugucgcccaggcuggagugcaguagcuuaaucucggcucacugcaagcuccgccucccggguucaugccauucuccugccucagccuccggaguagcugggacuacaggcaucugccaccacgccuggcuaauuuuuuuguauuuuuaguagagaugggguuucaccguggucuugaucuccugaccucgugaucugcccgccucaggcucccaaagugcugggauuacaggcgugagccaccgcacccggccaaggacggaguguuguucugucgcccaggcuggagugcaguggugcgaucuuggcucacugcaaccuuuuggagacaaaaggccuuuguugugucuggccuuuaucuuuguuguaaugacccugaaaccguggccugagucuuugagguggaaguugcccuagaaaugucauguaauauaccagaauuuaucaagccuuucucuaguacugggacacuuaacaugugccugugguacuuuuguuuguuuugcuauuauuucacauuuaauuucauuuuuguaaauaaauaauuuugaagccaaauucagauuuuucaucuuuaugucuacuuagguugcuuagaccuaaugugguagaucagguuuuguuuuuguuuucuuucuuuuuuuuuuuuuuuuuuuuuugagacaaggucucacucugucacccaagcuagagugcaguggcaugaucauggcucacugcagucugaauuccugggcuuaagcaauccuccugccucagccuucugcaaagcuggaacuacaggcaugugccaccaugccagccuauuuuuuuuuccuuuuguagauacauggucuuguuauguugcccaggcuagucucaaacuccuagccucaggugauccucucaucucaaccuuccaaaguggugggauuacaggugugaaccaccaugcccagccuguuuucuuguuuugaauccaagcuuucugaggguuguccuuuaggaggagaauguaaggaauuccagagucagggaggcaugggcugugcucugggagaggccuggggaggcacugcucuggaacugccuguaggaguggugucagacugccagcagaagccaggguggugaggggagggcugaauguucugcaagagagauuuauaccacuauuuucuuuuucuuuuauuuauuuauuuauuuauuuauuuauuuauuuauuuauuuauuuuuugagacggagucuugcucugucgcccagacuggagugcagugguacuaucucggcucacugcaagcuccgccucccagguucacgccauucuccugccucagccucccugguagcugggacuauaggcgcaugccaccacgcccggcuaauuuuuuguauuuuuaguagagacaggguuucaccguguuagccaggauggucucgaucuccugaccuugugauccuccugccucaguauccugaagugcugggauuacaggcgugagccaccgcgcccggcccuuuuucuuuuuuuugagacagagucucacucuggaguguaguggcaugaucucggcucacugcaagcuccaccucguggguucaagugauucuccuaacucagccucccaaguagcugggauuacaggugugcaucaccacgccuggcuaauuuuuauauuuuuaguagagacaggguuucacccuguuggccaggcuggucucgaacuccugaccucgggugaucugcccaccucagccucccaaaguguugggauuacaggcgugagacacugcgcucagccugauaugaauauucuugacggugucuucuggguauauaccuaagagugaacuguuagauauauaguauuugauuuuuuuuguuuguuuuguuuugcuuuguuuuugagauucagucucgcucuguugcccaggcuggagugcaguggugugaucuuggcucacuggauccucugccucccagguugaagugauuuuccugucucagccuaaccaguagcugggauuacaggcgugugccaugccuggcuaauuuuuguauuuuuaguaguaaugggguuucucuguguugcccagacugaucucgaacuccuggauugcucaagcaauccaccugccuuggccucccaaagugcugggauuacagguaugagccaccgugcccggccugauguuuuaauuauugagaauuuuguauuuuuuguagagaugggguucuuccucuuugccuaggcacacgacugucuaucccagauggcugcacuggccuaggacagacgguucuucccccaguacgucaagacccuggagggugcaagcuacagaacagcugggcuccugcauuccucccagacccugucuucaguaggacaacaggcaacaaacuuaaauuugguaauaugaauuuagaaaauguuaauguuuuccagaacagugaaacuacaauauaaagguuagacuugagaaccaaaguuacucucuagcuucccucuucugcccuucaugugcucagcacuuguaucuguguucucacuaccccugagcccugaguucuucugggguuggcccaggaggugccuugguucagagagauaccugggaggaaaccacauggaaucaacaacaguacuacauauuuguuauuauuuggaguaauuagccccauacauucuuuuuuuuuuuuuuuuuuuuuguuugagaugggaucgugcucugucacccaggcuggagugcaguggcgugaucucggcucacugcaaccuccgccucccggguucaagcgauucuccugccucggccuccccauuagcugggacuacaacaggcucccgccaccauacacggcuaauuuuuuguguuuuucauagagacgggguuucaccauguuagccaggauggucucgaucuccugaccucgugaucugcccgccucggcuucccaaagugcugggaauucagacgugagccaccacgcccggccagccccauaaauucuugauagcaauuuuccugagguacucaaguuuuacuagaaaaacauagcaucauguuuugauucauuaguugucuagaugcucacccuccuguauuaucauucuggcuaacuauuaaguaccauuacucccagauugaauuuaugacaccugcugcccaccaugcccauuaaucaaacaauaagggcagggcaaacugcugucucauguuguuucaaacugccccaccuccuuccucuuccaucuuauguuauuaaugaaagaguuugacaauacuuaaauguuagugaaaauaagagaaaagucguuuguaucuuuaggugaggguguaaauugaaggacauuuugccaaaucuaacaauuccaauguacauauccuuugacccagcaauuccacaucuaggauuauauccuuagauauguucuaagaagaaugcaaggaugagugugagaacacccuggagagcaagauaugcaagauacuuagacauuuagaugugccacacacaauaggggugaaugagaagaaggaucuacccacuggggcugaggucucucaguucugcuaaauuagaaaaaggaacgguuauuuauuuauuuuuuuuugauagggauucucauucugucucccaugcuggagugcaguggcgcggucuuggcucacugaaaccuuugcuucccagggucaagcgauuccccugccucagcuuccugaguagcugggauuacaggugcgugccacuaugaccaucuaauuuuuuauauuuuuaauagagacgggguuucaccauguuggccaggcuggccuugaacuccugaccuuaugaucugcuugccaggugugagccacugcgcccggcaaaaaaggaacaguuuugaagaauuugauuucauuugaacuuuaagaaugaaauuaaaagagaugugcuuguuuauguguuuagagauauacauucaaugugucauuuguggagagcuacugaagaaacucagucugcucaccugaggaccugggaaggagaccugcuuuucauuuguguccuagugugguguuggaauuuauuuuaccuccaugugaauuaccuuuuuuuuuuuuuugagacacaguuuugcucuuguugcccaggcuggagugcaauggcgugaucuuggcucaccgcaaccucugccucccggauucaagcgauucugccucagccucccgaauagcugggauuacaggcaugugccaccacgccuggcuaauuuuguauuuucaguagaaaagggguuucuccauguuggucgggcuggucucgaacucccgaccucaggugaucugcccaccucugccuccaguagugcugggauuacaggugugagccaccgugccuggcccuugaauuacuuuuauugcauuaagucaaaggggaggaccagauaguugaugacaucauugugagauagacugggaaccaauaguagggaaucggauacugggaaacacuggaugcagcgugcccacauuuugcccuuagcucugggaccucuuaacuugguaaugaucugauuuggguuuuuuuuccucuaggagggaagguuccugggaagggaagauagaaucuauuuuuaaucuuaagaaaacauagcucaauguaguaauuuugggcccuagugugacauuuucuuccauuauaacccaagucacuuuuaaaacaaaauccuuuuuuuguauauuuuguguuuguaauguuucuagaggaaaaugcuuuuaaaguauccucacuucccuucguaaacuugggagggcuugggaccuggugggguauguguuuugaaucaugcugucugggggauuagugccuggaauccagauuccuacuggacaaagcgcugggguuugagguaaguggggugggguagggggaggguuauauagcugucacagauuacagagcuuaccugcugacugcuucacaauuguugguacauacaccugcuuuggcauggacguccugagagggggcuuggaccaugacccguguuccuuucucuuaccacuuguuuuuuuccauuuuggcugggcgcgguggcuuacgccuguaaucccagcacuuugggaggccgaggcagacggaucacgaggucaggagaucgagacuauccuggcuaacacggugaaaccccgucucuacuaaaaauagaaaaaauuacugaggugugguggcagguaccuguagucccagcuacuugggcggcugaggcaggagaaugauguggacccgggagguggagcuugcagugagccgagaucgcgccacugcccucuagccugggcgacagagugagacucugucucaaaaaaaaaaaaguuuuuuuuuuuuauauaacuuuaaauuuacagaaaaauugcaagaauaauucaagaaacucccaaauacuccaucuagagucaccauuuguuugcauuuugcuguguuugcucugucauucucuuuucuaucuauaccuuuuuuucugaaccaucuaugaguaauugacagaaaucaugccucuuuauuccuaauuuuuuuauucuuuuauuuuuuuuuuuugggacagggucuugcucugucaccuagguuggagugcagugaugagaucuuggcuuauugccaccuccgccucccaagcuugagcgaucuuccugccuuagccucccgaguagcugagacugcaggugcaggcuaccaugcuggccuaauuuuguauuuuuuuguagagaugggguuucaccauguugcccaggcuggucucaaacucaucagugcaagcuaucugcccuucucagccucccaaagugcugggauuacagacaugagccacaaccuggccuacuccuaaauucuuuuuuuuuuuuuuuuuuuuuuugagacggagucucacucuguugucuugguuggagugcaguggcacgaucuuggcucacugcaacuucugccucccagguucaagcgauuuuccugccacaaucucccugaguagcugggacuacaggcgcgcacuacuacgccuggcuaauuuuuguacuuuaguagagacagguuucgccauguuggccaggcuggucucgaacuccugacccaggugguccgccugccucagccuuccaaaguacaggcgugagccaccacgccuggcauuuuuuucuauuuuuaauagagauggggucccacuauguugccggggcuggucucaaacuccuggguuuaagugauccuccugccucagccucccgaaaugcugggauuacagguaugagccaccgcucccagccaaguuguuuuuuuuuuuuuugagacagagucucauucuuucgcccagguuggaaugcaguggcguguuuuuggcucacugcagccucugccuccugggucaagcaguucuccugccucagccucccaaguagcagggaucauaggcaccugccacuauguccugcuauuuuuuuuuucuuuuuuuugagacggagucuugcuauguugcccaggcuggagugcaguggcgcgaucuugcucacugcaagcucugccucccggguucacgccauucuccugccucagccucccaaguagcugggacugcaggcguccgccaacacgccuggcuaauuuuuuguauuuuuaguagagaugugguuucacuguguuagucaggauggucucgaucuccugaccucgugauccgcccgcgucggccucccaaagugcuaggauuacaggcgugagccaccgcgcccggccuguccugcuauuuuuguauuuuuaguagagacgggguuucgccacauuggccagucuggucucaaacuccugaccucaagugauccucccgccuuggccucccagaguacugggauuacaggcgugagcugccucgccuggccccaagucuauucuuuuuuuuuuuuuugagacggagucucacuuuguugcccaggcuggagugcaguggugagaucucggcucccugcgaccucugccucccggguucaagcaauucuucugccucagccuccugaauaacugggauuauaggcaugggccaccaagcccagcuaauuuuuguauuuuuaguagagacaggguuucaccauguuggucaggcuguucucgaacuccuggccuugugaucugccugccuuggccuccuaaagugcugggauuacaggcgugagccaccguaccccgccuggcuccaagucuauucuuaagaccacagaacuuuugauuuaagauucacuggacagauacauaacaauacauaaaauaaauguuuuauuuacaaaauaagaccuuuaaguaguuagcugccaguugaaauaaugauuuggacuggauguggugguuuaugccuguaaucccagcauuuuaggaggcugaggugggagaauugcuugagccuaggaauuugagaccagccugggcaacgugguaaggccccaucucuacaaaagauaaaaaauuagccaagugugguggugccauguuuguaaucccagcuauuugggaggcugagguaggaggaucaauugagccugggagggugaggcugcagugagccaucaucgugucauugcacuccagcccagguaacagagugagacccugcaucuuuaaaggaaaauuuaaaaagagauaaaugcaggagaucuuccaucuuaucaaaagggugcuguuauaauuuauauauuuuuaaguacuggauggggagguggaguagcagcuccaagguacuuuucagugguggccuuaaucugcugaugcauggaagguguguucuucuuccagauagcccugggaucuccugaauuuccagguugggcuacucaggcauggauugacuccuacaguucaggcggauggagaucccaccaacccacagcuuaauucuucagaugcuuuaucuucauuucucauguaucuucaguuggcuucuaaugugagcacauaaaugcccugcagaauuucuuucccaucuuugugcaaaucauuauuuuuauucuuuuuuuuuuuuuuuuuuuuuuugagacgacagggucuugcucagucacccaggcgggagugcaguggcaugaucauggcucacugcaaccucaaccucccaggcucaagcgauccucccaccucaguagcugaguagcucagauuauaggcaugcgucaccacacucagccaauuuuuucauauuuuguagagacagagucucccuguguugcccaggcugauuucaaacuccugggcucaagcaauccaucaaccuuagccuaccaaagugcuaggauuacaggcaugaaccacugugccuugccugcuuuucauuuuuaauccuuggguucuaaaaugcaagaauuaauuuccaaauaauuaguauggaauggaaucccacuuuuuccugugugcugagagaaugaucaaagaucacagaaaagagauggagacagaagaagcugagagcaagggcaucuuuaaggauuucuucagucuuguuaaucuggguguaaauucuguguggcugacagccucugaggaucccuugaaguuuugaggaggaggaaagcgcuugagaguaauggauuuacuugauuuuacuuuguauagaagagccugaacuggacauaucuccagguaugugcuguggucuuuaacaagcagcccaacauccuuugcuggggaaggccagcaaugugggagcuaguggggccuagcccaggagccuugcguucaccaggucacugggaacuggugcuuucugaugcaccucuaugcaagccugauucugaagucagauguggugggcaucccuguccauaguguuggccuggcccaccauuucacuggucauagaauggcuguagcuuugcagagcagggauugcgagaauggaagaaugucuuuuggcucuucugcucuagcuuuuggaaguacgucagagaaguuugugauuuuuuagaauuuguagcuguggcaaggcugaagcagguaaaagggccaauuagaaccaucugugggagggaaggaauucuguuagcaggaaggaaaaccugagcaaagggagugggugguaguuuugucuuguucuuuuauaaacacaguguguugauauggcaguuccuggcaugggugaaauauuuuugaugguugagcauuaagaauguagccaaaaacaagaauguggcuaaaagcaagucaccacuuuaaacacugaagauugaagcauuugccuagauaaauauucugcagugaauaugccagaauucccacauaccuguuuggcuccugaggcauugugcuuagggucccaggccuuuauuacaggggcugcuggcagggucaagggcuggguugccuggagcuucccugacauuucgccucacuccucuguuuuggagucuaauuggccaauuaggucagaaaggccaccagccagcacacuuuuucuaaauuuaauucaucauugcuagauuagcauauuaauuuugagcuauggcacuuauuuuuaaucuuucguaguguaauggaaaaaauaccagaaagcucagcauugaacuucaaagugugaaaucaagugaucauugccuuuaugcuuggugaauuauuauuauuauuuuuuuuuuuuuggagacagagucuugcacugucauccaggcuggagugcaguggcgugaucuuggcucacugcaaccuccgccucacagguucaaacgauucuccugccucagcuucccgaguagcugggacuacaggugccugccaccacgcccagcuaauuuuuguauuuuuaguagagacgggguuucaccauguuagccaggauggucucgaucucuugaccuugugauccacccgccucagccucccaaagugcugggauuacaggugugagccaccggcgcuuggcugcuuggggaauuauuuaggggauuuaguggaauuuccuuuccuguacucugugggcaucugcugaguaccugcuuggugccaggcaucuacugggagagaaagcagcagagucaaugcugucaagaccccugcaguggaccucuucucccccuuuucucucaagggaaccauuggcauccagccuugacccccaguagacacugaucauccagcccccacaggguagccccacuguaccuuuguacugaguuggugaggggaugggauagccagggggaguuuggggaagucagaaggcaacuuucaguuucuauuagaguaagcacuuggaaaaugucuguuuauaauguauuaguauaaauacuugguuuguuaccacuuguguuuccugauuuaguaauguauauaaaucuuaauugaauauuuuugugugaaacuuggaaagacugcaucuauagcaaauaaagccucacaccuagcacaggguagguaguugguaaacaugugcugaaguguuaauuguugggcugucuucagagaauuguaguuugcuuuaauugcauuuuuugaugcaacgcgggugcaagggugugguaauucauucccacuuggauucugcugaggcuggccacccaccucucagacuuauucccccaccaccucuccaccuccuacucuagcugcugcagccaaauggacaguuagggccgggcacaguggcucaugccuguaaucccagcacuuugggaggcugaggcgagcggaucacaaugucaggaguucgagaccagccuggccaauacggugaaacccugucuguacuacaaauacaaaaauuagcugggcgugguggcaggcaccuguaaccccagcuacucaggaggcugaggcaggagaauugcuugaacccggaaggcagaguuugcagugagccgagaucgugccacuugcacuccagccugggcgacagagcgagacuccgucucaaaaaaacaaaaacaaaaacaaaaaaacagaaaaaaaaaaaccccaaauggaugguuuggccugguccuuaucuuuggccucaguuuauccuuuucugucuucagugucuuaccugggcacuggugauuaaaguacuggaccaugucaucacggggauaugccccuaaaagccuccuaaaguauuuucuucugaagucuaauugguguaacuaaguaauguuuucuaaaauauuguggcaaaauauacauaacauaaagaugguguauuuauuuauuuauuuugcuuugucacccaggcuggagcacagugguggagucauggcucauggcagccucaaccucccaggcucaagcaguccucccaccucaggccaaguagcugggacuacagguccaugccuacguacuuggccaauuuuuuaaauuuuuaacuuuuuuuuuuuuuuuuuuuuuugagauggagucucacucugucgcccagacuggagugcaguggcgcgaucucggcucaccacaaccuccaccucccagguucaagcaauucugcugccuuagccuccugaguagcugggauuacaggcgugugccacugcgccuggcuaauuuuuuuuuguauuuuuaguagagacaggguuucaccauauuggccaggcuggucuugaacuccugaccuugugauccgccugccuuggccucccagagugcugggauuacaggcaugagccacugugcccggccuaaauuuuuuuuucuuuuuuuuuuuggcacaaucucggcucacugcaaccucuaccucccaaguucaagcaguucuccugugucagccuccugaguagcugggacuacaggcaugcaccacaacacccagcuaauuuuuguauuuuuaguagagaugggguuucaccauguuggccaggauggucuccaucucuugaucucgugauccacccaccucggccucccaaaguguugggauuauaggugugagccacuaugccuggccuaaauuuuuuuuuguagagaugggggucucacuauguuguccaggcuuauauuuuaauauaccaucuuaaccauuaaaaauguuuuuuuuaggggcuggcuguaguggcuugucccuauagucccagugcuagaggaggcugaggcaggaggauuguuugaaccaggaguuugagaccagccugggcaacauagugagacccugucucuacaaaauaaaaacuaaaaaauggccgagcaugaugguucacaccuauaaucccagcacuuugggaggccgagguggguagaucaccugagaucaggaguucaagaccagccuggcuaacauggugaaaucccaucccuacuaaaaauacaaaaauuagcuggacgucauagugggcaccuauaaucccagcuacuggagagguugaggcgagagaagcucuugaacccaggaggcggagguugcagugagccgagauugugcugaugcacuccagccugggugacagagcaagacuccgucucaaaaaaaaaaaaaaaaaaaauuaaaaaaugagccaggcauggugcugugaaccaguagucccaguugugggaggcugaggcagaaggaucacuugagcccaggaguuugagguuacagugagcuauuacuguaccacuguacuccacccugggggauagauugagagacugucucucaaaaaaaaaauaaaaauaaccccaaacccaccuuuuuaaauugugaaaaacacaauauaaaacuuaaccaucuucaaagucaaguauacuguucgguaauaaauaauguuuaacgcaguguauggacuucaguggaauguagaaggaauucuuucagugagccccauuacguaccauguuaaaaucuacucagauuaaaagccaugguucaguggagaaugacuguucuggguuuugaaccuugcuuuucuucccuuucccuagaacaugucugcaccuggguggauuuauaccuagguuuuaaaccuuugcuucugucuuuguuggaaaaaaccaaaccaccgccagcagaagccacugcccuuuguuuaucugugauaagugagaauuuguaagaauuuuccaagugagagaaguguucaaaguagcuuuuauguuugauagaauguguagugcuugccucucaggggugguauuuuuucucccacguauuuuuaccuuuaaaucucuugcuguauaugugacccuggcucccuuugguugguccuccagcucccugaugguccuggggcucccuccauaucacuggugguauuuccacauugccugcaguuuagguaggaaccugucccaugucagggaaacccuaucuguccccugaacugagcacuuuuaauuuuagggugauaccuugaaucuucaccagucacuugacuucagaccuuucucaucugacgccaaggagucaaaaaggccuguuuuuaacuagaagcagagacauuugccauuuuuuuuuuuaauauuuggagcucaaauaaacaaugacuucacaccacuguuuuccacuguguugaguacauccuguuggccaugauauugagcaguuuuaaacugguuaaccuuucagaaacuuuauauuaauguuggacugacaguuaauauuuaacuugucaaagugauuuuugcuagauugaaccugaagugguuaauauuucugcuuuuuauguuuuccaaaaccauuuaaaauaggaacaugguauuuuauuauuuuaaucugguuucaaaaugaauaucccauuuucuuuauuauuauuauuauuaauuaauuuuuuuuuuuugagauagguucuugcugugucacccaggcuggagugcaguguuguaaucucacugcaaucucaccauccuggguucaagcaguucauucaccucagccucccaaguagcugugauuacaggcaugcgccaccaugccuggcugaacuuuguacuuuuuuguagaaacaggguuuugccacguugcccaggcuggucuugaaguccucagcucaagcaaucugcccaccucggccucccagaguacugggauucuaggugugugccacugcaccuggccauuccuuaaauguuuuaaugacuguggcaaaugauagcaauuuaacagcuuaacuacuauuuuuagguagcguagcuauuugggaguaggggcuccuaggaguggugggaugggcuaccucugccaaauuuugugugguuaauaauggguugagucucccaacuuuucuuuuauucuugggaagcaaaaacuaauagagagcuguuguuucagaguuuuuagguuaagaugugugaaaguuucagagccggguacaguggccugugccuguagucuccuauuugggaggccgaggcaggaggaucacuggggaguucaaggcuggugagcuauaauuguuucugugaauagccacugcacacuagccugggcaacauagugagacccugucuuaaaacuaaaaacagagguacuuaaaaauauauauaucugaaaguuucauucacugugaguuuuucuauggaugaggaaacauuaaguuuauggcaaauugaguuggugccccaugugcauuuguucuucacaucuguugaguggaaagcauuuauuaacugaguucccugugugcgugggcacucauagcucuggggaggcagccugaguggaacagagccgccuguuccauaaggcugucuggacagaauggggucauaagggccuggcuccucaugggcaucuccccuuuccucccaccaagcaacauccuuugguugcaucuuccugggggaugguauuggugguggugaugggaggggccagugggauccuuaccugcugaaccuuacccuuggaugccugguguccuugccaguuacuguauaauguuuuugauuuccuaguuauaucccugaugacugaucugauaaacuuuaaauauaccugccucuaggguagcuuuaauauauuuuggcuacaaaggucacuaccuuuuagguauuauugauaacuugacauuuuacuucuucuucuuuuuuuuuuuuuuugagacagaaucuugcucugucgcccagucuggagugcacuggugugaucuuggcucacuguagccuccgcuucccggguucaagcaauuuuccugucucagccuccgcuucccggguucaagcaauuuuccugucucagccucccgaguagcugggauuauagguguccgccaccaugcccgacuaauuuuuguauuuuuaguagagaugggguuucaccauguuggccgggcuggucuugaacuccugaccucgugaucugcccgccucagccuccaaagugcugguauuacaggcgugagccacugcaccuaccuggccugacauuuuacuucugcccaucacuugagagucccacauaucacaacugggaggaagggagugccuggucauuggcagaugcgagccacuuacuggcccuaccccaacuagcucugguucuucuggcugaggguguuuaucugcagugagucucagggucuggggucuggggcagugcugagagcuuagacucaguuguggguacugcacugggugcuggcacagaggaauaagguucccauucccacuacucgaaaaagagcuucuguagcuccugucagccaguggugaauccagcuaagacauguucuugggcugccuugagcacuuccuacucucuuuuagaggauauaaugugaaugagugugagguguuaaauuggguagcugugucaggaagacuagguggcuguggccagaaucuugccagaaucuuucugugguucccaagcacucuuuucucccacaaguucuggccaccaagcuguaugugaccacgacugaguauuuaccucuguuuggaccuuggucucugaaccacgaggaggaggaucucuguagcgucucuaucugaaugacugaguguaugaguaugagacuguguaaaaaaaacuuccagagggacauucugauacaaguauauggaugcagccuaucagauuccuagcacaggcagacaugacccuugcuuauaggaagccagcaucagaaagacaaaaggguguuuuauuaccaaguugcaaaaaauuuuucuccuuagagcauggaaaaccaacacauaguaguuggaguugugcccugaacaucgccugccugcuaaaugcagagcacuuagucaugcccaugaaacagacaccccaugucgucauguguccgcagauagcagacagcuuaaguuccugguagggcagggugugucucauaacugacuguuuuuaaauaagcugagaauuuuaaaauugagaaugagauuggaauagugaaagaucagcuggaucuaauaagugaaguaaagacuaaagaugaugggaagaaccugaaaaaaagguccugugucuccccauucauucauuagguguaugguguaugucuggcacuggaugagugcugggcacauauuagugauugcaacagauguaucccugcucucccacaacuuauagucuuguggggguguugguugagcugagccauuuacuaaauuagaauuaaaaugcgucugggcaugguggcucauaccuguaaucccagcacuuugggaggccgaggugggcagaucacccgaggucaggaguucaagaccagccuggccaacauggcgaaacucugucuccacuaaaaaauacaaaaauuagccaagcgugguggcaggugcuuguagucccagcuacuugggaggcugaggcagggagaauugcuugaacccgggaggcagagguugcagugagccgagaucaugccacuguacuccagcccgggugacagagugagacucccucuccaaaaaaaaaaaaaaggauuaaaaugcauaagaaaggaaaaggccaguaaagaaaacacuaugcaacaguaaagaaaacuguaggccaagcacaguggcucacgccuguucccaacacuuugggaggccaaggcaggaggauugcuugagcccaugaguuugaaaccagccuggguaauauagucuguaucucuucaacaaaauuuacaaauuagccuggugugguggcgcacaccuguaguuccagcuacuugagaggcugauaggagguuuucuugagcccagagguugaggcugcagugagcugugauuacaccauuuccagccugggugaccaaaaaaccaaaacaaaaacuacacagaaaagaguugaagaaaaaccuucaacuuggagcacuuuauagagaucugaggagaagacccucaccagaguacugggacugcugguuguugagaaggaguuccugguggaggaccccucagacaucacuggaaguuaaaugguucuuggaacugaugcccauagggcuccuccaucuauguacauggucauuuggucccuuuugcugaguguggcacuuaacauugcuggugagccuguggugggcaaaagugacccagccaucuacugauggcagggagggaagguuccugcggaggaaugggucugaaauccugugagccaccuggucccaugggccuuggaguguggaacaagguaguagagaggaaagaggacaauguuuuaccuauuacuuaucucacauugaugacaggaaucaaucaaacuauaucgugcuaaauuguaagacaucuuuaacuuucuuuuuuuuuuuuuuuuuugagacggagucuugcucugucgccuaggcuggagugcaguggugcgaucucggcucacuacaagcuccgccucccggguucacgccauucuccugccucagccucccgaguagcugggacuacaggcgcccgccaccacaccuggcuaauuuuuguauuuuuaguacagacgggguuucaccauguuggccaggcuggucucgaacuucugaccuugugaucugcccgccuuggccucccaaagugcugggauuacaggcaugagucaccgcgcccggccagcacuuucugagauuuacgcauguugauacuuguuuuaguuuuuuuaauuguccuacagaguuccaugauauuccaugaaagccuauugauauauuuuccaguacauggacauuaggauuguuuuuaacuuuccaguguugcagugaacaugcguaugccaucucuccauauauguuugcacuuuccugucugugugccuaggaguggaagggcccagcuacauggugagucuucuccagggugcuagggcagcucacagcucccaccaacagccaugugguccuguucccucaguggugucacauuggaacauuuuggcccaucugauugguguggaaagguuuuugcuguuacuuuaauuuucuuuucccugauuauugguaagguugagcauccuuuuuguaaguuuacugcuauucagguuuucuucucugugaauuacuuguugguucguucuuccuaucuucagcccauuuuuauuguuuuagguugcuugauauuuuuugauaaggauucauuaccuaucacaugcauugaaaaagcuuuuucccagccugugguuagccauuuuuuucuuucuuuaagguguccuuuagucauuaaaaauuauuggccaggccugguggcgcaugcuuguaaucccagaaguuugagaggccaagguggguggauugcuuuagcccaggauuuugagaccaggcugggcaacauggugacacugucucuacagguacaaaaacauagccaggugugguagcacaugccuguggucccagcuauuucggaagcugaggugggaggaucgcgugagcccgggaggucgaggcugcagugagcugugauugugccauuguacuccagccugggccacagagugagacccugucucaaaaaaaaaaaaagaaaaaagaaauuuaaagguuuuuuuuugagacagagucuuacugugucagauuuaaaauucaaauucaaauuuaucuuaagauuuaaaagauuuuuugagauaauugugaauucacaguuguuagaagagggauccuauguacaguuacccaguuccccccaugguaacaucuugcaaaacuauauaguacaauauauaucacaggcaggauauuggaaaugguauagucaagguacagaacauuuccauugccacaggauauuuuauguuguccuuuuauagccacaucuaccuccuucacagucugacccccuucuguaacuucuggcacccacuaaucaguucucuguuucuauaauuuugucauucaagaauguuauaaaaaugaaacuauauaguauaguauguaaccuuuugggguuggcuuuuuuuuuucacuuagcaagauugcuuggaaauucauccaaguuguugagcguauccauaguucauucauuuuuauuguuuauuaguauuccaugguaugcauguaccauaguuuguuuaaucauucacccauugaaggacaucuggguuguaccauuuguugaaaaggcaauuuuuuccccguugaauugcuuuugcauuguugucaaaaaucacuuggguauauuuguguaugucuauuucuggauucccuauuauauuccauuugucuauguaucugucccuccaccaauacagucuuuuuuuuuuuuuuuuuuuuuuuuuuuuuuuuuuuuuuugacagagucucacucuguugcucaggcuggagugcaguggcacgaucucggcucacuccaaccucugccuccuggguucaugccauucuccugccucagccuccccaguagcugaguagcugggacuacaggcgcccgcuaccacgcccagcuaauuuuuuuuuuuuuuuuuuuuuuuguauuuuuaguagagacgggguuucaccauguuagccaggauggccucgaucuccugaccucgugauccacccgccucggccucccaaagugcugggauuacaggugugagccacugugcccagcuguauucccuauuauauuccauuggucuauguaucugucccuccaccauuacagucuucuucuuuuuuuuuuuuuuuaauuuuaaaauuacuauuguuauuuuugagacagggucuugcuccguugcccaggcuggagugcaguggugugaauguggcucacugagccuugaccugcugggcucaagcgauccucccacauagcugaggccacagcugcaugccaccacacuuggcuaauuuuuaaaauuuuuguagagaugaggucuuacuguguugcccagauugguuucuaacuccugggcucaagugaugcuucugccucagccucccagauuguugggauuauagguaugagccacugcaccccgcccuuauuuuuuuuuaauuacuauguugccaaggcuggugucaaacuccuggguuccuccgucagccucuugcguagcugggaucacagguguaugcauaguuuucagcauacaaauuguguacauguuuuguuagauuugcaccuaaguaauuuuuuugaauaguuuaaaugauacuguauuuuuaauuuugguguccacauguugcaguauauagaaauacaauugauuuuugaauguuuuuguguucugugaccuuguugaacucacuuauuauagaacugauauaggacuauaaggaguuuucuuauggauucuuuggcauuuucuacauagacaauuaugucaucugcaaauaagggcaauuuuauuuuuucuuuuccaaucuguaugccaaacuuuuuuuuuugagacggaguuucgcucuuguugcccagguuggagugcaauggcgccaucuuggcucaccgcaaccuccaccucccagguucaaacaauucuccugccucagccuccugaguagcugggcaugcaccaccaugcccggcuaauuuuguauuuuuuuuuuuuaguagagaugggguuucuccauguuggccaggcuggucucgaacucccgaccucaggugauccaccugccucggccccccaaggugcuggaauuacaggcgugagccaccacgcccggccuauuuuuuuuucuuuuuuuuuuuuuuugagucagaguuucacuccuguugcccaggcuggagugcaguggcuugaucucggcucacuacaaccaccgccuccuggguucaagcgauucuccugccucagccuccugaguagcuaggauuacaggugcccgccaccacgccuggcuaauuuuuuguauuuaguagagaugggguuucaccauguuagucaggcuggucuugaacuccugacccaggugauucaccggccucagccucccaaagugcugggauuacaggcgugggccacugcgccuggccacuauacuuuuuuucucacuuuauugcacuagcuagaacuucuagcauuauguuguauaugaauggugauaguggacauucuuugccuuguuucuguucuuaaggauaagucacucaguuugucaccaguaaauacaguguuagcuguagggguguuugguagaugcucuuuaucaaguugaagaaguuccccucuguuccuauuugucugagaguuuuuuuauuaugaaucaguguugaauuuugucagacacuuucucugcaucaauugguaugaccaugugauuuuuuuucuguagccuguuaauaugguuaauuuucaaauauugagcugauuaauuuucaaauauugagcucuccuugcaucucuggaauaaguaccacuuggucgugguauauauuucuuuuaauauauugcugaauucuguuugaucauguuuucuuaaagacuuucgugucuguuuucaugauagauacuggucuauaguuuuguuguaauaucuugguuugauuuugauaucaggauaaugcuaccuuaauagaaugaauuggagccaaguaugguggcaaaugccuauaguccuagcuacucaggaggcugaggugguggggacugcuugagcccaggaguucaaaucuagcuugggcaauguagcaagaccccauuucuaaaaaagaaaaaugaaaaaaaaaaaagaaaaauaaguaaaaaguuaaauaaagaaaauucaauauauuaaaacaaaaugaaucaggauguguuuccuccuugucugcuuucuggaagaguuugugccuggcaguggcucaugccuguaauuccagaacuuugggaguccaaggcggguggaucacuugaggucaggaguucaggaccagccuggccaacuccuucuccaaaaaaaagaaaaagaagaaaaagaaaagauugguagaacuuaccgcugaugucauucaggccuguagauuucuuuuugugggaguuuuaaaauuacaaauucagggucaggcgugguggcucacaccuguaaucccagcacuuugggaggcugaggugggcggaucaccugaggucaggaguucaagaccagccuggucaacguggcaaaaccccgucucuauuaaaaauacaaaaauuagcugggcguaguggugggagccuguaaucccagcuacuugggaggcugaggcaggagaauuguuugaaccugggaggcggagguuacagugagccgagauugugcacuacauuccagucuaggugacagagcaaggcuccaucucaaauaaauaaauaaauuuaaaaaaaaauuacaaauucaauuuccuuaauauuuuucuuuucuuuuuuuucuuuuuuuuucuuuuucuuuuucuuuuccuuuccuuuaucuuuuccuuuucuuuugagacagucucaaucugucauccaggcuagagugcaguggugugauuauggcuuauuacagccuugaacugcugggcucaagccaaccuucuuccuuagccuccugaguaccugggacuucugucuuaaaaaaaaauuuuauccuuucugccucuguaaaauaauuuucuuaauagaaauuauaucauauuggaugaguuguaguaguuuguauuuuuugagaggaaucuguucguuuaguuugauucauauuugucuguguagaguuguuuauaguguuuccuuauuuuucuuuugaugucugcaauaucuagugauaucuccugcuucauuguugauguuaguaauugucuucucuuuuuucuuguaucauucuugagaucaauuuuauuaaucuuuucaaauaacuaguuauuuguuucaaugguuuuucucuguuuuuguuuucaguuucauugggguuuuuugcuuuuuauuauuuccuucugcuugcuuuugguuuauuuugcuuuuuuuuuuuuuuuuuuaauaaugagauggaguuuugcucuuguugcccaagcuggaaugcaauggugcauucucagcucacuucagccucugccuccuggguucgagcaauucuccugcuucagccucccgaguagcugggauuacaggugccugccaccacacccggcuaauuuuuguauuuguauuuguuuguguauauguauguauguguuguuuuugagacagggucuugcucugucacccaggcuagagugcaguggugcagucuccgcucacugcaaccucugccuaccagguucaagggauucuccugccucagccuccuaaguagcugcgacuucaggcgugcaccaccacgccuggcuaauuuuuuguauuuguaguagagacgggguuucaccauguuggccaggcuggucuugaacuccugacgucaggugaucugccugccuuggccucccaaagugcuaggguuacaggcgugagccaccaugccuggcauguauuuuuaguagagacaagauuucaccaugcuggccaggcuggucuugaacuccugacuucaagugaaccuccugucucagccucccaaagugcugggauuacaggcaugagccacugcacccgcccgccaggccucaaagcauuuuucuaagccucauuguuacaguugccacaugaauguaucucuauauauacauguauacauuuuuuuucuuugaaucauuuugaagugaguugcagaguguuugacacuucaucccuaaguacuucaaaauacaauucauaagauugaggaugauucccuauagagucuuacuaccaucauaucaccuaagaaaaauaacaguaaaucccauuuccaguuuacacgcaaaauuccucaauuaccccuuugggagcuggacucauggguuuuuuuaaaaaguaaauccagaauccagucaagagauacacauugucugggcaagauugcuuaccuuucuaauccugggagacugaggugagaggaucacuugaggccaagaguuugaggccagccugggcagcauagugggacacugucuguacaaaagauuuuuaaaaacuagcugaguggaguggugugcaccugaagucccagcuauuuacuugagcccaggaguucaagguuacauugagcuaugaacaugacacuguacucuauccugggccacagagcaagaaccuucucuguccccacuccccuaccccuagaaagauacacacaucaagucugguugcugucucuaaaucgagaacagucaucuuauguuuagggaugucagcauuuggagagaccaggccaguuguuuggcagaagaucccacauucuagauuugugugauuuucuuugcauagcucccauauuuccuguaaauuggaaguuaggucuaaagcagugccacccaacagaaauauaacaugagccacauaugucacuuaaauuuuccugguagccacaugaagaaaagcagauuaaauuaauuucaaucauauauuuuacuuaauauuuuauuguuuuuuuuugaggucgagucucacucugucacccaggcuggagugcaguggugcaaucucggcucacugcaaccuccaccucccggguucaagugauucucuugccucagcuuccucaguagcugggauuacaggcacccaccaccaugcccggcuaauuuucauauuuuuaguagagaugggauuuuaccauguuggccaggcugguuucaaacuccuuaccucaagucauccacccacccuagucucccaagaugccaggaucauaggcgugagccacggugcccgucuuguuuaauacauuucuuuauuauuuauucuuuguuaauacuuauuguuuacuuaauauauuuuauugaauguaucugacuguauucaaaauauuacuaauacauaucauuucaguuugcaaucaauauuuuaaaaguauuaaugaggcauuuuacauucauuuuuuaugaaguuuucaaaauccaguguauauuuuauauuuaauggaucagcuacauuuccagugcuaaggaguugcacgaaacuguugguuucuguauaagagaccauggggguaagaggcuugauccaacucgggguagauguuuuugacaguaacuccuggaggauaguaugugacugaaccacuggaauugcucaagucuaaaccugcuuuucuuuuuuuuucaggcucugugugcuccgggauggagcaggugugcagagggugagaacccagcucugggaccaagucacuugcuuccuuacuuagcaagacuaucgacuugagcaaacuuggaccugggaugaggaugucugugggccucucgcugcugcugccccucucggggaggaccuuucuccuccugcucucugugguuauggcucagucccacuggcccagugaacccucagaggcugucagggacugggaaaaccagcuugaggcauccaugcacucagugcucucagaccuccacgaggcuguucccacagugguuggcauuccugauggcacggcugucgucgggcgcucauuucgagugaccauuccaacagauuugauugccuccaguggagauaucaucaaggugagacuggauauaaagcauaaaugaggaagaguucucauuuuccauuuuaguuuugguggcuuuuccuuuucaagucuaagcuucaccaauucugagcucaguucuuccaguacccccuuagaagagggacagccacugauguucauaagagaaucccuauauacucagaauagcauccuaaacuguauucuuguuccuauucugagggcaucaccauguaauagccuuuacucuggaaguucuacugaacacugauuuagggauuuguuggaaaggucugucacguguauagggaaagguuaccuuuaauaaaacacagaguuaaaccccaaaaaauaggacuuuuaugcuuugaacuuacuuuuuaaaauaagauauaaauaaauauaggaguucugcucugauuugcugauguauguuggcuaauguaauugaucacuuaagaaccaaaauuaguacccaaacuucagccuugccccauauccuuuggagaagccauccagagaacaauggaaucugaggcccguguagagaagagugucuugguugacccaggauagaaaucaggugaaauaggaagcuuuugugugaugaagcaccaucucucugucugaguuuguggaaccauggaauuuccccuagaucuuaaaugaguuuguuucauggacaggugggugggauguaccccucaaguuaugaacaucuucuagagcagaagucagcacacuucacccaagcuggagugcacuggcaugaucaugucucacuguagccuugaccucccaggcucaagugauccucccaccucagccucccaaguagcugggacuauaagcacauaucagcacaccuggcuaauuuuuguacuuuuuguagagauaggguuuugucauguugcucaagcuagucuugaacuccugagcucaagccaucuuccugccuuggccucccaaagugcugggauugcaggcaugcaccacugcaccaagcuccaggcaguaaauauuuuaggcuuugcaggccauaugguuucugucagaacuccucgacucugccuguguaguguuaaaguagccuuuacaauauauaaaucaaugggcaauaaaacuuuacgguggauacuuuuucuuuuuuaauuuuuuacacuuauagucccauucugacuugaaacagauuuuugaauuucauaugucaagaaagaaauauucuuuuacaauuuuuuuuuuugaggcagggucuugcucuguuguucaggcuggagugcagugguacagccauggcucucugcagccuuaaccucccaggcuuaagccuucuucccucuucagccucccaaguagcugggacuacaggugugcaccaccacacccagcuaauuuauuuauuuauuuauuuuugagacagaguuucgcucuugucgcccaggcuggagugcaauggcacaaucuuggcucacugcaaccuccgccuccuggguucaagugauucuccugccucagccuccucaguagcuaggauuacaggcgcacgucaccacgcccagcuaauuuuuaaauuuuaauuuauuuuaauuaauuaauuaauuuugagaugaagucucucucugucacccaagcuggaaugcaaugacacaaucucagcucacugcaaccuccaucucccagauucaagugauucuccugccucagccucccaaguagcugggauuacaggugcgcaccaccaugcccggcuaauuuuuguauuuuuaguacugacgggguuucaccauguuggccaggcuggucucaaacuccuuaucucgggugaucugucugccucagccucgcaacacccagcuaauuaaaaaaaaauuuuuuuuuaguuugggcgugaugacuuacaccuguaauccuagcacuuugggaggcugagggaggcagauugcuugagcccaggaguuugagaccagccugggcaacauggugaaaccccaacucuacaaaaaauacaaaaauuaguuacaaaaaauuuuuuuuagauagggucuuacucugucugccaggcuggucucaaacuucugguuccugcccuacagcauuccuucucuagagguguggccuacaugugaacuaaaaguauucugagaccuauacuuuguuagguauuuucuguaugaucucugcauucagacuucuacauacauuuagugcucuggcuuucuguugguguguuuaaaccaccaaaacagugguuuaacucaaccagcuuguuuuacucaacauuuuuuggccaggaauucagagauaaggaaccuuaucucuguuucacaugguacuagguagaguggcucaccuggggcuggggaauucacuucuaaguuggcucauucauggcuggcaaguugaugcugccuguugacagggagcuuagcuggggcuguuggucaguguccuugauuccucuucauguagaccucuccaugggcugcuuagguguccucaaagcacgauagauggauuuuaagauuagguauuucaagaaauaggaaaggaagcugcccaaucucuuaaggcccagaacuugcccaacaacacuuccauuuuacuccauuggucaaagcacauauagacucugauggguguuuaccagcuugcccccgugacccguaagccccaggcuucuagauuagaaauggccacaaguucuaugccacucuuuccuugcagaggugagucugugcccuuuucccugaaucuggguggaccuccccuucagccugcucccuucuuguguucgccuccuuuucccuguuggucaccuucuuuuuaagccguggcuuguucucagagugaccuuguggucucuggggcaaccguauuucugaagaucuuggcccauguagcagcucacauguagcaguucacagagcucuuccuaguuugcagaguguuugcauaaaguuuccuugucaucuuuguaauaucccagcaagcuagaugcuaaucugaccauuagauacagagugguggcucuggaagguacauuucuugcucagcuucagauuuaauccugaauauccauacccugcauugguugccuuuguuccaguagccauuggaauguuuuacguggauuaaucuuggccagaagugccuugaacugauacagcaaacuagauauuuguuguauuuggcagagagauguuuaacaggcuuauuuaccaagggggugaagagauuuuacugagaaaacaggauuuuaucugagcauauuuaucuguggaaagcagaccauuuaguagcugaugagcuuguagaaaaacagaugaagaugugugacucuucguuccagucuuaaccaccgggauuauauggguuggggagucagaaggucagaaagccugaucuuguuccuagagcuuugguuucugcaucuguaaagcaggauuuagaaagucuuuauauuaaaggaauuuuuuucuuauuauaauaaugaugcauaaauguacauuguggaaaauauagaaagggaaaaaaaaucugugguuucuaccauucagagugaaguccucuaccguuuucuaugcucaucaagagauggucaugccacauacacacacagacgucuuaacauauuagacagaccuaggaucauaguggauauauuuuuuaaccuuuuuuuuuugagacagagucucacuuuguugcccaggcuggagugcaguggcacagucccggcucacugcaaccuccaccucccggguucaaaugauucuccugccuccaucucccgaguagcugggacuacaggcaugcgcuaccacaccuggcuaauuuuuguguuuuuuuggggggauggaguuucgcucuugucgcccaggauggaguacaauggcgugaucuuggccuacugcaaccuccgccucccggguucaagcgauucuccugccucagccuccugaguagcugggacuauaggcuugaaccaccacuccuggcauauguguguguguguguguguguguguguguguacacauacauagacacacacacacauauauauauauuuuuugagauggaaucuugcucuuucguccaggcuggaaugcaguggcgugaucucagcucagugcaaccuccgccuccuggguucaggcuauucuucugccucagccuccugaauagcugggacuacaggcaugcgccaccacacccggcuaggguuucaccauauuggccagacuggucucaaacuccugaccucgugauccgcccaccuuggccucccaaagugcugggguuacaggggugagccaccuugcccagcccacguuuuguauuuuuaguagagaugggguuucaccauguuggccaggcugguaucaaacuccugaccucaggugaucugccugccucggccucccaacgugcugggauuacaggaaugagccacugucccgggccuauuuuuuuuuuuuuuuuaacauuuuucauucacuguagcuugaguauuuuuuuaccuguagucauuaaauguuaugugggaauguaacuuuuaauggcugccuaauauucuuguguuguuuuuuuuuuuuuuuugagacagggucuugcucuguugcccaggcuggagugcaguggcacuaucauggcucacugcagccuccaccuccuagcuuaagcaauccucucaccucagccuuccaaguaacugggacuauaggugugggccaccacacccagguaauuuuuaaauuuuuuuguagagaugggucucacuuuguugcccaggccggucuugaacuccuaggcucaagugauccuacugccucagccucccaaagugcuaggauuacagacaugagcaucacgcccagccugcccacuauucuugagugugugaggaacauuucagauauugguccuaaggaugcuuguugaggcgaccccagucaucuugggcccacugguacugcccuucauccaagcuacugcuugcuuacuucuuccuaggcucccccugccuuuguucuugaccucucaauuuguucuccauauugagucaagagaugucuuuaucuuucuaaagcuuaaaucuauucaaaaucccuuuuuacugagcugcaccaagaaucgaaccccauaugaucuggccugugaccuccucucccacaucuuuuucuuuguauacuuugucccagccacacugguccuuuucugcccagugaacacaccuagcuuaggguccaccccaagcuuuugauucuuucuucuuuugucauggguacagccauaucuuucaggcucaacuuggacaucaucuguuggagcccuuuccuuccacccugguaaaagcagcuuucccacaaaacucugugucaucuucuucuuagcagauuucuguauuugaaauucuuguuuuuuguuagucauguuugccuuccaucacauaguaggcccucaaauguuuguaggcuggcaaagggaaugaggacucauuuagcaccugcaaaccuguuuuggauugucaaagccugccuugcuguaugcagggagaaaugcuagccugugcuggggcagcaagagacuaaguucaccugcugccccacaguguacuauggucuugccguguuuugaggccucaggcccugugacacacacacuuucaaaugacuucuuguuguauuuucacauuggaaaguggccccacccugucccucuaacacuugacuguguguuuauugauccauuauuaguacaaacucacuguuuccuaauauucaauaguuuauugcucaucuuaauuauugugguguucaaauugucccagauuugaccauugggagccccuuuaaguugguuccuguauucuugugauaugccccugucaaucauuaagugcuuccuuacuuucugggauaagaugcuccaggccugucuuguauucacccucccucagccauuucuucaaggagccugauuccuuuuuguggugaauguuauuggggguucagaucugggugcuaggugaguucauugccacugggauuuccuugcuucuuugagccguucagcagauaguguggcuccauuuuuagaugacaaagugguagcuaagugacuuaucucggagcacauagcuuguagggacagaguuaguuuguagggagcacccaagaggcuuuuuuuuuuuuuuuuuuuuaauugagacggagucucgcucugucgcccaggcuggagugcaguggugcuaucucggcucacugcaaccuccgucucccagguucaugccauucuccugccucagccuccugaguagcugggacuacaggugccugcuaccaugcccggcuaauuuuuuguauuuuuaguagagacgggguuucacuguguuagccaggauggucucgaucuccugaccuugugguccgcccgccucggccucccaaagugcugggauuacaggagagagccaccgcacccagcccccaagaggcuucuugagccuguaguauauaaggucuuaucuucagguaacugaccuguguuuauuuugugugucagcaugcuuuggaauuauaauuuaaugcuuuguucuagucaguuuuagaagacuucccucguaguugucuguuaccgugccucugaccucugacacugcagggcuguggaagagagagacacacuggguaugccuugacauggauggugucacaugugaugagacggguuuguacaaccugccaugcaugugggcaucuuugagccagagcagaagcugaccuaucauugggcccaaaacugauugcuaaguaaauggcugguuuacaguucuggcuuuuggaaugaaggcugcaggaccacagguuuggaagaucagggccaaccuugaugaaagugaaaggagagucugagugaaaggugaugucuggcugguaagcuaucauuguucccuguguaggguucuagauacuuggcauaggaccuguuucgaaguagaugccuaauuaaaggcuugcuaugugauaaagcauuaacagagguggagcaacaacgguaagacaugugggacagugguggguugcagagcuccauguggggaauuugagaaguuguugggagcacauggaguugggcuccucagcagagaaaggccagugcccacauguggcaggguugucaauuugagugaaaguaaauggagagagaaguggguccguaaggggcuuuucaaaggcuuucuuccccaaguaucagaggaagaagaagcuggugaagaacugagguaggagguacugagccuggccugcuuccuccuaagccccaugugggauguccagaugaggguuggucuauuugggcagggcugaguugccaaaugaagacucagguggaacgugaucugcauggucugucccaagaccuggugagauuagauggcauaguugucauacuugcugauugguuaggggauaugcauggggguugacgguagaauaauccaguguuuauagcacacuuagaugcuggucuguugaagggcuagaaaauuaaguucucauucuaagugagcuguguugacugccugaaaagccuggccugaccugugugggcuucugguuacuuuauuucaggagguugugcugccuggugucagucuguugauauacccaacaaagcgccugaagcaaaugcuucgcuacauuuuauauugguguauacuuuacacgucagucugcagggucaggagaauaaagaagggaccugccugcgcagaggguauagccccaagauccuggcucuucugcucugccccacaccugacacuccuucauguucugacagcucuuguccagucucagccuggccagcacuuguugcuuaaccaaugcuguucuccaguucugccuugagaauugauauucuguuauugaccccagcuuaacucacacauggacugcuuugaccagacgugugagaaggggcuaugggcucccucaagguccucauggccagcauagcuuuuuugagagaccugugccauggggccccugucuccucucuuguggccuuaggaaacccuaaagcagauagucuugauguuugcucccuugaaucagacuggaugccuguauacaaagcucagcccagcucuugacuguccuuggcucucacagcuacuuuuggagcugagaggacccuuucuccuuaucagggucuguggggaugggucccacagaagccaaccuggccuucacucaguggauccuggccuguccugggcuggcaacaguaugagccacccuugucucccuuggguuuggugcuggaucccugcaggcaccucuccucugacuugagugugggacuggcugagaaaugugauuauaugccaggagauguucuaaccucuccucgaagguggucagggagagacaucuuuacauuucaugaaaugcccaggcugccccucagaugucucauuuugguagagccugcaaggauggcuuuucaucccugcuucccuuuagccuucuugccugcagacaauguggaccuucccucagcccaagauguuggcaggcugggagcagcccuuccugggacugugcucucagcugcuggcacgggcccccaauuguuccccugagaacaaugggcacucucuuuggcuaggaaggggaguucaugaaaggagcauuucuuuggaugcuugagagcuuuguggcagccccgccugugugagaugagcugcaguuucuuccugccuugaguggguguuccgcauuucugaauggaccccuugugaacaaagcacaccgggaaaugcggguuggcgauggaaggcauccuugggggugggcugucagaauggcauuugcccagauucaucaacucaaauacuuagugaaaauauaggcuucuauguuuaaaaaaaucacugacaaagacugaaagagaacaugacaaaguaaaauagaugaugucagggcuccagauugaaggacugauucugaggauuuuauuaguggcucuaacuauguuaagcugcccuuuacuuuuuuggggaaaaagacuaauuuuugcuuuuagaugagaacagugaacaugagauaaaaugcuuuguagcucagaccagaagggcauugacugggcugaacaguguguucaguauugauccuguggcguugguguuuguggcaggggccagguucugcuuugagguuugcaugucuaacagcaggaccaaugaugaucccuugugggugugacucugcuaaggccgcauguacuuaacuucccucaugauuuuuuaccucagguggggacaaaggccuggcccucugaccuuaagcuagaggcucuuccuguuggucugugccaucucccugcagcacagccaugugacugcccauguuccucauuagcagaaggccacagagcagauuuaucucauugucuuaguccauggcacagacacaggauaacccugagugugagucagcaccaaggcugauacuccaucagaggguccaucuccugcuucccugagcagaggacacacagucagcuugcaaugaggaggccuugacugccucaugugggagugccuccaggguguugucuaugguacccagccauagauggcugcagguuggcccagcucugcagccugacuagggaugagggagcugaaaggucgggaauugaugaccaggucugaaggaaagcagggacuuugccaacgcaggccucugcagguccagcauugggaugucacggggcagcagucuguaucacuuugaaauggaucuguugggggacacggggaagggcccagcccacaccuuaagggcugacauguccagagguauugauggaaggugccaccaccaaggcccaaaguucccuccaaaagauuuguagugagaaggaaugcucaccaaaucaguuucucgauuauguuauucuuaggaucccucuuuacuggccaucaucagcugugaaagugcucguacaucugucuagagucuuugcuugccauuucuaaguccugcaacuccugcauggauaagacaucaucuugugggcccugaaugauacagcuuguguuuucuugguuucauaagccaauuauaauuauuuggcccuagagagagccuaauucuucaguuuuguuuuucagcuaugcauaacugacucagacuauggguggaaaccugcuuuuaugagaacuaaguaauagaagcuccuccagccauuugcucuuucuucagguguggaaugguacuggcuuggggugagagacuuugcuugaguuucaugguguuuuuuuuuguuuuguuuuuuuguuuguuuuuguuguuguuguuuuuugagacagagucucgcucuuugcccaggcuggagugcaguggcgcgaucucggcucacugcaagcuccgccuccuggguucacgccauuuuccugccucagccucccaaguagcugggacuacaggcacccgccaccacaccuggcuuauuuuuuuuguauuuuuaguagagacgggguuucaccguguuagccaggauggucucgaucuccugaccucgugauccacccgccucagccucccaaagugcugggauuacaggcgugagccacugcgcccggccgucuuuguuuuuuugagacaggucuugcucugucacccaggccaaggugcgguggcgcaaucauagcucacugcagccuugacuuccccaggcucaagcaggcuucccaccucagccuccugaguagcugggaccaccacgcccagcuaauuuuucuuuuuuguaaagacgacguuuugccguguugcccaggcugaugguguuuagugccuacaggugcuguaucuuuaucaaagucaguguuugauggucuauugugugcagagggcaucaguaaagcagcuggagggagugucccagagacugaggagugaccaaaauguucaaauuuggcaguucccuggucauuggucauggugauuuauugugggcaucacaguuuuagaccuuuguuuuuuuuuuugagauggagucucgcucugucgcccaggcuggagugcgguggcacgaucuuggcucacugcaaucuccaccucccggguucaagcaauucuccugcuucagccuccuaaguagcugggauuacaggugcgcaccaacaugcccggcuaauuuucuuuuuacuuuauuuuauuuuuuuuugagacaaagucucacucuugucccccaggcuggagugcaauggugugaucucggcucacugcaacuuccgccucccggguucaagcaauucuccugccucagccucccaaguagcugggauuacaggugccugccaccacacccagcuaauuuuuuuguauuuuuaguagagaugggguuucaccauguuggccaggcuggucuugaacuccugaccucaggugauccgcucaccucagccucccaaacugcugggauuacaggcgugagccacugcgccuggcuuuuuuuuguauuuuuaguagagaugggcuuucaccauguuggccaggcugcucuugaacuccugaccucgugauccacccgcuucggcucccgaagugcugcgauugcaggcuugagccaccacgcccgccccccucccaccccuuuuuuuuuuuuuuaagacugcaucaugguauguugcccaggcugggcucaacuccuggccucaagugauccucccgccucagccuccugaguagcugggguuauaggugugagccaccaugcccagcucagucuuuggaacuuuuuguggaucugcccagguuuugugguuuugauucuuaauguuuugggaugcacuuugugggucaggauuucagaagcugguuauaggcuuuucaagaucuuuuuuuccuuaaugcuagacuuacuuucuaucucagaagcacaucgucucuaaggguugccgaaaccagaaaguuuucuggccuuuuugguggccugugagcuacagccugugaucuccuuaaaucaggcuuucuugggcaguuucugccuccugcagaugugccuaguaacugucugaaggcuucuuucaagacagcaacuguaaggucagcaggccuugccucucccagcuccaaggcaguguugguguuugguguuggcugguagagagaccugaaaugcuggaggaguuccacggugggaccagcuugucaccccaaacucaugugccucugugccucugcugcuaaggaccucagagccccaauuccugccucuuuucugcccuuccuggccuggcagcccuuagaggauuaguuguggguggcugugguauaguaggcagaaaucuuuauaccaggcaaaccaaggacucuaaggauagucaaaaucccauguguaaaugugccaggaucuagugcacccauuuuauuaauuauagagacaaagucucacuauguugcccaggcuggucuugaacuucuggccucaaacaauccucucgccuuggccuccuagagugcugggauuacaggugugagccacugugccuggccuaguccaccuguuuuagguugaagaggugaaagcaggucuuuggguucucaccugcagcaggucccccacuucccccaugccccuuaguguuuucaucuacuucugguagacaaguguugacaggcaacucucugagcuuccccagccucagcuuuguuucucuauaugauuuuggcucccucauugccuguugccuccccacuuaccuuagaugcuuugagcuucuguuuugugguaugaacagggagacaggaccccacugugcacuggguccaaggucaguugggaaggagaacuagggagaggagccuggacaugcccugggccccuuugugcaguagccucaaauuacuuacugguucuucucagagcccaugggagccauaggaaccauuauuggcagaguccaucaugugccuggcacuauaaucauaugagguugggauuguuucccugauuuuacagaugacacuggggccaagguugggucaagcgccagccagccuggagcugggauucgcagugaaagaugggccuucucauggaguagaagaaugaggauuguuauccccauuguuauggggaugaguccuggcuugucauugggcugcaucugugagaaggaacuuucauauccuguuucacccuuaggaucugagaagaagagaagugauccagagccuauaaguuuugaaagcugaggagguauccagaguucccguggacugagggccuccugcuuuguuaggguagagcaggugcuuuauccccuagcaccuccgggaugagcuaagcccugagcugagucccuuugggaggguggggcuccuaguggaauccuuuggggacuguggacacugccaaaccuucaggcauguucagacuuuccagguaggggcuuuccccaaauggccuugaaaaugcagaagugccagugugccugugacuuggccagguuccuuguggaaauuagguuuguuuugcuuccuguagcccuucuauuaaaaugaaucauggcugggcacgguggcucacaccuguaaucccaacacuuuggcaggcugaggcaggaggaucacugaagccuaggaguucaagaccaaucuggacaacauaggaagacccaucucuacaaaaaaguaaauauuggccaggccugguuguacacaccuggcucaaguagucccagcuauucaagaggcugaggugggaugaucacuucagcccaggaguuugagguugcagugagcugugauugcaccacugcacuccagucuggugacagugagugagacccuggcucaaaaaaauguauauuuaagggcugggcaugguggcccacaccuguaaucccaggauuuugggaggcugaggcaggaggauugcuugagcccagaaguuuaaagccagucugggcaauauaaugagacccugucucuacacacccacacacacaaaauacccgggcacgugccuaugucccagcuacuugggaggcugaggugggaggauugcuugagccugggagguugaggcugcaaugugccaugaucacacuacugaauuccagccuaggcaacagagugagacccuuauauauacauauacauauauguauauaaagaaucauugccacucaaagugcugcuugggccugaugucaccaguaccacucaaagugcugcuugggccugaugucaccaguaccacucaaagugcugcuugggccugaugucaccaguaccaagacuggagaugcagggguuuuagaacauucagguuaguacuuuuucuuccugaguaguacccaugauccuggagugacugccugcuucagggcuguagaucuagacaccuguccugcagccagguaguggccgggacuucaggacccuggggagccaaaauuugcagaggggaaagcaggugacuagguuggagagacuuggcucuuauauuagucuguucuuguggugcuauaaagaaauaccugagacugguaauuuauagagaaaagaguuuuaauuggcucaugguucugcaggcuauacagggaauauaguggcuucugcuucuggggaugccucaggaagcuuccaaucauaguggaaagcaaagggagagcuggcgcuucacacggcuggccggaacaggaggaaggcugggggaggugcuacacacuuuuuuuuuuuuuuuugagacggaaucucgcucugucgcccaggcuggagugccguggcgugaucucggcucacugcaggcuccgccccccggguucacugccauucuccugccucagccucccgaguagcugggacuacaggcgcccgccaccucgccccgcuaauuuuuuuuauuuuuaguagagacgggguuucaccauguuagccaggauggucuugaucuccugaccucgugauccgccugccucagccucccaaagugcugggauuacaggcgugagccaccgcgcucggccuuuuuuuuuuugagauggaguuucgcucuucugcccaggcuggagugaaguggugcaaucucggcucacuucaaccuccgcccucuggguucaagcgacucuccugccucagccucucgaguagcugggauuauaggcgccugccagcaugcccagcuaauuuucguauuuuuaguagagacaggguuucaccauguugaccaggcuggucuugaacuccugaacucaagugauccacccaccucagccucccaaaguacuaggauuauaggcgugagccucugcucccggccuacacacuuuuaaacaaccagaucuugugagaacucugucaugagaacagcacuaggggggugguacuaaacgauccaugagaaaucacccccaugauccaguccccucccccagaccccaccuccaacacuagggauaauaauuugacaugagauuugggcagugacacagaugugaaccauauaagcucuguuuuucugacaugacuugccccaaagacauggguaaacuuuacauggcugcaaagccauggguagacaauaguaaaagaauuuggucacgugcaguggcucacaacuguaaucccagcacuuugggaggcugaggcagccagaucacuggaggccaggaguuugagaccagccugggcaacauggcgaaaucccaucucuaaaaaaagaaaaagaaaaaaaaaauuagccgggcauaguggcagucaccuguggucccagcuacucaggaggcugaagcuggagaaacauuugaacccaggaagcagagguuacagugaacugagaucgugccacugcacuccagcccaggugacagagugagacucugucucaaaaaauaaauaaauaaauaaaauuaaauaaauugugaaagaauuuguucucaguagucaaaauaaagcucauuucucaucucccaucucccaauuugaaauugagcauuauaacuugcuuuggugaaaccugacguuuucuuuaguguuuauuguuuguuacauaauauuaacauguuuuuaaguuacuuggcauaguuaaaauaaguguauggcuuucaaggauggcuucgcugugggagccuuccuauagaauggccugaguuuguucuguaggaacugccugauagcagaacuuuggcuguuggggucagcagaauaggaagugagccaggcugggaagccuugagaaggcagggcccuucucuauuuucuguuaaaaagugcccuuguggccgggugcgguggcucaugccuguaaucccagcacuuugggaggccgaggugggcagaucacgaggucgggagauugagaccauccuggcuaacacagugaaaccccgucucuacuaaaaauacgaaaaauugccgggcgcgguggcucacgccuguaaucccagcacuuugggaggccaaggcgggcggaucacgagcucaggagaucgagaccaucuuggcuaacacggugaaaccccgucucuacuaaaaauacaaaaaauuagccgggcacgguggcgggcgccuguagucccagcuacaggagaaugaggcaggagaauggcaugaacccgggaggcggagcuugcagugagccgagauagcgccacugcaguccggccugggcgaaagagcgagacucugucucaaaaaaaaaaaaaaccaacaaaacacgaaaaauuagccaggcgugguggcgggcgccuguagucccagcuacuugggaggcugaggcaggagaauggcgugaucccgggaggcggagcuugcagugagccgagaucacgccccugcacuccagccugggugauagagugagacgcugucuaaaaaaaaaaagugcccuuguauaguugaagacagacuuggagaggcaacagguugcugacuuaucaacacugauggagcgccuagccacucaggaaugucccaugguucuagccagccauuuggcucccuucuucuagucccucucaaccuuguucagucuccucugcaguuggcuucuccuuaguuggcuuuacccagaccucuauuccaggccuucccugucaccuuucuucauccucccucugccaugugagcucguguccuacugguggccauugggauggaguagaguuaggaaauaacccucaggugaccaaaaaccgggguccacacccuaauucaccuacucuccaccucucaggaccccuacuucuaucccacuccuguaaaacaucucaugggccuuacuuauuugcuucauggugguuuuuuguuuguuuguuuuugcaaaacaagagcauucaaccuuuauuuuauguguuuauauacggauguggcaguuuuauuuaauauaaaugaacugaaaaauguaaagcuuagauuuuucagccaaaacauuugaaauagugugauuuuuuuuuuuuuuuuuuuuuuuuuuugggacagagucucacucugucauucaggcuggagugcagugguguggucuccgcucacugcagccucugucuccuggguucaagccauucuugugcaucagccucccgacuagcugggacuacaggugugcaccaccaugccuggcuaauuuuuguguuuuuaguagagacgggauuuugccauguuggccaggcuggucucaaacuccugacuucaagugauccacccgccucaaccucccaaagugcugggauuacaggcaugagccaccacgcccagccaauaagugugauuuuuaugguuaaaaaauauuuuuaaagaaaaauauauuuagcauuuuucaugaauuugaagacacccauguuuacagauguuuuaacauuucugauguuugauggugagugacagggugggagauucuuaauuagaugauggcacaucuuagaguugaugcaaugugguaucacaaaagaaacacuauuugcuaacccuuaaugaguggcucagagagcaauuaggaaaugauaacccugauaauaauaacgccuuuuuuuuuuuuuuuucugagauggagucucacucugucacccaggcuggguugcaguggcgugaucucaguucacugcaaccuccgcuucccagguucaagcaauucuuaugccuuagccuccugaguagcugggacuacaggugccugccaccacauccgacuaauuuuuguacuuuuaguagagaugggguuucgccguguuggccaggcuggucucgaacuccugaccucaggugaucugcccaccuuggccucccaaagugcugggauuacaggggugagccaccaugccuggcccaauaauaauaauuccuaacaaugucaguaaucucaugguuaaaaaaaauuuuuuuuuugaaauagagaugggggucucacuguguuggccaggguggucucuaaugccugcuggccucaagcaauccucccgccuuggccucccaaaguacugggauuauagguaugagcuaccaugcccagcuuucucauacauuuuugcuggguguaggaaaccuguuuaaauuaguuuaaaggggggaaauuaucuaguuucugauaaggcugcugccuggacaccuggguacaagccuggggucuccuuuccaaaucacucaaguacuuuguuuuuuggcaggaggaagcccagggaaccagaggcacuggggaauccagcagucaguggcuuuagcuuuccugccacagggagggggaagcauuuuagggucccccuauugauaagcaguggucaugaagggcaguccuaagcugagucugggagugugauguacuguguuuuggccaauuugucucugguacuuguuauaggacaauggagaugagagugccuucaggccaaccagagaauggggggugucacuuuucuugcauuggggcaggaguagguguuucccaaaagugaaaggagccacagauggggcuggggcaagagcuaagucauauuuuccucuugucagcuguugguggagguuucuaugguggcauuuccuugggugcucugaguaugaccaguuauaucucuguggaaagggacuuccacaacaaaagaagucugggagaugcuguugaguuggaauaaggugaugagcuccuuaggccugcuucugugccuggucucuccaagggcagaagaggucucuguguauuuccuguacuugauugacuguagaaccucucucuuuuagagagaccagagcuccuugggauuccuuuaguaagcacuauucuagaauaguugauucuagucucugcucccuggguaccacaguuugucuugagauuugagaagcaggguaaaugaaaacauuagauacaacuaacucucuuugcuacacaaaugugccccacuacacuugaauguaacgugauguuguaaugugaguccuucagagcguugagccuucccuuguacccagaccugugugcaucuccacuuuggggcaggaaugguccuccaggccaggcaugugaccugagcaaagauguggugucugcagagggccggggagaagucugaggcaaggguggaaaggaaugcugagggcuggaaugugacuugauucuucagguagaaugggcaaguagguggcagggcgugucacuguuauaaaauccacaacagucgugagcuccauggcaucaguucuugggaaugagacaugugcuugagugccagcacugcugucuccccacuguguggccuugggugagauauuugccucccaaguuagcccaucucauagcccuagucuugugacagguaaauaaacucaguugugucucucuaggggggaggaaucagcuuccccagcaggcauucugaauuauaccuuaaaccugucacacaauucagguuaacuguugugaucauauucagguuaugcagugacaauaguauuuuuaauuuaugcuugugucucuucuagguaucagcggcagggaaggaggcuuugccaucuuggcugcacugggacucacagagccacacccuggagggccucccccuugacacugauaagggugugcauuacauuucagugagcgcuacacggcugggggccaacgggagccacaucccccagaccuccaguguguucuccaucgaggucuacccugaagaccacagugagcugcagucggugaggacagccuccccagacccuggugaggugguaucaucugccugugcugcggaugaaccugugacuguuuugacggugauuuuggaugccgaccucaccaagaugaccccaaagcaaaggauugaccuccugcacaggaugcggagcuucucagaaguagagcuucacaacaugaaauuagugccgguggugaauaacagacuauuugacaugucggccuucauggcuggcccgggaaaugcaaaaaaggugguggagaauggggcccuucucuccuggaagcugggcugcucccugaaccagaacagugugccugacauucaugguguagaggccccugccagggagggcgcaaugucugcucagcuuggcuacccugugguggguuggcacaucgccaauaagaagcccccucuucccaaacgcguccggaggcagauccaugcuacacccacaccugucacugccauugggcccccaaccacggcuauccaggagcccccauccaggaucgugccaacccccacaucuccagccauugcuccuccaacagagaccauggcuccuccagucagggauccuguuccugggaaacccacggucaccauccggacucgaggcgccauuauucaaaccccaacccuaggccccauccagccuacucgggugucagaagcuggcaccacaguuccuggccagauucgcccaacgaugaccauuccuggcuauguggagccuacugcaguugcuaccccucccacaaccaccaccaagaagccacgaguauccacaccaaaaccagcaacgccuucaacugacuccaccaccaccacgacucgcaggccaaccaagaaaccacggacaccccggccagugccccgggucaccaccaaaguuuccaucaccagauuggaaacugccucaccgccuacucguauucgcaccaccaccaguggagugccccguggcggagaacccaaccagcgcccagagcucaagaaccauauugacaggguagaugccuggguuggcaccuacuuugaggugaagaucccgucagacacuuucuaugaccaugaggacaccaccacugacaagcugaagcugacccugaaacugcgggagcagcagcuggugggcgagaaguccuggguacaguucaacagcaacagccagcucauguauggccuucccgacagcagccacgugggcaaacacgaguauuucaugcaugccacagacaaggggggccugucggcuguggaugccuucgagauccacguccacaggcgcccccaaggggauagggcuccugcaagguucaaggccaaguuugugggugacccggcacugguguugaaugacauccacaagaagauugccuugguaaagaaacuggccuucgccuuuggagaccgaaacuguagcaccaucacccugcagaauaucacccggggcuccaucgugguggaauggaccaacaacacacugcccuuggagcccugccccaaggagcagaucgcugggcugagccgccggaucgcugaggaugauggaaaaccucggccugccuucuccaacgcccuagagccugacuuuaaggccacaagcaucacugugacgggcucuggcaguugucggcaccuacaguuuaucccugugguaccacccaggagagugcccucagaggcgccgcccacagaagugccugacagggacccugagaagagcagugaggaugaugucuaccugcacacagucauuccggccgugguggucgcagccauccugcucauugcuggcaucauugccaugaucugcuaccgcaagaagcggaagggcaagcuuacccuugaggaccaggccaccuucaucaagaagggggugccuaucaucuuugcagacgaacuggacgacuccaagcccccacccuccuccagcaugccacucauucugcaggaggagaaggcuccccuacccccuccugaguaccccaaccagagugugcccgagaccacuccucugaaccaggacaccaugggagaguacacgccccugcgggaugaggaucccaaugcgccucccuaccagcccccaccgcccuucacagcacccauggagggcaagggcucccgucccaagaacaugaccccauaccggucaccuccucccuaugucccaccuuaacccgcaagcgccuggguggaggcaggguagggcaggggccuggagacgacaugguguugucuguggagaccgguggccugcagaccauugcccaccgggagccgacaccugaccuagcacacacugacacaggggccuggacaagcccgcccucucugguccucccaaaccccaaagcagcuggagagacuuuggggacuuuuuuauuuuuauuuuuugccuaacagcuuuugguuuguucauagagaauucuucgcuucauuuuugauggcuggcucugaaagcaccauguggaguggagguggagggagcgaggaaccaugaaugaacucgcaggcagugccgggcggcccccuggcucucugcguuuugccuuuaacacuaacuguacuguuuuuucuauucacgugugucuagcugcaggauguaacauggaaaacaguaacuaaagauuaaauucaaaggacuuucagaaguuaagguuaaguuuuuacguuuaaucugcuguuuaccuaaacuuguauguauaauuuuuggguggguauggggaauugcuuugcuaaaaauaagcucccaggguguuucaaacuuagagaagaccaagggacaguauuuuuuaucaaaggaauacuauuuuuucacacuacgucaacuugguugcucugauaccccagagccugauugggggccucccggcccuggcucacgccaagucccuggugcuggguuugcucucccgcuguugccaggggcuggaagcuggaggggucucuugggccauggacauccccacuuccagcccauguacacuaguggcccacgaccaaggggucuucauuuccaugaaaaagggacuccaagaggcagugguggcuguggcccccaacuuuggugcuccagggugggccagcugcuugugggggcaccugggaggucaaaggucuccaccacaucaaccuauuuuguuuuacccuuuuucugugcauuguuuuuuuuuuuccuccuaaaaggaauaucacgguuuuuugaaacacucagugggggacauuuuggugaagaugcaauauuuuuaugucaugugaugcucuuuccucacuugaccuuggccgcuuuguccuaacaguccacaguccugccccgacccaccccaucccuuuucucuggcacuccagucccaggccuugggccugaacuacuggaaaaggucuggcggcuggggaggagugccagcaauaguucauaauaaaaaucuguuagcucucaaagcuaauuuuuuacuaaaguuuuuauacagccucaaauuguuuuauuaaaaaaaagauuuaaaauggugaugcuuacagcaguuuguacgagcucuuaaguguugauuccauggaacugacggcuuugcuuguuuugauucuuuucccccuacuuuuccuaaugguuuaaauucuggaauuacacugggguucuuuugccuuuuuuagcagaacauccguccguccaucugcaucucugucccaugacucaggggcgcccacucugcuucgauucuccuccuguggaagaaaccauuuugagcaugacuuuucuugaugucugaagcguuauuuuggguacuuuuuagggaggaaugccuuucgcaauaauguauccauucccugauugaggguggguggguggacccaggcucccuuugcacacagagcagcuacuucuaagccauaucgacuguuuugcagaggauuugugugugcugccucaggaggggagggcugguaggagggggggagaggucucuguccuacugcucuccagagggcauuuccccuugcgccuucucccacagggcccagccccucuccccugccccaguccccaggggguacucuggagugagcagugccccugugggggagccuguaaaugcgggcucaguggaccacuggugacugggcucaugccuccaagucagaguuucccuggugccccagagacaggagcacaagugggaucugaccuggugagauuauuucugaugaccucaucaaaaaauaaacaauucccaauguuccaggugagggcuuugaaaggccuuccaaacagcuccgucgccccuagcaacuccaccauugggcacugccaugcagagacguggcuggcccagaauggccuguugccauagcaacuggaggcgauggggcagugaacagaauaacaacagcaacaaugccuuugcaggcagccugcuccccugagcgcugggcuggugauggucguuggacucugugagauggagagccaaucucacauucaaguguucaccaaccacugauguguuuuuauuuccuucuauaugauuuuaagauguguuuucugcauucuguaaagaaacauaucaaacuaaauaaaagcagugucuuuauuacaa

SEQ ID NO: 192096 - RNA, 52948 nt, Homo sapiens
guggaugagcugugagugcgcgcgcgugcgcggggccgcgaccugugccggcucgagcccgcugggcacucggaggcgcgcacgucguuccccgcccucccgccgccgcccgcccucgcucucucgcgcuacccucccgccgcccgcgguccuccgucgguucucucguuaguccacggucuggucuucagcuacccgccuucgucuccgaguuugcgacucgcggaccggcguccccggcgcgaagaggcuggacucggauucguugccugaggugagcggaaggguucccuccaggcgccgcggggccccaggcccgccagcccgguacucuuccggccggcaggccgccgcaccgccgcggccgcgccccaccggcugcucguggccgagccgccccuggccccugacccuugaccugacucccagcccgggccccgcgccccaagcggcgaccccgcccgcgcaguccccggaagcgcgcccgguagucuccugugccccuucccccgcccggccgggccugguggagcccaggcugcccgccugcccgcccucgguccccggagcuuccucucccagcggcgccgggcagggcgggggcuuugggccgggccccgcgaccgcgcaguguagccggccgcugaaagcgcgcguggcugucggaguugaaaugggaaagaaacucuuuacaacuccauuuugcuuuuuacguuuaacgagaaacgacaaucacuguuucauauugauuaaaguccaguuacacuuuggguagguuuucuuuuaaugcagacuuguuggagacuguguaaguaaguaaaagauuguauugaacgcuuagggguaugaucuacggccauaccaccuggaacgcgcccgaacucgucugaaagcuuuggggucuguuuugaguggaaaagggguauuuuccauuuggaaaaaaaaaacaacacacaaaacuguaaaugauuuaagcgauguugcaugaaaauagaugcaauguugcuuagucgaagucgcuguauugauuaggaaugaucuaaauaucuguaccuuaguuacugauuggaucuacaguuacgggucgucuucauugaauagcgcuauucgcauccaaguugauuuguucacaaaccuuguuuaguaguuuacgguggaaaauuggaauccuuuuuaccucaaaguugguuccacuuguguuuuuuaauaguucugauuuuaaauuuuuaccucuguuguugacuuguuugguucugucuugaagaaagucuuaaacguuucuugcagguguguaaguagauauuucacucugccuuucugaaggagaaaaauugaaaaaccaaaaaacuuccauaauuuaaaauguuguauguggagagaauuuuucaaccacuuaguaucacccagauguguaauguguaccaugcggaugauugucaccuuagauguggcuagauuggcggagauacuguuuugagcauuuggcacaagugacauuggacugaaaaacuaguuuuuaauuguaaagaaugacuuauugaaggaucucuggauaacuugucuuaauugguuccaucuacuuuuguggagcacugauggcucuuggggacauuaaauauauaaggugcaccuugguuugaguuaaagucuagugcuagauuuauccucucuguucucauaaaaaucuguguuggagggaagaagagaguaggaauacuguguaguucuugaguuuuagaucuaagaggaaucuuucaggacugguuguccaaccccauuugcagaugagcaaacugagucccagagacuuaaguaaauuucccaagguuaccuaucuagucaggagcagaccagaacugucugcucuguuaagguauucuccauuuacucccaagcaguuggccuccagagucagcuaaaauucaggacuucuagcuuauuccauuguuucuucuuuuaaaccuuguugauggugaauaguuugggagaaacuguucauuugccaaaaaauuucgguucauuagcuuacacagcacucuccccuuguuaacuggaugguccugccuucaauugagggagauagaugaauguacgagggucccugguuggccuaaucauggcuuuguuuggauuuuuuuuuaagggaccaacuucuagagcaaggccuacacuuuacugcuucaaaaccaagauauuuaggucaggcuaagauauuuuuaguuaacugugggcacuuuugacuguugauuugggguacugcguguaucaaguaaacaauucccugugcacaugcaugugguggugguggaguauuuucguaguccugauuucuuuccauuugucaguuaacugcuuuuuaaaaguuuauucuggucauauggggguguaaguuauuaggagaguaaaaacagguagcucuucagguguuucuuguccaugggguggaguccaugcagugacuggagaaggugcuaguuugcgucuuuuuaauugucuuagagagcugagagauauauguuaacucugagaagaaagacugaucagcuucuaagagagcuaauuugaagcugcuggccuucuguagacagcaccuuggguuuaauugcauugugguuacuagugauuaugauaaauaguacauagucacuggauuuuaaaauuggccauauaguuguaguuuuauauuuauuuuuauuuuugaaauggagucucacucuguugcccaggcuggagugcaguggcgcgaucucagcucacugcaccgucugccuccuggguucaagugauucuccugccucggccccuggaguagcugggacuacaggcacccaccaccauuccuggcuaacuuuuguauuuuuaguagagaugggguuucaccguguuggccaggcuggucuugaacuccugaccucaggugauccgccugccuuggccucccaaagugcugggauuacaagggugagccaccacgcccacccauauuuguaguuuuaaaaggauccuggcagggcgcggugguucaugccuguaaucccagcacuuugggaggccgaggcgggcggaucacgaggucuggagaccauccuggcuaacacggugaaaccccgucucuacuaaaaauacaaaaaaaauuagcugggugugguggcgggcgccuguagucccagcugcucuggaggcugaggcaggggaauggcgugaacccgagaggcggagcuugccgugagcugagaucgcgccacugugcuccagccagggcaacagagcgagacuccgucucaaaaaaaaaaaaaaaggaucuuaaguauuuugucugacucugccauuuaguuuauuccuuuguuuaccugcccaauggaacuguuugcuuguaacuacacauuaauauaacuaaauuuugaacuuaauguuacaugccuugcuauacauggggcucuuuggggacaugcucauuugugggauuaaaauuuccaagacgguuugaaguuuguaauuacuauaaaaucccucaucuuuaaucuguggagcuguaguauuaagugaaggccuugguauguucauaauuacgauagucaugugacugaaaaucaggcacugaagcugcucguucuggguguuggucucaguuuauugaugcuucauccaaauacauuuuuauagcuaauaauaaagaaaaacaucaaauacucuugcuaaauugcaaucaguaugcaguuuaugccaaacuuagcuugauuuuauuuuuugaagaggaugaguauguauauuuaagcauauguguguguguguauauguauauauacuuguguauacguauauacguguauacguauauauauguguacauauacguguauacguauauauauguguacauauacguguguguauguguguguguauauauauauauuuuuuuuuuuuucucuuuugagacugagucucacucugucguccgggccagagugcaguagcgccaucucggcucacugcaaccgccgccuccuaguucaagugauucuugugccucggccucuggaguaguugggaguaccagcaugcgccacugugcucagcuaauuuuuguauuuuuaguagagacgggguuucaccauguuggucaggcuguucucgaacuccuggccuugugaucugccccccuuggccucugaaaguguugagauugcaggugagagccacuaugucuggccauauuuaagcauauuuaugauaguaucuuaaauuuaagugaagggaaagaggaaaacauacacagccaaugaaguaaguuugaaguggagugaaaggaaaaguuggagguaaaaagagguuagagaggugggcaggggccaaaucauauagggccuuuaggacaugggaaauucuuuggauuuguucugagauuagaagucauuuagauauucuuuagaaagggaaugacaugaucugauauuaaaaaaaaaacuagaaucacugugaguaggaguagaucuaauuccauucugacuaaauaguaaacuaauaugauaauuuggacaaauauaaaaaggaauuccuggcugggagcaguggcugaugccuguaaucccagcacuuuggaagugcugggcagguggaucacuugaggucaggaguuugagaccagccuggccacauggugaaacccugucucuacuaaaaauacaaaacauuagcugggcguggcagcaggcgccuauaaucccggcuauucaggaggcugagauaggagaaucacuuuaaccugggaggcggagguugcugugagcagagaucgagccauugcacuccagccugggagacggugcaagacucaaaaaaaaaaaaaaaaaaaaaaaaacggaaaggauuucauaauauuaauuuccuugacuuagugacuucugccuauuuuauuugaagucauugguucuucucuucucuucucuugagacagggucucacugucacccaggcuggagugcagugagugaucuuuguucacuucaaccuuuguuucccagguucaagcgauucucgugccucagucucuagaguagcugggacuacaggugugugugugugaccaugcccgacuaauuuuuguauuuuuaguaaagacgggaucucaccauguuggccaggauggccuugaucucuugaccucgugaccccgugacccacccaccuuggccucccaagguguugggauuacaagcaugagccacuaaggauuuguuuuuaaaauuuuuuugcuuuauuuuuuucuucucuuuuuuuguacuagagauggugucuugcuauguugcccagacagaucuuguacuccugggcucaaguuguccuccugccucagccucccaaagugcugggauuaaagaugugagucaagcgauucucgugccucaaccuacccacuagcucgauuacaggugccauccaccaccugcccaccacccuuggcuaauuuuuguauuuuguauuuuaguagagacaagaauuuuaccaugucggccaggcuggucucaaauuccugaccucaggcaauccacccgccucagcuuccugcugggauuacgggcgugagcuacccuggccaagauuuuuaauuucugaagcuuauagcugcucuaaagcacaaggauucagucccaugauuuaaaaaaguugcuuguuuugacuucaaguauaugguugagcauucuaacuuuuguuauguauacauuuuuauuuuacuguauucuucuagccauuguauccuagucuguauguugcagaugaguugugauucucuggugucucuuccauggaccuagagaucauaugcucuacuacugggauuuuuuuuuguaacuuuguuugggauauaggcuuugagagguuaaggaaguaaauuuaagauggauauuuaauguuguaacacuuuguuaaugcuuuuuucuacaagauaauuuuauuaugugauauggcagcuuuguuggaaauaccuguuuuuuuguguguguggaaaauuucuuuucuggaugaaaucucuuguuuaacuuuuccaguuauucauaaugaagcucuguuuaucuuuugaagaucuuaaguucagaaacagaaggcaggcugcguaugguggcucaugccaguuaucccagcacuuugggaggccgaggugggugggucaccugaggucaggaguucgaaaccagucugaccaacauggugaaaccccaucucuacuaaaaauacaaaaaucagccgaguguauuagugagugccuguaaucccagcuacucggaaggcugaagcaggagaaucccucgaacuugagaggcgcagguugcagugagccaagauugcugcacuccagcccgggcaacagagcgaaacuccgucucaaacauacacacaaaaaaaagaaggaaagaaaaggcaguagaguaucuuauuuaagagcauggauucuggagagaaacugacaguuaaauacuagcucugacacuugauggcuugagacccuuggcaguaguaugucuccuuuguaauucaguuuuuuucuucuguagaaagggaaugguaaggaagcgccaugagauuucagugagagagaagcacuuaccucaagugccagacauguagcccuucaacuaacuuauuuuauuuauuuauuuuuugagauggaguuuugcucuuguugcccaggcuggagugcaauggcgugaucccagcucacugcaaccuccaccuccuggauucaagugauucuccugccucagccuccccauuaguugggguuuacaggcaugucaccaugcccagcuaauuuuuuuuuuuuuuuuuuuuuuuuugagacacagucucgcucugucacccaggcuggagugcaguggcgcgaucucggcucacugcaaccuccgcccuccgaguucaagcaguucuccuuccucagccuccugaguagcugagacuacaggugcccgccaccacgcccggcuagguguuuuuuuuuuuuguauuuuuaguagagacaggguuuuaccguguuagccaggauggucccgaucuccugaccucaggugaucugccugccuccgccucccaaaguguugggauuauaggugugagccaccgcgccuggccuacuuuuuuuauuauuuuuuuuuuuggagacaagagucucgcucugucgcccaggcuggagugcaguggcgugaucucggcucacugcaaacucugccucccggguucaugcgguucuccugccuuagccucccagguaaacugggacuacaggugcaugcugccacgccuggcuaauuuuuuuuuuuuuuuguauuuuaguagagacgggguuuaaccauguugcccaggcuggucuccaucuccugagcucaggcaaucugccugccuuggccucccaaagugcuaggauuacagccgugagccaccgugccuggccuucuggccuuuuuuuuuuuuuuuuuuuuuuuuuuugagacggagucuugcucuguugucuaagcuggaguguaguggcacaaucucggcucacugcaaucucugccuaccagggugcaagcgauucuccugccucagccucccaaguagcugggacuacaggugcgugccaccaugcccggcuaauuuuguguguguguguguguguguguguuuuacuagagacgggguuuuacuuuguuggccaggcuggucuugaacuccugaccuugugauccaccugccuuggcuucccaaaguacugggauuacgggugugagccacugcgccuggcuuuuuuuuggagagauaaggucuuguuuugucaucuaggcuggagugcaguggcacagucauagcucaugguggccuccaacuuuuggugucaagguauccuuacgccucguccucccuaguagcugggacuacagguguaugugccacugcgcccagcuaauauuuuuacauuuuguagagauggagucuugcugucuugcccagguugggucucagacuccugggcucaaacaguccucccaccucagacucccaaagugcugcaaguacgggcaugagccacugaguccagcuaucuucaacuuucacuauucagguuacaguuuguaguaccuuuuuucggggguggugggaggguagugggaguagcacccuaagauuucuuggaauaaaacagggcuuacuacuugguuccugguacuuaagaacagugguuccuagacuccacuguucccaaacuuggaauccaguuccccaaauuggaaucaccugagguuuaauuaccuucauggagguuuaauuugcauacaauaaaaugcacauacuuuaaaugauaguuugauaauuuuuuuguucuuauuuuuuuuagacauagggccuuguucugucacccagcugaagugcagugucggaaucauggcuuacuacauccucgaccuccuaggcccaagaauucucugcuuuagccucccgaguagcugggacugcaggugugcaccaccacgccuggcuacauuuuuauuuuguaauuuuuuuuuuuguagagagaggggucucacuaugugcucagacuggucuugaacuccuggccuuaagugauucucucgucucaaccucacaaagcccugggauuauaggcaugagccaccacaaaccgccaguuugauaaauuuugaugaauguguauacccaaguaauugccacucagucgaguuaaagagcauuuccucaaggcuuuaaauuuuuauuuuuauuuuugagacggagucuuauucugucaucuaggagugcagugccgcaaucuuggcucacugcagccucugccucccggguucaagugauuccccugccucagccuccugaguagcugggacuacaggugcgugccaccacacccagcuaacuuuuuguauuuuuaguagagaugggguuucacucuguuagccaggauggucucgaucugaucuugugauccgccugccucugcuucccaaaguguugggauuacaggcgugagccaccgcgcucggcggguuucuuuuuuuuuuuuuuuaugagauggaaucucgcucuguugcccaggcugcagugcaguggcacgaucucaacucacugcaaccuccgccucucggguucaagcgauucuucugcuucagccucccgaguagcuggaacuacaggcacccgccaccacgcccggcuaauuuuuuguguuuuuaguggauacgggguuucgccauguuggccaggcuggucucaaaggccugaccuugugauccuccugccucggucucccaaagugcuggaauuacaggugugagccacugcuccuggccuaaaguuuuuuagacuaguuuuuuuguucauucguuuuauuugcuuggcuuccuagaauaugacaaguuuugguuuguuuuugagacagagucuugaucuguuucccaggcuggagugcaguggugcuaucguggcucacugcagccucuaacucuugugcccaaguaauacuccugccucagccucaugagcaucugggacuacaggcaagcaccaccauaccuaguuaauuaauuuaauuuuuauagagaugacguuuugccauguuguccaggcuggucucuaacuccugagcucuggccucgcaaaguggugggauuauaggugugaaccacugcacccggccuaguuuuuuauuuuaagaaauauauauacuugguaaaaguaaacuccugcaauaagguuuacaauaagcauauauaaauucuuagccagcucacugggagguaccuaaugguucauuuuucuuugucaguuuuacuagauacgcauugucuuagaggcaauguaaguuuggaauuaggccaaacaaagucaaauccugauucugugcauccauugaagguuaaccuuauaauauuuacauuuugagauaaaugauuucaugcucuuauuuaggaaacuugacgguauguuaccucagggauuguuccuugccugucuuuccccaaagaacuugaguuugaagugauuuucacuuggcaguaaauugaagguuuucuucauugcuuaccaccaugugccuuauuccugcugcucuugaucuccaagugcccuuacugcuacagaaaggaaagcucuugaacuaagagcuuggcagccacuugaucaggauggccaaauaauggcaguacagguugagcaucugaaaugcuucaagaugggcgcuggcaugacauucaaaggaaaugccuaguggugccuuucagacuuucaauuuuuggauuugggauacugaaccaguaaguauaaugcagauauuccaaaaucugaagaaauucugaaaucugaaacacuucugggcccaagcauuuuggauaagcaguacucaaccuauaccaggcucaaguucauuauggacagauggauggaugguaguuuggcccuuucaucaggaauuucccaugcagucaguaaacaaaauaaacagcucuauguuuucaacuucauuuccccaauuuuuuuuuuuuuuuuuugagacagaguuucauucuugucgcccaggcuggagugcaguggcccgaucuccacucacugcaaccuuugccucccagagguuucgccauguugcccaggcuggugucaaacucuugggcucaagugauccauccgccauggccucccaaagugcugggauuauaggcauaagcuaccuugccuguccguuuucauauuuuuuugagagaugaggucucacuguauugcccagacuggucuccaccucuuggcuucaagcaguccuccugccucccaaagugcugggauugcaguugugagccaccacaccuggucaggaguuuuacauacuaugcguuguuacuuguaggucuuguuuggaaagaaguaacuuccuaaggucaauucagaaaagaaggguaguaacuuagaggaaguaaauuugaaggcccuagugucuaauauuaguaauuugggcuuuugaaaguuuccuuucuaaaagguaggaaauuaacucuuuuuuuuuuuuuuuuuuuugagacggagucucugucgcccaggcuggagugcaguggugcaaucucagcucacugcaaguucugccucccggguucacgccauucuccugccucagccucccgaauagcugggacuacaggcgcccgccacuaugcccggcuaauuuuuuuguauuuuuaguagagacgggauuucaccguguuagccaggauggucuugaucuccugaccucgugauccgcccgccucggccucccaaagugcuggaauuacaggcgugagccaccgugcccggcuggaaauuaacccuuuuauauaccauccccccaccucaccuuuuuggcuacaaucuugcucugucacccaggcuggagugcaguggcaugaucauagcucacugcagccuugaacuccugggcucaagggauccagcuaccucagccuccugaguagcuaggauuacagacgcauggcaccaaguccugauacagucuucucuguaccagaacaaaguauucagugauucaagcucacauaggcaugaaacagcacugaaagacgaagugcuguaggaguucagggauaaagaagaauuuagaguagccaggaagccacugaggccucugguggugaggguguaacucuuggccuuuaaaaugagguuuaggggaaauguuaugaguagugggaaucaacccuuggccugaacacagauaaucuuguuuuaucuccuuauagaaacaggagguggugggggguggccaguuuugguuagacuagggaagauguugggggagaggggggcaguaugcuucuguaguuucguuuuuuuuguuuuuuuuuuuuuuugagauggagucucgcucugucacccaggcuggagugcaguggcgcggucucggcucacugcaagcuccgccucccggguucaagcgauucuccugccucagccucccgaguagcugggauuacaagcacgugccaccaugcccagcuaauuuuuuuguauuuuuaguagagacggguuucaccuuguuggucaggcuggucucgaacuccugauucgcccaccucggccucccaacgugcugggauuacaggcgugagccaccgugcccagccguuucuguaguuucuugaguucagauuccaagauggauuuuugcauauguauugcuuuauuucuuacccccuugauguaaucuacuauauaaaucuuuuaaagucccuacauuuaaaaauuuaucuuguucgaaaacauaauaguuuuauuugguaaauucaaacagugcaaaaggauauauggccccuagagguaccuguuguguuucuuguagaccagugcauguaaucccagcacuuggggcagcugaggggagcccaggaguucuaggccgcagugagucaugaucacuccacugcacuccagcacugcagccugagugacaaagcaagacccuuucugggggaaaaaaaaaaaaaagcuccuguguacuauucuagagacagucuauacauauaccagugucuauuggugaauauuguacaccucugucaagcccuguuuuguauaucuauguaucccgccauuacacuaugguaugauagcauaugacauauuuggcacaucacuuuuuucauuuaauaaucuugucucagagaucauuuguuaacacacuuuuuuuuuuuuugagacagagucucgcucugucgcccaggcugcagugcaguggugcgaucucggcucacugcaagcuccgccucccagguucacgucauucucuugccucagccucccgaguagcugggacuacaggugcccgccgccacgcccagcuaaguuuuuguaguuuuuaguagagacgggguuucacugugucagccaggguggucuugaucuccugaccucgugaucugccugccucggccucccagagugcugggauuacaggcaugagccaccgugcccagccuuuuuuuuuuuuuuuuuuuuuuuuuuuuuuuuugagacggagucuugcucugucacgcaggcuggagugcaguggcacagucucagcuaacugcaaccucugccucccgaggcagcaauucuccugucucagucucccaaauaacugggauuacaggcgugagccaccaguauuaaagcccuguaauaauacuguaauacucagacagcaaaauucuuuuuuuuuuuuuuuuuuuuuuuuuuuuuuuugagacggagucucgcugugucgcucaggcuggagugcaguggcauaaucucggcucacugcaagcucugccucccggguucacgccguucuccugccucagccuccagaguagcuaggacuacaggugcccgccaccacgaccagcuaauuuuuuguauuucuuuuuuuuuuucuuuuaguagagacgggguuucaugguguuuuagccaggauggucucgaucuccugaccucgugauccacccgccuuggccucccaaagugcugggauuacaggcgugagccaccgcgcccugccagcaaaauucuuuaagcccccacuggggcuuaacaucuauugaugcuacugccuacccuuucacugcuccuuaccuuuaguuuaucacuguaauuacccccuuuuauguauucuccauuucuuguucugucucucauuuuauguuaccuggcaaaaucucagcccugguuuagaucuuacuuuuuuuuuuugacaaagucuugcucuguuacccaggguggagugcaguggugcgaucucaaggcucacagcaaccuccgccuucuggguucaagcaauucucgugucucagccuccugaguagaugggaccacaggagcgcgccaccacacuuggcuacuuuaguagagaugggguuucaccguguuggccgggguggucucaaacuccugaccucaagugaucugcccaccucagccucccaaagugcugggacuauaggugugagccaccacgccuagccuaaauccuacucuuuaccuauucugugcuuuugacugaauguagcgaaagaaaaaauucacugacuugucucucuuugaacucauggacccuugaccucaaagguggcugcuuuuagcacugccuagcagucccgcuaagauuccuuaguccguuuauucuccugcuuuuaggauaauauagcaccauguccuuuggcucaaaucuccuguucccuuuccuugccucuaucagcuguuaugaucuugcuucuuacuuauuuuucuauuccuguggaucagucccuugggaguccauuguucuaucuaaggucagcccuuccacuugcaagcgaaaucucguuccccucuaaucucguaauguugcucuagcaguucucugcucuccugcaucaucauuuucugcauacagucuguuggucagaucuuaauaccccaccuagcugcagugaaugcugggaaauguagucuuuauaacuggcagccaugugacuaugaaggggaaagcuauugaggcagauaagcaggcagucucugccauacuuucaacgcuuauuuuuuuuaaaaaaacaaaaaccaacucuuuugguaacaauuuuacugagauauaauucauauaucacaccauucauuugaaaugaacaguuugguggguuuuaguauauucacagaguuuuacguguaucacuacagucaauuuuagaacauuauuaucaccucaaaaagaaacccuauguucuucaacugucaucuucaaucucccuaucaccacgcccagccuuagguaaccacuaaucuacuuugugucucuauagauuugccuauucuggauauuucguguaauggaaucauauauugucuuuugugacuggcuucuuucauuuaugcaauguuuuaaagguucauccauguuguaacauuuauuuucugacuuuuuuuuuuuuuuuuuuugagacaggauuuugcucugucacccaggcuggagugcagugucucgaucacuacucacugccacuuugcccuccugggcccaagcgauccugccaccucagccugcagaguaggugggaccacagguauaugcuaccacgccuggguaauauuuuuauuuuuuguagagacaagcucucaccauguugaccaggccagucuugaacuccugggcucaagugauccucccaccucagccucccaaagugcugggauuauaggcaugagccaccaagcccaggcugacuacuuuaaaaaaauuuuuuuuaguaaagauguggucucacuauguugcccgggcugguguugaacucgugcuuaagcaguucucccaccucagccucccagagugcugauaacugcacccggccugacuuuuuuugugugugauguuuugcucuuguugcccagucuggagagcagugguacgauuuuggcucacugacaccuccaccucccagguucaagcgauucuccugccucagccucccgaguagcugggauuacagacgugugccaucauguccggcuaauuuuuguauuuuuaguagagguaagguuucacuauguuggccaggcuggucucgaacugcugaccucgugauccgcccaccuuggcuuccaaaguacugggauuacaggugcgagccaccgcgcccaacuaauuuuuuguauuuuuaguagagucagggucucaccauguuggccaggcuggucucuaacuccugaucucaaaugauccauccuccucagccucccaaagugcugggauuacaggcgugagccaccaggccuggccccgggcugacuucuugaaagaacauuuuccaccacauaucucagugcccacguuuucucaauucacugccaucuacucuugccuguggcuauaugaaaagguuuucuccuguugcuggacaccuccucauagaccuguguucuuuuugcaagcauguaguuuggacucuuuucuuguaauguguucuuccuuuuuucuugguguucauuaucaucauaccuuuuugagcauuucaguuauuucuggcuucuucaugaccaccacuuccuuuguguugguggcacucuuuggcuagaucacugccccucuccauuccauacacuggaagacuaugcuguuuuuaccuguaauaacagcuuaccugggcacugauauuuuucagcugacuguggggaaauguuugugagguuuggaaaacgccuccuuagauugugcccauuccaccuccccuuccauuaggguucuuucuuuugggcacccucauacccuugccauaguuuucucaucccuauccaguuaaccacucaaucacuuuucgugcccugccaaggcucuguuucuuccucuucuuuuuuuuuggagacagagucucgcucuguugcccaggcuagagugcaguggugugaucuuggcucacugcaaccuccgccuccuggguucaagcgauucuccuaccucagccucccgaguagcugaaauuauaggcgcccaccaccacgccuggcuaauuuuuguauuuuuaguagagaugggguuucaccauguuggcuaggcuggucuugaacuccugaccucaggugaucugcaccccucucagucucccaaagugccgggauuacaggugugaacagccgugcccggccaggcuuuguuucucuauuaauuacagaccugauugugcugguccaguggcuuucccuuccuuacagaauagaaugcagauugcucugcaugacauaccauauccucuggucuaaccaucgccccaucuuuccacccuuauuuucaaaaaucuccuuucugaauucuuuuuuuuuuuuugagacggagucuugcacugucguccaggcuggagugccguggugcgaucucggcucacugcaagcuccgccucccggguucacgucauucuccugccucagccucccgaguagcugggacuacaggugccugccaccacacccggcuguuuuuuuuuguauuuuuaguagagacaugauuucaccguguuagccaagauggucucgaucuccugaccucgugaucugcccgccucggccucccaaagugcugggauuacaagcgugagccaccgcgcccgaccgccaaauucuuguguuacuggucauugagguuauuugcucaagcuguuuccucaccuuagaaaguauuccugaaccaucguuaccgcucuuuccaggggacuuguccuccuucuucaagguccauccaggucagauaucaucuuaucugaagcucucuggcagaaucacuugccuuuucucugaguucauaccagagaagauaagcuuuuguuacagcacuuaauuacauugugcuguuuucccugaguguuuuccagauaaagcuguaucucuaguagcuagaacaaggaauggcccauagaagacagugguuuguggccggaugcaguggcucacgccugaaaucccagcauuuugggaggccgaggcagguagaucacuugaggugaagaguuugagaccaguuuggccaauauggucaaaccccaucucuacuaaaauuacaaaaauuagcugggcaugguugugcgcaccuguaauucuaguuacucaugaggcugaugcaggagaauugguggaacccgggagguggagguugcauugagccaagaucaugccacugcacuucagccugggcaacagagagagacucuaucucagaaaaacaaaaacaaaaaagugguuuguaugagaccagucggggcaauaagaauugagacaaggagcuggaugcaguggcucacgccuguaauccuagcacuucgggaggcugaggcaggcagaucgcgaggucaggaguucgagaccagccugaccaacauggugaaucccugucucuacuaaaaauacaaaaauuaggccgggggcgguggcucacaccuguaaucccagcacuuugggaggcugaggcaggcagaucacgaggucaggagauugagaccauccuggcuaacacggugaaacccugucucuaauaaaaaauaaaaaaauuagccaggcguguuggcgggugccuguaguccuagcuacuugggaggcugaggcaggagaauggcgugaacccgggagguggagcuugcagugagccgagaucaugccacagcacuccagccugggcaacagaggagacuccaucucaaaaaaaaaaaaauuagccaggcguaguggugcaugccuguaaucccagcuacucaggaggcugagacaggagaacugcuugaacccgggaggcggagguugcagugagccgagauugcaccacugcacuccagccugggcgacagagcgagauucugucacacacacacacacacacacacacacacacacacacacacacacacacacacagagagagaauuugagacaagggaccugugguccuaacuguucuugaggcugagccucuuaaaaaaaaaaaaaaaaaaaaaagccagugcaguggccuacaccuguaaucugagcacuuugggaggccaaggcagguagaucgcuugaucccaggaguuggagacccgucuggcccauaugauggaaccccaucucuacagcaauuagccaaacgugguggugugugccuguggucucagcuacuugggauacugaggugggagaacugauugagccugggagguugaggcugcagugagccauaauuacgucacugcacuccagucugggugacagaggcagacccucucuggaaaaaaaaguugacacaaggccacugggccuggcaaggagaagaucaccauuauacugcaguaguagguggcagagugacuaagaaggaagcguaaaagauggaugggagcacuuagaauuuaucuuuaaaauaccugauuuuuuuauuuuuugagacagagucuugcucuguugccgaggcuggaguggcgcgaucuuggcucacugcagccuccgccucccagguuccagcgauucuccugccucagccucucagguagcugggauuacaggcacgcucaccaugccuggguaauuuuuguauuuuuaguagagacgggguuugaccauguuggccaggcuggucuugaacuccugaccucagcugaucuaccccccuugaccucccaaagugcuaggauuacagaagugagccaucacgccuggccucuaaaagaccugauguuuguggugaccauuuucuggaaaaauuugugacauuaaauuguggauaugucuucuuugaccaauccagcagcugugggagacauguuuagaacagcguugucuuucugugaugguggacgugcuguauaucugcacuguccaguaccauagcucccagccacauguggcuauugagcauugaauauggucaguguggccaaggaacugaauuugaaaaugaaaaauuuuaggccaagugcaguaguucacaccuguaaucccagcacuuguggaaggcugaggcaggcagaugacuugagcucaggaguuugagaccagucuggguaacauggcaagaccugucuuuuauucaauacuuuaaaauuuuuacuuacuugauaaaaaggaagaauauuuuaaaauuuaaacaucaguuuuuuguuguucuuguuuuugacacagggacucacucuggcacccaggcuggagagcaaugguaugaucauggcucacuguagacuuuaccuacuggcugaagcuguccucucaccucaguuucccacccuuacccacccaguagcugggauuacagacacucaccaacacgccuggcuaauuuuuauuauuuguagaaaugaggucucacuguauugcccaggcuggucucgagcuccuggccucagacauccugggauuacaggugggagucacugugccugaccagcauuguuuuuuuguuuuuguuuguuuuuuuaaagauaaauuaauuggccaugugugguggcucacgccuguaaucccagcacuuugcgggggcugaggcugguggaucacuugagauaggaguucgagaccagccuggccaauaaggcaaaacccugucucuacuaaaaauacggaaaugagccgaacauagugguggaugccuauaaucccagcuacuugggaggcugaggcgggagaaucacuugaaccugggaggcaggauuguagugagcugagaucgugccauuacacuccagucugggggacaagaucgaaacgcugucucaaaaaaaaaaaaaaaaaaaaaagauaaauuaauuaggccgggcacaguggcucacgccuguaaucccagcacuuugggaggcugaggugggcggaucaccugagguugggaaguucagaccagccugaccaacauggagaaaccccgucucuacuaaaaauacaaaauuacccgggcaugguggugcaugccuguaaucccagcuaccggggaggcggagguuguagugaguugagaucgcgccauugcacuccagccugggcaacaagagcgaaacucugucuuaaaaaaagaaagucacaauguggcuaguagcuaccacguugggcagugaagcugugacauuaccaguuguaggauugaaugcaauccagacuuuuugucuguuguguucacacuugaagcagugacucugcugccuaaguauguauaauuuuuacuuuuuuuuuuuuuuuugacggauucucacucugucgcucaaguuggagugcaguggugugaucuuggcucacugcagccucugucuccuggguucaacugaucuuccugccucagccucccuaguagcuggaacuacacguguguacuaccacaccuggcuaauuuuuguauuucuuuuuuuuuuuuuuugagacggcguugcucugucacccagacuggagugcaguggugcgaucucggcucacugcaaccucugccucccggguacaagcgguucuccugccucauccucccaaguagcugggacuacaggugcaugccaccacgccuggcuaguuuuuuguauuuuuaguagagacgggguuucaccguguuagccaggguggucucgaucuccugaccucgugauccuccugccucagccucccaaagugcugggauuacaggcaugagccacugcauccagccuaauuuuuguauuuuuaguagagacgggguuucaccacguuggccaggcuggucucgaacuccugaccucaaguaaucugcccgccucagcuucccagaaugcugagauuauaggggagagccaccacaccuggccccguacucuuuuauauuaauauccaugacgccuuuuaccuuuucugaaauagauuuuuucaguuucucuacugucacucuaucaaaauuuguaaauuuuccuuggaauauuagacagaggauuaagccacguguuuuuccaguccaacuuuuguuacaucuguauuuuccuuuuacauguugacugguucaaacuggcuagcaucccaaguaaggugugaauuaaauccugacauggggcugggcgugguggcucauaccuguaauaccagcacuuugagaggccaaggcaggcgaauuaccuguggucaggaguucaagacuagucuggccaacauggugaacccgucucuacaaaaaauacaaaaauuaaggcugggugcaguggcucacgccuguaaucccagcauuuugggaggccgaggcagguggaucacaaggucaggaguucaagaccagccuggccaagauguuccccgucucuacuaaaacuacaaaaauuagcugggcgugguggcgggugccuguagucccagcuacucagaaggcugggacacaagaaucgcuugaacccgggagguggaggcugcagugagcugagauugugccacugcauuccagccugggugacagagugagacuccaucuuaaagaaaaaaaaaaaauuccugacaacggacugucaaagcuauuugcuucucacagucuguggguauuauagauggacggggacccgccaauaaaggaggggaaggcuccuuuugugaaacugauuugcuucugucuucuaaaucaguauguguacuugggccuacuaaucaagucuuacuguuuugucuguaacuuuuuuuuuuuuuuuuuuuuugagguggagucucacucuguugcccaggcuggagugcaguggcaccaucucggcucacugcaagcuccaccuccuggguucaugccauuuuucugccucagccucccaaguagcugggacuacaggcaccugccaccacgcccggcuaauuuuuugugugugugguagagacugggauucacuguguuaggauggugucaauauccugaccucgugauccgccugccucggccucccaaagugcugggauuacaggcguaagccaccgcgcccggcuucuguaacuuuuauuuauuguaaguuguuagcuauuggaauucuggacagaacagagcuccugagucuguucacugcuguaagaaguaagaagugucaugacucuuuuucagcagaggaauuagucuauuaaugacauguggcuggaaauagaccugccgcucagaaccuguucuggaguuaaguccuuccaagaugggccuagggaaucugagaagcacagcagguuccucucagcaagugcugcugaaccccaaacuaagcucacacauucuucuuggguucugccuggagagucccuauuagccucaucccuaagcaaccacuaugcuccuuuuuuuuuuuggagauggagucucgcuuugucgcccaggcuggagcgcaaugucacaaucuucacucacugcaagcucagccccccgaguagcugggauuacagguggacgccaccaggccuggcugauuuuuuuuuuuguauuuuuguagagaugggguuucaccagguuggccagguuggucuugaacuccugacuucagguguuccacccgccucggccucccaaagugcugggauuacaggcgugagcuaccacgcccagcagcugcuuucugucucuguagauuuaccuauucuggauauuucauacaaauaugguaugaaacaugugguucuuugugacugguuucuuuuacugagcauaguauuuucaagauucauccauguuguagcauguuucaguacaguacuguacuucguuccuuauuguugcugaguaguacuccacuguauggcuauaacacaugguuagauauguagcuuagauaggauuguuuuguuaauuaaaagcuaaugaacaaagauuucaaagugugagauauuagucauuaguaggcuggccauugaacagcuccacauuucaaaaugugagauacuaaauuaguuauuagugggcuggcccauugaacagcuccagaaggccuucaggaaguuguccagacaaaugugaguaagcaucauggucacacaaaugugagaaaauuaccaaagacugcuaugugaaaugcggagaguugcucauuaaugcaugguuuuaauuuaccuacugaagcauagucaguagccacuguagcaucugaagaacauaugauggacacaccacucccacacucagcacccagauaagcaaggcaggcagcaaugcagaugagcuauaguuaucccaggaaaucacuuugacuuguaaagugugaaaaggacuggccuucaccuaucauucuuucuauagcagagcucccuaaagcucagaaagccacagcuggcuggaugucauggcuccaccuauuauaaucccaccacuuuggaagacagaggcgggugggucacuuaagcccaggaguucaucacugagcccaggaguuugagaccagccugggcaacauggcaaaaccccgucuccacacacacacccacacaaauagaaaaaaauuuagucgggaaugguggcacacaccuauagucccagcuacucgggaagcugaggugggagggucaccugagcccaggaguuugacgcugcagugagccuugaugacagcacugcacuccagccugggcaacagagugagaccuugucuccaggaaaaaaaaaaaaagagaaagccauccccuuccuugacaucaucuguaaugaguaaacagacauuaaaacaguaagaguaaacagguguaagacaugcuagaaccaaagaaccaagaguugaugauuucagagugacucaaacauaugugacauuguuauuauuucuuccucugguguguacagaaaaaagauacacacaucuaaaagaaauguaugcaaaaacaucauaaaagcauagaaaacaaacauaauaggguuuuuuuuuuuguuuuuuuuuuuugagaccuggagucucgcucugucccccgggcuggggugcaguggugugaucucacugcaaccucugcucccggguucacaccauucuccuaccucagccuccugaguagcuggaacuacaggugcccgccaccacgccuggcuaauuuuuuuuguauuuuuaguagagacgggguuucaccguguuagccaggauggucucuaugcugaccucgugaucugcccaccuugggccucccaaagugcugggauuacaggcaugagccaccgcgcccgacccuuuuuuuuuuuuucccccgagauggagucucgcucugucaccuaggcuggagugcaauggcacgaucucggcucauugcaaccucugcuucucagguucaagcaauuuuccugccucagccucccaaguagcugggacuacaggugcgugccaccaugccuggcuaauuuuuuguauuuuuaguagagaugggguuucaccauauuagccaggauggucucaauuuccugaccucaugauccgcccgccucggccucccaaagugcugggauuacaggugugagccaccacgcccggccuguuuuuuuuuuuuuuuuuuuuuuuuuuuuuuuuuuuuuuuuuuugagacggaguuucucucuuguugcccaggcuggaguggaauggcgugaucucggcucacugcaaccuccgccucccagguucaagcgguucuccugccucagccuccugaguagcugggauuacaggcacccgccaccaugccuggcuaauuuuuuuuuguauuuuuaguagagacgggauuuugccauguuggccagacuggucucgauuuccugacgucaggugauccauuugccucggccucccaaagugcugggauuacaggcgugagcugccacgcccggucauguaacaguuuuaaaaagcccauacggucauacugaauauagacauagacagaguuaaucaaauacaucagagacugaguuugugaaguuaaggaaaaauauucaaacuaguuaaucgcccuaaguugcauauuaauuaaucgagucuuucagugucaccaagguuugccugaguaggcaaaggagaauaauacgcuaaagcuguagaaucacuucucuugacacggggaaggaaggaggguaagacaguggaauguuuagaaauguguacucugaaacggauugcuuaauuuacuucaguguccaauucugccucuuacuggcuagcagugcgacugacguugaacaaauuagccuuuccauacucaguuucuucauuuguaaaugagaguauuagaacuuacaggaggacuguugcgaggauuguuuguuuaaaguuuauaacugcauuauuuguuagcuguuucuuauauuuuuccucuucuacaaaguaguggugggagacaaggcuucccuacauuuaguuugaugccugugguucuaaguauaaggagaaaacggaagggaggaaagaggaaguaaaaaaaugaaagaugaccuaaauaaauggaaaggcguccauguucauaugucagaagacuuaacauuguaaagaugacaguacuccccaaaucgaucuguagauucaguguaauuccuaucaaaauuccagcuggcuuuuuugcagaaauugacaaacuguuacuaaaauacauaccaaaauucaggggacccagaauaaccaaaauaaucuuggaaaaaaacaaagcuggaggacucacaccuccagauuuuaaaacuuacugcaaagcaacaguaaucaagacugugguacuaguauaaagguggacaauauagaccaauggaauaggauuaauccaaaguaaacccucaguugcuaauuaguugauuucucaagugugccaggaccauccaguuggggggaaaauagucuuuucaguaaauaaugcugaggugacuagauuuccaaaugaaaaagaaugaaguuggaccccuuaccucauaucauguaugaaaauuaacucaaaaugaaucaaaggccuaaaguguaagacuuaaaacuauagaaagaagcauauauauuuuuuuuacgaccuugaauuuggcugugguauuuuagauaugccaccaaaccaucaguaaccaaagggaaaaauagauaaauuugacuucaacaaaauaaaaaacguugugccccaaagggcaucaucaaaaaaauaaaaaaaacaacugaguuuaaaaaugggcaaugggggcugggugcgguggcucauugcuguaauccuagcacuuugggaggccgaggcaaguggaucaccugaggucaggaguuugagaccagccuggucaacaugguaaaaccccgucucuacuaaaaauaaaaaaauuagccaggcgugguggcagacgccucccagcuauuugggaggcugaggcaggagaauugcuugaaccugggaggcggagguugcagugagccaagaucgcgccacugcacuccagccugggcgacagaguaagacucugucucagaaaaaaaaaaaaaaagguaggggggcaauggaccaggcgcaguggcucaccccuguagucccaacacuuagggagccaacacgggagaaucacuugaggcuaggaguuugagacuagccagggcaacacagcaagacccugucucuacauaaaagauaauuaaauuuguuuuucccccgagacagucuugcugucacccagacuggagugcaguggugccaucucagcucacugcaaccuccgccucccagguucaaacaauucuccugccucagccucccgaguagcugggauuacaggugccugccaccacgcuaggcuaauuuuuguguucauaguagagaaugguuucaccauguuggccaggcugcugguuucgaacuccugaccucaagugaucugcccaucugagccucccaaaguacuuggauuacaggcgugagccacugcacccagccaagauaauuaaauuuuuagaaagugggggcaucacuugagcccaggaguuuaagaccauccugggcaacauggugaaacuccaucuuuacaaaaaaaacacaaaaauuagcugggcguggugugugugccuguacuccuagcuacuugggagacugaagugggaggauuaccugagccugggaggucaagguugugguaagccaugauaacaccaccucacuccagccuggaugacagugagacccugucucaaaaaaaaaaaauuaaaaguuguaaaagaaauacuguuauuuguguauuguuacuggugacuuaauuagauauaacugacuuuugguuaaauaaaccucuacuccaaacuuauaaguuauuucugagacuaaaccuagccuggaaaaugacacgucugggagagcuaagcgugauuuccuuucuugacaaaccauguacuuguaaagaaugcugcauuauagcaaaguggaaaggagagauaauucugcaaaauuucuccugcguuuuucaaggagaaaacagcaaguuugauuuucugugcuuguacuuuuuacuucucaacuucuguguauugccgcacucccaguaucccagaaaucacuuaggcuuucauuuuguccgauaaucacuuguaauuuuugucuuugucaccauuaguggcuaaaugauuuuauucuuuuucugggccaaauguucuuuaucagauauuuuucuuuuucuuuucuuucuuuuuucugagacacagucucacucugccgcccaggcuguaaugcaguagugcaaucucggcucacugcaaccuccaccucccagguucaagugauucucgugccucagccuuccaaguagcugggauuacaggcagaugccaccaugcccggcuaauuuuuguauuuucaguagagacgggguuuugccauguuugccaggcuggucucgaacuccugaccucaagugauccgccuaccucagccucccaaagugcugggauuaugggcgugagccaccgugccuggcuggacuagggucuuuaaacgugaauucccucccuauaagcaaagguggagacagagucuggacauucuaggaagggaaggcacaaacagaauagaagacacaugcaguaaucucagacacaccagagcacccggaaggaauggagugcaggcugaaagugcagaggggaagguggggcuggagagggcccaaggacaggcaaugauuuauuccccaucuauaaggaaacuuuucaaaccauaacagaagauuuaagucaauacuggaacaaauauugugggcauguugaacuauaaacaaagcaaagauagcucuuuuuuuuuuuuuuugagauggauucucgcucuauagaccaggcuggagugcaguggugugaucucagcucacugcaagcuccaccuuccggguucacgccauucuccugccucagccucccgaguagcugggacuacaggcgccugccaccaugcccggcuaauuuuuuguauuuuuaguagaaauguuagccgggauggucucgaucuccugaccucgugaucugcccgccucggccucccaaagugcuggaauuacaggcgugagccaccacaccuggccgaaagagauuauuucucaagaauugaaugucuucuagguagggugcuacgcaaagguggcagccuuuucuuuuucuuuuucuuuuuuuuuuucugauacgauggaguuuugcucuugucgcccaggcuggagugcaauggcgcuaacucggcucacugcaaccuuugccuccuguguucaagugauucuccugccucagcaucucaguaguugggauuacaggugcccaccaccacgcccaccuaauuuuuguauuuuuaguggauaugggguuacaccauguuggucaggcuugucucgaacuccugaccucaggugauccacccaccucucaaaguacugggauugcaggcaugaaccccagcacacucggccaaagcagccuuuucuugaacuggggaauuccuguugacguuucuuugcaucccauaggguccugguuguuugacuuugggcaaaagcccaugcagauuaggccuuaugagagauguaaaguuuauuaaaucuuuauuuggugagacagggucuuacugugucacucaggcuggaguguaguggcaugauuucagcucacugcaaccucugccuccuguacucaagugauccucccaucuuagccuccugaguagcugugaccacagaugcgcaccaccacagccagcuaauuuuuuguauuuuggguagagaugggguuucacuguguuguuuaggauggucuccaacucuuaggcucaagcaauuugccugccuuggcuucccaaagugcugggauuacaggugugagccaccacgcccagugucuauuuuuuuauuuuauuuauuuauuuauuuuugagacggagucucucucugucacccaggcuggagugcaguggcacgaucuuagcucacugcaagcuccaccuccuggguucaccccauucucaugccucagccuccugaguagcuggaacuacaggcgcccuucacgacgccuggcuaauuuuuuguauuuuuaguagagacgggauuucacuauguuagccaggauggucucgaucuccuuaccucgugaucugcccaccucagccucccaaagugcugggauuacaggugugagccaccaugcccggccaauauuuuuuuauuuuuaugagauagggucuugcuauuuugcccaagcuggucucaaacucuggacucuagcugucuucccaccucagccuccugaguagaugggauuacaggcaugaguugccacacuugacucuaacuggggaacuucacucucugucuuuuuuuuuuuugagacgaauuuucgcucuuguugccuaaacuggagugcaguggcacgaucucagcucacugcaacuuccuccucccggguucaagugauucuccugccucagccuccugaguagcugagauuacaggugcggaccaccaugcccggcuaauuuuucuauuuuuaguagagaugggguuucaccauguuggucaggcuggucucgaacuccugacaucgugauccacaggccucggccucccaaagugcugggauuacaggcgugagccaccaugccaauccuuuuuuuuuuuugacagagucucacuguguugcccaggcuggagugcaguggcgcguucucagcucacugcaaccuccgccugccuaauucaagugauucucaugccucagcauccugaguagccuuucagggguuacaggugccugccaccaacccagcuaacuuuuuuuuuuuuuuugagacgggguuuuucucuuguuucccaggcuggaaugcaauggcgagauaucggcuuacugcagccucugccuccugaguucaggagauucuccugccucagccucucgaguagccgggauuauggguacaugccacuacguccaacuuauuuuuauauuuuuuguagagacgggguuucacaauguuggccaggcuggucuugaacucuggaccucaagugauccgccuaccucagccucccaaagugcuggcauuacaggcaugagccauuacuccuagccuugacugcaugcucuuguuugaagauaugcauugagcacauuucccuaucaucgauaugcuucuuauugugcuuucaugauuaguaguaucuucaauuuacucccuuuuugcaaaaaaaaaaaaaguuacuagauuuuguagauuuggauaaaauucuauaauaucuguaucuauauauauacacacacacguauucacugcuguauguaauauuguccugagaauucacaaaugaguaauggcagcacugucagcccucugaguuuuuuuguuuuguuuucauuguuuauuuuugucguuguuugcccucugaguuuucuucugguaccccuguggauugucuuauccauucugguuggggaacauacccuuuagacaauauaguuuugauaaugaguauuuauuauuauuauuauuauuauuauuauuauuauuauuauuauuauuuuugagacaagagucucugucacccaggcuggagugcaguggcaugaucuuggcucacugcaaccuccaccucccagguucaagcgauucucuugccucaccccaccacgccuggguaauuuuaauauuuuuaauagagaugggguuucauauguuggccaggcuggucucaaacuccugaccucgugaucugcccgccucggccucccagugugcugggauuacaggcgugaaucaccaugcccagcugaguguauauaauuuaggauuaguuugacuauagguaacagagacuugaaaaauaccaccuuaaauaagacagucauuuauuucucauucauauggaagaaacauggaagguaggcagucuuggggcugagaugguggcucccaagaucaccugagauccaggcuccuuuuuaccuuuugguucuuccagccccacgguauggcauucauucucacauaccaggauggcugcuuagaaaccagcccuuacuuuagauuuaagcagcaggaaaggaggaggauaauaaagacuucccuuuaagaaagacuuucuggaagucccacaacauacugcugauucucacaucucaugguacauggccaugucuccaagggaagcuaggaaguguagucuacaacaaaguacauagcuaaaaaucgaaguauggucuaggagggaagggcgggaauugggaugguugaccaucacugucugccagauggaaggaaucugcagauuucucucuuuuuuccccccacugggggcgagaguggugguaacagcuuuauugaaauauaauccacauaucuuacaauucaccuuuuuaaagugugaauuauauauacugugggcugggugcgguggcucacgccuguaaucccaacacacugggagagacaggcaggaggaucgcuugaccucaggaguuugagagcagcuggggcaacguggugaaacccggucacuacuaaaaauacaaaaaauuagccgggugugguggcaugcaccuuuaguuccagcuacuugggagacugagauuggagguucacuugagccuggggaggcuaagguugcagugaguggagaucgcaccacuauacuccagccugggcaacagagugagacccugucucaaaauaaauaaaaugugugaauuauauauacuauaaucaauaguuuauaguauauucauagaguugugcagccaucaccacaauaauuuuggaaaaaucuuuuuaccugagaaacuccaguauuccauuagucauuuuccauuucucuccacccccaagucccugcccuaggcaacuaccagucuauuuucucuuucugaauuuguuuauucuggacaauuuuauauaaauggaaucaugcauguugguuuuugugacuggguucuuucacuuauauaacauuuccaagaucuauccauacuauagcauauaucaguacuuuauccuuuaucgcugaauaauauuccauuccauuguauggauauauuauauucaucaguuguuggauauuuggguucuuuacauuuuuugacaauauauuaugaauaauccugcuaugaauauucauguagagguacaaguuguuauguggacauauguuuuuguuucucuuagauauauaccuaggaauagaauugcagggucauaccuacucacauccuuugcucauuuuuuaauuggauuagauuauuugucuuuuuauuauugaauuguaagaguucuuuauuuuuuaauuuuuucuauauacuguauuuaggccuggggagguggcuuaugcuuguaaucccagcacuuugggaggcugaaucgggaggauugcaugagcccaggaguuugagaccagccuggguaauauagugaaacgcuaucuguauaaaaauuagucagcugugguggcaggagccugguagucccagcuacuggagagguugaggugggaggaucgcuugaguugagccugggaggcagaggcugcagugagccaauauugcaccacugcauuccagccuuggugacagaaugagacccuuucugaaaauaacuacauaauagagaaacacauagauagguuagauagguacauagauuggauagaugcguagauagaugggcaguggcucacgccuguaaucccucagcacugugggaggccgaggcgaguagaucacuugagcucaggaguuggagaccagccugggaaacauggcaaaacccugucucugccaaaaauacaaaaauuagcugggcgugguggcgcaugccuguggucccagcugcuggggaauuugaagugggaggaucacuugagccucggagguggagauugcauugagccaagaucacgccacugcauuccagccugggugacagagugagaccucaucucaaaaaaaaaaaaaaaaaaaaaaaagauagauggauagauaaauagcguacuucaugucagaaggaguucucucuuuuuuuuuuuuuuuuuuuuuaagacacaguuucacucuguugcccaggcuggagugcucuguugcccaggcuggagugcagugguacaaucugggcucacugcaacuucugccuccuggguucaagcgauucuccugccucagucucccgaguaacugggauuacaggugcccaccaccacacccggcuaaguuuugaauuuuuuguagaaacgggguuuugcuggguuggucaggcuggucucgaacuccugaccucaaguguucugcuugccucagccucccaaagugcugggauuacaggugugagcuaccgugcccagcccaaaaagaguucuuuaugauuucaaccuugcaagagauccugagccagaccaccaaccuaagcugcuuuuuuguaguugagucauaagaguuugagacaagguuccacucugucacccaggcuggagugcagugaugcaaucauagcucaccacauccuccaccuccugggcucaagcaauccucccaccucagccuccuugguagcugggacuacaggugcaugcuaccacaacuggcugauuuuuuuuuuuuucuuuuccuucuuuuuuuagagacagugucucacugggguuccccaggcuggaguguagugaugcaaucucagcucacugcagcuuccaccuccagggcucaggggauuaucccaccugagccucccaaguaacugugauuagcaugcaccaccgcuccuggcuaauuuuuuguauuuuuaguagagacaggguuucacuauguuucccaggcucgucuugaacuccuggacucucaagcaguccaccuguuucggccucccagauugcugggauuauaggcgugagccacugcgcccggcccuuuucuuucuccccuccccucucaugcuuccguccguccuuccuuucucagugucucacuauguugucagggcuggucucuuaacuccugggccugagcauuccuccugcuucagucucccaaaguguugggauuacagacaugaaccacugugcucggccucaauugauuuuucuuuuuugagacggaguuucgcucuuguugcccaggcuggagugcaauggcaugaucucggcucaccacaaccucugccucccggguucaagcgauucuccugccucuugcuccuguguagcuaggauuauaggcaugugccaccacgccuggcuaauuuuguauuuuugguagagaugggguuucuccauguuggccaggcuggucucaaacuccugaccucaggugaucugccugccucggccucccaaaaugcugggauuauaggcgugagccaccgcgcccagccaagaaugcuguuucuuuacaaacaaaucuagauugguaaaagaaggaauauccaaacuuagaaagauugcagaaugucuacccaaacaaccugccgaugacuuuuuugguucuuuccucccuuggguacucccuuucaucaguccuuucauuguuuuuacccugcuugacaaauuguuuccuuuuuuuuuuuuuuuuuuuuugugagauggagucuuacucugucccccaggcuggugugcaguggcccgaucuuggcucacugcaagcucugucuccuggguucacgccauucuccugccucagccucccaaguagcugggacuacaggugccugccaccaugcccggcuaguuauuuguauuuuuaguagagaugggguuucuccguguuagccaggauggucucgaucuccugaccucgugauccacccgccucggccucccaaagugcugggauuauaggcgugagccacugcgccuggcucaauugauuuuuuaauguuaauauuguauccugcaaccuuacugaacuuguuuauucuaaaaguuuucuuuaggauuucccacauuacaaaaucaucucaugugugaauugagauaguuuuacuucuuccuuuccaauuuggaugucuuuuauuucauuuucuuaccuuauugcccuggcuaggaccuccaguauccugcuggauagaaguagcaagaacaggccaggcgugguggcucacgccuguaaucccagcacuuugggaggcugaggcagguggaucaccugaggucaggaguucaagaccagccuggccaacaaggugaaaccccaucucuaucaaaaauuagcuggauguggugguacgugccuguaaucccagcuacuugggagucugaggcaggagaauugcuugaacccgggaggcuggagguugcagugaacugagauugggccagugcacuccagccugggcgacagagugagacuccgucucaaaaaaaaaaagaaguggcaagaacagacauucuugucuuguuccugaucuuagggggcagaccuuuuuuucagucuuuuaccauuaaguauaauguuaguuacgaguuuuuaauguauaaccuuuuggugccagguggaucggcguacuagaaguuugaauuugaguaugcuaauagagguuuaugccccaugguuaccaaagcaugugucauccuguaagcuaccuaugacuucuugugcauugcagguaauaucuguguuuuguguuucagcaauggcugccauccggaagaaacuggugauuguuggugauggagccuguggaaagacaugcuugcucauagucuucagcaaggaccaguucccagagguguaugugcccacaguguuugagaacuauguggcagauaucgagguggauggaaagcaggugaguauacuuuucauaacaacugaugccauuuuccauguuagaauauuuauggagcauguagagaauuagagcuuuuugccucuucaguauaccauauaacaaaaauguuggaaagaagaauccauucucauccugccaucuuaguccaaguuuguucuuuuuuuuuuuuuggagacggagucucauucuguugcccaggcuagagugcaguggcucggucuuggcucacugcaaccucugccucccagguucaagugauucuccugccucagccucccaaauagcagggauuacaggcauguugccaccaugcugagcucauuuuucguuuaguagagaugggguuucaccaggcuggucucaaacuucugaccucgggugauccacccaccucagccucccaaagugcugggauuacaggagugagccacugugcccagccuucccccagguuuaaaggauucuccugccucagccuccccaguagcugggauuacgggaauaugccaccacaccuggcugauuuuuguauuuuuaguagaaaugggguuucacuacguuggccaggcuggucaugaacuccugaccgcaggugauuggcuguuuuuucauuuuuaacugcuacucauccagacuuuguuuacauucauauguauuugacaugguguccuuagcauauguguuuuuuuuuuguuuuguuuuguuguuugagacagagucucgcucugucgcccaggcuggagugcagugguacaaucucagcucgcugcaaccuccaccucccggguucaagcaauucuuuugccucagccuccagaguagaguagcugggauuacaggcgcacgccgccaugccuggcuaauacuuguauuuuguaaagaugcaauuuugccauguuggccaggcuggucucaagcuccugaccucagaugauccaccugccucagccucccaaagugcugggauuacaggcgugagccaccuugcccagccauaugugcucuuuucaaguuuacguauauuugaaguuuaguucauugccauauagauaaugcucagaugaacuucuuuguaugcuuggacuuugacaaaaauucugucaaaguauuuaaucagaugucccaguauuagauuacuaguucaagcucugccuccuggguucacgcuguucuccugccucauccucccaaguagcugggacuacagguguccaccaccagacuggcuaauuuuuuguauuuuuaguagagacgggguuucaccguguuagccaggauggucucgaucuccugaucuugugaucugcccgucucggccucccaaagugcugggauuacaggcaugagccacugugcccggccaaaagauuuuuuuuuacuuuaacauaaaauagccugccacaguuguuuuauuuuauugucauugauggugagaacagugcuuccccauuucuguccuaaaagcccucuggcaagacuggaacaaagcucuugugaaauuggaggguuuuuuuggguuuuaauuuugguuuugguuuguuuuuguuuuuuuuuuuaaucuucugcuuccuuuuguugucuaaguaaugcuuugcuuggccucucauacuuuuuuuuuuuucucuuaaauaaagagacagggauuguacuuugucucccaggccugcagugcugugacaugaucaugcagccuugaacucuugggcucaagugauccuuccaccucagccucccaaauagcuggcacuguagguaugugccaccacaccuggguaauuuauguuuuuagagaugaggucuuguguugguccagcugguuucaaacaacugggcucaaguucuuccaucucagccccaaguggcugggcuuacaggcgcaagccagcgugcccagcucuccuauacaucuuuugaagugggucagcugaaaggaaaaaaccccuaaaacuagaaugaggugcucuucuccaacauucucauuuuucuugagcauucaguuauaugucucauaugcugcuaacacuugauauauuagcuuccauucauccccuuucuccuuucuuacuuuguuuuuguuuguuugucuagagacagagucucccucuaucacccagguuggagugcaauggcaugaucuugguuuacaacaaccuccgccuccugaguucaagcaauucuccuaucucagccucccgaggagcugggauuacaggugccugccaccaagcccagcuaaucuuuguauuuuuaguagagacgagguuucgccauguuggccaggcuggucucgaacuuuugacgucaggugauccgcccgccuuggccucccaaagugcugggauuacaugcaugagccaccgugccuggccacuucuacuuguccacauuacuuauuucuuucuguccuagggccaccuagccuccuuuuguggcacugugugaggaauguggguuagaucagcugcucagaacuccagggucccucauuguagggcuuccugauaguuguuugaccaucaguaagcuccugaccuuugagccuuccucauuuguaaaacgguuuuuauaggugacaucaagguucugugaaguaacggaaaauguuuggcagcaccaaagcgcuuucuaagagaugaauacugccauguucaaaacccucuuucauaguuuguaguccuuuuuuuuuuuuuuuuuuuugagacagagucucgcucugucgcccaggcuggagugcaguggcgugaucucugcuaacugcaaccucugccuccuggguucacgccauucuccugccucauccuccggaguagccgggacuacaggcgcccgccaccacgccuggcuaguuuuuuguauuuuuaguagagacaggguuucaccguguuagccaggauggucuggaucuccugaccucgugaucugccugccucccaaagugcugggauuacaggcgugagccacugcgcccguccuauaguuugugcucuuuuuuauucaaauacagagugagccacgaugauugcucuuaugcuaauaggaacucuaagauacuuucuggcccaaguauagauggaaaaaauacaacaaauaccagccuaacagaauuuugggauguacccugaagguggcaaaccaauacagaggguguuaauucagccucagccaagcauggaugcuuggacauagguguuuuugugguccugauaggaaaacugguuuuauauggacacagggcccaguugugacaaacuagguagaaaugugaugacaucuucaggauuggugucaaguuauagcccucuuaccuaacuuagauugaugcaccauacauagaaagauccauuggcuuggggaagcaaugucagguuggcauuuucauagcuuauuucucaaaagccuaguagugaauguauauuacugguuguauccuaacauuuucuccagagaguggcuguuaauugcugcaugucuguaagcaugaacuggaagggucuuuuccaucuguggcaguauguauguuuuggaagcagcucuuugguucucuuggaaacauuauuucugccugggcaucuuggaacaaccagaaucuugcccauaagaaauuuagagaccuugacuuaaaaccuugaggcauggucugugaguauuuuucuugugcugcaaaccuuggacaucacugacccucgcaagauagggggagguucucacuugaggagaguccccuggaauaaaaguguuugauugaagagcauauuacaggcuaccugccugccucagagcaacucaagaguccccaagaugggagaggguacuguguaggaauauucauuuaacaguaugcaauaguauaaggccagacgucguagcucacaccuguaauccagcacuuugggaggcugaggcaggaggaucaccagaggucaggaguuugagaccagccugcccaacauggcaaaacccaaucucuacuaaaaauacaaaaaauuagcugggcgugguggcaggcacuuguaaucccagcuacuugggaggcugaggcaggagaaucacuugaaccugggaggcagagguugcagugaacugagacugcgccacugcacucaagccugggcgacaagggcgaaacucugucucaaaaaaaaaaaaaaacaguaggcaauaguacagccuagggaaccauacaagauuguaggugaucaugguaccaagaguaggccugcucacaaugaaaaggccccuuuugauaugagacagacucaacaucuuggaagcauuuuaucaagcgccaauagaggcuggauauaugacuaaacaccgugggguggagggggccgggagagugggauuugccagggaguaaaugagcuccauuauugugagggcagacagauugugauaauugggcaucaguauaucuuaguuacacaugccagaaugaugguuugcaugacagaaguacagugggccuuguggagguuauuugugaugcauccuggggcaaaaguucggggguggaagagccaucaauuuuaaggaagaaaucauuuagaaacugaaauuugggcugugaaggugcuaagagaagaaagauguguuccaaguauuggagggagaccucuugggccucaaagggccucuguacagaggauguuuaacauggagucuggugauaagaaugggguagcagagcugggugcagugcugggcaguguugaaugggacuuguauucagagcccaggcaucaguuuacccuucuaccacaggagggugaggauguacccggaugugaaaggaguacucucucaccuuacgugaugcauuauuucagacauuucuugaguaguaaaggcacagccaaaagggcuuuccugucaucucaggccuugccuaacagccagcauggugucuuuuccuaccuaccaacucaaaauacagauuuguuuccaugguuuccacauuauagcagaaaauuuacuuagucuuguaucuuccucucucgccuguaugccugguaggauguuauuuaaaauuugauuucuucccuccugucugcuuucuuuccuaguagaauguuauuuauaauuaaacacuuuuauaagcuacagaguuauuuuugacuugacauuuugaauuaugccacuugguucaguucuaguaucuguuuuguuuuuuuguuuuuuuccuaauugagucaaggucucacugccuaggcugcagugcaguggcacaaucucugcuuacugcaaccuccgccucccgggcucaagcaguccucccaccucagucucccaaguagcugggacuacaggcgugcaccaccacagucagcuaauuuuuuuuuuuuuuuaaauggaguuucgcucuuguuggccaggcuggagugcaguggugcaaucucagcucauugcaaccuccacucauugcaaccuccgccuccuggguucaagcgauucuccugccucagccuccugaguagcugggauuacaggcaugcuucaccacgcccagcuaauuuuguauuuucaguagagaugggguuucuccacauuugucaggcuagucucgaacuuccgacuucaggugauccgcccgccuuggccucccaaagugcugggauuacaggcgugagccaccgcacccagcccacacucagcuaaguuuuauuuuauuuauuuuuuuuuuuuuuagagauggaggcucgcuuugucgcccaugcuggagugcuggagugcaguggcacgaucuuggcucacugcaaccuuugccucucgaguucaagcaauucaccugccuuagccucuccaguagcugggacuacaggcgcacgcugccgugccuggcuaauuucuuucguauuuuaguagggacgggguuucaccauguugcccaggcuggucucgaacuccugagcucaggcagucagcccgccucagccucccaaagugcuaggauuacaggcaugagccaccgcgccuggccacacucagcuaauuuuuaagguguuuuuguagagguggguucucagauuuucaauuuugagaaauuucaaccuaaaauaauuuaaauauacucucauuugagcuugaugcucauaaaagugaauacucggccgggugugguggcucaugccuguaaucccagcacuuugggaggccgaggcaggcggaucacgaggucaggagaucaagaccauccuggcuaacauggugaaaccccgucucuacuaaaaguacgaaaaauuagccaagcgugguggcgggcgccuguagucccagcugcucaggaggcugaggcaggagaauggcaugaacccgggggcagagcuugcagugagccaagaucuugccacugaacuccagucugagcaacagaguaagacuccgucucaacaaaaaaaaaaaaaaaaaaaaaaaaaaaaaaaaaggccaggcgcggugggucacgccugcaaucccaacacuuugggaggccgaggcggacggaucaugaggucaggagauccagaccauccuggcuaacacagugaaaccccgucucuacuaaaaauacaaaaaauuagccgggugugauggcgggcaccuguagucccagcuacuugggaggccaaggcaggagaauggugugaacccgggagacggagcuugcagggagcagagaucgcgccacugcacucuagccugggcgacagagcaagacuacaucucaaaaaaaaaaaaaaaaaagaaaaaagaaaaaauguaaauacuccuguguuuuacuguuuuagaccgucugccauuucaauggucugccauuucaauguacuaugguaagugucacuuuuucuaaaaguggguggggggauuaaccuugcacucuugugguuguuuuucccauuacagguagaguuggcuuugugggacacagcugggcaggaagauuaugaucgccugaggccccucuccuacccagauaccgauguuauacugauguguuuuuccaucgacagcccugauaguuuaggugaguggcccugcacccugauauuugucacugccuguguagcuaguuggcaucugguuucugggcaucaaguggcugaaaagcagacaugaacuucagagaagcaaucaucgucaguggccggaguccuggaguuugggauuguagagcgugggccuugggucccuuucagccuaggucucccauggguacuguauuuaaaauguauccaccuaggcagggcacggugccugacaccuauaaucccugcgcuuugggagguccagacggguggaucaccugagggucaggaguucaagaccagccuggccaacauggugaaaccccgucuuuacuaaaaguacaaaaaaauuagccaggcaugguggugcacgccuguagucccagguacuugggaggcugaggcaggagaaucguuugaaccugguagguggagauugcagugagccgagauuauggcacugcauuccagacugagcaacagagcaagacucuaucucaaaaauaauaauuauuauuauuauuacuaaauaauauuaaauguuauuuaaaaaucuaacugccuuguaaacuagaugaauuccagauacaaagaugaguaaacuaaggcuggugcggcggcugacaccuguaauccuagcacuuugggaggccgaggcuggcagaucaccugaggucaggaguuugagaccagccuaggcaacauggugaaccccuugucucuacuaaaauacaaaaauuagcugggugugguggcgugcacuuguaaucccagcuauuccaggggcugaggcaggagaaucacuugagccugggaagcagaaguugcagugagccaagaucaugccacuguacugcagacuccaucucccaaaaaaaaagaugagcaaacuagaugaguuccaaauguaaagccaucucuuuuggggaaagacuuucuuuuuuuugguugcccugucuuagccuuuuucugaagugucuuagcugauagaagcuugaaugugaucauuucauuagccuaaacacagccacauaauucagaagucaguaagucaguauucuuuuuuuuuuuuuuuuuuuuuuuugagagggagucuugcucugucucccaggcuggauugcagcagcuugaucucagcucacugcaagcucugccuccuggguugaugccauucuccugccucagccacccaaguagcugggacuacagguggccaccaccacgcccggcuaauuuuuuguauuuuuuaguagagaugggauuucaccacguuagccaggaugaucuugaucuccugaccucgugauccgccugccucggccucccaaagugcugggauuacaggcgugagccacugcgccuggcccagaagucaguauucuuuagaaaaagacugaagaaugcuaaccugacauucugugaaaccaggcuugaaaaaacuugcuuuagguuugugcugaagaugaugagguaucuauuaauaaacuugugcugcagcccucccugucaugacagggcagcaggugggucaaggauguugucgucauuaccacaaacagccuuugagggucugcuuguggccucggguugccuggauaguuaguguuagagugauuguguuguuaugguugucccuaccuuaaugaugauaacugggguugcuccaagauauugagccacuuguuuaaggucaugcuggcccaaggagcugagcuaagauugaguccucugugcaguaugucccaggacagagaaagagcacguauuccaugccguugguucacuuagaucauuuucagcaguuaugauugauugauugauuuagaggcggggucucgcucuguugcccaggcuggaguugaguggcacaaucuuggcucacugcaaccuccgccuuccagguucaagcaaaucuccugucucagccucccaaguagcuuggacuacaggcauacgcccccacgccugggugauuuuuguauuuuuaguagagaccggguuucuccguguuggccaggcuucucucaaacuucugaccucuggugauccacucaccuuggccucccaaagugcugggauuacaggugugagccaccacacccagccuaguuuugguuuucaaacuaauaugacuuccuuuugugaagcugcuggaaggcccuggaggcugggcagagcuuuaggccacagagaaaauuugagcuaguugacacucuccuaucagauacacacauaaauaacuucaccuagauccuauuggaaugagaaggacugugugccuuugcccucguuaucuaguguauaauucuugagggaaaaaacugccuccagagcaaaacauuuugucucuucagucucacuuuuuucuuuuugagacagggucucgcuuucuugcccagucuugagugcaguugcagauucaguuuacugcugccucgaccuccugggcucaaacaauccucccaucucaguccccacccaguaguugguacuacaggcacacacugcugcgcuugguuaauuuuuauauuuuuuaggccgggcaugguggcucacgccuguaaucccagcacuucgggaggcugagguaggcggaucaccugaggucaggaguucgagaccagccuggccaacauggugaaauccugucgcuacuaaaaauacaaaacuuagccaaguaugguggcauguaccuguaaucccagcuacucaggaggcugaggcaggagaauugcuugaaccugggaggcagagguugcagugagccgagaucgcaucacugcacuccagccuaggugacagagugagacucuugucucaaaaaaaaaaaaaaaaaaaguuugaaaauuuauucaccaaaaguggcgacagucaauuuauucaaauucuauguaccucaaacuccaggaaggggguagacuauugguauaauuucacauauucaggaaauaacuacagcaccuacuaacagaacaucuauucuaggccaggcacuguggcucacaccuguaaucccaccacuuugggaggccaagguggguggauccugaggucaggaguucaagaccagccuguccaacauggugaaucccugucucuacuaaaaauacaaaaaaaucauccgggcgugguggcgagugccuguaaucccagcuacucgggaggcugaggcaggagaauugcuugaacccgggaggcagagguuguagugagcugagauugcgccacugcgcuccagccugggcgacagagcaagaguccaucuaaaaaaaaaaaaaaaaaacuucuguucuagaugagggaagacagaauaggcuccccucaaugcccccaaaaaaguaaaucagaaaauaacaacaguaaacccaguaacaguaaauauuacaaauaacauuuguagaggugggucaugguuguaugcuguuuuguuuuauuuauuuuuauuuuuguuuuuuugagacagacuuuugcucuugucacgcaggcuggagugcaauggugcgaucucagcucacugcacuccgccucccggguucaagcacuucuucugccucagccucccaaguagcugggauuacaggcaugcaccaccaugccugacuaauuuuuguauuauuaguagagacaggguuucaacauguuggccagacuggucucaaacuccugauccaccugccucggccucccaaagugcugagauuacaggccugaugagccacugcaccuggucuauuuauuuuuauuuauuuauuuauuuauuuauuuugagacggagucucgcucugucgcccaggcuggagggcaguggcacgaucuuggcucacugcaaccuccaccucccugguucaaggaauuucccugccucagccucccuaguagcugggauuacaggugugcaccaccaugcccaguuaauuuuuuuguuuuguuuuguuguuuuugagacggaguuucgcucuuguugcccaggcuggagugcaauggcacgaucucggcucacugcaacuuccgccucccggguucaagcgauucuccagccucagccucucaaguagcugggauugcaggcaugugccaccacgcccagcuaauuuuguauuuuuaguagagacgggguuucuccauguugguuaugcuggucucccaacucccgaccugaggugauccacccgccccggccuucacagugcugggauuauaggcaugaaccacugcgccuggcaaucuuuuuguauuuuuaauagagaugggguuucaccauguuggccagacuggucucgaacuccugaccuaacgcgauccaccugccucagccucucaaaguuuugggauuauagacgugagccacugcgcccagccuauuuauuuguuuuuaagagaugaagucucacuuugucacccuggcuggagugcaguaguagcgugaucauagcucacugcuaccuugaauccuggacuccagugauccucccaccucagccucucaaguaggugggaaugcaggcacauguaccacuguaaacugcuaaguuuuuguauguuuuuguggagaugggguuuuugacuuuuuugauacagagucucacucuguugcccaggcuggagugaguguaguauugcgaucucgacucaucacaaccuccaccuccuggguucaaguguuucuucugccucagccucccaaguagcugggacuauaggugcacaccacugcgcccggcuaauuuuaguaauuuuaguagagaugagguuucgccauguuggccaggcuggucucgaacuccugaccucuggugauccacccaccuaagccucccaaagugcugggauuacaggcacgagccaccacgcugucuggagaugggguuuagccauguugcauaggcuguucuugagcuccuaggcccaagcugucuacuugccuuagccucucaaaagugcuggaauuacaaguaugagucaccacgcccagccucuuuugguuauuuucaaaagucacuuuuuuuuauuugagacggagucuugcucugucgcccaggagugcaguggcgcgaucucagcucauggcaagcucugccucccggguucacaccauucuccugccucagccuccugaauagcugggacuacaggugcccaccacuacacccggcuaauuuuuuuuguauuuuuaguagagacgggguuucacuguguuagccaggauggucucgaucuccugaccucaugauccgcccaccuuggccucccaaagugcugggauuacaggcaugagccaccgcucccggccaaaagucacucuucagccauuugaaauaccaguaaaccccauaggguagaaguuaugcugagaguugaugaacaaguuagaaaaagaacauguggacccugggucagcugcugcccuagaauggggaccccuucuguaagcuaugucagaaucaucuaccagcagugacagauguccuguaaagugccugccuuuguggggcaggaagugccccccgugaaacuaccuuguguuguggaucuuuugcuccuccagagcccuuacucgggccccaccuacagagaugcucagcaccacucuuggcuggacugagaaaaagcuguugguucucuguuuaaaggaaagggauuauauuuccuuuuuaugguuuugaaacuagugaguuucauuaaaugucuagcauuuuucugaagccacaaagaaagugucucugcaauuucacugagguucuuggaaagucuucaagauagaauuguauguauccccaaauucucuacauuuuucuuucagaaaacaucccagaaaaguggaccccagaagucaagcauuucugucccaacgugcccaucauccugguugggaauaagaaggaucuucggaaugaugagcacacaaggcgggagcuagccaagaugaagcaggcaugaucuggggcaggacugucuuguaguauucuugaacuagggccccaaguuuggagguuuggggagcccagcaggaaccuucacaggccagguuguuuuagaggcucagaagccccucuguggcccucugacccucauuaauugggaucuucacagaagaucccuaagauaguucaccaguccugugagauggaauguuuuuuuaugagguagugcuaugcccauaaggacugcuggccugagaaugaaccauuucauuaguagcuaguaaucaguggcucuagauguaggaacuuucuuuuuuuugauauggagucucauucugucacccaggcuggagugcaguggcgcaaucucagcucacugcaaccuccgccuccgggguucaagcgauucuucugccucagacucccgaguagcugggacuacaggcacccuccaccaugaccggcuaauuuuuuuuuuuuuuaauagaugggguuucacccuguuggccaggcuggucuugaacuccuuaccucaagugaucugcccacuuuugccucccaaagugcagggauuacaggugugagccacugugccuggccucuguuagacucuuuauuuuuauuuuuugagacacaguuuugcuuuugucacccaggcuggaaugcagugaugcuaucucggcugcaaccucagccuccaagguuuaagugauucuccugccucagccucccaaguugcugggauuacaggcaugugccaccacgccuggcuaauuuuuguauuuuuaguagagacggguuuucuccauguuggucaggcuggucucaaacuccugaccuuaggugaucugcccgccuuggccucccaaagugcugggauuacaggugugagccaccacgcccgggccuguuagacucuugauugccuuccccagcuauuacuuugguacaugugaggccaaagauaaauuaguggcaacugaaagauaaggaaaucuugaaggcugggaguccagauagaaagcccuaaugccuucccucuccuccacucccaaugccuuuuuaaaagugaugauggauguggcaucuuggccucucagaaaccagcuggccuaauggcagggcuuccucacuggaggagaagcauugagaucuucaaccuaaguucucuuacucagguuucucugucugaaugucaaggguaggcuuuauuuccuucagggcauuuaguccuggauugguagcuugaguaauuuugcucuugauugacuccuuaaccuuccagggcuccucugaccucuucccucuacuucccagugaauaccauguuuauuagagauuuuauguuugguaggggguaguuaccauaugucaguuuaaaaauuucauaaguuuagcaguuuguuguuuuuuuuuuuuguuuuguuuuuuuugagaaggagccucacugugucgccaggcuggagugcuguggcacgaucuuggcucaacugcaaccuccgccucccagauuuaagcgauuccccugccucagccuccugaguagcugggguuacaggcgcccacuaccacacccaggugauuuuuuguauuuuaguaaagagggguuucaccauguuggccaggauggucuugaucuccuaaacucgugauccgcccagcucagccucccaaagugcugggauuacaggugugagccaccacacccagccaaguuuaacagcuuuugaaagucuuuuuuuuuuuuaggcuggguacaguggcucaugccuguaucccagcacuuugggaggccgaggugggcagaucacuuggucaggaguucgagaccagccuggccaaaauggugaaaccccaucucuacuaaaaaauuacuugggcgugguggugggcaccuguagucccagcuacucgggaggcugaggcgggagaaucccuugaacccaggagguggagguugcagucagcugagaucaugccauugcccuccagccugggcgaccgacgagcaaaacugucucaaaaaaagaaaaaaaaaucuuuuagaugaauuugaauacuuuuuacuuacuauauguaugccacacuauuagcuaaaaggacuauuuuuuuuucuuugcuaggagccggugaaaccugaagaaggcagagauauggcaaacaggauuggcgcuuuuggguacauggaguguucagcaaagaccaaagauggagugagagagguuuuugaaauggcuacgagagcugcucugcaagcuagacgugggaagaaaaaaucugggugccuugucuugugaaaccuugcugcaagcacagcccuuaugcgguuaauuuugaagugcuguuuauuaaucuuaguguaugauuacuggccuuuuucauuuaucuauaauuuaccuaagauuacaaaucagaagucaucuugcuaccaguauuuagaagccaacuaugauuauuaacgauguccaacccgucuggcccaccaggguccuuuugacacugcucuaacagcccuccucugcacucccaccugacacaccaggcgcuaauucaaggaauuucuuaacuucuugcuucuuucuagaaagagaaacaguugguaacuuuugugaauuaggcuguaacuacuuuauaacuaacauguccugccuauuaucugucagcugcaagguacucuggugagucaccacuucagggcuuuacuccguaacagauuuuguuggcauagcucuggggugggcaguuuuuugaaaaugggcucaaccagaaaagcccaaguucaugcagcuguggcagaguuacaguucugugguuucauguuaguuaccuuauaguuacuguguaauuagugccacuuaauguauguuaccaaaaauaaauauaucuaccccagacuagauguaguauuuuuuguauaauuggauuuccuaauacugucauccucaaagaaaguguauugguuuuuuaaaaaagaaaguguauuuggaaauaaagucagauggaaaauucauuuuuuaaauucccguuuugucacuuuuucugauaaaagauggccauauuaccccuuuucggccccauguaucucaguaccccauggagcugggcuaaguaaauaggaauugguuucacgccugaggcaauuagacacuuuggaagauggcauaaccugucucaccuggacuuaagcaucuggcucuaauucacagugcucuuuucuccucacuguauccagguucccucccagaggagccaccaguucucauggguggcacucagucucucuucucuccagcugacuaaacuuuuuuucuguaccaguuaauuuuuccaacuacuaauagaauaaaggcaguuuucuaa

SEQ ID NO: 192097 - RNA, 32465 nt, Homo sapiens
cggacagagguuccgggaaccagccgggccggggcggggcggggcgagggagaggggcggccgcgcggaucacugaggcuguggcggcacugcgcccggcgcucgcguccguccgcccguccgcccgcccagccaugacugcgccgguccccgcgccgcggauccuguugccguugcuguugcugcugcugcuaacgccgccuccggguggugagccgggggugggggcggcccguccugcccugggaccgggcagacacuuccccgcgcugccucuccaacgagccgggcagcaccagccccacuaugccccccacugaccccugauugccccgaggccgucagcgaacccccacgacugcggaccccuccuccaccccagcacccuccuugccugaacaacccugccuagacaccaggcagcugccaccuuugucuguccuggaacgguggggaggggucugcccucccgcccauguuccaggggauggaguccccagaggcuaggguaggguucccugccuggcuuuagucuggcggguggcugcagggcgagcuggccccuccaucagaggccuucccucuuugccucuguuuaaugucugggagcccccaccgcugccuccguuggcccuuguguuccuguagagcccggcgcugaggcuggccucugggguggagacaccacuguguguguugguugcagauaggugauucacagagucuggaaggcuggcugggggcggguccuuuaaaggguuaggaauuggaacaauccccugcccacccaugggaagccaaagacccuuuugggguggguggcuucguggaggggaaggcuguauuuccugggggcugggaugaauccagaggaccugggcuagagaaaugagaaaggggagacuugugcccagaauccgcccacuccuggagugagccuguaggagggucggucacugauucagugaggucugggggucagagagcauuugugccauggacucagccuaaacagccucaccggugugucuucagcccuagcucagaggcucagauugggcugugaagaccuugcugcauauggguucaccugagccaccaggcacgggccaugcugaugauaccagcuuucaggugggcagcuggccaaacugggcuugucaaugguccaauccucugcuccauggcuuugcccagagcaggguucugccuggagcugccaagaagugcaguuccccccaacuccccacuaaaguucccucuucccaaggaggucacuuggugucucugucucugggcuucacucuacugacagccucggggugugugguguccugaucaggcccgggcaccagaugcugcacauggccaggugccuggccuggcugggucuccagaggccacgugcuauggcagacuguuuccaggccgauguaguuaugccucagggcuaucaucagaccuguccccugccuacugcggacuugugggccuugcuggacuagguauucucuuuggagucugcccuggcagaauccgguacuguuccuuccuguuagugggcacaggucucugcuaauguagccugaggauacaugggaacauuugacuguagcaucuuccuggagguuuguaaaccuuguggucauccaaaaaccuggguuauuuuccacauuuguugucagccagauccccucagcaugaccucguuuauugagacuuguaaggaugucaguagaucccaacucugugcugagagucuugugauggcuccagggcuacagauggugccacugccuuggagcccuguugcccaggcuggucucaaacuccuggaaggcacagacauuuccuggacaccugcugcaggcccagcgcggggcuaagugcuuuaugaacgcugguauggugggugugacaauuucugaccaggaucuagccugccaucaugguuaugggguggucugugagagccaggccccugcaguuguggugcccagcaggggcugagguugcugugguugagugagggagagagugaacgaggauuaagaacuagacagucuggcuggggugcgguggcucaugccuguaauuucagcacuuuggaggccaagauggguggaucaccugaggucaggaguucaagaccagccuggccaacauggcgaaacucugucuguacuaaaaaauacaaaaaauuagcugggccugguggcaggcaccuguaaucccagcuacucgggaagcugaggcaggaaaauugcuuggaucugggaggcagagauugcagugagcugagaucgcaccacugcacuccagccugggcaacagagugagacucugucucaaaaaaaaaaaaaaaaaagaaagaaagggacaguccagugucugguccccugcagguguugagcugugugacuucucgccugggcagcuucuggaggaggccaccuggaguagggccuugaaggaugaguagaguugaaaggcaggagauaggaaccaggcaagaaugugagcggaguguggacagguuggagagcuggagugaucuucaggacucugcaguuuagacccugcuuggaaacucgggccuugauccugaagcagugggaauuaggggagguuugagagcaggguguggccccaucagacucacauugagaaaguucacccuccuaucaggaggccagugcacuggugagggagagagggagcccaguuagggcagcucuguuguggcccgugggauagggcaaggcugagggggagcaguggccaggggucagaagguggccuguggcuaggguggcucagagacggugcagcauguguguguguguguggucugguggcugugccagggagggcgcugugucugcuggggccuggcccgugggcacaggugaacagauguguuucuccucuccagcacguggugagguguguauggcuucccguggacucagccucuuccccgaguccuguccagauuucugcugugguaccugugaugaccaauacugcugcucugacgugcugaagaaauuuguguggagcgaggaaaggugugcugugccugaggccaggugggugcaccagugggucacaggguggguggcuugagccugugccccacaggagaguauguggaagagagauagcucugccccucuggccucucagcccucucaagaugguggccagagcauuggagcagaggguuuagggauccccuguucugggcuggacccccuagaccugcucaguuaguccccuguccaucuccucccuacccugagggcuccagcuugcugagccuugggcugagcagguuucuuagagguccuuggccucagcugguccugugacucaccccggguguguaccugugccaagauguccucaggguggguacuugggcuugacuauaccccacaguaugcgcaugccccugagggguauccuuuguucagaacccgcuuguggagccuguagggugcagugcguaagcaugugccccagugugagcucuaucuguguccucccagcgcagccuaugaauuuaccugcauguuggguguagacuguuucauggcugggaccaagguuccaggccccuguguguggcucuuugccguauucuguauuuccuuuguguuuggccucgguguagaggguugagauggucauacuccucugcucauggcaggugaucauccugggucugggcaagaccaacccccgcuaucuuacauauuuauuuuugugagauggagucucaccauguugcccaggcuggucucauacuccugggcucaagccauccuccucccucagccuccugaguagcuggaacuauaggugugcaccaccaugccuggccuauauauuuacuuuaauaugucaggaccauuucauuccuuucccaccccacaggcaaccgucugcuauggucugcuauguauaagguacauccuuuucauuauuugaguucuugcaaagucgguguaguguaagaccuagccacauugcuguggcacaucuggcccuugcccacuacugcugugucccucugaauggugugaauccacaaugguugucaugauagauagcuucagugggcaucugguauaccuccuuuuauggagcuguguaagaauucucuuggaaacacaucugguuguggaguugccaugucauagaugcacacaguuauccacuaaggacuuccaggugcucuugggaguggugcacagggcugcacaccugucaguccugccugaggguuccugacaggucuucuucuacccuuucacccuuucacuucaccuuuuggcuuuuuuuuuuuuuuuuuuuugagacggagucucacuucuguugcccagguuggagugcaauaaugugaucucggcucaccgcaaccuccgccucccggguuccagcgauucuccugccucagccucccgaguagcugggauuauaggcgugcaccaccacaccuggcuaauuuuuguauuuuuguauuuuuuuuuuuuuagacagagucucgcucugucacccaggcugcaggcuggaaugugguggugcgaucuuggcucacugcaagcuccgccucccagguucacgccauucuccuaccucagccucccaaguagcuggaacuacaggcgcccgccaccacgcccggccuaauuuuuguauuuuuacuagagaugggguuucaccauguucaccaagcuggucuugaacuccugaccucaggugaucugcccaucuuggccugccaaagugcugggauaacaggcaugagccaccgcgccugaugguauuucuuuuuuuaaaagcaggagcauuuauuccauuuaaauuuaauguagagggccggggguugcuguggcucaugccuguaagcccaguacuuugggaagcugagguaggaggaucacuugaaccuagcagguugagacugcaguaagucgugauuggugccacugcacuccagccugggcaacagagugagaccucgacucaaaaauaaauuaauuaauuaauuuaauguaguuauugauauucugggguuauauuugcaucuuuugugcuauuugucucuccugcauuaucuuuuuuuuuuuuuuuuuugagauggaguuucguucuuguugcccaggcuggagugcaaugguguguucuuggcucaccgcaaccuccaccuccugaguucaaacaauucuccugccucagccuccugaguagcugggauuacaggcaugugccaccacacccggcuaauuuuguauuuuuuaguagagacaggguuucaccguguuggccaggcuggucuugaacucccgaccucaggugauccuccugccucggccucccaaagugcugggauuacaggcgugagccaccgcgcccguaugcauuauccuuuuuuuacuuccuguauuguuucgauuuguuuuuacgccauauuuuucuucgacuguuacuucuucuuuuccauucugucuuuuuuuuuuuuuuuuuuuucuuucuggagacagucugugucucccaggcuggagugcaguggcgcgugaucucaucucacggcaaccuccaccugccagguucaagcaauuauccugccucagcuucccauguagcugggaccacaagugcaugcugccacgccuggcuaauuuuuuguauuuuaguagagacaggguuucacuguguugcccagguuggucucgaacuacugagcucaggcaaucugucugccucggacucccaaagugcuagaauuacaggcaugagccacugcccccagccuucuuuccuauucugaaugucuuauuucuuuuucuugccuuauuguguuggcuaggcccucaguuacaauguugaguagaaguggagaaagcagacaucugugucuuguuuccgaguuuagggggaagacauucaguuuuucacuaguaggaaggaugucagcuguggcuuuuucauagguguccuuuaucagguugaggaaguucucugcauuucuaguacaccuagaguuuuaauuauggauggauguugaauuaugucaaaugcuuuuugugcauuuguagagaugacuguaugauuuuaaaauuuuuauucuguuaauaugguaaauuauauuacucucuaaaacacuauuuuaugugaguauagagcuuagguugaugguuauuuuuucuuagcauauugaagcuuccauucuacugucucccggcuuccauuguuucuguugagacaucaacucaacagccagugucucucauugaaagaaaucucucucucucucuucuuuuuuuuuuuuugagacagucucacucuguugcccaggcuggagugcaguggugcagucacuggcucaugucacucucagccuccugggcugaagcauauccuccuaccucagcuuuccaaguagcugggauuacaggugccugccaccaugccuggcuaauuuuguuuacuuuuuguagagacagggucucccuauguugcccaggcuugucuuaaacuccugggcucaagugauccucccaccucgaccucccaaagugcugagauuacaggugcaccuagcugaaaucccucuuuuuuuuuaacccuccgauugcuuuuuaagauuguuuuuuucuggccgggugcgguggcucacaccuguaaucccagcacuuugggaggcugaggcgggugggucacgaggucaggagaucaagaccugccuggccaagauggggaaaccccaucucuacuaaaaauacaaaaauuagcugggcaugguggugggugccuguaaucccagcuacucaggagccugaggcagagaauugcuugaacccaggaggcggagguugcagugagccaagaucaugccacugcacuccagccugggugacagagcgagacuccgucaaaaaaaaaaaaaaaaaaaaacuuguucuggaagccuuaagaccguuaaccccacaagaaguagcaagacagacagcagacuggagaacaauggcaugaucucggcucacugcaaccucugccuccuggguucaagugauuccccugccucagccuccagaguagcuggaauuacaggugccugccaccacacccagcuaaguuuuuuguauuuuuaauagagaugggguuucaccagauuacccaggcuggucucaaacucuuggccucaggugauccacccgccucagccucccaaagugcugggaucacaggugugagccaccacaccuggccauuucuguggaauugacauuuuacuauauugaguuuuccaaugcauuaacaugguauuucugcucuuguauuuaguuuucuuuccuucucucucaauuuucuauuauauaauauuuuuucuauuucaaagucuuauauauguuucauuuuuuccuuuguuuuuuuuuaugguauuauaaauaguguaguuuaaauuucuuuucuuuuuuuuuuugagacgaagucuagcucuuguccccagauuggagugugauggcgugaucacggcuuacugcaaccucugccucccggguucaagcgauucuacugccucagccucccaaguagcugggauuacaggggccugccaccucgcccagcuaaauuuuuuuguauuuuuaguagagacgggguuucaucauguuggccaggcuggucucgagcucccgaccucaggugauccauccgccucagccucccauguagccgggacuacaggcaccugccaccacgccuggcuaauuuuuuguauuauuuuuaguagagacgggguuucaccauguuagccaggauggucucgaucuccugaccuugugaaccaccugccucggccucccaaagugcugggauuacaggcaugagccacugcacccggccuaauuuuuguauuuuuuuuuuugacggagucgcacucuguugcccaggcuggaguacaguggcacaaucucggcucacugcaaccuccgcuucccggguucaagugauucuccugccucagccucuugaguagcugggacuacaggcgcccgccaccgcgcccggcuaauuuuuuguauuuuuaguagagacaggguuucaccguguuugccaggauggucuugaucuccugaccucgugauccgcccgccucggccucccaaagugcugggauuacaggcgugagccaccgcgccuggccuuuuuuuuuuuuuuuuuuuuuuuuuuuuuuuuuuuuuuuuugagauggagucuugcucuguucccggcuggaguggaguggcacaaucucagcucacugcaaccuccacacccugagcagucuuaacucauuccagcaucaacuacucuuaacucuaaagugcaaagccuuguucacauauuaucaaaaucagauaugaaugagaccauagguacauuucauccugaggcaaaauuuaucuccaguugugaaaccugugaagccagaaaugcauuugugggacaggcaaaggauagccaccccuauuacaaaagggagagaaaucaguaggaaguguagccagggcaacauggugagaccccaucucuacuaaaaaaauccccaggcaugauggugcgcgucuguggucccaacuauuaggaggcugaggugggagaauugcuugagcuuggugggggcagagguugcagugagcugagaucgugccacucuacuccagccugggacagagugagacccuuguuucaaacaaaacaaaacaaaaacaaacaaacgaaaacagcaggaagugauaggugcugucaacgaaaagccaaacucuaaaauauuugaagagauuuauucugagccgaauaugagugaccaucgcccgugaaacagcccucaggaggucuugagaacaugugcccaaggugguccgggcaccgcuugguuucauacauuuuagagaggcaugagacaucaaucaaauacauuaaagaaauacauugguuaggccgggcgcggugccucacaccuguaaucccagcacuuugggaggccgaggcgggcggaucacgaggucaggagaucgagaccauccuggcuaacacggugaaaccccgucucuacuaaaaauacaaaaaauuagcugggcauggugacgggcgcuuguagccccagcuacucgggaggcugaggcaggagaauggcgugaaccugggaggcagagcuugcagugagcagagaucacgccacugcacuccagccugggcgacagagcgagacuccaucucaaaaaaaaagaagaaauacauugguuugguccagaaaggugggacgacucaaagggcgggggguugggaggguggggagcuucuagccuauaagugaauuuaaacguuuucuguuugacaauugguugaguuugucuaaagacaaaauugauugauagaaaaggaauguucagauuaagauaaagauuguggagcccaaaguucuucugaagucuucuaguggcugcccuuagagacaauagaugacaaauguuuccuauucagauuuuaguuacucucuuuaggauugggagggucuggaaggaaaagaucuagcuauguuaauagagauucuuuacagaugcacauuuucucccauagagaacagcuuugcaaggucauuucaaaauauggcaaagaaacauguuuugggguaaaauguuuugauuuuuuuuccuugucucuuaauguuaugccagagucagguuggaaaguaaaucaugauauauaggguuaaauaaaacccauuugaugagaauuuaugauuuguagggcaugacuccccaggccccuuagauaggaauuugggcgagauaaaaaaaaucagaguuuaguucucagugccaggcaauucuaaauucuagcaagacaaacuccaguagacuuuaagccuugggaauaauccucuuuggcuggacacucugcccucuggacccacugugaugggggcugcacccccauggcucugcuggguggugguccuggccuucaaaacugagguggccggccaggugcaguggcucauaccuguaauccuaccacuucgggaagccgaggugggcggaucaccugaggucaggaguuugagaccagccugaccaacauagagaaaccccaucuguauuaauaaugcaaaaauagcuggguaugguggcgcaugccuguaaucccagcuacuugggaggcugaggcaggagaaucgcuugaacccaggagguggagguuguagugaaccgagauugcgccauugcacuccagccagccuggguggcaagagcaaaacuccgucucagaaaaaaagcaacaacaacaaaaaaaacggagguggcggcaaccugguuccggccugugcacucugggccuguggugggaguggcagccuugaugauugaauugucuuugggguccuuuucuugucuuuaagaacacugcaccuugaaaauagcgcugccaagcaugauggcugacgccuuuaaucccaguacuuugagaggcugagaugggaggauugcuugagcccaggaguucaagaccagccugggcaauauagugagaccucgucuccaugauuuuuuuuuuuuaguuagcugggcaugguagcaugcacuuguagccccagcuacucaggaggcugaggugggaggauugcuugagccuaggagaucaagguugcaguaagcugugaucacacuacugcacuccagcuuggguggcagagugagacccugucucaaaaaaaaaaaaaaaaaaaaaaaaggccaggcgcaguggcucaagccuguaaucccagcacuuugggaggccgaggcgggcggaucacaaggucaggagaucgagaccauccuggcuaacauggugaaaccccgucucugcugaacaaaauagaaaaaguuagccaggcaugguggcgggcgccuguagugccagcuacucaggagacugaggcaggaauggcgugaacccgggaggcagagcuugcagugagcugagaucaugccacugcacuccagcuugggugacagagugagacucuggcuaaaaaauaaaaaaauaaaaaaauagcuguagcagggguguccaaucuuuugccuucucugggccacuuuggaagaagaaaauugucuugggccacacauaaaacacacuaaugauagcugaugagcaaaaaaaaaaaaaaaaaaucucauaauguuuuaagaaaguuuaagaauuuguguugggccacauucaaagccauccuggccugaaugugggccgcuggucacagguuggacaagcuugcucuauggcccaguccuguaggaucuuagauguccgacagccuuccuucacuucauccccuuucuccccucuggcaggugcuagggugacugauuaggucugugauucauacccauucuaaucuccuuaccucgcaguuuuuggacuacucucuuaguauuuacaguauggauaggcugagaauuguccagauuuuuaaauucuaguucuuuuuuugcuuaacaauucauuucucuuuuuucacuuuuuuuuuuuuuuuuuugagacggaguuucgcucuuguugcucaggcuggagugcaauggcaugagcucagcucaccgcaaccuccaccucccggguucaagugauucugcugccucagccucccuaguagcugggauuacaggcaugugccaccacgcacggcuaauuuuguguuuuuaguagagacgggguuucuccauguuggccaggcuggucucgaacucccgacaucaggugaucugcccgccuuggccucccaaagugcugggauuacaggcgugagccaccgcgcccggccuuuucacauuuuacuauaagcaguuggcugggugcgguggcucacgccuguaaucccagcacuuugggaggccaagguaggcggaucaugaggucaggagaucaagaccauccuggcuaacauggugaaaccccaucucuacuaaaaauacaaaaaguuagccgggcaugguggugggcaccuguagucccagcuacucgggaggcuaagggaggagaauggcgugaaccagggaggcggagcuugcauugagucgagauugggcuacaagcaagacucugucucccaaaaaaaaaaaaaaaaaaaaaaagcagucaagaggauccaagcugcuccuucaacacuaaguaucccauauauuucaaguuuuccucugaauugcucaaucuuuuguuuaaucucuuuaagcucuuuuuuccuuuaaucucacuguguaaucuuuaaacaguguauguguuguuauucuaaugucagugucugauaauuucaguauuuuaaggcaaauuuuucuccuuagcuucacugguuuuccuucaaauguauuaggguauaauuguuuauaaugcuuuuaaauuuuguuuuguuuaacaucuaaagaaauaucccccauggguacuucuuuuguuuuguuuuguuuugguuugguuugguuuuuugagacggagucucacucuguugcccaggcuggagugcaguggcaugaucuuggcucacugcaaccucugccucccagguucaagcgauucuccuaccucagccucccaagcaacuuggguuacaggcaugugccaccaugcccagauaauuuuuuugguauuuuuaguagacaggguuuugcuauguuggccaggcuggccuugaacuccuuaccucaggugauucacccaccuuggccucccaaagugcugggauuacagaugugagccacugcgcccagcugguauuucuuuuuuugugugugugagacauacaaggucaguauaguaaaaaaaucuauuaaacuucuaauuaaaaauauaauuucaaaagacguuuccaauagcaucaaaaacaucaaauaccuaggaaagacaaaauuucuacacagaaaacuaugaaccauaaacuguaaaacauacaaacuguguauuuauaaaacauauaaacauacaaacuauaaacauuaaaacguauaaacuguauguucauaaagcauauaaacuauguaacuauauaaacuauaaaauacauaaaacauuauuacaaaaaaucauagcccuaaauaaauggaggcauagacagggcucaugaauuggaagaccauauuuuaaagauauugauuccccucaaauugguauauggaauuuguuaaauuucaguuuuagaaaacucuuggcaggcgcaucugugugggagugugugugagugugugugugugugugcgugugcgugugugugugugcgccuauggacauuauuauauuuuuuuaauacugaugggaucucccuauguugcccaggcuggucuugaacugcugggcuuaagcaauccuuccaacuuggccucccagagugcuaggauuauaggcaugagccgccacaccuggccaccuguggguuuuucuuuucuuuucuuucuuuuuuuuuuuuuugagauggagucuugucucugucacccaggcuggcgugcaguggcucagucucggcucacuguaaccuccaccucccggguucaagugauucuccugucucagccucccgaguacaggcauugcagggauuacaggcaugcgccaccaugccuggcaaauuuuuauuuuauuuuauuuuauuuuuauuuuuaguagagacaggguuucaccauguugaucaagcuggucucaaacuccugaccucaggugauccacccgccuccgccucccaaagugcugggauuauaggcgugagcuuauaaucuauuauaauauauauauaaucuauauauauaauauauaauauauaaaaucuauaaucuauauaauauauaauauauauuuauaauuauauuauauauauuguauauuauauaauuauaaauauauauaauauguaauauauauaauauaauuauaaauauauaauauauaauauuauaaauauauaaaauauauaauauauaauauauauaguauauaauauauaauauauauaauauauauauaguauauaauauauguaaucuauaaucuauuuucuauugucaguuuuuucugcuguuuucuauucauacugucuggucuccuaguguuucugaaaauuuuugauugugugccuaacaucacauuugcaaaauugauuauagaaauuuggagccaggacuuucuccagggaggauuuagguugcuucuggcaguaacucuagcguucucagaucaccuggucuaguuguagagacugaaauuauuagaggcugagccgucuacucagucucucccuuccucuuaagguacagcuuuucgggucccagccuaagugaaugggggucaucagggccaccucaccugguaggcucuggaucuaagcccugucaccuuggucuccugaagcuuccagaagugcugcucagccucucagcugcccuucugaaaguggcuaaugcuccaaggagaaaaaggaccucagcugucaggcucaucucuggaucuuuguccccagccucaccaccacucauaucagcuucacauucuuuccauugcucucugaagcuuucacacugauuucuuuuaaauguauauaauauuauauguagauuuuauauauaaauauaauauauacuuauauauaauaucuauauauuauauauaaauacauauucuuauauuaucuuauauuaaauauagaauauauauuauauauaauauauuauauauauaauauauauauuuaauauauauauaaaaauauauauuuuuugagauggaguuuugcucuuguugcccauggugggcaacaagugcaauggcacgaucuuggcucacugcaaccuccaccucccagguucaagcgauucuccugccucagccucccuaguagcugggauuacaggcaugcaccaccacgcuuggcuaauuuuguauuuuuaguagagacgggguuucuccauguuggucaggcuggucuugaacuccugaccucaggugauccgcccgccuuggccucccaaagugcugggauuacaggcgugagccaccgugcccggucucacacugguuucuuuucuuuauuucuuuucguuuuuuugagacugagucuugcucugucccccaggcugaaguguaguggcaugaucacggcucacugcagccucuaccucccucaagugauccuccugccucagccuguugaguagcugggaccacaugcccagccaacuuuuguauuuuuuguagagaaggggucucaccauguugcucagucugguuuugacuccugugcucaagcgauucucuagccucggccucccaaaguacuacaugccuguaggcacgagccauugcaccuggccucagauuucuuuuuuugagauggaguuuugcucucauugcccaggcuggagugcaguggcgccaucucggcucacugcaaccucugccuucuggguucaagcgauucuccugccucagccuccugaguagcuggggcuacaggcaccugccaccacgccuggcuaauuuuuuguauuuuuaguagggaugggguuucaccauuuuggccaggccagucucaaacuccugaccucaggugaucugccugccuuggccucccaaagugcugggauuacaggcaugagccacugugccuggccuucuuuauuuuuugguuuugagacagagucucgcucugucgcccaggcuggaguagcacaaucucagcucacugcaaccuccgccuccuggguucaagcaauucuccugucuccgccuccugaguagcuggaauuacaggcaggugccaccacgccccgcuaauuuuuguauuuuuaguagagacaggguuucaccauguuggccaggcuggucucaaacuccugaucuuaggugauccgccugccucggcuucccaaaguguagggauuacaggcaugagccaccgcacccagcccacauauuucuuaaaaaauauuuucuccucagcuuuuacugguuuuccuccaaguguauuaggguauaauuguuuauaacgcuuuuacauuuuauuuuguuuuacaucuaauuuuggaaaguuucaaauaaguacaaaagcagagagaacaauauaacucaaugcauccaucacccacuucccguuaccaauacucugacaccauugugcuauauaugucccaccacuuuucuuuuucugaauuauuuuaaagcaaaucccagacaucauaaaaaguucuucuuaaauauuaguauuuggcugggugcaguggcucacaccuguaaucccagcacuuugggaggcugaggcaggaggaucacuugaguccaggaguuucagaccaaccugggcaauauagugagaccuuaugucuacaaaaaauucaaaaaauuagcuagguggggucagccccccgcccggccagccgcccuguccgggagggaggugggggggucagccccccgcccggccagccgccccguccgggagggagguggugggggucagccccccacccggccagccgccccguccgggaggugaggggcgccucugcccggccaccccuacugggaagugaggagccccucugcccggccaccaccccgucugggagguguacccaacagcucauugagaacgggccaaggugacaauggcgguuuugugggauagaaaagggggaaagguggggaaaagauugagaaaucagaugguugcugugucuguguagaaagaaguagacaugggagaccuuucauuuuguucuauacugagaaaaauucuucugccuugggauccuguugaucuaugaccuuacccccaacccugugcucucugaaacaugugcuguguccacucaggguuaaauggauuaagggcggugcaagaugugcuuuguuaaacagaugcuugaaggcagcaugcuccuuaagagucaucaccacucccuaaucucaaguacccagggacacaaacacugcugaaggccgcaggguccucugccuaggaaaacuagagaccuuuguucacuuguuuaucugcugaccuucccuccacuauuguccuaugacucugccaaaucccccucugcgagaaacacccaagaaugaucaauaaaaaaaaaaaaaaaauuagcuaggugggauggcaugugccuguagucccagcuacuugggaggccgaggugggaggaucacucgagcccgggaggucauagcugcagugagcugugaucacaccacugcauuccagccugggugacagaugagacccugugucaaagagaaaaaggccgggcacgguggcucacaccuguaauccuagaauuuugggaggccaagauggguggaucacaaggucaggaguucgaguccagccugacuaacauggugaaaccccaucucuacuaaaaauacaaaaauuagccggguguguggcacaugccuguaaucccagcuacucaggaggcugaggcaggagaaucgcuugaaccugggaggcagagguugcagugagccgagauugcaccacugcacuccagccugggcgacaagagacgagacucugucucaaaaaaaaaaaagugaguuuucauugcuaaaaaugagguccuugaaggcaaauauaacuauuucccuuccaauauaagggcaauauaaccacuaucauauuuggcacaauuaacaguaauucacugauagcuuuaaauacuguguucaguugccuccacuaguuuccaaaaugccuuuucacagaugguuuguccaaaucggaauccaaauaauguuauuauguuauuuuauuuauuuauuguuuucgagacagggucucagucugucgcccaggcuggagugcaguggcgugaucacagcucacugcagccuggaacuccugggcucaagugauccucccaccuaagccuccugaguagcugggaccacaggugugugcuauugcacuuggcugcccuccuuuuucgugguuagucuugucagaagucuauuagcuuugguuugcuaaucuucucuauuauucucuauggcuauucugguuuauuuuugcacuuaccuuuauuaauuucuuccuuguuuuuuggguuuuccauuacuuuuuuuuuuuuuuuugagacagagucuuuuuuuuuucuuuuuugugagacagagucucacucugucccccaggcuggagugcaguggcaugaucucggcucacugcaaccucugccucccggguucacaccauucuccugccucagccucccgaguagcugugacuacaggugccugccaccacgccuggcuaauuuuuuuuguauuuuuaguagagacaggguuucacuguguuagccaggauggucucgaucuccugaccuugugauccacccgccucggccucccaaagugcugggauuauaggcgugagccacugcacccggccgagacagucuugcucuuuucacccaggcuggagugcaauggcaugaucuuggcucacagcaaccuccaccucccagguucaaacaauucuccugccucauccucccgaguagcggauuacaggcggccaccaccacaccaggcuaauuuuuguaguuuuaguagagaugggguuucgccacguuggccaggcuggucucgaacuccugaucucaugauccgcccuccucagccucccaaagugcuguuauuacaggcgugagccaccaaccuggccacauuuuccauuacuuuuaaagaaaucaucuugaguuuauuuuauuuuauuuuauuuuauuuuauuuuauuuuauuuuuuugagacagagucucgguccauugccaaggcuggagugcaguggcacgaucuuggcucacugcaaccuccaccucccggguucaagcaguucucugccucagccucccgaguagcugggauuacaggcgccugccaccacacccagcuaauuuuuuguauuuuuaguagagacaggguuucaccaucuuggccaggcuggucuuguacuccugaccucaugauccacccaccuuggccucccaaaaugcugggauuacaggcgugagccaccacgcccagcucaucuugaguuuaauaucaucuuauuuauuuauuuauuuauuuauuuauucuuauuauuuuucaagauggagucucgcucuugucgcccaggcuggauugcaauggugugaucucggcucacugccgccugcaccaccugggucgaagcaauucuccucccucagacuccagaguagcugggauuacaggugcccgccaccacgccuggcuaauuuuuguauuuuuaauagagacgggguuuuaccauauuggccaggcuggucucgaacuccugaccucaguugaucugccugccucgaucucucaaagcacugggauuacaggcaugagucacuuccccuggcccauaucauuuauuuuuaaccauuccuguuuucugauaaauuauuauuauuuuugacauuugagucuugcucugucacuuaggcuugagugcagugacgugaucugagcuuacugcaaccuccgccuccuggguucaagcgauucuccugccucagccucccgaguaacugggauuacaggugcaugccacugagcccggcuaauuuuuguauuuuuaguagagaugggguuucaccauccuggacaggcuagucucaaacuccugaccuugagauccacccuccucggcccccccauuucuugauaaauucuauuaaagauacaaaucucccucuaagaacuauuuuaucuguguuucacgaauuuugauguauuuucaucauuuaguucuacauacuuguuaguuuccuuuauuacuucuucgugaucaugauaucuucuccccugccagguaaguauccuuuaugaguucuuauuuaacacaauacaaaucaagaguuuugguuuuauuuugcuuuuuuuuuuuuguaccuucuuaguuucccaagguaggaguuuuuuguuguuguuguuguuguuguuuuaguacuuuuuaaaaaaacucuguggaggccaggcgugguggcucacgccuguaaucccagcacuuugggaggccaaggcagguggaucacgaggucaggagaucgagaccauccuggcuaacacggugaaaccuugucucuacuaaaaauacaaaaaauuagccgggcguaguugugggcgccuguagacccagcuacucgggaggcugaggcaggagaacggugugaagccgggaggcggagcuugcagugagccgagaucgcgccaccgcacuccagccugggcgagagagcaagacucugucucaaaaaaaaaaaaaaaacuuuguggaaauguaggccaggugugguggcuaacgccuguaaucccagcacuuugggaggccaaggcgggcagaucacgaggucaggaguucgagaccagccuggccaauauggugaaacacugucucuacuaaaaauacaaaaauuagcugcgcaugguggcgggugccuguaaucccagcuacccaggagggugaggcaggagaaucgcuugaaccugggaggcggagguugcagugagccaagaucgugccucugcacuccagccuaggugacagaggaagacuccaucucaaaaacaaaaaaaaauuauaauaaacuuuguggcaaugugguuacugauuuguaacuucauccuguuguggucagagaagauccuuuguaugguaucugucuucuaaaaucugcugagacuuguuuuguggccuaacauauguucucuccuggagacagucugguggacaccugagaggauguguggcuuugugcuaugagaucccggugugggcagaguccaccucuggaaggccauugaagccaccgguucauaguagcuucugugcacguuuuguggugcccuaagguaguguuugugcuggcgcucgguggggcuucauugugcuaaucacaagguuuccuguuugcagcgugccugccaguguagagccgguggagcagcugggcucggcgcugagguuucgcccuggcuacaacgaccccaugucaggguaaguaaagccugcuggcugggugcaucuuccuggcaaaggugacaagagggcucaggggggccagugugcaucugggggacugggaugauucggucauugggguggagcccaagaaacugucaccauaucugaccacuaggacacuugcuccuuaugcugugaaggugucuucauuagugugcuggggugguggggacgugggugacuguggucggggguugacaauugaagggccagggguccgggguacauugaccuagaugcuggguugagucagcagaugacugauggguuccgaugggggcaggagugacagagaaggggcuguagugggcaugcgaugaugguagaugggagcggguauauugugauugggcauuggugacaauggugauggugauggggugaugguggugcuggcaagcacaugguauuggggugauaacgguggggagagguccugggacaaccaaugaugccacaguuccugugugaagcuuugugggucaugguuacugugucaggacucuccucucagggaaccaaggagcaaccccagcccccaaaccccaguccccuuggcugggcuccggccuguguuauugccaccguaacaggaguugugacaucuuccuggagguggaaugggugugcagccacuagggcgggcuuuccuggcugggucuguuccacuugcugucuccccucuucccugguggaucuagaagccgcuuaaagaaaaggucugcccaggagggcaguguuuccccuuuggaggaagagaccuugggcucugggccugaguggggggcuuggguucuuguuuugccccaucccauccuguaggcccaggcagguguggggccucacuggcuacagcagaaucagggcagggcuccugugcguggaggaggggaagaagugcagcugugccccuccucaacaccucagggcugguuggagccugagaucucuacaggccuuccccuccacguccaggagcccaggagcggcuguccugcccugaggcccaggauugugggcuuucagauggccccgugggagaugccuaugcccagccugugugggccuggaggcagucaaggagugggccucguccugaggacagugggcaucacagaggguucugggagcgcuggggaccgaauggaguuuuaggaagaccacacuggcugcucuguggaagauggaaagagcagauggggugggugugggaggugggaagucguuucuguaggagguggccucaggcggcuuccuggccagaggcgcuggaggccagagagagccagagagagccagagcuugguggcaagaggugaggauggagacuuacauucagcagcucccacaaggcaggguguggagggagugggaaggagcaggggcuggacacuggaggagggcaggcuuguggugaagugcgcuguggaauggagauuucacaccacggaguccauggcacccugggcaagagcgaggcaguggagcagauugaagagcaguuggaaauuguaugcuggucgcaggcaacuccuuggagaguuuuagccgugaauggaugaggaguaagacaggcauugaagcugggcacagugccacacuucuguagucccagcuacuugggaggcugaggcaggaggaucgcuguaggccgggaguucagggcuacagugagguaugauccugccugggaauaaucccugcacuccagccugggcgaccccguguuuuuuguuuuuuguuuuuaaaagggaggccgggcgugguggcuaaugcuuauaaucccagcacuuugggaggcugagguggacagaucaccugaggccaggaguucaagaccagccuggccaacauggugaaacccugucucuacuaaaaauaacaaaaauuagcugggcguguuggcgggugccuguaauuccagcuacucuguaggcugaggcaggagaaucacuugaacccaggaggcagagguugcaacaacaaaaaaaaggaguuggagaauccaugugaaggguuguucuguuucuuuuuuuuuuuuuuuucucaauguuauagauuugagcugggacaacaaggaggagacagugcggaacaagcucccagaggggcauaggaggaggaguggcuuccugggguuguggcagcagggaggugacuggggccagcucagaggcaccucugacuccccaaggugugcaugugggaccuguucuguuagcccagcugccgccguggugugcauagcacugggccucgugugccgugugcuuggcgugcccugcugccuccugccccaggcuauuuugcccaugcaucgagaagagcaggugacuggagugaugcucccccucccgcgccucaugucaucucuuguccucugcuuuguucugagccccagcucaugccuaggaccugcuuuauaaaggugcaggagccaaagaagugggugcugggaggaggggagggggacagggucaucaaugacuccucucuuuugaacucucucagguggcugccugucugggucccaaggagacauccucugcugggcauccaugugcugccuacuuggccaagggcacuguuuguccacuggagaguuggcuccauguugagggccuggccccugcugucgaggccauggccaggagcucaggagaagccaggcaggggaaagaccccaggccaggagccccaccccagcucugccccacucucugccacugaccccuccuccucuccuuauuuugggacccuugccucuggcuaucucccucugggcuacuuuuuuuuuuuuuuuuuuuugagauggaguuucucuccuguugcccaggcuggagugcaguggcacaaucucugcucacugcaaccuccgccuccuggguucaagcaauucuccugccucagcuuccugaguagcugggauuacaggugccggccaccaugcccggcuaauuuuuguauuuuuaguagagaugggguuucaccauguuggccagacuggucucgagcuccugaccuugugaucugcccgccucagccucccaaaaugcugggauuacaggcugagccacugugcccgaccugggcuacuuuuugaguucccuaggcaugaggcagcaggcuggagccuggauccagaugggcccacaucugccuggcccagaaccccugccgcaggaggaugccacccauggcagggguuauaguguggcccuauuugugggcucaggguuggcccaggucuucugcccccuagacuuuggcaagugaaucucuguuuaauggugaguggcuccagccauucuugccuuauucacuccccagauagucuccugguuguuuuggauccuacugucauguccucuucccagcuccuugcacucacaggacugucgggcaagacuguuggguuucuaaguaccgaauggcagaagcucuggcugcagaccccaaggaggccaccacugacccucugcugugacuccacugccacagugcaggggaaagggagagaggcccauuaggcgagguguggccacagccccggugcuaccucccagcccucaaagcguccuuucugugguucucaggcccucaagccugucuggggccuugcugacaccagggugggggugcggguaucccagguccagagccagccuguucacugucuaagguuuggagucuuccauuucuuggaggccgccgaguucuccccagacccuacaauccugcccaaacucccugccgggguggcugccccucugccuucugcucccuccugcuugggccgacucugccuuuugagcuuggccccagccuugggagaccccauuccuuccucucggaggcguaguuccauugguacuguagccacguguggccuuguacccuagccccgcucugcaaccaccccuugaauguugcuugguuuucuaaggucaccgugccuggguggggucucugagugaauuuauucauuuaccuguccaauauuuauugauuaauucacaacauuaugcaaaaauuuuuuuuuuauugagcacucacuauaugcuaggcacuggaaauauagugguggccgaaagcuguauuggaugauaaugguacaaagcaggggcaagacguaguugaucaaaugcucacacacaacagaguguguguuuaugaacugaaguagaaaggaauuuaauuccgugcgggcaugugcugaggggccuggccucuucugcaugguggggagggugcuccuggggaagugaccugaggccugaggggugagcaggaaugaguuagguguggcugagaugaaaggaggaaagggcugagcuggcaggaguaucugcaugugcaaaggccuugagcaggacacagcauggugcuuucaaagcugaaaggagggggaugggacucagcacagagguugaaggagagggggcaguuccagaccacacauggcuuugugggccuaauagggaguuuuauuuuauuuaaaauuuuaauuaaaggccaggcacgguggcucaggccuguaaucccagcacuuugggaggccaaggugggcagaucaccugaggucgggaguucgagaccagccuggccaacauggugaaaccccaucucuacuaaaaauacacaaauuagccaggugugguggcacgcaccuguagucccagcuucucgggaggcugaggcacgagaaucacuugaacccggggaggcggaggcugcagugggcugagauugcaccauugcacuccagccugggugacagagaaagacucugucucaaaaaaaaaaaaauuaaauuaaaaaauaaaauuuuaauuaaagauuaaaaauuagccugggcaacacagugagacccugucucuacaaaaaauaaaaaaauagccgagugugguggugcaugccugugguuccagcuacuugggggacugaggugggaggaucacuugagccugggaguuugaggcugcagugagcugugaucgugccacugcacuccagccugggcaacagagugagacccugccucaaaaaaauaauaauaauaaaauuuccuuuauuguaaauuucacugucuggugagacaaaucccagauuuuucuuuucuuccucuucuuuuuuuuuuuuuuuuugagacagauucucacucagucucccaggcuggagaaagccuccugaguagcugggauuacaggugcgugccaccaagccuggcuaauuuuuguauuuuuugguagguaaagaaggaguuuugccauguugcccaggcuggucucgaacuccugggcucaagcuucccaaaagccucggccucccaaagugcugggauugcaggugugagccacugcacauggccucuuuucuucuuuuauugucaacuauaauacauacacaggaaagcacagacacacucaguuuaacauguaauuauaaagcaaauuccuuuguaaucgcaagagcuacaggagccauagcuggcguuugagcagguggugacaugauggaccuugcaugguggccccaguaggguggccgggagaacauggggagacagauuggagagagugcuggugggagaggaggagcuaaagggacaggcuggacuuugcuccuugcaugugugucagccagggccccagggucgcccucugggccuagauggaugcagaagcuccuccuggaggcugguggaacagggccgguggguuagguggaagugggggugggggugcugcugagcuagagugugguuggggcccacugaggcugggguggcucuuagacccccuaguggccaggcugcauucugaggucaggcccuguaggcuuggcucagggaggcagcucugggaggcaaauggggcaccucugcuuccccuccuccccggcccccgccccuuggcuccuuggcugcuagccggcugcugggcggggccauccugugucuuuaagaggguggaacggggcuucgcgucugugcuuccuguggcugacgucaucuggaggagauuugcuuucuuuuucuccaaaaggggaggaaauugaaacugaguggcccacgaugggaagaggggaaagcccagggguacaggaggccucugggugaaggcagaggcuaacauggggugagcuugggcgccaugcugcguguguguuugagagacaaacacugagagaucucuggagggaugauaacggccuugcggucgcaugucauugauggcgugugaaugugugugcguuucuccauuccugccucugguugggccggaagacaccuguagucugcugguccuguuuuagggccuuguccuggacggccuggggcugauggcuccugcuuugagaguccugaggggugcuuuugagccuggagucuuuagcucugucccugggcugugcuguggggcccugcugaaguugugcagucccagggcgggguagggugggacccacacccuccuugggccucuguugggcagaggcugcugggggaugcccuacagcuaacaaagcuccuagaguuuuuggauguguuugaugcaguuaccaagcauuugccuuuuguuggaauaaagcuuggguugggcaugguggcugacaccuuuuaaaaaaaacuuauuauuuuuuauuuuuuuggagacagagucucgcucugucacccaggcaggagugcaguggcgcgaucucugcucacugcaaccuccgccucauggguucacgugauucuucugccucagccuccccaguagcugggaccacaggcacgugccaccacgcccggcuaauucuuuuuuuuuuuguauuuuaguagagaugggguuucacuauguugcccaggcuggucucaaauuccugaccucaggcgauccgccugccucggccucccaaaguguuaggauuacaggcaugaaccacugcgccuggccuauuuauuuuauuuuuuaauuuuuugagacggagucucccacuguugcucaggcuggagugcaguggcacaaucuuagcucacugcaaccucccuccuugguucaagcgauucuccugccucagccuccugaguagcugggacuacaguuuugcgccacuacgcccugcuaauuuuuguauuuuuaguagagacaggguuuuaccauguuagccaggguagucuagaacuccugaccucaagcgauccgcccacuucggccucuagaaguguugccaccgcgccuggccaguuuuuuauuuuuauuuuuuauuuauuuacuuuuuugagauggaguuucgcuuuuguugccuaggcuggagugcaauggugugaucuuggcucacugcaaucucugccuccuuggguucaagagauucuccugccuuagccucccaaguagcugggauugcaagcacccaccaucauguccggcuaauuuuuuuuauacuuucucgaauuccagaccucaggugauccaccugccucggccucccaaaguacugggauuacaggugugagccaccgcacccaaccguuuuuuauuuuuuaaaaucuuuuaucauccaguacaaaauguaaggcugacaguuuuuuuuuuuuuuuuuuuuuuuugagacagagucucacucugucccccaggcuggagugcaguggugcgaucuuggcucacuacaaccuccaccuccuggguucaagcgauucuccugccucagccuccugaguaguugggacuaccggcuaauuuuuguauuuuuaguagagacgggguuucaccauguugaccaagcuggucucaaacugcuaaccuugugauccgcccaucucggccucccaaagugcugggauuacaggcaugagccaccgcacccuggccacgagacaguuuuaaucucagcacuuugagaggccgaggagggaagauugcuugaggccaggaguuggaaaccaguuagguaacauagugagaccccugucucugcaaaaauaaaugugguagugcaugccugugguuccagcuacuggggaggcugaggugggagaaucacuugagccugggagguggaggcugcagugaacugugaucauaucacugcacuccagccugggcaacagagugagacccugucucaaaaaauaaauuaaaaaagaaaaagaaugaagcuuggccucugcaaacacggcaggguggcuaguaaggggcucugucugcauuuggaagucagguuuuuuuuuuuuucuuucauuuuugagacagaguuuugcuccuguccccaggcuggagugcaauggcgugaucuuggcugaaugcaaccucugccucucggguucaagcgauucuccugccucagccucccaaguagcugggauuacaggcaccugccaccgugcccgacuaauuuuuguauuuuuaguagagacaggguuucaccauguuggccaggcuggucucgaacaccucaccucaggugauccgcccuccucggccucccaaagugcugagauugcaggcaugagccacugcccccuccuagaagucaauuuuggugagcuucccagcccagggccugcuuucucaaagggcaggcccucuggccuccugccuccaggccucuguguccuccccuuggcucuuggcccucucaccuguggaaguggccaugcaggucagaggugggggacccaggggugugugugaccccuggcacggugcuuggcauacagcaagcuugcaggcagaggcaacuguccuuaucacucaggggccagccucccugcccuggggcuguuguggagugcaggggaacaaugggggccuccuguucuggccacacuggccucugcccuccuggggcuucucucagucuucacccugugcuuugugagccauguuaucuucacugucugccuccuacacuggacugugggcucccagaggccagggcuggcugucuugcccacuguuaaguuuuuugacucaaaucacagugccuggcuuguggcaugugcccuauacccaucugcugaucaguugguugugagguggacaagauagauguauguguguggcaugggacuugaagagcuuccucccaugccucugagggugggacaagcgggggagacccagggagagacaguuacagggacucacauauaccccaguuuacacaagaggaaacagauugaaacaggugcaggccacccgacaaggaaguagcuauaacuguauugcccagaccccuucuggcaagaggggcaugccuugggaagguguggaugcuggucuggggaggggcgaggugccccgggucacgucuagcucuuuggcagguucggagcgaccuuggccguuggccugaccaucuuugugcugucugucgucacuaucaucaucugcuucaccugcuccugcugcugccuuuacaagacgugccgccgaccacgucguaagcgugcccacccugccccacugugacccccuggggugguaagggaagcugaccaggcccugcuuuggcuaagcuggagggauggguggcaagccuggcucucaagaccuggggagauggaggaggguccugacuggaauucucuuugcagcgguugucaccaccaccacauccaccacuguggugcaugccccuuauccucagccuccaagugugccgcccagcuacccuggaccaagcuaccagggcuaccacaccaugccgccucagccagggaugccagcagcacccuacccaaugcaguacccaccaccuuacccagcccagcccaugggcccaccggccuaccacgagacccuggcuggugagugccccugccaacucuagcccugcccgacuucccgagucucugccagcaucccucgggcacccaucccaaacuacaucacucaacaggccucugccccuuucugcuugccugccacucacacggcagcccaccaugcucacagccaaccaggguccucucugcuuucaggaggagcagccgcgcccuaccccgccagccagccuccuuacaacccggccuacauggaugccccgaaggcggcccucugagcauucccuggccucucuggcugccacuugguuauguugugugugugcgugaguggugugcaggcgcgguuccuuacgccccaugugugcuguguguguccaggcacgguuccuuacgccccaugugugcuguguguguccugccuguauauguggcuuccucugaugcugacaagguggggaacaauccuugccagagugggcugggaccagacuuuguucucuuccucaccugaaauuaugcuuccuaaaaucucaagccaaacucaaagaauggggugguggggggcacccugugagguggccccugagaggugggggccucuccagggcacaucuggaguucuucuccagcuuacccuagggugaccaaguagggccugucacaccaggguggcgcagcuuucugugugaugcagauguguccugguuucggcagcguagccagcugcugcuugaggccauggcucguccccggaguuggggguacccguugcagagccagggacaugaugcaggcgaagcuugggaucuggccaaguuggacuuugauccuuugggcagaugucccauugcucccuggagccugucaugccuguuggggaucaggcagccuccugaugccagaacaccucaggcagagcccuacucagcuguaccugucugccuggacuguccccuguccccgcaucuccccugggaccagcuggagggccacaugcacacacagccuagcugcccccagggagcucugcugcccuugcuggcccugcccuucccacaggugagcagggcuccuguccaccagcacacucaguucucuucccugcaguguuuucauuuuauuuuagccaaacauuuugccuguuuucuguuucaaacaugauaguugauaugagacugaaaccccuggguuguggagggaaauuggcucagagauggacaaccuggcaacugugagucccugcuucccgacaccagccucauggaauaugcaacaacuccuguaccccaguccacgguguucuggcagcagggacaccugggccaaugggccaucuggaccaaaggugggguguggggcccuggauggcagcucuggcccagacaugaauaccucguguuccuccucccucuauuacuguuucaccagagcugucuuagcucaaaucuguuguguuucugagucuagggucuguacacuuguuuauaauaaaugcaaucguuuggagcugcugcccccuuucuuccuggccucggcugcuggaauuggaaucaggcuguacucuuuccauccauuugggcuucu

SEQ ID NO: 192098 - RNA, 31134 nt, Homo sapiens
auggguucaagaucuuuuauuuucagagcuuccaacaguugguuaguaaugcuagcuaagcugguauaaucugaaggccaucccaccuuucucuuuaggcagucaaccaacagaaucucuuucuuacaaacaauaucauuaaccaguuggaaucugucucaaugcgcguguaggaagaaguccucucccccacauuuuucccaacaagauuguuuuauagccaaauguaacucaaacccguaacacagcaacuagccaucuccaguaucacugauucccaccccaagaaguugagguaagaggggagagacugucuccuguuuaagaaaaacccaccuacaccucagugaagccgugaugguaaggaggcuggcaccagagggcagggaugaguaggcacugaaacaggucucucuagaaucaaugaagucugccccagcuccuuggaugagguguucuuuugaaauucccacuuuuauggaguuagauaaggggacaaccggugaugauucaucacucccugucucuaaaauuaaaacaugauaaacccagaaaguuuuaccuucaaaauccaccaagcucccuccugagaaaauucuauccagucauguccaugccagcacccacucccuucuccuaaugcccagggcuuccagccccucuccucacccuugggugguccauccaacacugauuugauacucuuugacucauaauaugaccauuuuuuaaaaauuagaaaauaaaagcuaucaauaucacagcaacauaaggaagauacucaguggacaugcuccucccccauccuguggagcccaccuacccccaccccccuucccugggaaaccuacacugcaacauuccagcacugagccggggguggcccaacagaugcugccucaagugcuuuccugacuguggcuccuauaccagccaaugucauggaacuggggugaggaagaacagggccacaccucccaccaaauagauaucgguagccaguggugggucugggagauuuagcuuaugucaggcagccaagccuggguccaacgcucucaccaggaccucaguucuuggcuuaaauagcagcagccccaguaccacagcgccuccugggggugacagagcaccuagcuuucuguccgauaacuuauaacagguuugcauuuucuuacccacuucuuuuuuuuuuuuaaauuaaaagccgagguagucccugggauaauaaaacccuaccuagaauggcaguauuucaaccuaaugaagcaguaaaauaagucuccaggaguuagaaaaaaaaauaaaauaaagugauugaugaaguugaauaaauuaaacauauggauuaucccacaaagaccuuuccuucccagguugucuuugcuauuuggccagcagcauuucuguguaacuucucuacuccccuccgucuccucuccccucaugagauggcuggagcccgauaaggccccggcugguucaucccacuguggcucagagcagcuugacacggugcucagaacugcauuguggcacaguucugauauggacggaggacgucuaacagggacagaagaggcguagccagcaagaugcccugggcuccaaccuugggagugugggagguagguuuaaggcauggaagucccaggcccccucuccaaaugucacacagcuguccccuuugcuuaaguuucucugcagcaaagaggguaaagggggauggagggaagcuugggcugcugcuggcugguccugccgcccucagagcuucuucagacgacuguacaucucccucuugcucuucuccccugcccagguccggcucuuggugcggaacuucuucaggucuucuuuaaaguccucguggugcaugggccgguagcuagggggcucacaguaagacugaggggacaggagagaauaagguuaggguacaccugccucacacccacaaccugguuuccucucugccuagggcuacaaggcugaaagcggccaggcagaccuagggagccaguucuacaggggcuuucuuuggguucagcagauacccaccuugucccccgaccccuggaaagaaagucaugaccaccagacagauccauuagucuaccacugggggcaggggaggagagaugcucuccacaaccccagucuuaccuggcauuucauaaagaacuccuuguauccccccuucaggacauacagcucaggguaguggaguuugggguauucauuacccaggcgaucucucucucucacauaccggcaccuagucaggggaaggaaggccaaagcaggguuagcuuuuccagcacagcaacaaggcaacgcagucaaagcagcaguuguggucuaagucccccuuauacacaucuucccaacuugacauuuauucuuagaaacaaucagugcugaguugcaaguuccuggccacaugagcagcacucacagccagugccaguagauggucucuuccccaauuuuccuuucuccaacaauccuagcaucugaguccugcccagcaccuucaccaccacaguuuguggcaaguuuucacuauaugagccagcuuccccuugcuuucuccaccccagccuucucuucagccaggcucccucacucaccuccuucuacauaagugggcuuguuucuuucuguggcuuuuaaagaggcugaacuugcuccugccucggggcccuguuucuauccucuacuuggacugaauggucuucaauauccagccaauggcugcuuacugccucgcccuuggugaaaaagcccgaggccccaaguccuucagaggccuacagcucuacaggccccuacugcugcucugccccuuguucaccccacgccagccccugcagccccacuacuguuccuccagccugccugggagcuccaccacuggccuuauuuuccucugaagcaccuucuuuuuucugagacagaaucucacucugucaccaggcuggagugcaagggcgugaccucaggcucacugcaaucuccgucucccggguucaagcaauucuccugccucagccucccaaauagcugggacuacaggcgcgugccaccgcccagcugauuuuuguauguuuaguagagauggggcuucaccauguuggccaggauggucucgaccucuugaccuugugauccaccugccuuggccucccaaaguguugggauuacaggaguuagccaccgcacccagucaccuuuuuuuuuuuuuuuuugagauggagucucacucugucgcccaggcuggagugcacuggcgcgaucucggcucacugcaaccucugccuccuggguucaagggaugcuccugccucagccuccaaaguagcugggauuacagguguccgccaccacgccuggcuaauuuuuguauuuuuaguagagacgggauuucaccauguuggccaggcuggucucgaucuccuguccacuccgaaauguaaguuccaugaaggcagagauuuuuuggucuguuuuguucacugcucuucucccucaguaucuagaaagguaucugguacacaagagccaagaguaucugcugauuuucucuugaagcucagugguuuggggccuuuguuagcugcucaugagggaugggcagcagcuuccucugcagcacguagcuuaaaccauuugccugugguuaaaaggaguuuggcugggcgcgguggcucacaccuguaauuccagcacuuugggaggcugaggcgguggaucacgaggucaggaguucgagaccagccuggccaagauagugaaacccugugucuacuaaaacuacaaaaaauuagcugggcgugguggcaggugccuguaaucccagcuacuugggaggcugaggcagagaaaugcuugaacccgggaggaggaggcugcagugagccgagauugugccacugcauuccagccugggcgaaagggcgagauuccaacucaaaaaaaaaaaaaaaaaaaaaaaagaguucaccugugaaucccaaaucuuuccccaguggaacaacagaaagccagugauggcgaaacucaaguggggaacgaaguguaagggguaucuguagauggugauauaaacaugcagcuugcaaauacagaauacagagauggggcguuuucuguauaucuaggugaaguuucaauaugguauaauaauguccuuuauauuagagguguuaaagaggaagauggggaaaugagagauuaagagaauagcaucuuuugggcugggcauggcggcucacaccuguaauccaagcacuuugggaggccaggauugccugagcccaggaguuugagaccagccugggcaacacagugagacccugucucuauaaaaaauacaaaaauuagccaggcauggugaugcauguuugugguccuagcuuccugggaggcugaggugggagaaucacuugagccugggaggcagaggcuacagugagcugugcuccugccacuguacuccagccuggacaacagagacugacccugacucaaaaauaaaaaaaaaagagagcagcaucuuuuguggguuuaaaaacaauuuacauguguguguauguguguccagauuaguuuguuucaggccuauaaucccagcacuuugggaggcugaggcggguagaucacuugaggucaggaguucgagaccagccuggccaauguagcaaaaccccgucucuacuaaaaauacaaacauuagcuuggcaugguggcaugcacccguagucccagcuacuugggagccugaggcaggagaauugcuugaacccgggagguggagguugcagugauccgagaucgcaccacugcacuccagucuggguggcagagcaagacuacaucucaaacaaacaaacaaaaaaacugcugagugaauaauuccauucaugaaugagcauccuuuggagacagauguuugaaggacuuaugagaugacagucaaaagugucaaguuguacuguaguugccuguguguagagcauguacauacaaaugugacaaaauguuaaaaauuaauaaaaucaggugaagugugugcaaguauaaccuuugugugugugugugugugugugugugugugugagagagagacagaaucucacucugucaccuaggcuggaguacaguggcaugaucauggcucaccacagccucgaccugcugggcucaaacgauccucccaccuccuauuuuuuguagagguguggucccacuguguuacccagguuggucuggucugaaacucccgagcaagugauccuccugccucggccucccaaaguguugggauuacaggugccacugugcccagccauaaccucaccucuucuugagcuuuaaaaugguucaggucaggcgcaguggcucacgccuguaauccaagcacuuugggaggccgagacgggcagaucgcaaggucaggagauggagaccauccuggcuaaaauggugaaacccugucucuacuaaaaauacaaaaaaauuagccaggcgugauggugggcaccuguagucccagcuacucgggaggcugaggcaggagaauggcaugaacccaggaggcggagcuugcaguaagucgagauugugccacugcacuccagccugggugacagagcgagacuccgucucaaaaaaaaaaaaagguucaaaggggugggcacaguggcucaugccugcaauccuagcacuuuggaggccaaggagagaggauugcuugaggccaggaguuugagaccaaccuggccaauauauuaagaccccaucucaaaauuugaaauuucugcugggcgugguggcucacaccuguaaucccagcacuuugggaggucaaggcggguggaucaccugaggucaggaguucaagaccagcccggccaacauggugaaacccccaucucuacuacaaauacaaaaauuagccgggugugguggugcacgccuguuaucccagcuacucaggaggcugaggcaggagaaucgcuugaacccaggagguggagguugcagugagccgagaucaugccacugcauuccagucugggugaaaacagugugccuccgccucaaaaaaaaaaaaaaaaaagaaagaaagaaagaaagaaaaagccaggugcaguggcucacgccuguaaucccacuacuuugggaggcugaggcaggcggaucaccuaaggucgggaguucaagaccagccugaccaacauguagaaacccugccucuacuaaaaauacaaaauuagccgggcgugauggcgcaugccuguaaucccagcuacuugggaggcugaggcaggagaacugcuugaaccugggaggcagagguugcagugagaagagauugugccacugcacuccagccugggcaacaagagcaaaacuccgucaaaaaaaaaaaauugaaauuuuuuaauuuaaaaauguuuuuuaaaauaaauugguucaaaauaaaaagguggcauaagaacgugguccugcagaagucucccuuggaccauccuaguuaagcugcacucucuguccuaccucucugccuguccuccuagcauuuauacggauccccacuuggaucucugcugcaguaggguccuuguugguccugcucgcugugguauuuuuacuguacuguguuuuacuguaguuacauuuuuauugucagugccugacaaacagcaggcuugcaauccuuuuagaauggacacagaugacugaugggcagcucuuuggcccccuuuuuucuuuucacccugaaauugguaauaauaucaaguguuucaaagcaucauaucauaugagguuuuacagaaugagaacuucacacuuuucuggcauuugcauaaggaacggucacuuuguacuugaaggaggucacaugagaacaguagccccacagaucagacuaaggacagucggggagacuggaagagccaaaguucaccucaggauaaaauuacauaugaaaauggcuuguuaugugccagagguugcuugauaugcuaaaauaugcuccaagugcaagccacaaaccaccaugucccacaaaagcaucauggagccugugccccagaacccaguuccgugcagcacucacaugcggggaccucucucagaagaaaacucgcagugaaacacaacaaugacacgcuugccaucaguagguacaaugggcuucuucaauaagaagucuucaaccucuucuuccaugugcaaguucacugcacccugugaagacaacagagacccuuggaaccugcacguuucacacaugaaguaaugauucagcaagauguaaugauucaucaagagugaucuuuaaguccacaagaccaguuugugauuuuugcaguucuucuagcugaauagcccaguagaccauuuggcaccuguaucucaauggagcuuuguggguccguacacguucaucauacaguaaugcacauggggacuggaaaugggcaauucaaauaugacaaugguacacuuuauagguaguuuuauaaauuuggggauuuucaaaagccacaagacaauggcaaacaguaacaucguauuuaaaguaccuccuuacuauauuuaaacacuauuaaucggguaaaacauuaaaauggcaggccaggcgccguggcucaugccuguaauccuagcacuuugggaggcugaggcgggcgguuugccugagcucaggaguuugagaccagcccgggcaacauggugaaaccccgucucuacuaaaaaaaaaaaaaaauuagccgggcguggcagcgugcaccuguagucccagcuacuuggaaggcugaggcaggagaauugcuugaacccaggaggcagagguuguggugauccgagaucaugccacugcacuccagccuggcgacagagcggacucugucucaaaaaaaaaaaaaaaaaaagauuaaaauggcaaaaucaguuccuuucuucuugggaacgugugucccaacacgccccuccaccaggcagcuugcugaacaaucaacuuuggaggcaucacuaggccuggcacagacaccaggacauguugccagagauggucuucuccucaucaggagcccuggggugcucagacauugguacccaagccucuuaaaugcuaugaaacccauucuugucccccgaaugacuuaaacaucaguggguaccuccuacaaguguccuugauaaugauggugugagggacaaacaugaagaauaacugugcacaaggugguagagaguauugcagacaagggaacauucguuaagagcacccggaaucaaaugccuuccacacucacuguauuguuucaaaauucuaacaacuagcauaugagcuaaguggccaggugucacuguccuccccacuuuaaaaccacagauccuguuuagggcuccuucuacagcaagucucaggaauccauaccuugauguggccucccucguauucauauggguaucgacagucgaugauaacaaacucuuuaaugagguuggcaaacuugccauucaaaacagaugccaucuguugagagaaaauuagggagaaucaacuuugaccgucagggaaaacuagauucaaguacccgaugugugguggguuucaaaaggauggacuuacaauuucuggagagauguauuuuaaauccugauguuucccagcaacuguaugaaagagauaacccuuaaaaagaaaaaaagauacuuagagaaucugaaagccuauauauuauucacacuuauacuguuuugucuggcugguaggaggcaucuuuuaaaaaacaaacauuaauggccaggcacgguggcucacaccuguaaucccagcacuuugggaggccgaggcuaguggaucaccugaggucaggaguucgagacaagccuggccaacauggugaaaccccaacucuuuuaaaaauacaaaaauuagccgggcguuagcaugcaccuauagucccagcuacucggaaggcuggagugggaaaaucgcuugaauccaggaggcggagguugcagugagcugagauugcaccacugcacuccagccugggugacagagcaagacucccucucaaaaaacaaacaaacaaacaagcaaacaaacauuaguuaguacacacuaguuacucuucuaguuacuucauuaacauccugacauuuaauuuucacacaaaccaaugagguauauuauccccauuuugagcaccuuauccaagguuaccuagcuaguaaggcagauuuaaauaaagaaaccucagguaaucucauuuuccuccugcuuuugucaagaauccacacgucaguaguuagacugcgaauagcacuuaaacauacagauuucacucauuuacugagcaccugcuauguccagcauggugccaggcacuggggauaggaaaaaaagagaccuagcccagccuugaggaggaagaugcacacauuagcaauuacucauuagggugacuggcugagccaagaguucaucuauccccaugcauaggcccauuaagacaaauauaaccaggccucaauucaaguugaaaauuccacugagugugguggugcaugccuguagucccagcuacuugggaggcugaggcagggggagcacuugaggccauaaguuugaggcuacaguguacuaugauagcaugugcgaauagccacugcacuacagccugagcaacauaguaagaccacaucucucccugccaaacaagagaagguuccaaaacugaggauacagcuggaucuuugcuuguucucuucauucuccguuccuucaaaacccauuugggcugaaauaucaacggcccaaccccagacguuccccaacccccuagccaagauaaacccuuuuacuucucacggcaugcuguuuauguuuacaccucacuaaaauuuauuucagucuaccaugugguacauguaguucacgucucaccucuccaaccacaugcuaaauucuuugagggaaggaacuguaucucauuuuggaaucucugccuaacacauaagugcuucaauaaauguuaacuaaauuaaugaauaaaacauugaucugguaaccuucaagucaaaaugugauuaaagaagcugcuauugacacauucccuguccuagccuuguauuuuacugcagccaagccuucauguaguauaucaggcuauuagaagaucuuccucuagacuuccuggagggucuuuucccucaauggccaagcuucucugaacggagaaauucagucucaaucccagaccuucuaagauaaccuuucaacaugcagacuuguaguguggcuacagauuuauuucugcuguacacuauccugcuaauuacuauuuuuauaauaacacaguucccagagagccuagucuuuggguuacaaucaaggugguugguggacagcucccuaccuaaaacugcccaucagcuauagugauaucuacagucucagaaaccaacauauaccugaucaugagaaacuaaguuugcuucccuaccuuuaacauucuuuuaacuguguccuuuuggagguaugccaggaaccacccuggggagggagacaggcugagugggauucuaaauacccacacucccuccuacacuugccagagcagcucugcuugcaauuaccuuggagaagucuccuauaaggucccuugggucauuguccaaaauguucucaaugguuccuuugggggaagaugccagggauaaagacugaugaagagucuguaacaaaucaaagguagagaaugagacaaggguucugaauggaacuuccgaaaacauucacuuggagcaugucucgaggagacuaaaauguuaaugccuacauuuaguaagaaguuuuuauuuuauuuuauugaaucuggagugaacaaaaacagauguggguuauugacuaggucuccuauuauuccagugucuaaccgaauugcucugaaacuaaguuuuccuuccuuccuuaaaaaaaaaaaaaaaaaaagggggugcaggugguuuggcucaugccuguaaucccagcacuuugggaggccaagguggguuacucacuugagcccaggaguuccagaccagccugggcaaggcaggugaaucgcuugagcccaggaguuccagaccagaucaaagagcaagacccuguccacacacacacacacacacacacacacacacacacacacacacacacaagcugggcaugguggugugugccuguagucccagcuacuugggaggcugaagugggaggaucaccugagccuggggaggucgaggcuacagcaaguggugauggugccacugcacuccagccugggugacagacugaaacuaucuccagaaaaagagaaagaaacaagggggguuaaaacuaggauuaaguuuagaaaaaguaugucuuaacuuuuuuuuuuuuuuuuuuuuaaaaagacagagucucgcucugucgcucaggcuggagugcaguggaguacaggaguggagugcaggcuggaguacagugaucuuggcucacuguaaccucugccucccagguucaagcgauucugccgcagccuccagagcagcugagacuauaggugugcgccaccacgcccagcuaauuuuuguauuuuuaguagagacgggguuucaccauguuggccagauggucuugaacuccuggccucaggugaucugccugccuuggccucccaaagugcugggauuacaggugugagccaccgcgcccggccuacgucuuagcuuuauucaaugagaagaggaagccagcuguuaaaaaggggauaauuugaguaaaaggauaauacuuguaauacacagaaacacauuaaauguuuuaacccaugaauuccugauuauuauugaaaaacaacuauaagucuugcuuucaacuuuggaagaugcuugguagggcauuauuuggaaacuggcaaauaaagagauccaauauucauccugccuuucccaaggguaaccacaguguuugaugaguguaaguuucucuuuauagauauauucuagcuaauuaaugaggaaagaauguaaaaacugcaguaucaucuuucugaaacccuggugaaaugaaguaaaaaaucugggcagcaaucaccaauggcugccuggcacauuauacuuccugaucaaaguagacaaaaucaccuaugugauauucuugccaaacaaauagaacuggaauucaauccauccuuuccagaguuagguuaaggcaauauaggggauagaagacaaugucugaagaccccacaggacugugggaaccuuugcaggacaaaugacuugagcucuucaacaaauaaaaauaugcaagagggaaacagauggagcacugaaaucugaagaguaagagaccuauugaccaacuacaguguauagacuuuauuuggauccagauuuuaacaaauaaacuguaaaaguacuuaggagacaacuggggaaaacugaacccagacuggauauuugacauuugauaguaagaaauuuagcucugccgggcgugguggcucaugccuguaaucccagcacuuugggaggccgaggugaguggaucacuugaugucagggguucgagaccagccuugccaacauggugaaaccccgucucuacuaaaaauauaaaaaauuagccaggcgugguggugggcgccuguagucccagcuacuugggaggcugaggcgggagaauugcuggaaccugagaggcggagguugcagugagcagagaucgacccauggcacuccagucugggcgacagagcgagacuuggucucaaaaaaaaaaacaaacaaaaaaacacccagaaauuuagcccuguaugauauguuugugugaggaaaacaccccacaaacucaaagugauuuuucuuauucccucacucaacagcaacagaagacagaagugcuguuacccccagauaugaggggauuucucccuaccagcaagcaagcaagcaagcaagcaguucugcaguggaaaauagcugggugccguccaauucaauucugacacuaucuaccugcagagcgucagaucaggaaguugagggcccaguccucaaaaccacaccacccuucagacaccaguugggccucuggaucuucugaucuacgaccaccagcuuuaaguagggguucccaugaccccuucuuuggguuuaauuugcuagaaguggcucacagaacucaagaaaacacauuuaccaguuuauuaugaaggauauucaaaggauauagaagaagacaugcauagggugagguaugggagaagggacauggagcugccaugcucuccuugggugccccaaccuccaggaaccuccauguguucagcuauccagaagcucucugaacccuguccuuucaagguuuuagggaggcuucauuacauagaaaugauugauuaaaccauuggccaugagugaucaacuugaccuuuagccccucuccuuuccguagauauuggaggguggggcugaaaguuccaaccucuaaucaugucucugucuuuccagugaccagucccacccugaagcuaucaaucauuaguauacaaaaagauaugaccuuggauauuccaaagauuuuaggaguuauaugacagaaggggaagaagacuaaauauauauuucacaauaucacagguaugauaacuguacucuagcaaugcuugacauuuucuccacaauggaauuuaaaauacuaaaaauuaaaauauaugaaaauaaaccaaaacaugagggccaauauauauacaaaauaauuauuaacaguauuauuuuauccaaaaaaaguuuuacaaauauggaaauaaaaaggucaaucucuauuacgguaaaagaaaaugaauauucuggccgggcacaguggcucacaccuguaaccccagcacuuugggaggccaaggcggauauaucaccugaggucaggaguucaagaccagccuggccaacuuggugaaacuccgccucuacuaaaaauacaaaaaaaauuagccaggcguggcagugggcaccuguaaucccagcuacucaggaggcugaggcagagacuugcuugaacuggggaggcggagguugccgugagccaagauccugccacugcacuccagcgugucucaaaaagaaagaaaaagaaaaugaauauucuuuuuuuuuuuuuuuugagaugaaaucucacucuaucacccaggcuggagugcaguggcgugaucucugcucacugcaaccuccauuucccggguucaagcgauucuccugccucagccuccugagcagcugggauuacaggcucauaccaccacacccagcuauuuuuuguauuuucaguagagacaggguuucaccauauuggccaggcugguauggaacuccugaccucgugauccacccgccuuguccucccaaagugcugggauuacaggagugaaccacagcacucagccagaauauuauuaaauauugauagauauuuucugacauguauacaauguaaaguuucacaaauguucuugcccuuauaacccagaauuucauuuuuaauuagaaauaaaaggaaaaucaggggaagggaaauucuaaauguccagaaggugauuuauucaauuauuucuaguauacuuguaagucaaaacacuaucggccaggugcacuggccugugccuguagucccagauacuuuggaggcugaggugggaggacugcuugagcccaggaauucaaggccagccugggcaacacaguaagaccucuuuucuacaaaaaauaaaaaaaaauuuuuuuuaaauuaacugggcaugguggugcaugccuguagucccagcugcuaggggggcugaggcgggaggagugcuugagcccauggaggcuguacugagcugugaucgugcuagugcacuccagccugagugacagcgcuagacccugugccccccacaaacaaaaagaacaaaaaccaaaaccaaacaacucucccaaaacaaaaauacuaugcaauuauuaaaauauucuuuuagaacaauacuuuaaaaacauucauaaagcauuaaaaacaaaagcagauacgauaaggcaguaggccuaaaugcuaaauguuuuccuagcugucaucucucuaaccuuuuaagacugugaugagauuuacuuaaaccuuuucaugccacagaaaacacagguaguucaccauuuuauaaugcuuaauaccaaaccucaauauaaggacaguauaaugaaggaaaaacauacaaauaaaccaguguuuugugugucuagccacagaauaaauagaaaaaauaacacaaaggaccauaggacuuaggcccagacaaccaugacacuagcucacccaugccaggugcugugucuaacaccuaugauccuggcacuuugggaggccaaggcgggaggauugcccugagcccaggaguuugagaccagccugcgcaacauggcgaaagccugucucuacaaaaaauacaaaaauuagcuggguuugguggcacacaccuauagucccagcugcuugagagccugaggugggaggacugcuugagccugggagguggagagugcagugagcggagaucaugccacugcacuccagccugggugacagagagacccugucucagaaacaggaaacaacaaaacagccuauacaacuaugagcaaugcaaugaauuaacuugaagaauuagacagacagggcugggcgcaguggcucacgccuguaauuccagcacuuuaggaggcugaggcgggcggaucacaaggucaggagauggagaccauccuagcuaacacugugaaaccccgucucuacuaaaaauacaaaaaauuagccaggcgugguggcgggguccuguagucccagcuacugggaggcugaagcaggagaauggcaugaacccgggaggcagagcuugcagugagcugagaucgcgccacugcacuccagccugggcgacagagcgucucaaaaaaaaaaaaaaaaaagacagaccuuuauaaaaaucaaguauuuaauaggccaugauaggucuggauuaaaaggaaauaaaauaucuacaacaaaugauaauaaaaacauuucaggucaaaaguuaugagacaaaucuaaagcagugggaaauucauagauucaaauagauuuauccagaaauaagaaaauuaaaaacgaaugaguuaaccauucaacucaugaagcuggagacagcaacacaacaagccccaagaaaagccugcucucccuaggcaaaggauggccuauugaggcagaagacuuuuagacaauaaucauucuacuagucaacacagaaacaauuauggccaacagcaagcgggggccuccaccuuugcccagcugucauacagugccccagucaccaccccacggggauggaaugaacuuccacucccucccagcaauaaugagacaaguccccacccaaggugucaauggaguuugugcuggggaacccggacuuccacccaugccuuucuugcaguaucagaggaagccugcuaaaacguaaaauuuacauagaccggagacucacaaauauacaggagacaauggaagaaucaccggucauaccaagaaccagaaaaaucccaacuugaacaggaaaagacaaucaacagaugccaacaacacuauggauggauguuggauuugucuuacaaagauuuuaaagcagccaucuuaaaaaugcuucaacaggcaauuaugaacauacucaaagcaaaugaaaaaccaacaugaaaacagccaaguaucagccaggugugguggcucacacuuguaaucccagugcuuugggaggccaaggcaggaggaucacuugaggcuaggaguucaggaccagcgugggcaacaucgcuagaucccaucucuauuaaaagaaacacacacacacccacacacacacacaaccccacaaaaccccagcaaaucuuagcaaagaaaauaaaugaaccacuaaguagaaauuuuuagaacugaaaaauacaguaucugugcuagagcaaaaaggaaccuaggaaacuaaccucaugggccuucucuggauuaguugacucuuuggggcuggccccagacaugcucuuccuccucuuuguacuuccagguggagacuccucuugagaucguucuggucucuucaacacugaccgagugcuggagcuacacagggaaggggagucaaacagcuugcaucgguuguccuuacaggaaaaaaaacagacagacccaucuuucauuaaaaccuguucacuugaaugguaagacaaauaaaccgaagguuuccugggaugaucuaagaucaauucuaaauuagccaacagacacugccgauucaucuaguccuagcaacucucacagggccuggcacauaguaggcacugagcacuuagugcucaaugaauauauacucagcugacauuauauagagaugagcaaaacguccuuugcccucacaaaaacugucuacauaauccugcgucaagagaagugugaccuuccagucaggaacacauuuuuggcuugccuaucuuccccuccauuuuauuacuugcaccuugcuuaauuaagcaggucaacggguuuaaauaccccacuuaaauccagaaaagaugcacaguagccagguuauaauaaaaaugggggcaucuuugguuaagguauaguuaagaugguaaauuuggagggaguggggaugggcagaguagcaaaugccuuucaaaauuguguucaaagucuuuuuuucuacuuggucuuuuaaagacuaauuucccaggcugggcgcgguggcucacgccuguaaucccaacacugugggaucacuugaggucacaaguucaauaacagccuggccaacaugaagaaaccccaucucuauuaaaaauacaaaaaaauuagccaggugugguggugcgugccuuuaaucccagcuacccaggaggcugaggcacgagaaucacuugaaaccaggagguggugguugcagugagcuaagauuugcaccacugcacuccagccugggugacagagcaagacucugucucaauaaauaaauaaauaaauaaagacaaauuuuccagagcccaagggaagccaaucugaccagugguagcaagagucagcucucuaaacgcaucucagccuauucucgacuccaugugucuuggccuggcuuuuccuucugcacagaauguccuuucacaucucaguaaaccauucauuuucaaguugaugcuaacauuucaaugucacuucuuugaaaucuuccugauaguccccaguagaauggaucacucccacaucugcucccauagagaccggggauuuucuuccucuuuugugugaaguuuauuuuccauuacagcucccagcaaugguuaguuuguaauaaccauuuguggaagacauuuccccacuauuaagagcuuacaagcccaugcuuaugacucuaaaaucaaaucuauaaaacuaacagccacuuccaaaguguucucacauuuuauguaauuuuaugccuaucaaaaugaccugguaaauuuacucauaacauuuguacugcguuaacauauuuucucaaaagcuaugcacaugaauguacuauaauccauaagugaucucaaaacuguagcuuggcugggcacgguggcucaugccuguaaucccagcacuuugggaggcagguggauggaucaccugaggucaagaguucgagaccagccuggccaacauagugaaaccucgucucuacuaaaaauaccaaaaaaauuagccgggagugguggcguaagccuguagucccagcuacucagaaggcugagccagaagaagcacuugaacccaggaggcagagguugcagcaagucaagacuacaccacugcacugcaccccagccugggcaacagagggagacucugucucaaaaacaaaacaaaacaaacaaacaaaaaaacuguagcucauuuguucuguaauuauaguucagguuauugagaauuaaaaaauaugaacuuaucaauuuagauguguaccuaaggguguauaucucugaacauacagguguauauaucuguauaggcacauucuugcuucuaacuuugaaaguaucccuaugaugaaaacacgaaucuauagcauguguauguguguguauauauaugugauuuugaauauauauacacacauacacuauagauucuguaucuacauauacuaugcuuucuguuugaaaguaucccugauggaaacacaaaucuauacuguguaugugugugugugaguauauauauauauauauauauauauauaaaauauauauuauauauaauuuuuaaaaucgaaaauaucuaccugaaaauacccagccucagguagguauuuucaaugaaaaacaaaacaaaacaaaacaaacaaacaaaacagcaacaaaaaacauccagccaggcacaguggcucaugccuguaaucccagcacuuugggaggucgaggugggcagaucaccugaggucaggagaucgagacuagccuggccaacauaauguaaccccgucucuacugaaaauacaaagauuagcugggugugguggcaggcaccuguaaucccagcuacucgggaggcugaggcaggagaaucacuugaaccugggaggcagagguugcagugagccaagauugugccacugcacucuagaaugggcaacaagagcgagacuccgucucaaaaaaaaaaacaaaaaacacagaaacaaaaaaaauccugugaguuacuguugcuugucuaauuuuaugcuagguucuguggaauauaaaugagaauaaccuaaaaaaaguaaaguauucaggcuaaaggcuucagauaggcuuuuuucaaacugacuagaugguaaaagcuaggaaugaccauggucccuccuaacccacacuccuuauacaucaggagacaugcagagagauaucaugacuaaaggucauaauuuguagguagccaaagugaggccuaaaacccagauccccaaauccuaucaugcauuucaaucuuuggcuauacucaacuaaggacuacucuguccagugccccaaucacgcagggcuuccuccagacacacuagaacaacucacaagguuuguaguucucaugacgagaggagcuguccagaggcuugccaugcacgagggggucuccuccucauucuaaagaaacagaaaaacugauuuuaaaaagagccuguagagacuaacauuuguuuaagugcuuuagguguguuucucccugaacaauaccagauaggccuggauaggaaguauccuuaauguaccauccuauaccguucugauuucauguuucuugcauauagauuguuaguuagcuccuucaggguaagaaggaucaugugucuucuuuugaugcccccaucccccaauccaaaggauuuaauaaggcugguagcccuauuauuaaaugaauuaucaccaaaugaacaaaaauaucagcuaagcaagccccggggaacugcuguugcuguucuuuuucacaucacaugccuucuccagagguaauuaauuaguagaacaaauaggaacacacacacacacacacgguaccuucagauucucuccaucgagaagguccacgaagccaucauccucaucagacaaaguggcugucacaggugacugggguguaaaaagaggaaugaaauucccugguucacugcuaucucuuucauuugaggaaagcuguaagacaaaauucauggauuaauaaugagagcucugauccacuuucauuuccuugaaugggucacuaguuuuuaugaugaaaacauacuauguuauacuuguuauacaaagcaaaauuuuagccauuacugauuauaugaaaauguaucccaagauuauaaaugauuugaugaccacacacagcccugaguagucaguagccuuuacagagaacucuugccagaagcaauucaccuuauaauggguacuagagauagccucuugugaagaacaagguuucuuuuauuagaagguugcaucagugaacaccgaucagcauugaggacugugacaguaugagaaucugcugaaaugaguuagggcaagcagaugcaaaucucuauaaagaccauaaaauggccuagagaaugcacuuauauauaacuccaguucugacaggggggaauaaaggguaacuuccuucuauaaaaucuauccucguucuuuagacuugggauuuaaaugcucaguuuuuaaacgaggaauuacugugugccagauacuacgauauaaucuuuauacauauaauccaauagaagccucacaauacacuaaagguagcuaauccuuuccuuuuucuuuagcaaaucaggaaacuggugcuuaagagguuaccaagauuauacaccucaucuguuugacuccaaaauccaaacucuucucaccacacuaucucccuaggagaaaaccauuccuggaauuaaaauggcgguaccucauuagccaaccuauagucauacuuuuuuugggaaaccucuaaacauggaauauagaaaauuuagaaaaacugcucauaaauccacaccugaagauaaauccuaccaauacaaacacugcuaauacugaauuauuuauuuucuaggcacuuucaaauccagaaaaaaaaguuuagaguuauuuuuuucacaguagcaggguagucccaauguuaugaccuacaaguaauccuuaaaauccaaaucucuuugggguaugaaucuguuguuaguuaaguggcccucugauuuucugaguggaucaugcaccaaggaauccucucugcagcuggccuauucugguucuggcauuagcuuugcuucacaauauaaaacaaguucugagcagucucuaguccuccccaagugcacacucugggaaauggcaaauuuuuuuagccuagggguagauaacuuuauuauggggcaguaccuuuaucacgaaagcucacacuauaucacaccaacauuugugagguauguucugggauuccuaggugcagaugugauacaggcucuagucgcuaagcacacaccaaauauauuguuucugauacccaacucuuaaagcauuacuguguacuugggaauuuagagauuguuuauugagacagggauucauuguccaggcuggaguacaguggucugaucauagcucacugcagccucgaauucuugggcucaagcaauccucccacuucagccucccgacuaauugggacuauaggaacaagccaccacacucagcuuauuuuuuaacuuuguacagauagggucucacuauguuacccaggcugucuugaacuccugaccucaugugauccucccaccucggccucccaaagugcugggauuacagccaugagccaccacacccagccagagaucauuaaauccugguuuccuacuuauguauauccuuugguaaaucauccaaaccucucuagugguacuuuccuaaucuguucaaguggauuaacuccacuucacaagacaagaacauauaaaagugcuuugugcaaaugauagacagaguaacaauacuggcugaaccucagaacacaaagcagauuggaaagguauauuuucagauuuaagauccuagguaaaccuggaagccaaauguggucaucuugcucaaguugggccucuccaaucuauagaugcuaucaguuaauccaauucagaccaacagcaggaaacuuuggaaguaaugacagucccugucuggcaaauacauagcccugaaacgagugaccccaaaacugcccagcagccugagcauucacuguaauccauaauaguucuuuaaaaaaauuaaaaauaaaaaaaauagagauguggucucacuaugcugcccaggacucaagcgauccuccugucucaguuuuccaaagugcugagauuauaggcaugagccauggcaccuggcccauaacuguucuuaacaaaccaccuuuggaagaagucaagugcucucucuccaguuccuugagaagcacuuagaaugcauaguaaagaccaaguuuuaaguaagagaucuaguguuacggcucuuuuaaaauuugucucgcaggcuuuccgguuuuugccagaaagcccuuaaaaaaaaaaaaagaaaaaaagaaaaaaauaggaagagauauaaucccaccauacauacauuuaggaugacccaggauuucccagauuaacaaggucgauuauuccuugcacaacuccaauauuucaaacaccaucucccacucuuacuaccgccugucuguucuccagacacagcaaaaccaccaagaaugcuugacagucuaauuucaaaagacaaagucaagguaaaaacagcuagugcuacuguagugccuucaauucuggaugaaagaagguguuuuaauccuuucuuccugucaggaauuccccuaugaaagccagagcacauaccauccgagcuggggcagaguucugccucugugugaagagaucuuuacccuccuggaguccaugagagugcaggcagccacgagauacaggucuuacuggcuucuuaaacucaaaggcuuccugcaagacauaguugagacaucuacuguccaugaaaaccaacucaggccucagcuugggugaaagaggcaagaaagugggcacugaucaccuuucugccuccaaauuaaaguuucaccuaauuccaacaauagaucugcguaacuaagaauuuccaaggcucugucaacagcuaacuucuaaaguaacaucuuuuucuugucauacuguauuuccuaacacaaguaucugccaaauauacaaaacacgaugaauaagcuaaaucacaaacuuucugaaaucuaaagcaaaaauaaauaaaaucuaauauaauugccugugaauaguugucaaaauuuuccaucuagguccaucuguuucagggcuucauauuuuccaccucuuccuaccaacuggagauaauuuuuucuacuuauaauuauucuauucuauacuaaaagcaaugaaaaaaaaaaaagcccuacugguuuacucaacguggacgauucuuacaagcauaauguuuuuuaaagccagauaugauagaauacauaucguaugauuccacuuuauggaaugaaaacacucacaggucccuugcccuaaaauauucacuuaagaacucauaauuaaguauuaaaagcaguaauggcuagcacuggcguggguggcugaguuccccguugcccuuggucucggggucgcggucggcacugaggcugcagcuaucauggugaacuuacuucagauugugcgggaccacuggguucauguucuugucccuaugggauuugucacuggauguuauuuagacagaaagagugaugaacggcuaacuaccuuccggaacaagagcauguuauuuaaaaggguauugcgacccaauaaagaaguuaccuggaaguaaagacuggcugaauuauagaauguucacauuuuaaaguucugagagaaauaaaaccaugaagaaucaaaaaaaaaaaaaaagcaguaauggcuaauauuacagugauuucuaugccaacacaguacuaaguacuuucugugcauuaacuuuuuaaccaucaaauacaaccugauugucccgauuuuacaggugagaaaacuagaccuugcagguuaaggaaugugcccaaaauauugaaguaaaacaggacaacuccagagugagagcucuuuaaccaccaucuaugcuguuuucccuuuaaaacaaagcuccaggcaagcaacccugagaagcuauuucgggggaaaaccaggcaucaguacagcuuugcccugguaaaaagcacuagaggcugauacacuguuccaagcacucaaggcuggaacucauuuccauauucuuucucaugacacuucccagguugauaaagaaaucaucaggagaguucauggaggcaguggguuucacacuaaaccugaagauuguaaggacaaggauuaugaacuguggcauuucagcaggaauggaaaaggggagaaaguaaauauauagaaauacaguagagagaaggcugaaaaaauuacaacuguuuuggaugccuacucugugcaaugucuaaaagaacaaaaaagccaggcucauucaggguagauaaccagaaauucaccuuccaagccaccauuucaguuacucugagauucccuagaacuuguugaccccguucuuacaaauacugccaaagagccuuuuccuaagcuuacaauucauuucagggucagagcaaagaggcaaggacagccugggcagagccuuccagacaaacacuauuuguacauguaauuacuccugugagcuacaaucugagcaacucccgccugucaggcaccauuuucaauacuucauacauaaucuuacuuauugccacaacaucccuaaaagguauuacuacuccuauuuuacaaaagagcaaagauuaaaaagagaagaauuugccaacaucacacagcuaguaagcaggauccaaacccagaauucucugacuccaaagaccgcacauaauggccaaguuuagucucccagaaagcagcccagccacuucuaagccacugacagccuguggguuucaccucugccucagguuaguacauugaagucacacucacauuuuccuuguucucaucugggucgaugagcugaaagaugucauggucaagagaaucagaauggcuccucuucagagcuggacuacaucccaacagcuucugcuaucaaaguaaaaaaggaaaauaauuaaggcacacaaauaaaauuucaguggaaaauucaguucucaaaagaaaaaaaagggggguugaauaggggguagacuagcuccucacacacugcaguagguaaccaguaaauguggccaggaauccaccuugccaggacacagccaggacacagcauagaaguuuccauuccauggguuuacagcuaaccucacaaggucuacagugccccccucaacagggauuacagugccaaaucaauccccaaauaacauuugcaucaaaagaacccuuccugguuuaauaaagcucuguuagagauggaggacaaauuccuccagaccgaacaucuugaguacuuaugagacuaaggaaaggcugggaauaguggcucuugccuauaauccuagcacuuugggaggccgaggcaggaguuugaaaccagccugggcaacagagugagacccccaugucuacaaaaaauacaaaaaucagccgggugugauggugugcaccuauauauagucccagcuccucuggaaguugaggugggaggaucacuugagccagggaagcagagguugcagugagccaagauuuugccacugcacuccagccugggugacagagcaagaccuugucucaaaagagacuaaagaaaagcaguuuuuacucucuaaauuaagucuccuaucaaggucaugcugguagcuaaggaacagauaacagguauuagcucaaaauaaacaaggaacuaacuuacagguagggaauguauucuucucauaggauuuucaaggcuguaaugagaucagaagguaaauaaugagaauaaaacaaguaaagagguauucauauuagcagagagauaguguuuagccuguagcuuggggguacagucacagacucccauuuuaggcaagagaugggagaauaaauuucugaagcuguccuguucucaggagcacccccaacacuagacuucuaggugaaaaaaaacaaacccaugucuuuucuuaaaauacacacauucggcugggcgcgguggcucacacauguaaucccagcacuaugggcacuaugggaggccgaggaggguauaucacgaggucaggagucucgaacuccuggccuggccaacacgaugaaaccucgugucuacuaaaaauacaaaaauuaaccgggugugguggugcacuccuguagucccagcuacucgggaggcugaggcaggagaaucaguugaaccugggagguggagguugcagugagccacugcacucuagccugggcggcagagugagacucugccucagaaacaaacaaacaaacaaacaaaaaaaccccacauguucuuguaaggcuaugaugucagagcacagaguaaggguuuggguaagacccaaacagaacaccaaaauuauagcuaaaauaaaggagaaaaaguucugaaaauugcugacacaaacuauucauucuugagauuccagaguguuucuaggcacagguaaauccagggcuccaguccaguguaugaagaacuucauuuaaauaagguauuuaaguuuagacacguuuuuucuacauauaaacauuugaaagcagugaauacauacuuuucuuuacuguccaauggcccaggagaaucuagacagaaaccuauggggaaaaaaaaaaccucucaagaaauaauacaaaaaacaccauuuugucauuaaaauuaaaacacuaaacaaaguaccugggucuuuauuuaagucaggcaacaaauauucauggcuuguacuuuugccagaauugauguuacgucuauuagauugucaaaaaugucauguuuguacaagucuuaauauuuucauagcguauuuacuguuuuuucuccuauuugcaaauaacaucaagggaaauaggauuugagaagagggugaauaaaacugauucauaucaugauuguuugguuauucagauagaggugacccagauaacuuucugugaguuccaaccauagaaacaauagguaccagauuuucuuggcauaguuuuuaaacguuuuaccuugucaaaucauaugaggcuugaaaaauacaacuacugaccaggcacaguggcucacaccugugauuccaauacuuugggaggcugaggcaggcugauggcuugaggccacaaguucaaaacaagccuggggcaacauagugagacuugacucuaccaaaguuaaaaaaaaaauuaguugggugugguggcacgugucuguagucccagcuacuuggggaggcuggagugggagguucgcuugagcucggaaaguugaagcuacagugaacccugauugugccacuguacaccagccugagaccuggaaaacagagcaagacccugucucaaaaaaaaaaaaaaaaaaaggccaggugcaguagcucaccccuguaaucucagcacuuugggaggucgaaguggguggaucaccugagaucagaaguuugagacccacaccuguaauuccagcuacuagggaagcugaggcagaagaauucucuaaaucugggaggcagaguugccugggugacagaguugagaccuugucucaaaaugaaaaagaaaaauacaacuacuggucaugacaugcaaggcaagcacuugcugccuuuaacaaaaugacaccaagguguccaucucacaaaaggcagcagggugaaggagacacuguucagcauuacuaauaugccagcucagaugacgcagacccacccacccauagcucaugugucuauacagccuuauggaaagugagguguuacagcccuugcucaccacacugcuacaagugauaauccuauccccaguucuauauuaaauuacauucuacauacagaagccuacauuacauuuuaagacuugcucuugcaguuccuuuaaccuaaaggaucuuugcaccaauggucuuaucuguacaaauacagauaaacucugcaguaauaugaauucaugaagaaugaaaugcacuggcaauuuccuccauagcagcaucacugaaaugauuucaugacacuguacuuccaaucauuugauccuguauuuuaaccaguaagauugccugaaugccacuuacagugguauggugaauuauacuuuacuacccauccuucaagggcaagcacacaccaccuccuuauagacauuugaaaccuauuuccuuucuucauaaacagccacaagggcuccuuuguauuguucucaauaauguuuaucaccgggcgcgguggcucacgcuguaaucccagcacuuugggaggccgaggaaggcggaucaccugagguugugaauucgagaccaggcugaccaacaugaagaaacccugucucuacuaaaaaauacaaaauuagccgggugugguggugcaugccuguaaucccagcuacucgggaggcugaggcaggagaaucacuugaacccgggagguggagguuacagugagcugagaucaugccauugcacuccagccugggcgacaagagcgaaacucugucucaaaaaaaaaaaaaaaaaaguuuaucacccaaugccaugacuuccucaaguucucaccaaaacuaaccuccugggugaaaaggcauguuucaggaaauucagaguauugcuccccacacagcagacuuaaauaccugaaucuguugacucggaggagcccauucucugcagauuacuguuguucuucaccuccagugguugcucauaaucacugaaaccaacagaaauaaaccaugaaugauuuauaggauauaauuaaaaggucacaugcaggagauaggccaugagauuaagaagcagccaggcugccagaaaccauuucuaggccacaccacaaguggcaaagaucccacuuugccacucugaacacccaauuagcacuugggcaaaggagaaaaaaggagugggugggcauggccuuggaccacauugcagguuaugauggcuauggcaaauguugggguauuuccuaaaauaaaagcauguguucuaaguacugagacagagucgggaugaaaguugaacaggacacuuucugcuuuucagaaguugggaaacgcacaagacaugugcuuagcaaacgggaugccagagauugaagggaaaguagcucuuccgcgggaaacaccgugggaugcauuuuuugcuaucaggaaaagcccaggaagcuuucugaaaguuggguaaaaagaccuggccuuaggaaagcagcagaguggacaucaggaaugugcacagggcgagggacugagaugauuuuacauaaacgccaggaaagaaaaugccaugguccuuuguugagaaggaacaaagaucacagcaaacgaagauccugaggaugguuuagcaaagggugaaagugagugccuagaagagccugauuuuccccgcggggguagauuccaaagagcuuccagggauagagauagaaggagaguacggagcaauccgaaaggggugaaggugggccuggcucgggcuuaggcccaaggaucuccaccucuuccccuggaaggucccgacggccucucccgcccaacauuccgcccgggcgggggugcacauggcaggcccuagcccggcuguccccgagcggcgaacccggacggacgggucucgcccuucucccgguccguuuccuggccugaucucuccgaggccgacaccgaggccaggggcccggagcaccgcccgccggucucuccuuaccugcccagacccugcagcugguccauagugacggucagguuggugacaggcgacagucccccggcggcugaagcgccaaauagcgccuucacgacgggcugcgacgcgggaggggggcugcaggcgaagagcaggcggcggcggugcgggggcuccgggcccaguuccauggcggcgcccggccucgcagagcucccgcucccucuuccucugccuccgccgcgaccgccccgccccgccgacaccggccucggccgcgcgccaccggcgcccgcgggucaaacacaaacacgacuccgcgguucagggacgcggcugccgcgggcaagcggcgcggccgggcgggugugcggacccuccaggcgccagccaccagccacaggcacgggugcuucccucucacaccgcgaggccagcgggcgggcgggcgccggcaaccugaagauuaaauccaaacaaacguggcgggucggcaagagaagccgggcgagagccucgaggcaacggcccaggcucacgcugucuucgcuguuc

SEQ ID NO: 192099 - RNA, 238590 nt, Homo sapiens
aggccccacccgcugguggcccgguccgcgugugcgccgacucucgcacucuccucgcuccgggcgcccagacucugagagagagcgacggccaucauagaacagcgaaggcagucgaucggccugcgguccgcuucggcauucgcaggccgcaggcgggaggcuagagcccccaggcgcaccucgccccaaccgcccgcggcucgggcagcucugcagagacgucguggcggcagggccagcacccauugguccgccacagcccuccgcccucccccucgccacgcuuauuggccggagcggcggcgcucgccggguaggcgguggcggcgucccucccuugcgccggcccucaagaggcgacgaggaagcggccgccucccugcgccccgccccuccggcuagcucgcuggcucccggcuccucccgacgucuccuaccuccucacggcucuucccggcgcucuccuggcucccuucugccccagcuccgucucggcggcggcggguaggugcagccgcaggcgggguccgauuggaggggcggccuccucacugucccggggcugcccgagccuugcccugcggcagcuggguaccccacggggcccgcccgaggcguggaagggcgguggccgccggccugcgagacgcgggggcguccgagggagggggccaggcggggggcuggcggcuuugaccuucggagucuuugaggcgcgaucuaggggggucuuuggagugaggggggcugagagguccagcuuuugagggucggggcgguggggccgagcgacaugccuugggcucuggauggggcugagccgcggagcgagggucggccgcagucuggggcccugggugggguucggagguguaggagaacucaggggucguuuucugaggcuuugugggggucaguugaugugaggcugaggugagccuuaguauguccagucagggauuauggguggggcugagggguggucuggagaaccgggcccuaggcggggcucuucccccuugcaaaggccccgacacuguguggggacuaaagcgugugucuggcagugggagugcgaaagggucacauuaggguggggguggggaggguacagggacuaggagaggcaguuggaaacauuacccagaacagagauugugauuuagcacauggaacaaguucuccgccggugugaguuagaucccuuuggugaaauuguccuguggaggaguugugaggguuuugcucacuuccaggaacggguaaauuaaaugcauuugcugcuuuggggaagaggcagugauugauuaccuuuagguuugugcuuuaggacccaagcucggaugaaauacguguuccucgcgaagguuaguguuacccagcuuucuacuggaaacccccuuuucuccuuugccuucucugguccuguuacaguauugcuccccagggccucucgauucucucucccugguugcauagcauugcaguguuucuugcagugugugugugugugugugugugugugugugugcgcgugcgugugugugcgcgugcguguguaugugugugugcgcgcgcgcgcgucucccgcccauuucccugcugcugugcuuuuggcaacugccucugcucuuucccagggaugguuguggcauugcaucaggggauauuugugcuuguaauuugcucacucagcccaggaggagggugaauaguaugcuguagagauggggggcgggggcagggugccgucagcuuggcuggguagacagagaaauggguguggugagggaauacagcugcucuaggccuuugggguaacacugcccagucaucagcccaaagagauucaaagagcaccaccagcagcuauuuuuauaaaucaauccugaauccaagcugagcacauggauuuagagugaacaguugucaugcucuauuacaagcuggguguuugguagacaacauuaaaguugcuaagcaggagacucccaucuguacugugcaguguguacuuuacuugcaacuuuuaaacuuugcuuuucucaacuccaaagauugggacaucucucuucaggcugugucuuuuaaauuaacguaguuugcugauccguacuacuacuuuucaaaugaaauguuuucaccucaguuacacacuuccuuucaaauuuagcuucaaaauaauaaagcugucacuuuuugagcacuugccaucucccaggcacuagcuauguuuguuaacagaugaggaaauugagacugaugggaagaagaggucacacagauaguuaaguggcaaaaaugguauccaaccaaaccaaggucucuccaacccccacauaguaguucagaaacuucagaauuuugguuuacauugggaugauucaagugcuugagaauuuauucaugcaaaguaaacaaacucaccagagacugauaaaccagauaccaguuaaugcauguuggaaguauuaagugccaugugcacaauuggauuuaauuguccacugaccaggacaccuccauuguucugggcugccuaaucaguaauaaaaagguaguugauuauggaauuggaaaggcacuagauauucuuaguggguauuuuuuaaauuuaaauuuuauuuauuuauuuauuuuugagacagggucuugcucugucgcccaggcuggacaguggcaggaucucggcucacugcagacucuaccuccggaguucaagcaguucuccugccacagccuccggaguagcugggauuauaggcaugugccaccacacucggcugauuuuuguauuuuuaguagagacgggguuucgccacguuggacagacuggucucaaacuccugaccucaagugauccgccugcuuuggccucccaaagugcccugggauuacaggugcaagccaccaugcccggccauuuauuuuuauuuuauucuauuuuauuuuuuaagauggagucucgcugugucauccaggcuggagugcaguggcaugaucuuggcucacugcaaccucugccucccagguucaagugauucuccugccucagcuuccugauagcugggauuauaggcacccaccaccacaccuggcuaauuugugugugugugugugugugaguguguguauauacgugcacacacauacauauauacauacacauauacauauauauacacacauacauacauauacacacacauauauauauauuuuuuugagauggagucuuacucuguugcccaggcuggagugcaguggcacgaucucagcucacugcaaccuucgccuccuggguucaagugauucuccugccucagccucccuaguggcuggaacuacaggcacgugccaccacgccuggcuaauuuuuuguauuuuuaguagagacaggguuucacuguguuaggguggucucuaucuccugaccucguguuccgccugccucggccucccaaaguccugggauuacaggcgugagccaccgcgccuggcuaauuuuugaauuuuuaguaaagaugggguuucaccauguuggccaggcuggucuugaacuccugaccucagaugauccaccuaccucggccucccagaguguugggauuacaggcaugagccaucacgccuggccuuacggguauuuuaaucaaggaacaaaagucuagugagucucccuuuccccaguguaaaaacacauacagugcuggaggaugucuuaacacauuuuccuacucugucucacuuguuuuuuaaguagucucuucaaauauuugucauuccagcaucccuuuguuaaaauuuucaaauuuacaaauacauuuauauuaccuauuaaaaagucauuuuccauuguuugcugacagugaaggaagcaccuggauuuucuuauauauaggcggcuuagcuuuagucagagaguagauucuuccuaaucucauagugucuuguucuuccuaaucucauagugucuuguucuuuccuaaucuuguuucugaauuuggugaucaauccuuuggcucuguaaacuuuugcucuugacaguuuuuggaaucacuuugcuuuuuuuuuuuuuuuuuuuuaaagauuaagcgugaguaguugcuauguagcuuuuagauuuccuuaagaugugagaaaaucugagaggaacauuuugacccaguggaaggcaucuuggcaguucauguauauagucaauuugaaaaggaaaccaaguaaguaucagugauuucacuuugucuuucuaaacagcacuuuuagaaccagguuauuguagacuuauugcuaggagugaguggguugagaacaauuaagguuaagaagggggauuguagggcuggguggcucaugccuguaauuccagcacuuugggagccugaggcggaggauugcuugaggccagaaguuugauaccagccuggauaacauagugagacccugucuccauuaaaaaaaaaacaaaaacaacuuagucgguccccagauaauuuuaguguacagcaaaacaacaaaaacaacaacaacaaacuuagcuaggugugguggcaugugucuauagucccagcuacucuggaggcuggggugggaggaucacuggagcccaggaguucaaggcuccagugauaugauugugccacugcacuucagccuugcugaaagagccagaccugcucaccccugcaaaaaaaaaaaaaagggguaauaaagcacacugauacauauaggggaucauauucaucauacucaucuaccauuuuagagcuccuaggccagucuuuaaaugcagaccuuauggugaacuauuuuggaugucauuaacauuuuaagguugaaagucaacacaauuacuuucgugauucuuuuuccuuuuuuuuuuuuuuuuuuagagaugagaucauguucugucagcagugggggagaucauagcucacugcagccuugaacuucuggccucaagugauccuccugccucagccuccccaguaguucagacuguguaugugcaccaucacaccuggcuaacuuuugugauucuuguucuuauucuuuuuuuuuuuuuuuugagacugagucucgcuguauucccaggcuggaguacaguggcgcgaucucagcucaccacaaccuccaccucccggguucaagcaauucuccugccucagccuccugaguagcugggauuacaggcacucccgcugcgaccagcuauugugauuauuuauagguuaaaaaaguuaaucuucuuggcuugggcaugauggcucaugccuguaaucccagcacuuugggaggccgaggcagggggaucacuugaggucaggaguucgagaccagccuggccaacauggugaaacccugucucuacuaaaauacaaaaauuagcuggcaugguggcaagcgccuguaaucccagcuacucgcgaggcugagacaggagaaucacuugaaucugggaggcacagguugcagggagccaagaucacgccacugcacuccagccugggcaacaagaguggaacuccaucucaaaaaaaaaaaguuaaucuuacuguaaacuaauauuuuauuaguuugcauauauuuaaauauguuuaaaaauuuauuuaugcugggugcgguggcucaugccuguaaucccagcacuuugggaggcugaggugggcagaucaagaggucaggaguucgagaccagccuggccaacaugguaaaaaccccgucucuacuaaaaauacaaaaauuagcugggccugguggcgggcgccuguaaucccagcuacucgggaagcugaggcaggagaaucacuugaacccgggaggcagagguugcagugagccgagacugcaccauugcacuccagccugggcuacagcgagacugucucaaaaaauaaauuuuuuuauuuauaacuuuccucacuucuuuuuauauggaaaauaguuuaaaacuccuuuuaaauaauuucagguuuacagaagaguuguaaagguaguacagacuuucuauauacauucuguauucauuccauuucucuuagcguuaacauuuuauauaaccugauacccuuaucaaaauuaagaaauuagcauuaguggaauauuauugagcaaacuacagacuuuccucugauuuuccuguguuuuccacugauguccuuuuccuguuacaggauccaauccaggauaccacauugcauuuagaugucacaauucuuuaguuucuuccaauaggugacaguuucuuagucucuccuucccuaucuuuccuugacaccuuuaaagaugaguggucaugcauuuguagaaugguucucauuuuggguuuucuggugcuuucucaugauuagcccgagguuaugcauuuuggggaaaaauaccauagagaugguuuacccuucuugucacaucauaucugggaauaccugauaucaacaugacucguuacugauuaacuuuuuuuuuuuuuuuuuuuuuugagacaaagucuugcucuguugcccaggcuggagugcaguagcaugaucuuggcucacggcaaccucugccuacccaauucaagugauuuuugugccuuagccucccaaguagcugggaccacaggcacgugccaccacaccuaauuuuuguauuuuuaguaaaggcaggguuuugccauguugcccaggcuggucuugaacuccuggccucaugcaguccaccggccucauccuccgaaaaugcuaggauagcaggcaugagccauugugccuuguuaacuuugauaacuugauuaaagugauguucugcacuguaaagugacuguuguucugcuuuuuaauuuuacuugauagaaccuagaaaugagucaccaagucauauccauauucugggggaagggaauuaagcuccaaccccugaagggaggaguaucaaagaauuugugggcauguuaaaauuccuaaaguaauuaguuaauauuuuggggaagauaacugugagguuauacagaaucugauuucuccuuaaaaauuuccucuacuuauuuuagcauucauuagugaaucuugccugcggcagcguugauuauauuauucuguugguuuucuauuuuucuaauucuuucuacuuuuaugauuuggaauccuuuuguaaggaagauuuaugccucccccauuuauuuauuaaaucauuuaugucaacauggacccaugaauauuuuuuucuuugcuuauaauccaguacuguauuuuguugcucaaguuguuccagcuuuggccauucuaacauuggcaccuauguucuuuugaaauaccuuucccuaccuuucuuugucuuuuagcacuuuuguacuuccuggcacuguaagaugccccagucucaucuuguacuuuaccugccccaacccuaaaaucagccauuucuccaagguguccugguuccuucuguuggagaagaguauuuggaaaccacuaucugguuucuaaaugagcuugaugcacucauuacugcuaggguaucacugcuucuaggcccucucaggggauaguuaggaaguaauauauauauauacugacccacacauaucuucguuuacuuccguaucugucuguauauaaauauaaacaugaguuuauacugauaucucugaugcugauccagcaccacagaguucauucuagcauucucuuccuugcuucuuucucugaaagugagaaauuuggcugauuuaaugaauaauacaugcuaauuuuuucaacucuaauauauauaugaaguaaaaaauagucuuaauugucauauaaaguaaauuuccaaagcauuuugcaguuguuaacuaauuuaaauuauacuccuauaauauugguauuuuaaauuacuguuuuucagcucagguagagagaugaaaucauuuacccuuggccaaacaggaagugagugauuguaucuagaauugaagauuuauuauuuauuuauuuauuuauuuauuuuauuuauuuauuuuuuuugagauggagucucgcuguuucccaggcuggaguucaguggcgcaaucucggcucacugcaagcugcgccuccgggguucacaccauucuccugccucagccuccugaguagcugggacuacaggcgccugccaccacucccggcuaauguuuuuucuguuuuuugagauggagucucgcucugucgccugggcuggagugcaguggcaugaucucggcucacugaaagcucugccucccggguucacgccauucuccugccucagccucuuuaguagcugggaauacaggagcccgccaccacgccuggcuaauuuuuuguauuuuuaguagagacgggguuucaccguguuagccaggauggucucuaucuccugacuucgugaucugcccaccuuggccucccaaagugcucggauuacaggcgugagccagggcgcccggccaacuggcuaauuuuuuguauuuuuuuaguagagacagaguuuccccauguuagccaggauggucucgaucuccugaccucgugauccgccugccucagccucccaaagugcugggauuacaggcuugagccacugcacccggccuauuuauuuauuuuuuaagagacagagucuugcuauguugcucaggccggucuugaauuccuggccucaagcaauccuccuaccucagccucccaaaguucugggauuauaggugugagccacuguuccuggccaaaugaccuauucucacucccagugcuauacuugauccuaaggaaagcagucucauuaucuugacuaacaaaucaaccuuugucuucuugaugggauuguuccuuuuaauuaaagaaguuccugguauuuagcuuuuuuaaaaaaaauacuuucagcaguauugagagcaaaaacaauucuuuuucuggacuucuuccuccucguagaaucauagaagagauuuagagauaaucuagacaaauguuucacauaauaggugauuccuccaguucucuaugcagguauuucccaagauaaguacuucacagcugguugcuaccaauuccagguuugcagauuugucauuuuagaaagauuuuccggauaaugauuguagaucugccucccugcaguuucucuucagugguccuaauuuuucugucuacaguuauucccuguagcucuaaucucaacuuugcaccuauucaaugacaguuauuuugucccaccuuuuucuuuuccacacuaguggcuuuucccccagcuaccucucgugaaaugugcuuucuaagccuuuuauuauugucagaagacaaaguuacaacaaauuuauuuauagauuuuuuuuuuuuuuugagacggagucucacucuuuugcccaggccggaguguaguggcacuaucucggcucacugcaagcuccgccucccggguucacgccaugcuccugccucagccucccgaguagcugggacuacaaguaccugccaccgugcccagcuaauuuuuuguauuauuaguagagacgguguuucacuuuguuagccaggaugcucucgaucuccugaccucuugauccgcccgccuuggccucccaaagugcugggauuacaggugugagccaccgcacccggcuuuuuuuuucuuuuuaagauggagucuugcugugucacccaggcuggaaugcaguggugugaucucggcucacugcaaccucugccuccuggguucaggcgauccuccugccucagccucccaaguaguugggaguacaggugcacaccaccaggccccagcuaauuuuuguauuuuuaguagagaugggguuuugccauauugaccaggcuggucuugaacuccugaccucaagugaugcgcccaccuuggccugccaaagugcugggauuacagacgugagccacugcacccagcuccagccuugaaauucuuaaucagauauagguugaguauccauuauuugaaauaugagaccagaauuguucauauuuuggauuuuuuggauuuuggaauaucuguaguauacagauauuccaaaaugcucucuagugagcauuuccuuugacaucaaaaaguauuagauuuuggagcauuucagauuucggauuuuuguguguuuuuugagacagggucucgcucuguugccagaguuuaguggcauaaucacagcucacuucagccuugaacuucugggcucaggugauccuccugccucagccucuugaguagcuggaauuauaggcacgugccaccaugcccagccaauuuuuguauuguuuguagagacagcguuucaccauguugcccaggcuggucucaaacuccuaggcucaagugaucuuuucaccucagccuccuaacaugcugaggauuucaugcaugagccacuacacccagcccaggauugagauuuuuggauuugggaugcucagcauauaauucacuuggguuagcccacuuucucuuuuaggaauagaaauccacuaguaggacucuggagagcucucagucauuuucuuaugggaagaacauauuuuuauugaaauaauuugaauuuggguagugaguguguugcuuugggugacaagugauuucucaguuuaggaaggauugggagcagagaaagugggggauaaggcagauuuacaggcuuaguucucuacauaucagcucaaguuucaccuuuagaaggucauucacggccccuuucuacccuacucuuugauguuuuccccaauguauaucuuugggcauaugucauuccacauuuaaaaaaguugauacauaauucacauaucguaaaacucaccauuuuaaagcauacaauuugggguaggcaugguagcucaugccuguaaucccagcaguuugggaggcugaggugggaggauugcuugagcccaggaguuugagaccagcaugggcaacauagcauggcaacccugucucuaccaaaaaaaaaaaaaaaaaaaaaauuagccaggcaugguggugcacaccuguagucccagacucuugggaggcugaggugggaggaucauucacuugagccaaagaauuugagauugcagugagccaugaucgugcacucuagccugggccacagagcaagacccugucaaaacaaaacaaaacaaaaucauagaauucagugguuuuugguguauucacaauguugugcaacuaccaccauuaucuaaguccagaacauuuucauuacccccaaaagaaaccucauacccguuagcagucucuuccauucccuucauucacccagccucuggcaaccacuaaucaucuuccugucuguucuggacauuccauauuaauggaaucauacaauaaauggccuuucuguguuuggcuucuuucauuuagcauaaugcuuuuagguucauccauguuguagcauguaucauuucauucauuuuuauggcugaauaauauuacauuacauggauauaaugcauuuuguuuaugcauucauccauugaugaacauuuggguugcauuuuuuagcuauuaugaauaaugcucugugaagauugauaugcuuuuauauggacauuuauuuuugucuaaauaccuagaaggagaauugcuugguuauguguuaauuauguuuaaccuuuuaaaaaauuauuuaucgccaggcgugguggcacaugccuguaauccuagcauuuugggaggcugaggaggguggacugcuugagcccagcaauucaagaccagccuggggcaggcaauauggugagacccugucucuauaaaaaaaaaaaaauuaaaaccagaaaauuauuuuuuucuucucuuucuuucuuucuuuuuuuuuuuuuugagacugaguuucguucuuguugcccaggcuggagugcaauggcacgaucucagcucauggcaaccuccgccucccggguucaagugauucgauucuccugccucagccuccugaguagcugggauuacaggcaugugccaccaugcccggcuaauuuuguauuuuuaguagagugggguuucuccauguuggugaggcugggcucgaacucccaaccucaggugaucugcccaccuccgccucccaaagugcugggauuacaggcgugagccaccgugccuggcuuucuuuucuuuuuugagacaagaucuugcucugucacucaggcuagagugcagugaugcgaucaugauucacugcagccuugaccuccagggcucaggugauucuuccaccucagccuucuggauagcuggcauuguaggugugugccaccacaccuggauaauuaaaaaaaacaauuuuaauuagagauggggucuccuuauauugcccagugaacuccugggcugaagcaauccucuugcuuggccacccaaagugcugggauuacaggugugagccaccaugccugacugauaguaucuuuugaaacacaaaaguuuuaaauuuugaugaaguccaguuuaucuaguuuuuucuugguugcuugugcuauaggugucacaucuaagaaacgauugccuaauuuaaggugauaaagauuucucuuuuguuuguuuuuuucauucguuuguucuuucguucguucguucuuucuucuuuccgagacagggucucugucuuuuguccaggcuggagugcaguggcaugauaucugcccacugcagccuccaccucucaggcucaagcuauccuuccaccucagucuccugaguagguaggacuacaggugugcaccaugaugcuuggcuaauuuugguaaccuuuuuuuuuuuuuuuuuaagauguagucucguucugucacccaggcuggagugcaguggugcgaucucugcucacuguaagcuccaccucccggguucaugccauucuccugccucagccucccaaguagcugggacuacaggugcccaccaccaugcccggcuaauuuuuuuuuuuuguauuuuuaguagagaugaaguuucaccauguuagccagaauggucuugaucuccugaccucaugaucugcccaccucgggcucccaaagugcuaggauuacaggcgugagccacugcgcccggcugagauguggucuuacuauguuguccaggcugaucucgaacuccugggcucaagugauccgcuuuccuugccucccaaaaugcugggauuauagguguaauuuauguuucuuuaaauaauuuuauaguuuuagcuguuguauuuaguuuuuuuuuuaucaauuucaaauuaauuuuuauacaugaugugugagguaggaauccaaaaucuuuuucuuuguuucuuuuuuuuuuuuuuuuuugagauggaguuucacucugucgcccaggcugaagugcaaugacgugaucucggcucacugcagccuccaccucccggguucaagcgauucuccugccucagccucccaaguagcugggauuacaggugcccgcuaccacacccagcuaauuuuuguauuuuuaguagagacugggguuucaccauguuggccaggcuggucucgaacuccugaccucgggugauucaccugcuuuagccucccaaagugcugggauuacaggcgugaaccacugcgcccggcccaaaaucuuuuucauuuguuuuuuuugguguguggauaucuaguuguccuugaaccaguuguugaaaagacuucuuuuuccauugaauuguguaucaucuuagcauccauguuuugagucaauugaccacagaggugugggcuuauuucuggacuuucuuuuuuuuugagacagucuugcuccguugcccaggcuggagugcaguggcgugaucgcagcucacuguaaccucucugccuuccagguucaagcaauucuccugccucugcgucuugaguagcugggauuacaggcaugcaccaccacacccagcuaauuuuuauauuuuugguagagacgggguuucaccauuuuggucagacgggucuugaacuccugaccucaagugauccgccugacucggccucccaaaguucugggauuacaggugugagccaccgugcccggccuggacuuucaauucuauugcauugguguacgucuaugccaguaccaucaugcuugcuuucuuguauuuucacccugugguacuacuaucugcuacuaucugcauaaauaugcugucuugauuaauguacuuuuguaauauguuuugaaauuaggaagugugaguuuucuaauuuuguuuuuuugaagauuguuuuggcuauucuggauccuuggcauuuccauuugagcuuuaggauuaacuuggcaacuuuugcagaaaaggcaguuggaauuuugauagggaaugccuuaaaucuguagaucaauuuagagagugcugccaucuuaacaaugucagaucuuccacuucaugaacgugggaugccuuuccauuuguuuaugucuuuaauuucuuucaagaauauuuuuuaagcugaguguggugguggcugacaccuguaaucccagcacuuugggaggcugaggugagaagauugcuugagcccaggaguucgagaccagucuggccgacauaucacacacacacacacacacacacacacacacacacacacacacacacacaauuagcuggaugugguggcuugccccuguaauccuagcuacucaucagggugaggauaaggugggaggaucccuucagcccaggacgucgaucugugauccugccauugcaauccagcaugggcaacagagugagccucugucucaaaaaaaaaaaaaaaaaaaaaaguguguguauauauauauauaauguauuuuguaguuuuuuuuucuuuuauuauuauacuuacaaguucuaggguacaugggcacaaugugcagguuuguuacauauguauacaugugccauguuggugugcugcacccauuaacucaucauuuacauuagguauaacuccuaaugcuuucccuccccccuccccccaccccaugacaggcccuagugugugacguuccccacccuguguccagguguucucauuguucaauucccaccuaugagugagaacaugcgguguuugguuuucuguccuugugauaguuugcucagaaugaugguuuccagcuucauccaugucccuacaaaggacaugaacucauccuuuuuuauggcugcauaguguuccaugguguauaugugccacauuuucuuaguccagucuaucauugauggacauuuggguugguuccaagucuuugcuauugugaauagugccgcaguaaacauacaugugcaugugucuuuaaaagacacaugauuuauaaucuuuuggguauaugcccaguaaugggaucgcugggucaaaugguauuucuaguucuagauccuugaggaaucgccacacuguaguccacaaugguugaacuaguuuuacagucccaccaacaguguaaaagaguuccuauuucuccacauccucuccagcuauuuuguaguuuuuaguguacaagucuuuuacuuuaaauuuauuccuuaguauuuuauuccuuuugaugcuauugaaaauggaauuauuuucuuauuucauuuuguguuguugauugcugguauagagaaauaaaagauuuuuauagaucugguauucuguggccuugcugaacuuuuuuuuucuucuuuuuuuuuuuugaaauggaguuuugcuuuuaucacccaaacuggagugcaauggagcgaucucggcucuccgcaaccuccgccuccuggguucaagcgauucuccugccucagccucccaaguagcugugauuacaggcaugugccaccaugccuggcuaauuuuguauuuuuaguagagucgggguuucuccaucuuggucaggcugaucucauacucccgaccucaggugaucccacccgccucagcuucccuaagugcugggauuacaggugugagccaccgcacccggcugaacuuguuuacuaaugcuaauuuguguguguguguguguguguguguguguguguguguguguguguguguguguauuccuuuggauuuccauauuguuuuaaaauuaugauuauuuuuugagauggagccucucuguugcccaggcuggagugcaguggcacaaucucugcucacuguaaccucugcuucccagguucaaaugauucuccugccucagccuccugaguaggugggauuacgggcaugugccaccauuuuuaguagacaggguuucaccauguuggccaggcucgucuccaacuccugaccucaagugauccaccagcuucagccucccaaagugcugggauuacaggcgugagccacugcacuuggccuaaaauuaaauauaucuugucacuggccugagagucccuugaagucagagaccauacuucauuucuuguuucucuuucucuacuggcaaauguauguucaauugaugcugcagucaggugcuacaguagugggacuuagcggagcauaaugccacuaaugacuuggaaaauggcacagaagggaagugggauauuguaaaacuauuuuuaccuauuauaaaaugcuuccugagguccaggaaaggcaauucucacguuugucucugcucuucuauaccuuuugccccuaauuauccuuuguuucuggaacucagaauacuaaggaucauaaaguuaggcauuuaagaauaggaacauuaauuugauuuuauauauuauuucccuagggaaauguguucuggccucauuaaaaaaauaguuuuuucaugaauuuauaauuuauuuuuuugggacagagucucacucuguugcccaggcuggagugcaguggcgccuucuuggcucacugcagccucugcuuccuggguucaagugauucuccugucucacccucccaaguagcugggacuacaggcacacgcugccacacccagguaauuuuuguagagacgcaguuuugccauguuggccaggcuggucuugugaaugccugaccucaagugauccgcccaccucggccucccaaagugcugggauuacaggcaugagccagcgugccuggccaaauuuauuauuaguaguaguaguaguauuuuugagauggaguuuccaucccaggcuggagugaagugacaugaucuuggcucacugcaacuuccgccuccuggguucaagugauucuccugcaucagccucccgaguagcugggauuauaggcgcaugucaccaugccuggcuaauguuuauguuuuuaguagccaggcuggucucgaacuccugaccucaagcgauccaccugccugggccucccaaaaugcuaggguuacagacgugagccacugcuccuggccucauuaauuuauuuauuuuuauuuuuuauuuuuuugagaccaagucuaacucuguugccuaggcuggagugaaguggcgcgaucuuggcucgcugcaaccucugccuccuggguucaagcaauucuccugcuuuagccucccgaguaucugggacuacagguacgcaccaccacacccugcuaaugggguuucaccacauuagcccagccagucucgagcuccugaccucuagugaucuaccugccuuggccucccaaagugcuggaguuacaggugugagcgacugcacccggcuacuuuuuucaugaauuuagaaguauuuaucguaaugauuggcuauguucauuguuaauucuguguucagauuuuuucucuuuucuuuuuuucuugagaugggucucaguccauugcccaggcucuggagugugguuuggcaucauggcucauugcagccuugaccuucugguuucaggugauccucccaacuucagccuuauggguaucugggacugcaggcgugugccaccacaccuggcugauuuuuuuugguauuuuuuuuguagagacaggguuucacuauguugcccaggcuggucucgaacuccugagcucgagcgaucugcccaucuuggccucccagaguucugggauuacagcugugagccaccgugccuggcccucagauuucuucuugaguaaacucaagcuuacuuauuuuccuuucccucuuauucacuaaguuacagagacauggggguaacaaaccauuugcaguuaaagggcaguaucugacccauuuguuuguuauauuuuugucugcccuuuauuacgagacauggagaaaugcuuuuuaaaagcacacuguacuucaaaaagggguaguuccuuuuuacuucauuuuauuuauuuuuuugagacaaggucccacucugucacccaggcuggagugcaguggugugaucacugcucccuguagccuugaccucccaggcuccagugauccuccugccuuagccuaccaaguugauaggacuacaggcgcucaccaccauauggaccuggaccuggcuaaguuuuugcuuuuuuuuuuuuuuuuccuguagagacgagaucucacuauguugcccaggcuggucucuuaacuccuggccucaagugauccuccugucucugccucccaaagugcugggauuacaggugugagccaccacaccuggcccacaguucccuuuuaauaagaaaauacuaaaaauuuuuuuaaaagaauguauugguggguccacacuuccaaccuguucuacaaaaacacaaaauagggccagguacagugguuuacaccuggaaucccagcacuucggauaccaaggaugggaggauugcuugaggccaggaguucaagaccagccuaagcagcauagugagaccccauuuguacaaaaaguaaaaaauuaaaaaaaacucagaacagauaaagaagaugaaauuaccacaaagaaagcaaaaaaggccaagaguaaaauuaaaauugaagaagauggagaagaaggaaaaguaguagugguagaagaagaggucucugugaagaagaagaaggauaaaaagaaaccgugguugggcaugguggcucacacuuguaaucccagcacuuugggaggcugaggugggaggaucacuugaggccaggaguucaaaacaagccugguuaaguagcaccugaggagggagaaaaaaaaagaaaaaagagacuauccuggccaacauagcaagaccccaucucugaaaaaaaaaaaguuaaaaaaaauuaucuagccaugguggugucuguagucccagcuacucagcaggcuaaggcaggaggcuuacuugagcccaggaguuugagguuacagugagcuaugaucgugccacuacauucuagccuggguaauggagugagacccugucucagaaaaaaaauuuuuuuucacuaauauugcuaguuuaauagguuaaaaaaagggauaaucucacacuuuuaaucacaucugauuuucuuaaaacaauaacaucaguauugcauggucauauaucugauaauuaaagguaaguuugggucaccgauaaugagguucucugauauagccaguugcuuuaguacucaaccaauuuaguauguuccauuuuagcaaguucucuugggcugaguauauuuuaagagugucaguggcuacccagacaguuguucuuuaucaagcuaaaauaagauaacaauaauagggacaaaaaaauguuugaaagauauucugaauaacuuugugugcucaguauagcugagacuugcugagaugcuucagaggcaaaccagucagccuauuucaucagccagagguggggugccuuucaacaguguguugucuaaaagucuaagguagacuugcccaaauuaacaaacuuugcaauuaucagugacaggcaacuauaguauggcaguaauagcacuggacugagugucaaaagaccaagguucagguuucaucuguaccacauaauaacugugaggucuggggcagaucagucuaucuguuuccuuauuuauaaaaucaagguugugagaauuaagggcuucgugacugggaugggugaccuucagaaugcuaguaagacacugucuagugauacaaaucagaaaauaauuuuuguguauauggaauuggugaagcauugauguuuucaauggaaauuacauucccuguaaguuucauuggguuauauagauggcaaauuggcugugaaauaugaaacucauggacuuacuggaaccacuuugagucccagaauaauucugccuucuccuaaggucauuuacuaaguuguagcugagucagaauuugaacuuuaaucucuagcauucuuucuacuguguucaauuuaauaccacggauauuuauauaccuucuaggugcauacacugugguaagugcuguaggugauuuuuuaaaaaguaaaauagaagaaacaauacacacugacuuuaaaacacugacuuuauuauuaaaagugucaugauacacacuguaaaugcuauacauauugugcauagguaugaaugacuaaguggauuuaaaugaaugucuuaggagccuggcauggugaacuguacccauagucccagcuucuuugagacggacgcucuguugcccaggcuggagugcaguggugcgaucuuggcucacugcaaccuccacuuccuggguucaagcgauucuccugccucugccuuccgaguagcugggauuacaggcgccugccaccacaccuggcuaauuuuuuguauuuuuaguagagaugggauuucaccguguuggccgggcuggucuggaacuccucgugauccgcccgccuuggccucccuaagggcugggauuacaggcgugagccaccacaccuggccagucccagcuucuugagaagcagaggcgggagaaucacuugagccuuggaguucaaguacaaccuggacaacauagugagauccuaccucuaaaauauaaauaaauaaaauaaaugccuuaaggagaucauggugcuuuguugaauugacucacagccaaggauucaguuaauuuucauuaguuuuuaauuaguagagcuggauguuuauuacuuaaauauuccuuuuuuuuuuuuuuuuuuugagacagaaucuugcucuguuacccagguuggagugcaguggcacgaucuuggcucauugcagccucugccuccugggcucaaaugaucuucccaccucagccuccugaguagcugggauuacagguguguggcaccaugccuggcuaauuuuuguauuuuuuguauagaugggguuucaccauguuguccaggcuagucuugaacuccugagcucaagugaucugccuaccucagccucccaaagugcugggauuacagguaugagccaucacaccugguccuuaaauauuauuuaaaauaguuuuuaaaaaaaugcuucucugggccaguugcaguggcucacgccuguaaucccagcacuuugggaggccaaggcagguggauugcuugaggccaggaguucaaaaccagccuugccaacagggcaaaaccccaucucuacuaaaaauacagaaaucagccggccaugguggugcaugccuauaaucccagcuacucgggaggcuaaggcaggagaaucgcuugaacccaggaagcagagguugcagugagccgagauugugccaccgcacuccagccuggguggcagagugagacucugucuggggauuuaaaaaaaaaaaaaaaaaagguuucucuuguuaacuuugagacaguaacggggaggugguauuauucagguagucagaagcauaaaugcccagaccgccucuauauuuuuaaaccuaagaaagugaaaccccugucucuacaaaacauguaaaaauuagcugugcacuguggcuugugccuguaguccuagcuacucugggaggcucaggugguagaauuacaugagcccagcagauagaggcugcaguaagccaugauugcaccacugcaauccagcuuggcgcaaucacgccaaaaaaaauuuaaaaauauaaaugaaaauacaggggaacauaauauuccagaccuuuaguauuguguugagguuuuuuuuuccccucuacuguaaaaugagaguguucaguuuuaagaggcacauuuucggagcauggauagagucuuuccaggagaaaacagucugucuggugauggaguaauuaaaaugauuugagacauuauuuaaggaauuagaggcugggcgcgguggcucacgcuugugaucucagcacuuugggaggcuaaggugggcggauuaccaggucagaagaucgagaccauccuggcuagcauggugaaaccccaucucuacugaaaauacaaaaaauuagccgggcguggugaugggcgcuuguggucccagcugcucaggaggcugaggcaggagaauggugugaaccugggaggcggagcuugcagugagccgagaucguaccacugcucuccagccugggcgacagagcgagacuccgucucaaaaaaaaaaaaaaaaaaaaaaaaaaaaaaaaaaaaggaauuagagauguuucauuuagagaauaaagagguggggacagcuauuuucaaauacaguugucccucgguauucaugggagauugguucucagaccuccugcagauaagaaaaucugaggaugauaaggucccauauauaaaaugauguaccucugcauguccugcgauauacuuggcgcacgccuguaaucccagcuacuuaggagguucaggcacgagaaucacuugaacccggguagcagagguugcagugagcggagauugcgccucugcacuccagccugggaggcagagugaaacugugucucaaaaaauaaaauaaaauaaaaaauauauauaugugauggcugaauccaaggauguggaaccuguggcuuuggagggcuaacuauauaucaaagaucuggcaaguggaauaggcauuagauuuaguauuuuguugcuuugacaaaagaacaaggaccaucaaguagaaguuaaagagaaaaauggaauguaacuuucuuauaagauagugaguuuccucauguuaaaguaagauacugaguuuaacuuauguuaaaacagagccaggguauuuagagauacuggggaggaaguuaaguugaaugaccuuuaauguuuuuguaaauaaaugguucuuaauuucaugaguauauauccccuugagaaucuaaccaacagcaaagacccuguccccagaaaacuucuacggauauacuauauagguauauauuuucuuucauccuugaaaacuacuuuuuuggggggcauaguauuguauguuuguuuguauguuuauuaguauugcauuuuauuuucuuucaguuuauugaauuuaucguuucuuuuuuuguuguuuuuguagagauggggucuuacuauguugcccaugcuugucucaaacuccuggacucaagcaauccucccaccucagccuuccaaagugcuggaauuacaggugugagccacccuguccagccuugaacuuaucauuccauuaucuucuggcuuacauuguugcuugagaaguuagccuugguguuaauaucugucagguacucuguggcaucacuaguuuuuuauuuccucaaacugcaugacuugacagucauuggcuuauccagauuauaagaaacuaagaugccagugcauacagggauuccucguggcuaugauuucucaggaauuuuuuauucuuuugauuugcucaacaccaaggcaggcuucuauauaguccgcuagggauagugaaaaauuuggggcuugguuuagauuggagagguauaugguggggugucuuauaaggcuuaacuuugggagggcccagggccuugauuucugucccccuugccuuguguggccuuugaauugaaagcuuuggauuaggccuucauagauuuuagugugcauacaaaucacaugaucuuuuuauaaggcagauucugauucugaagguuuagugugggacccaagauuuugcauuucugaucuauaaggugaugcuaauccuguuggucuacagaugacacuuuaaguuguaaggaguuagauugcuauguuugagaugugagugguauuaguaauguuagucaugguuaugaggugguacaguaguauauaaagaaugaagaucauuccauugugcagagguucuuuuuuaaaauuaauagacuuuucuuuuuuuuaagagacagugucuugcuuuguuacccaaguuggagugcaguggcacgaucauaacucacugcagccuggaacuucuggguucaagcaguccuccugccucagccuccacaguagaugggacuacacgugcacacuaccaaggcuggcaauuuuuuuucuuuuuuuguagagauggguacuuucuauauaguggagcugaaaauuuuucauugccuagugauguaaugcuuggcauaacaccuuaguuuuucuguuuuuagauauguuuagauacacagaugcuuaccauuguguuacaacugccugcaguauucaguaguuacaugcuguacagguuuguagccuaggagcaacagauuauaccauauagccuagauguguagcaggcuguaccaucuagguuuguuuaguacacucuaugacaguugcacaaugaugaagucaccuaacacauuucuuagaauguauucccauuguuaagugaugcaugacugucuaauuguaaccacccaacggggucaccuugcccgcuggcucaacagaaccuauuuaucaagaugggaauuacaguagagaaagaguaauucaagcagaacugacugugugggagaccagaguuuuauuauuacuuaaaucagucuguccgagaauuugugaauuggaguuuuaaaggauaauuuuguggguaggggaccagugagucaggaguucugauugauuggguuggagaugaaaucauagguaguugaagcuguccucuugugcugagucaguuccugggugggggccacaagacaagauaggccaguuuauaucagucuggguggugccagcuaauccauugaauauagggucugcaaaauaucucaaacacgaucuuggguuuuacaauaaugauguuauccccaggaguaauuuagggagguuuagaaucuugcagccucuagcugcaugacuccuaaaccaugauuucuaaucuuguuagaauuuguuaguccugcaaaggcagucuaguccccagccaggaaggggguuuguucugggaaaacuaaccuaaacuguaaacuaaguuccucccaaacaaaguuaguuugggcuaagucuaggaaugaacaaggacagcugggagguuagaagcaggauggaguugguuagaucagaucucuuucacuguaauaauugucucaguuauaauuuuugcaaagaugguuucauaauaauauguauauggaauaguuucacugcccuaaaaauccccuguacuccaccuauuuaucccuacuucuuccccuuaacuacuguaaccacuaauaucuuucugucuucauaguuuugccuuuuucacaaugucguauaguuagaauuauacaguauauagccuuucagauuggcuuuuuuuucaccuagcaauaugcauuugagguuucucaaugucuuuuuguggcuugauggcucauuucuuuuuauugcugaauaguauuccauugucuggguacacuacaauuugcuuauccauucaccuauuaaaggcauccuaguugguuccaaguuuuggcaauugugaauaaagcuacuauaaauguccacauguagguuuuuguguugacaugaguuuucaucuuuggguaaauaucaaggagugcaauugcuggauuguguggugagagaguauguuuaguauuguaagaaccucccaaacuggguauaacuuuuuuuuuuuuuuuuuaagacacaggucucgcuauguuguucaggcuagacucaucuccugggcucaagcaauccucuuggcuuagcguccugaguagcugggacuauaggugauuccagcucaccuugcuggcuguaccauuuugcauuuccacuagcaaugaaugagauuuccuauuguuugacauccuugucagcacuugguguugugcuuuggauuuuggccauucugauacggacacgguggcaucucauuguugucuuuuuuuuuuuuaaugaauuugaagucuuuuuuucuuauuaauaauuucuuuuaaccacgguugucagaauuauuguugucuuaauuggcaauucucugaugacauauguuauugaacaucuuuucguucauaugcuuauuugccauucguauaucguuggugaagugucuguucagaucuuuugccuauuuuuaaaaugggguuguucauuuucuuucuuuuuuuuuuuuuugagacagaguuucacucuuguugccuaggcuggagugcaauggcacgaucuuggcucacaacaaccucccgccucccagguucaagugauucuccuuccucagccucccgaguagcugggauuacaggcaugugccaccacgccuggcuaauuuuuuguauuuuuaguagagaugggguuucuucauguuggucaggcuggucucgaacucccaaccucaggugaucugcccgccucagccucccaaagugcugggauuacaggcgugaaccaccacgcccagccacauuguucauuuucuuuuuuuuaauuuauuuuuaauuuuuuaaauuuuuuuauuuuuuaaacauuauuuuauuuuuaauugacagauaacaauuguacauagucaugggguacauagugauguuuuuuuuuuuuuuuuuuuuuuuauugaucauucuuggguguuucucgcagaaggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaaggagcaugcugccuucaagcaucuguuuaacaaagcacaucuugcuccgcccuuaauccauuuaacccugaguggacacagcacauguuucagagagcaccggguuggggguaaggucauagaucaacagcaucccaaggcagaagaauuuuucuuaguacagaacaaaauggagucuccuaugcccacuucucuccacacagacacagcaacaaucugauuucuccaucuucuccccacauuuccccccuuucuacucgacaaaaccgccauccucaucauggcccguucccagugagcuguuggguacaccucccagacgggguggcggucaggcagaggggcuccucacuucccagaaggggcggcugggcagaggugccccccaccucccggacgggguggcggccgggcggaggcgccccccaccucccggacgggguggcuggccgggcgggggcugccccccaccucccucccggauggggcggcuggccgggugggggcugccccccaccucccucccggacggggcggcuggccgggcgggggcugccccccaccucccggacugggcggcugccggguggagacgcuccucacuucccagacggggcggcugccgggcagaggggcuccucacaucccagacgaugggcggccaggcagagacgcuccucacuucccagacgggguggcggccgggcagaggcugcaaucuuggcacuuugggaggccaaggcaggcggcugggagguggagguuguagcuagcugagaucacgccacugcacuccagccugggcaacauugagcacugagugaacgagacuccaucugcaaucccggcaccucaggaggccuaggcuggcagaucacucgcaguuaggagcuggagaccagcccggccaacaggcgaaaccccgucuccaccaaaaaaauacgaaaaccggucaggcguggcggcgcgugccugcaaucgcaggcacucggcaggcugagggaggagaaucaggcagggagguugcagugagcagagauggcagcaguacaguccagcuucggcucggcaucagagggagaccguggaaagagagggagagggagagggggagggggagggggagguguucauuuucauauuaaauuuuaagagcucuuuggguccaggcgcgguggcucacgccuguaaucccagcacuuuggaaggccgagguggguggauuacgaggucaggagauugaaaccauccuggcuaaugugguaaaaccccaucucuacuaaaaauacaaaaaaauuagccgggcgugguggcggguaccuguagucccagcuacuugggaggcugaggcaggagaauggcguguacuugggagacggagcuugcagugagccgagaucgcaccacuguccuccagccugggcgacagugagacuccgucucaaaaauaaaaaaaguuauuuguauauuuuguuucguuuuuaauuuuuuauuuauuuugagauuggguuguaagacuggcuacauuuuuuuuguauuauuauuauuuuuuuuuuuguagagacaggguuucgacacguugcccaggcuggucuugaacuccugggcuccugugauccaucucccucggccucccaaagugcugggauuauaggcgugagccacugcgccuggccucuguauauuuuggauaccaguucuuugucagagauguguuuugcaaauauuuucucccaaucuguugaguuucuauucucuuagcaguguauuuugcagaucagaauuuuuaacuucaguaaaguccagcuuaucaguuuuuucuuuccuacaucauguuuuugggguuguaucuaagaagucauugccaaacccuaggucaccuagauuuucuucuauguuauccucuaggaguuuuauaguuucguaucuuacauuuaggucuauaauccauuuuuuuuuaaugauccaucaaucuuuuaaucuuccacaguuuugguggguucucuuggacuuuauucuguagcaguucaugaccauguaccauuuacaggcaugagugauaaacuucauaguggcugagaaagaucaacagaaugaguugccuuguccaaaggaaauaugucagugacauaugagugacugaguuuuuacuaauugagauuacauccagguaccuuuuggugaugaaacuguuuauuguuuguugcagaguucuacugcagacuaacaauuccugaacccauuuaauaacccauguauauuaaaugugauaugauugggauuuuaaaggccagagguuuaagagagagauguucaaaaguuuuuuuuuuuuuuugagacagagucucacucuguggcccaggccagagugcaguggcacaaucucagcccacugcauccuccagguucaagcaauucuccugccucagccuccugaguugcugggauuacagguguguaccaccaagccggcuaauuuuuuguauuuuaguagagaugggguuucaccauguugcccccaggguggucucgaacucccgagcucaggcaauccgccugccucagcaucccaaagugcuaggauuacaggcgugagccacccgcuucagccucccaaaaugcuaggauuacaggugugagccacugcacccagcccaaaaguuguugaauucucaaauaauuaagauuucauguguucauauggaccauaaaggaucaaaauaaguauggcuugccauuauuguaauguugcuauccugaguaggucuuuuuuuuuuuuuuuuuuuuuuuuuugagauggagucuugcucuguugcccaagcuggagugcaguggcacgaucucggcucacuguaaccuccaccucccaggcucaagugauucucaugccucagccucccagguagcugggacuacaggcgcacgccaccaugccuggcuaauuuuuuguauuuuaguagaaacgggguuucaccauguugcccaggguggucucgaaccacugagcucaggcaaucuccccaccuuggccucccaaaguguugggauuaaggugugagccacugugccuggcccugauuggguuuuuaucauuaucuguucaguucauguaguuuuggcuguuaauucuguacuugaauuauucaaucacaaaguguuuuuacugacugcugacucuacuuucacuuucauuacuuaaugaugaaggcuguuuaaaauaauguuguaaugccgggcacgguggcucacaccuguaaucucagcacuuugggaggccaaggagggcagaucaccugaggucaggaguucaagagcagccuggcccacaugaugaaacccaucucuacuaaaaauacaaaaauuagccgggcgugguggugcacgccuguaaucucagcuacucggaggcugaggcagggagaaucacuugaacccaggagguggagguugcagugagccgagauagugccauugcacuccagccugggcgacagagcaagaccucaucucaaaaauaaauaaaauaaaauaaaauaauauuguaucuagauuuucaaaucagguguuuaugcaggaaaagacaauuguuuuauugguuuuagaaaaccaacaaaccaaagcaacaauaaagauuccuguauacauuuuuuucuuuaauuaaugaauuacuugggucauucugguaaaauaagaugcuuucuuguuaccgaaugccaguuuuaucagaugaaaaggacuguguucauagaugauggagauaaucaccaguucugauaguuacucuaaaagauaagacauaauccuguucagccagaccuagugaaaaucagaaauaccgaugaaacuuggacacguagaguaagauuuuuggcuuaaaacaccuuugcaaguggguggguauguguaguauuuaugugugcuacuugguuucuaaagacucccuacuauaugcuaauuuuuaaauuauguacaugguacuuuuuaagccucgcaggcuggccagccggccuacuggccucccucccucucuccguacaauaaauuagccaaaauaaugagguaauaucuaagucauuguagucuaggacugagucauuuuucucuuugaaaaaauuccagaauacuuuauauuuucuugaagguaacuuuuuugcacuuguuuuaagguauuguuacuuuauuuacagccaacgaaauggaacuguuagguuuguaagcaucuuauauuuuugaagugcugauuguauguucaaucuaauucaauaaauauuuauugucuaauauguucuaggcuuugguguaggugcuugggauauaaggauauguaacucauaguucagccuuaagucuaaauauuuaguauauuuguguuuuuuaauuuaguuuuuaaacacaguuuuuuaaaauaauuuugagauaauuauagauuuacauucaauuguaagaaacaauaauacagagauaucccuuguacacuuuacccaguuuccccugguggaaauuucuugcagaaucaugguacaauaucacaaccaggguauugacauugaaacaguuaacaguaaagugguacagccacucugaaaaauaguucggcaguuugccuaggaguacaguugcuaggccauaugguagucgcaugcuuacuuuuuuuuuuuuuucuuuuuuuucuuuuuuauuuauuuauuuauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugguuacuugagauuagggauuggugaugacucuuaacgagcaugcugccuucaagcaucuguuuaacaaagcacaucuugcaccgcccuuaauccauuuaacucugaguggacacagcacauguuucagagagcacaggguuggggguaaggucacagaucaacaggaucccaaggcagaggaauuuuucuuagugcagaacaaaaugaaaagucucccaugucuacuuccuuccacacagacacggcaaccauccgaucucucaaucuuuuccccaccuuucccgccuuucuauuccacaaagccgccauugucauccuggcccguucucaaugagcuagugggcacaccucccagacggggugguggccgggcagaggggcuccucacuucccaguaggggcggccgggcagaggcgccccucaccucccggacggggcggcuggccgggcaggggggcugaccccccccaccucccucccggacggggcggcuggccgggcggggggcugaaccccccaccucccucccggacggggcggcuggccgggcagaggcgccccucaccucccggacgggguggcuggccgggcaggggggcugaccccccccccaccucccucccggacgggucggcuggccgggcggggggcugacccccccaccucccucccggacggggcggcuggccgggcagaggggcuccucacuucccaguaggggcggccgggcagaggcgccccucaccucccagacggggcggcuggccgggcggagggcugacccccccaccucccucccagacagggcggcuggccgggcggggggcugacccccccaccucccucccggauggggcggcuggcggggcugaggggcuccucacuucccaguaggggcggccgggcagaggcgccccucaccucccagacggggcggcuggccggggggagggcugaccccccccaccucccucccggacggggcggcuggccaggcggggggcugacccccccaccucccucccggacggggcggcuggccgggugggggggcugacccccccaucucccucccggacgggguggcuggccgggcugaggggcuccucacuucccaguaggggcggccgggcagaggcgccccucaccucccggacggggcggcuggccgggcggggggcugacccccccaccucccucccggacggcacggcuggccaggcggggggcugacccccccaccucccucccggacggcauggcuggcggggcgggggggcugaccccccaccucccucccggauggggcggcuggccgggcggggggcugacccccccccaccucccucccggacgggguggcugccgggcggagacgcuccucacuucccagaugggguggcugcugggcggagaggcuccucacuucucagacggggcagcugccgggcggaggggcuccucacuucucagacggggugguugccaggcagagggucuccucacuucucagacggggcggccgggcagagacgcuccucaccucccagacggggucucggccgggcagaggcgcuccucacaucccagauggggcggcggggcagaggcgcuccccacgucucagacuaugggcggccgggcagagacgcuccucacuuccuagaugugauggcggcugggaagaggcgcuccucacuuccuagaugggauggcggccgggcggagacgcuccucacuuuccagacugggcagccaggcagaggggcuccucacaucccagacgaugggcggccaggcagagacacuccucacuucccagacgggguggcggccgggcagaggcugcaaucucggcacuuugggaggccaaggcaggcggcugggagguguagguuguagugagccgagaucacgccacugcacuccagccugggcaccauugagcacugagugaacgagacuccgucugcaaucccggcaccucgggaggccgagguuggcggaucacucgcgguuaggggcuggagaccggcccggccaacacagcgaaaccccgucuccaccaaaaccaaucaggcguggcggcgcgggccugcaaucgcaggcauucggcagacugaggcaggagaaucaggcagggagguugcagugagccgagauggcagcaguacaguccagcuucggcuccgcaugagagggagaccauggggagacggagacggagacggagacggagacggagacggagacggagagggagagggagagggagacuuuuuaaagaaacugccauuuguauugauauaauaugguggaggcccagguuccccacgugguccccgcugaucuuguuacuggucugcagggaugaaauuccuggauacccuacuuggcuuucugucuccaccuuggaagggguauugagugcuuaauuacagcuuugagagguuggaaaucuaggcuccccacuuggccuuugcuagaacggguagguuuuaaaccacaguauuuucuugguguuuggcugggguagauugguuauugucuaaaacuuuucugucuugcuagacugcuacuuucuuggucuuuuagcuaaagaagacugacuuuuguuggggcuuuucuuuucuuuuuuuuuuuuggagacagagucuugcuuugucgcccaggcuggagugcagugguaugaucuuggcucacugcaaccucugcuuucagguuucaagugauucucgugucucagccuccugaguagcugggauuacaggagcccgccaccauggccagcuaauuuuuuuuuuuuuuuuuuuuuuuuuuuuugagauggagucuuacacugucgcccagguuggcgugcaguggcaugaucucggcucacugcaaccucugccucucgaguucaagugauucuccugccucagccuccugaguagcuaggauuacaggcgcccgccaccacaccuguaauccuagcuacuuuauuguauuuuugguagagacgggguuucacuauguuggccaggcuggucuugaacuucugaccucaugauccacccaccuuggccucccaaagugggauuacaggcgugagccaccgugccuggccugcuccagcugauuuuuuguuuuuguuuuuuguuuuuuuuguuuuuugagguagagucuugcucucucgccaggcuggagugcaauggcgcgaucucggcucacugcgaucuccgccuccuggguucaagugauucuccuuccucagccuccugacuugcugagacuacaggugcgugccaccacaccuaauuuuuguauuuuuaguagagaugggguuucaccauguuggccaggauggucuuggucucuuaaccucaugaucugccugccucggccuuccaaaguuuugggaucacaggugugagccaccaugccuggcuggguauguuuuuaaaaugacauuuauuuuuucuuuuugcaaaaguuuuauuuaauguagauaauuuagaaacacaaaaauuauaaaagagaauaacauuuucauauauauucuucuagacauuuccugugaauauauauacauauuuuucuugugaaaauaagaacuauauauacuacucaugaacuuuuugcucgauauaagcaucauuccuuguuaauaaaugcaugaauauagcaccaauuugguaucaaucagguuguaaugugcacauucuggagaucaucaauauguguuacuccccuaggucgagugccugagagacagaucauguacaaauaaacgacguacauuuucacaugaaucucauaguucagacaucacuuauauacuagagagaguuagaaguaaaucagauuuagucauuaguuuuagaaacacuggguauuuggguagguauuuagauuuuaaaguuuaaaaauaaaaaaaauaaaaguguucauguggcuuuacgaaugcuauuuugauuaaaauucuuguucauauuuuccauaauauuauaagaagggucauuauacuuuucagaagaacauuugagauaauaauggcuuucuuguuuguucuuggaggaaauaggagauacuagcaguguuguuucaaugaacccuagcauuaguuuucugcuggaacuugcaaaacagaaaccagaacgacuuaaaucuuuuccauaguacaguuuuuucuaauugcuaugugguauacuugcagauguucagauuuauugggaaauuuagauuucauagcuuaggauuuuugguauuagcuauucagauugaugcaucaggucuaauuaaaaauuauacucaaguuuauucuuguacuuuauguugucuuuuucuuaugaugugaguagcugcaguauaacucaaaaccaguaauuauaaaaccacuuaaugaaugaauguagauguaaaagcauauaauauuuggaguuguuuuaguuucuguuucuuuaaaggugaagguacauaugucauaauuugggaagcuauccuuucaacuuaacauggaguugaaauugaaauguguucuuagacauaaauuugagauguguuauugaacauauuuaacacguuaucaguuuccauauuuuuccaagcaguuaaccauuggguagugcacagcaagcucauuuuccucuuagccguucugugcaucuugugguuugagauguucaucacugucuggcugugaaccccaaauguccuccuagugauccuggaagguauuuuagaauaguuuuggcuuucugcuuuugauucuaauuuaugagaucuggaguggaguccagaaucugaauuuuaaaaagaauagcucuauugagauacaauuuauaaaacauacaguucagccacuuaaaauguacaguucagugguuuucaguauuuucacaguugugcauccauuaccacaaucaguuuuagaacauuuucauuacucaggcaggacgcgguggcucacaccaguaaucccagcacuuugggaugcugaggcggguagaucacuugaggccaggaguucaagaccagcccgaccgauauagcgaaacccugucuuuccuaagaauacaaaaaguuagcugggugugauagugcacgccuauaaucccagcuacucgggaggcugaggcacgagaauagcuugaaccaggacguggagguugcagugagccaagaucgcgccaccgcacuccagccugggcgacagagcgagacucugucucaaaaaacaaaaacaaaaaaacccacccuguucuccuuagcuacucuuccaccuaauccuuccauuucccugcacucacaacuccuagauuuuuaugguguauggcucucaguuggcguagggguagaguugugauuuugcccuuuaggggacauuugacagugucuggaaacauucucaugggucacaacugggaaggugcuauuggcaugcuauuaaacaucuuccaguuuagaggacaaccucucauaacaauuuucuuguccaaaauuucaguagugaagguguuaagaaacucuggaagagaguuagacuaaacaaauugcaagaucaaauuuuuagcccucacauuggcaguaggauauuaucuuacauggucgauuuauaauuuauguaaaauuguuaaauguauugggguuauacagaugauagaaaaaagagucuuagggaccuaagggacucaguuuagucuagucuggaauaguaugauguccucgcugggagccaugaacccuagucuagagccugggauguaguuguugaaugaacaugauuauguggugguaguuugaacuaaaaugauucuuaguuauuucauaauugauggauaucuagauugguagacuucacauagcuguauagacuauucccucuuuuaauccuccuaucuugccaaaaucaauaaccauaaaaaagaauguguagaagagucugauuuuuauaguuuauuucaaagaaauuuaagagucucaauggugcuauaaagaaauuaaagacuggcugugguuugguugacuugaaaaggauaugugggucugaguguguguguuuaauuuuuuaaauuuucuuuuguuuuuguuuucagagagagucuugcucugucucacugcagccucugccucccggguucaagcaguucuccugccucagccuccugguagcugggauuacaggugcacaccaccacacccagcuaauuuuuguauuuuuaguagagacgggguuuugccauguugcccaggcuggucuugaacuccugaccucagaugauccauccaccuuggccucccaaagugcugggauuacaggcaugagccaccacagccagccuaaguguguguguguguguguguguguguguguguguggaaauugaaugguuuucaaaggugauuugauuagcauuugcauagacugugaauccaagauguuuguguucccuucccucauucuuccauucuuuucucuguuugucaauuuuuguaccgcgauauaugagggauuaaagaaaaaucuuuuagaauaguuuuggcuuucugccuuuuuuuuuuuuuugagauggaguuucacucuuguugcccaggcuggagugcaauggcgcgaucucagcucaccgcaaccucugccuccuggguucaagcgauucucuugccucagccucccgaguagcugggauuacaggcaugcgccaccaugcccagcuaaguuuuguaguuucaguagagauggauuucaccauguuggccaggauggucucgaucucuugaccugugauccgccugccucagccucccaaaguguugggauuacaguugugggccaccgcgcacguccucuauaguuuuuuuuuuuuuuuaaguuuaugauaaauugaaacaacacuaagaaaaucagauaauacaggaauauuaaaugaaaaccgaaucuuucugagaaaugaaaaauaguaucucauuguuuaauuuguauuucuuuuuagaugaaagaggcugaauuuuuuuuucacauuuauuauuuggauuucuaugaagaguuuguguccuggacucauuuuucuguuggguuguugauaguuguucuguuuguuugugagagcacuuaguauauuauaaaaauuaauccauuguguaguacauguaacacaaauauuuucuucuacuccguuauuugccuuuugacuuuacuauuuuuuuuuuuuuuuugagauggagucucgcucuuuugccaggcuggagugcaguagugucaucucggcucacuucaaucucuggcucccggguucaagcgauucuccugccucaaccucccgaguagcugggauuacaggugugugccaccacgcccagcuacuuuuuguauuuuuaguagagacgggguuucaccauguuggccaggcuggucucaaacucuugaccuccggugauccacccgccuuggccucccaaauugcugggauuacagguaugggccacugcacccggccaaaaauuuuuaauuuaauuuaauuaauuuauuuuuuuucccagacgaagucucacucuguugcccaagcuggagugcaguggugcgaucucggcucacugcaaccuccaccuccuggguucaagcaauucuacuaccucagccucccgaguagcugggacuacaggcacgcgccaccaugcccagcuauuuuuuuguguguguguuuuuaguagagacaggguuucacuauguuggccaggcuggucucaaacuccugacgucgcgauccgccugccuuggccucccaaagugcugggauuacaggcaugagccaccacaccuggccuuaauuuaauuuuuacuagucaauuuuuuuaguagaccuggucucacucuguuacccuggcuggagugcaguggugccaucauugcucacugcaaccugaacuccugggcucaagugaucuucccacuucauccucccaaguagcugggucuauagguaugcacuaucaugcccggcugauuuuugcauuuuuuguagagacaggguacgguuauguuacucagacuggucucagacuccuaggcucaaacgauccuccugccuuggccucccaaagugcuaggauuacaggugcuggauccagcuggcaguuucuuuaaaaauuaaacauguacuuaccauacuacccagaaaucacuccuuugguuauuuacuccaaauaaaauaaaauuuauguucacuuaaaaacuuguacguaacuguucauagcagacuuauucaaaacagcaaaaugugaaccaauccaaauguugugucaacaaguguaaagcaaaacauaugacauccauagcauggaauacuacugaguaaucaaaaggaacaagcaagcuauagauaaccugcaacaccuugaauagacuacaaggguaaugugcuuaguggaaaagcuuaucucaagaggucacauauuauauaguuccauuuauaugacauucucaaagugacaaaacuguaaagaugaagaauagauuagugauugccaggggacagggggguaguagguggaggggcuauaaauacagagagguagcagaacaguucuguaucuugauugcaguugugguuauaaaaaucuauacaugagacaaaacugcuuagaaauacacacacaaaugcagguuaaaaaaaauagugaaaacugaauaaggucuguagucuaguuaacaguuauguaucagugucauaauguuugagaccagccugggcaacauagugagauccugucucuacaaaaaaauuuaaaaaauuagcccaguguggcggcaugcaccuguggucucagcuacucuggaggcugaggugggagaucacuugaguccuggagguugaggaugcagugagccuuggcgcugccacugcacucuagccugagugacagagugaagacuuugucucaaaaaaaaaaaaaaaaaaaaaaaaaaaagauaauugagaucuggaucuaccugaugauaaaguguguguuccuugcacaguaccauccagucuugccugguaauuccuuucaggccuuuacuugguucuuaaauacuagauguugccaaauaagugaugcuacuuuuacuaggugugguuaggaggcacagcauccaaagcaaggacaugagauuguaauacaaggaaggugaugacuugcuccauugucuguggcuuucuuauguuguaaugggagcuuaucagugugcaccaugaucagguuacagcaucaggaggagcucuacaaccuauuuuagauucacaguuaauauugucugcuuuuuucuuuguucuugucauuuucuuuucucuuuuguacuuucucuuucucucucucuuuuuaaaagaugggagucuagauacauugcccaguacaguggcuguucacaggcauaaucauagcucauugcagccuugaacuccuggacucaagcaauccuuucugucucagccuuccaaguagauggaacuauaggcugugugucacugugccaaacaucucucucugucucuuuauuuuuuaagugauagagaaccacaaauguguuuuuuaaagaaccagcauuuuuucaaauaccaaauauuuguguagcugaugaugaggcaucacuaggaguuuccuuuuguugacaaauucaagagagacaucauuccaaaugaaauuuuauuccgaaagugaauuuugugaaaaccagugcuaagaaaauaacaaaaugaacgaacaccaaaacacccauguguuuacaaggaaacaagaaaacauggaguuaaaguaaguaauugugucuacuugacagauguuggguuuucuuucccucuuggacuauuguguuuccucaauuuguagguuucaugucaucuuuuuaaaauaguagccgucuuuugacuccuuauaaguuauguugggccaggccaccuuaccacaugaauucccuccccacuuugcuugguauuugauacccugcuuucagccaccauggcuuccuccccaccccuaaacgaagacucugauuuugcucugcuugcucuacccuaccugauggcuuuaggcuaaauuguuuaugcugaccggagucagauuuuauuuuuagagagauaauucuggugaccauauggagaacugggugagagacugucaguguucaguugagucuagugcagaaucuaggugagggguuugaaccaaaguacauggggauggauaaggaagacuaagcacucuacagacgaugaugauaauaugauaaauuauauagguuauaauuuacugaacacuugccaucccucauaacaacuucaugauugaaggccuuaacauuuuuauuuauuuauuuauuuauuuauuuauuuauuuauuuuugagacggagucucacucuguugcccaggcuggagugcagugguguggucucggcuuacugcaagcuccgccuccuggguucacgccauucuccugccucagccucccgaguagcugggacuacaggcgccugccaccacgcccggcucauuuuuuguauuuuuaguagagacgggguuuaaccguguuaaccaggauggucucgaucuccugaccucgugauccacccgccucagccucccaaagugcugggauuacaggcgugagccaccgcgcccggcuaacauuuuuauuuuauagaugaguaaacagucauggagagauuacauaccuugcccaaauuuaccuagcucaacagaggaaaagaaaggauaggaauucagguggucugauuuuagaaccugugcuuuugaccauuauacuagcugggggcuuuauuuuucuaacuguuagaaguguucaacaaugaaagagccacccugugaaguaaugugggcaucacuugaaauggucaggcaggaaguagacgggucauuaauacuacaucaaggguccacauacacacuguggcuagauuacugugaagaaggcuuuuaaguucugugauuuugugaugugauauacagggaguuguugcuuuaugugguucucauauacacuuucacuuaccaugguuugguuaaauaauaccaauucccuaauaacaugguuuaaauuuuacacagcauauuaacugugaauaaucguauaaaguacaaaauucgcugccagcucuucugucacuacauaaguaacaacugugcaaagcauggguuuguguuaccuccuugucucccagugauaaaucuaugugauaguuaagaaaaaucgauaaccgauagagagaauuggccgaaaaagaugaaaguucaggaaaaaaccaaaaaguaacaacaguggaagugaaauucaaauugaacucaaauggaguuauagaagaaauagaucacugagggaaugcugaugcucucauucaaaacacucuggauauguagccgaaauaacuuagugaaggugagcuuaucuacauaagugaagaaagugguuugguaaaaaaaaaaaaaaaaaaaagaagugaugcaagaaauuuuguagugaaagaacucucgaagguauucugugauauugaaauaugaaacauaaaguauuugaugcuauuccagacucagacaggagugugacaauuggcuaaggcauagaaaagaugucuauugcagccgggcgcgguggcuuacgccuguaaucccagcacuuugggaggccgaggcaggcggaucacaaggucaggagaucgagaccauccuggcuaacagggugaaaccccgucucuauuguaugaugagaagaauguaagcacuauuuaaacuaccccuaauaaauuuuuucaaagaacuuaaacauuauaauuuucaauauuucuauguucucuagugcagugguccucaaccuuuuuagcacugauuuaguggaagacaguuuuuccauggaaggggacgcugggggaggggauguuuucgggauaaaacucuuccaccucagaagaucaucaggcauuggauucucauaaagagugcacagucuagagcccucgcaugcacaguucacaguaggguuugugcucuuaugagaaucuaaugccacgacugaugugacaggaggcagagaugcucgccugcccuucgcucaccuccugcuuuagugcauuaaugauuaguuuuccuguucuuucaauuuuccuauaauuauaacugacagaguuuuuaauguuucaaugaaauuuuuuuuuuuuuuuuuuuugagacugagucucacucuugucacccaggcuggaacacaguggugcgaucucggcucacugcaaccuccgccuccuggguucaagcgauucuccugccucaggcucccuagcagcugggauuauaggcaugcaccaccaugccugacuaauuuuuuguauuuuuaguagagauggguuuucaccauguuguccaggcuggucuugaacuccugaccucaggugauuugccugccucagcuucccaaagugcugggaucucaggugugagacacugugccuggccucaacaaaaaaaaaauucuuuuuuuugagauaggaucuugcucuguugcccaggcuggagugcaguagugugaucucggcucacugcaaccucuaccuccuggauucaagcaauucuccugccucagccucccgaguagcugggauuacaggugcucaccaccaccccuggguaauauuuauuuuauuuuuuaaauuauuuuuugagauggagucucacugugucacuuaggcuggaguacaguggugcagucucagcucacgcaaccucuguagugaacccguccuagguucaaacaauucuccugccucagccucccaaguagcugggauuacaggcgugugccacuaccccuggcuaauuuuuguauuuuuaguagacaugagguuucgccauguuggccaggguggucucgaacuccugaccucaagugaucugcccaccucggccucccagugcugggauuacaggcaugagccacugugccuggcccaaaauuuuuuaaaaauuacagaguggcggccgggcacuguggcuuacgccuguaaucccagcacuuugggaggcugaugcggguggaucacgaggucaggagaucgagaccauccuggcuaacauggugaaaccccgucucuacuaaaaauacaaaaaaauuagccgggcgugguggcgggugccuguagucccagcuacucgggaggcugaggcaggagaauggcaugaaccugggagguggagcuuacagugaaccgagauugcgccacugcacuccagccugggcaacagagugagacugucucaaaaaacaaaaacaaaaaaaaauuacagagcggcugggugcaguggcucacgccuguacucccagcacuuugggaggcuuaggugggcagaucacgaggucaggagaucgagaccauccuggccaacauggugaaaccccaucucuacuaaaaauacaaacauuagcugggugugguggcacgugccuguagucccagcuacucaggaggcugaggcaggagaaucgcuugaccccaggaaguggagauugcagugagccaaggucgcgccacugcacccuagacuggacacagagcgagacuccgucucaauuuuaaaaaaaaaaagauuacagagcaauugcaguuuuucucauuaauuauuaugaucacuuugcaugguuucagcgugcauucuuacuuuuacgguuuugcacuauuguguaaaaugaaagcugccuguuuguaaacuguggaaaguuuaauuuuucuucuuaguuuuuagggguacccccuaacuagccuuuucuuugcagaguuuguauaugcaucucuaacaaaguauguuuccuuugacaaguuuugcuuuuaaaaaacuuggacugacugaaaauaauauuuguagaaaauauucuaaaaguaaugcaaaaaggaaauauccuuaaagcuaguauuaagaauaaucucauaggaaggaaguuucauguguuugguguuaucucucuuuuugguaacaguuuuguugagauauauuuuauauaccauaccauucacccacuuaaaguguagaauucaggccaggcacaguggcucaugccuguaaucacagcacuuuggaaggccgaggcagguagaucacuugaggccaggaguucgagaccagccugaccaacauggcaaaaccccgucucuacuaaacauacaaaaauuagccgggcauggcgacacgugccuguaaucccggcuacuugggaggcugaggcacaagaaucgcuugaacucaggaggcggagguugcagugagccaagaucaugccauuguacuccagccugggugacagagcaagacuccaucacaaaaaauaaauaaauaaauaaaauguacaauucauuguuuuuugguauauucacagacaugugcaccauuagugcaguaaagucuagaacauuuucaugacccccaaaagaaaucccauguucuuuaucacucccuaauacaauaaaccccaagccccaggcaaccaugaaucuacuuucuguauaaauuuaccuacucuggauauuuuauauacacagauuaauauaguagguggucuuuugugauguuuucaggguucacccaucuuguagcauguauuaggacuuuauucccuuuuauggcugaauaauauuccauuguauguauguaccucauuuuauuuaucauuuauuuguugaggaacauuuggguuauuucugcuuucauaugguaacucuguuuaaucuuuugaggagcucccagacuuuuucaagguggcugcaccauuuuauguucucauuagcaguauaugaggguuccaguucuugccacaucuaaaacacuugccauucauuaccuguuuuuuuuuauuuuagucaugcuacuggguguaggaucucauugugguuuugacuuucauuuuucuggugacuaauguguuuauuggccauuuguauauuaucuuuggagaaauguacagauucuuuguucauuuuuaaauuaauuugccuuuuuauuauuaaguugccagaguuuuugguauuuuagauacagguguguguggaaaaaacaaacuccguuucuccuacugcugauauucuuauagcacccuacugaaagcagauguguggggauuucuccccaccagcaggcaagcaagcagucauuucugcagcugacagccacucaauucugacauaaucaaccuggagauagcaucaagauuccacagguugagggcucaguuuccaagacugccucuccccacacuucacaugccaguuguaagcucccgcuuauuuuaccugugcuucugacugacuggcuauaaauugguguucccauuuauagccaugggcuuaacuugcuagagcagcucgcacaacucgaaaacacauguuuaccaguuuauuacaaaggauauuuuaaaggauacacauaaauagccagcugaagagauauauaagacaaggucuggaaagguccugagagcaggagcaucucuccugguggaauucgggugugcuacccucccaggacuuugucugugcuuauacuaguaccacauugucuugacuauuauagcuuucuguaguauguuaugaaaguggaaaguauguguccgucaaccuuguuuuuauuucaggguuguuuuagcuauucugggucccuugaauuuccauaugaauuuuaggauugauugucaauuucuacaaagaagcuuggugugauuuucauguauuuuuuuggacacagggucgcaccgcaucacccagacugagaugggguuuugccauguugcccaggcuggucuugaacuccugggcucaaguaauaaugcccaguuuggccuaccaaaguguugggauuacaggagugagccacugugccugaaucuguagaucaguuugggaagcauugccaucuuagcaauguuaaaucuucugauccaugaacuuaaaugucuuuccauuuauuuaaaucuuccuuaauuucuuucaggaauuuuuuuuuuuuaauuuuucagaguauaaauuguucacuucagccgggcacgguggcuuaugccuguuaucucagcacuuugggaggccaaggcagguggauuaccugaggucaggaguuugagacuagccugaccaacauuaugaaaccccauuucuacuaaaaauacaaaaauuagccgggcaugguggcaugugccuguaaucucuguuacucaggaggcugaggcaggagaaucgcuugaacccgggaggcggagguugcagugagccaagauugugccacugcacuccagccugggcagcaggagcaaaacuccaucucaaaauaaauaaauaaauuguucacuucuuuuaaguauuuuuuuaugcuauuuuaagcagaauuguuuucuuaauaucauuuuuggauuguugacgcagguacuuggugcauuuaaaauacaauuuuauuggcugggcaugguggcuuauaccuguaaucccagcacuuugggaggccaaggcuugcagauaccugaggucagggguucaagaccagccuggcuaacaacggcaaaaccccgucucuaucaaaaauacaaaaauuggcuggaugugguggcgcacgcacgccuuuaaucccagcacuuugggaggcugaggcgggcagaucauaaggucagcaguucaagaccagccugaccaauuggugaaaccccgucucuacuaaaaauacaaaaauuagcugggugugguggcgcaugccuauagucccagcuacucaggaggcugaggcaggagaauugcuugaaccugggaggcagaggcugcagugagccgagguugcggcacugcacuccagcugggugacagugagacucugucuuacaaaauaaauaaauaggcugggcgcgguggcucacgccuguaaucccagcacuuugggaggccgaggcgggcggaucacaaggucaggagaucgagaccguccuggcuaacauggugaaaccccaucucuacuaacaauaaaaaaaaauuaguugggcauggcugcaggcgccuguagucucagcuacucgggaggcugaggcaggagaauggccugaacccaggaggcggagcuugcagugagccgagaucacgccacugaacucuagccugggggacagagcaagaugccgucucaaaaaaaaauaaaaaaauaaaaauaaauaauaugauuuugucaaauuuaaaaccuuaagauccuauuggcuuguaauagcaaggaguagaagcguggauuguagaauguucuuaugaaggcuuuauuucaucaauggcuuuuaagcacuuuggggucagacuuugagcuguuagugauuguuuuugagcuguaguccuuagagauuccaaacugaugacugcauaugucacuuguauagucaaugugacugguuuucaaaagcccuuucaguuauagagccaaugacugggcaacagaaaugccuuucauuuauaucauucuucuguuuucuuggugcaaagggcuguaguuaagaggaacaguuagauuuuaguggcuuaccaaguugcuuuagaggaagucuaugaaaggacuguugagccaaacaauguucagauuaaaaaccagucuguuagcaggacagaauccucuugcagauacuuuguuuaaccuuuaacuuagugcaagaagaguucaagcuaugacuuuugagauuaaaucuuaaauuauguaagcauguuucugauaaggauuguuuuaucaucugcaucagaaccauuuggacugcuuuaaaauacagauuucuggacuccuacccagauuuacuaaaucaaauucugggaauagaacuucauaaucucuuuuaaaccaccuuuccaugggauguccacguuaaaguuugaaaacuacuuuuauuuauuuuuggcauccauauguguuuauugauauaguuucccacucaucuugauucaggguucuuucagugcugucucuaucugaaggagagccuuccuguaggcuggcagaggacagcagagcagccagacacacaacuacuauugugcaugacugacgaccauggugauuuuauagcauccugggcauuucacguucaggaaguaagaauuggggcucugcaccaggcacuucuugugcuugcucuuuuuuucuggagagggagggagauucuuugugagaggccuguucucgugaggggaucgucagcacuggaaaacugaaaaccaguuuuaauaguaccucuuucuguuaagagauugguuuuuaccaggacugaaauuuuucaaauuaugacucacugccaacuauuuuuucuguugcuguuuuuguuuguuuguuuuuuuugagacagaguuucccucugucucccaggcuggagugcagugguaugaucucggcucacugcagccuuuaccuccccaggcuuagguaauucuccuaucuuagcccucccaaauaggugggacuauaggcgugcaucaccaugccuggcuaauuuuuguauuuuuuguagagacuggaucucaccauguugcccaggcugaucuugaacuccugggcucgugugaucugccuaccucagccucccaaaaugcugggauuacaggcaugagccaucgcccuuggccuacagccaacucuuaaaagcaaaacaacacuagaagauaauggaauagaagauuucaguaggccgggcacaguggcucacgccuguaaucccagcacucugggaggccgaggcgggcggaucacgaggucaggagcucaagaccauccuggcuaacacggugaaaccccgucccugcuaaaaauacaaaaaauuagcugggcgugguggcaggcgccuguaguccccgcugcuugggaggcugaggcgggagaauggcaugaaccuggaaggcagagcuugcagugagccaagaucgugccacugcacuccagccugggcaacagagugggacuccaucucaaaaaaaaaaaaaaaaaaaguuucagugcauuguacauaguauggaugaguauugauuuauaaaacuucuguuucauuuauauauguguaugugaauauggaucauaauauaaauuuuuuuuugccauggauggugauaaaaagaaaaaaaugaagacuugagaauuagaaaaacacauauuuuucuuuccuucacucuuucauacguucuuuugcaucugccaugcuccuggaacugggauaggugcugggugagcauccaaauauuccgaaaauccucacucuuuuuuuuuuuuuuuuuucuuuuuuuggagauggagucuugcucugaugcccaggcuggaaugcaauggcgugaucucggcucacugcaaacuccaccugcuggguugaagcgauucucuugccucagccuccugaguagcugggauuauagacgccugccaccaaugcuuggcuaauuuuuguauauuuaguagagauggcauuuugccauguuggccaggcugguuucaaacuccugaccucaggugauccacccaccuuggccucccaaagugcugggauuacaggcgugagccacugugccuggccgaaaauccucacucuugagcucacaguuuauagaggguaauaggcacauaaauaauaaagugguauaguagaagcacaugucauacauuaacuguguacuagaaguacauaucauauagagugcuccugaagucauggcgacuuucauagggauggagguagguugagggguagguacugaaaauauugaagcugggugcugugguucacaccuguaauccuagcacuuugggaggccaaggugacaggaucgcuugggcccaggaguuugagaccagccugggcaacauggagaagcccugucucuacaaaaaauacaaaaauuagccaggcaugguggcaugugcuuggaguuccagcuacuugggaggcugaggugggaggaucaccugagccucaggagaucgaggcugcaguaagccaagauugugucacugcacgccagccugaguaacagaaugagacccugucucauaaauaaauaaagugaaaagguggagaagaagaauagcauuuuaauuauuaagcgugaaagaauuauuuuaguauugaagauggacaauaauugauauaaaucauuuuugauuuaguauucuuauccacucuuauucauauguuacucauucugaugcagcuuuugaguauauaggaucaauccagcacaugaagagcuaaagggagguucuguaccucuugugacagcuuuuccuauucuuggagggacccuuuuuuacuuuccucagaacuuuauuuacuagaguuuauuuccuuuuuagauuuuauuucauguugaugcuaguauucuuacugaauguauucugacccacuaagaaucaaugacaggguagggagguguaguugagauuuggggagagccuuaugcauuucauagggguccaaauucuguaucugauuuuuggcuucagaauacuuuucaggcuguaagccaguaaccucauuuuagucuuuaucucucagccuuauagucaucuuuuguuuuaucuuacuguaggcuaacauucaccauuagaaagucagacagcuggucuacacaccagaagauacuauauuagcuuucauugcuuauguuugccuguugcaggcucuuuuguuuacaucagccgccuucacucauuugguuuucauaugcauacugauugauacauauaaacuuagggagauucacucuaaacagugcucuugaucuauuuuguguuucuuaaguguuuuagcucagagacugguacuguuuacauagaaagaacagccucgucaagagucuggaggggcauacccuaugucacagcauuuggccauagcucuauacaugacgauaucaagaaggcgcccccuuggaccuacgaagacagaaggcacauucauguacuuugaguacacagaaauaugauaaaugaugaauaacaacuguuuuuaagaauuaaaaaacaggaggcauaaaguuaauaggagaugaaugcuuaauguguggcaguuucacguguuacauuugagggucaggucgguagugguguuggugaagggagcuaacugguuacccagccuggaugggauuggguggcuguggguggaaaaggugggagguagcguuauaaacaauuaaacuaguguucaauuguuaaaggcuauuaucauagccuuugacuuuucagucuguugaaugaucauuuugcuuugcauagagcuugcuauaaagauugcugugagagacaauauuugguaguaaauuaagaguugugccacuuuacuagcugagcaaucuuaggcaaguuauuuaaccucuaagugcccugguguccucauuuuaaaugggguuaucuauguccuagaguuguucaacauauuaagcaaaguaauuuauguaaagugauuagaauggucucuggaauauaagucugcaauaacugcuguuuuuuuuugagagggggggauggagucucgcucugucgcccaggcuggaaugcaguggugggaucucggcucacugcaaccuccaccacccagguucaagcaauucucaugccucagccucccgaguagcugggauuacaggugugugccaccacaccuggcuaauuuuuguaauuuuaguagaggcgggguuucaucauguuggccaggcugaucucgaacuccugaccucaugugcuccuccugccuuggccucccaaagugcugggauuacaagugugagccacaaugcccagcuggcucuucuuauuuuuauuuuuagucuauugagacaggaucucacucuguugagugagugcaguggugccaucacgacucacugcagccucaaccuccuggguuccagcaauccucccaccucagccuccugaguagcugggaccacaggcacauaccaccaugccuggcuaauuuuuaaauuuuuuguugagacgggaucucccuauguuucccaggcugaucuggaacaccugugcugaagcaguccucccucaucggccucccaaagugcugggauugcaggugucagccacugcaucuggucuaguucuuauuuuuuuauauggguuggaguuucuuuuuuuuuuuuccuuuuucuucuucaauuuuaauauuuugucauuuuauuauauugcaucucccacugaagacuuguauauuucuuggggucuuauuggagagaaauccuuuuuuuuuuuuuuuuuucauacaaaucagacccaagguagguuuaguguuuggacuguaauaugaaguuugcuuuuuaauuguuaaaauaaugauuuuuuucuugcauuaaacaauucugaaaguuuuucuuuuuguucacuuguagucagacaccaaagaaagggggaaaacuguagaauaaguuauuuuuuuugacagugucucacucucugucucccaggcuggagugcaguggugcagucacagcucacuguagacucaaccuccuggucucaagcaaaucuuucaccucagccucccaaggagcugggauuacaggcaugugccaccaugccuggcuaauuuuuguauauuuuguagagacaaggucucaguauguugccuaggcuggucuugaacuccuggacucaagcaauccucccaccucagccucacaaagugcugggauuacaggugugagccacugcaccuggccuaagugaaaaaaaauuuuuuauuuuuuggauacagagucucucucugucgcccaggguggagugugguggcaugaucucagcucacugcaaccucccccuccagguucaagcgauucucaugccucauacucccaaguagcugggauuacaggugugugccacaaugcuuagcucuuuuuuuguauuuuuaguagagacgggguuucacuauguuggccaggcuggucucgaacuccugaccucaaguaauucaccugucuugggcucccaaagugcugggauuacagguaugagccacugugcugggccccuaagugauuuuuuuaaauggucaaugugugagcuguuuuuuccuuaugguuuucucuguuccuuuuccuugccauaaaaguaaaaauagaucugguuuccuggguuaucacagcuuuuaacaaaaagcuuuuugauaaaauuagcuguugggucagugggaugagaucauuccuuucuaaguagugugaaauguccucuaagcauuugugagacaaaggcaugccagauaggcuaaccacacaauaagccuaacucugugguuauguuuagggcaggagugugaguuuucugugaaauagaauacuacugauauguagaaaaaggugaaagguacuuggcacaauauguaugcacucugguuggccacguguagaaagagauuagaaugauaaaagggcucaggauacacuugauaugagggcauaggccaucauuaucuucagaugugauuaauuaacugaaaauugaguagcucaucuacauuuggauuagugcaucuuuaauuaaaaauucuuggcuggacacgguggcuuacaccuguaaucccagcacuuugggagguugaggcgggcagaucaccuaggaucaggaguucgaaaccagccuggccaacauagugaaaaaauccgucuuuacuaaaaauacaaaaacuagcuggcugugguggcgugcaccuauaaucccagcuacucuggaggcugaggcaggagaaucacuugaaccucggaggcggagguugcagugagcugagauccuaccacugcacucaagccugggugacagagcgagacucccguuucaaaaaaauuaaaaauaaaaauaaaaaaauucuuaaggacaguuugaaacuggagagaaaucauaauguacuuuaaaaugguuaauuguauguuauguaaacuucacuucaauuaaaaaaauuaaggacagcuggaaagaaaacuaauauacuuuucuguuuguacaaaauaaaaugguagauuuaagaagcuuuaaccagggcuucaacuuucacaucauagauacuaacuguagaagcauagugcgauaacugauaguuaaauagaagauaaaaauccacaugaggagggcaugccauuuuaaaaaggagagcuaugugaugcuauuuccaauacauagauauagcuggacuuaccuucuuuaucccugagaaacgaaagcauucuaaguuagcagaggaaaugaugaucagaaugauaauaccuccuaccuuuuccccuugcuuccugauuugggauauaggacagaaaagaaauucuacuuuuaguugagaacucagggaugacuuugaacaaauauauuuguuaaucuccuuggacuuuucucacuuuuaaaauaaggagguuggauucaaaugcccuuucuaaaguuuugugauuugguuggaaauauuagaugugcacaucaccaaguuacuuuguuuuguuucuguguacaugaauaagcuuuuauuagacuuggucacuguugucucucugugaucaacaaggguaaguuagcuucuaagaguaccagugguagaacuuuaagauuugaagcuuuaacgagagucagcuaguuugcagugauuagagacuuguaaguuaauugauauacacacuuuugucuauauuuauuaaguuucucaggggaauuguagauuauuucagagugcaguuuuaggucguggaucagauuuaaguuggaaguaaauaaugguuauuacuagaauuuuuuguuuuuguuuguuuuugagaaggagucuuucucugucacccaggcuggagugcagugccacaaucucagcucacugcaaccucugucuccuggguucaagcgauucuccugccucagccuccugaguagcugggauuacaggugccugccaccacaccuggcuaauuuuuuuuuuuuugagacggagucuugcucucuugcccaggcuggaguguaguggugcgaucuugggcuaacugcaaccuccgccuccgagauucaaguaauucuccugccugagucucccuaguagcugggauuacaggcgcacaccaccaugcccaucuaauuuuuuuauuauuuuuuuuuaguagaaaugcaguuucaccauguuggccaggccgcucgcgaacuccugaccucaauuuucauacauuauuauuaacuaaaguucauaguuuauuuagauuuccuuaauuuuuaccuaaauaccuuuuucuguucuaggaucucaucuaggauaccacauuauguuuaguuaucauacuuagcuuucucuuggcuaugacaguuucuuacaccucccuuguuuuugaugacuuugacaguuuugaggaguacuggucugauauuuuguagaguguccuucaguugggaguugucugaucuuuuucucaugauuagacagagguuaugcuuuuuagaaggaagaucacagagguaaagugccacucuuaucacauuauaucaagggugcauacuaucaaaucaugucagcaugauuuaugucuguguguguguguguguguauguguguguguauguguguguuuugcuuuaucacucaagcuggaguacagugcugugaucacaguucacuggaaccuccuggacucgacucaagcuuccucucaacucagcuucccaaauagcugggaccauaggcacaugccaccaagcccagcuaauuuuuuuuugagaaagagucuugcucuguugcccaggcuggguugcaguggcacgaucguggcuuaccgcaacccuggccuccagggcccaagugauccucccaccucagccucccggguaguugggacuacaggcacguaccaccaugccuggcuaauuuuuuuguuuuuuuguuuuuuuuugagauggagucuugcucugucgcccaggcuggagugcaguggcgcgaccuuggcucacuguaacuuccgucuccuggguucaagugauucuccugccucggccucccaaguaggugggacuacaggcaugugccaccacacccagcuaacuuuuuguauuuuuaguagagacaggguuucaccauguuagccaggaugaucucaaucuccugaccuugagaucccccuacuuuggcuucccaaagugcugggauuacaggugugagccaccgcacccagccuaauuuuuguauuuuucauagagaugggguuucgccauguugcuugccuaaguuggugucagaacuccuggccucaagugaaccuccugccuuggccugccaaagugcugggauuacagauguaagccauugcacccagcugauuuaucacuauugauauuagucuugaucacuuggcuuagguaguauuugucauauuucucuuaccccccccucccauuuucauauuguacucuuuagaaggaggucacuaugugcuaugcacauguaaaggaugaaggguuauguucuaccucuuggaaguggaguaucuuguuuggaauucuucacugaagacuugcuuauucucucucauuuauuuauucagucuauuguuuauauuguuccagcuuuggucauugggaacuuuuuuaguugacuccuguguaauugaguuaccccuaucuuuuuuuuuuuuuuuuuuuuuuuuuugagauggagucuuacucugucgcccaggcuggagugcagugguacaaucucggcucagugcuaccuacacuuccuggguucaagcaauucuccugucucagccucccgaguagcugggauuacaggcacccaccaucaugccugguuaauauuuggguuuuuuauagagacggguuuuaaucauguuggucaggcuggucuugaacuccugacuucaggugaucugccugccuuggccucccaaagugcuggcauuacaggccugagccaccucguccggccaacuuaccccuaucguuguuuuuuuuuuuuuauuuuuauuuuuagcacuuccuaacuuucuggaaauacaagguacuucaggcucaucuugaauauuuuguucucaguccuagaauuagucauuucuccaaagagucuugguuucuuuaucagagaaugguauuagaaaccagcaucugggugugagguaugcuguugcuuuacugggguguccccugaagauuuuaauuaaacuucaucugaguuugaaaggacuggaaaugcuguguuuaaauuuuuuuuuauuuucuaauugagacagggucucacuguguugccaagacugaaaucaaauucuuagccuuagaugauccucccaccucagccuuucaaaguggugggauuacagacgugagccaccacaccuggccagaaaugccauauauauaaaauauauaauauauauuacaugugaauauguaauauauaauacauaauauuacauaugaauauauaauacauauauuauauauauauauuuuuuuuuuugagauggaaucuugcucaguugcucugugcaguagggaucucggcucacugcaaccucugccuccuggguucaagcgauuucccuaccucagccuccugaguagcugggacuacaggugcaugccaccacgcccagcuaauuuuuuguauuuuaauagagacgggguuucaccguguuagccagaauggccuugauccccugaccucgugauccucccaccucggccucccaaagugcugggauuacaggcguaagccaccgugcccgaccuaccucuuuuuacuacgauuuuauuacuacuggaacuagaucuuaaaauaucauguaagaucucugccauuauacuaguugucuguagcuacauguauggaauuuuaaaccguucagauuacuaccuuaggaaucaguaugcauucuugccuuuuccauaaagcagaggugucaggaccaagcuuuucaggucauugacaaaacugaaaaaggaguuagugauuauugcuuccuagggaaguaagacuuaaaaaaauaugcauuuacuuauuuauuuauuuagagacagagucucgcucugucacccaugcuggaguucaguggcgccaucucggcucacugcagccuccgccuccuggguuuuaagcauucucaugccagccucccgaguagcugggauuaugggugugcaccaccacgccuggcuaauuuuuguauuuuuaguagagacaggguuuuaccaugucggccaggcuggucuugaacuccugaccucaagugaucugcccgcuuuggccucacaaagugcugggauuacaggugugagccaccccaccuggcuuauuuaauuuugagacagagucucacucuguugcccaggcuggagugcaguggcacaauuucgacucacucauccucaacuucccagacuccagugauccucacaccucagccucccaaguagcugggacuacaggugugugccaccacaaccagcuaaccuuuuuuguauuuuuuaucgaggcagggguucaccauguugcccaggcuggucuugaacuccugggcucaagcgaucugcccgccucggccucccaguaugcugggauuacagaccuuugccacggugccugaccagaaguaagacauuuuggaugugugaaugaaguucugauuauguucuaaaggaauuaccacuaguuuugugguaccuuuuuuuuuuuuugagaaggagucucacucuguugccuaggcuggagugcaguggcgcaaucuuggcucacugccaccuccgccuccuggguucaagcaguucucugccucagccuccugaguaauugggacuacaggcgccggccaccaugcccagcuaauuuucguauuuuuaguagagacgggguuucaccaucuuggccaggcuggucuggaacuccugaccuugugauccaccugccucacccucccaaagugcugggauuacaggugugagccaccgugcccagccauuuugugguacuuuuguuuuccauuucucucccucucacaccuuuccugucuacugacuuugugauuuaguuaaaccaagccacuaaaacccagccaaaauucuacuaccaauaagaaauguuuagaguugauguugauuuaaauagcuuuagugcagcugugucguacuuaaacuccugcaaauuucccuccccccccagagauggugucuugcuuuguugcccaugcuagaguacaguggugcgauuuuggcucgcuacaaccuccgccuccuggguuugagugauucuccugcgucagccucccaaguaguugggacuauaggcgugugcuaccacaccuggcuaauuuuuguguuuuuaguagagaugagguuucacuauguuggccaggcugaucucaaacuccuggccucaggugaucugcccaccuuggccucccaaaguacugggauuacaggcgugagccacagugccuggccccugcaacguucuugaaguuaaagugagugaaguuggucuugauuaagaacuuaugcugcagauauugugugaauggguaucuacagaggcaguuauuucucagcuccaguauauuguugcuaaguggaaauacauagucauggccugaucuucggauuuuuuauuuuuuugagacagggucuuacacuaucacccaaggcugaggugcaguuccgcaaucauggcucacugcagccuugaccucccgggcucaaacgauccucccauuuuagucuccugaguagcuggaaccacaggugcaugcucggcuaauuuuuuuuauuuuuuguagacacggaguuucacugugcugcccaggcuggucucgagccccugggcuuaagggauccucccauuucagccuccuaaaguucugggauuacaggacugagccaacgcgccuggcccuguuuuuuaaaaaagcuguaaaacuguauuuucauucaaagauuacugauuuuggagauauuggccauuuuucaaaacacuauaugggccacugcaccaaggggccuguuugaccuagguuugcacucugaacuggugcuucucuuguggguucagugaguauucauuuuggggagggaacucugggcuuggugggaguugggagauguuuguccuaauuguagcuuugucucuaguuuucuagauggcuuuuggcaaagggaaaccacuuuggaucucucuuuucugaguuuuaaaauuugagaguaaacuggagaauuuaagguucucccuuacucuuuuuuauuuuacauguucauacauguauuuacuugagcugugaaacaaugaccauuuaugaguuggagacuucaggaagucuuacuagucuuaagugcuuugggaauagaggagacuauuauguuuucucuagauacacuuuuuucuaggcuacagaagauucucaccugcuuuuuggacucuuggcauacuugccgccucuaaucauuaucuggcagauguguacauaguaaugggugaugcauauguuucuguuuuuucaagcaaauugauucuaauuugaugaaagcuguauugauauguaggguuuuugggggguagucguggugauggguagaaauaguaaagcugacagugacaguauuuucuuaguuauggagaacauuuuaauacuuuauuucauuauuuuuaguuugaacuaauuaauuguuggugguucuauauggaaauaaugauguagguggguguucaucacuuaaaaucaacugcauaagauaauggcauaacuuaauuacuguaacagcaaaaaugaaaucugagaaacuucugaaauuuagucuuuuauuaauuugagauaagauuuauuuggagauaagauuucagacuuccuuuuaucagacaggugguuuuauaggaagauuaagauucuucuagaaaaaucuuaaagacaagggaaauaaguuuuucuuacacucuaaccauauauucacuugacauauaguguuuuuguaaaaauauauucguuucuuacaucuucagaauaaagcaucuugauguaaugugauuuacuaagaaucauaccucucuguccugaaggccaaucuaaauugcuguuuuguauagauugccaauuuuuaaaagagaaacuguuguauuugagugggauguaauaaauaugagcguuuaugauguagucucuugugggaauguuuauuuacaaguaauuuaagccucugugagccugacaaggcaaacucaaucuuaaauccuugauuaaguggaaguauaaacugauggaauaauaggcaagcaggauuuauguuuacaugguaauugcaacaauuuuggccaaaacauuuggccuaauagucacuaauuuugauccuuuauguucauuagcugaaauuguauauguaguaguuucuuuguaagguaauacaaagcaguaaggacacaggagaagaguauauuuaaaagaaauuucucuucagauguauagacuuugcuuuauaguucuaaugacaauaguccaggagccucuaagucagcauauuauuauuauuguuauuauuauuauuauuauuauuauuauuauuauuuuugaggcagaguuucgcacuuguagcccaggcuggagugcagugguacgaucucggcucacugcaaccuccgccuuccagguucaaguaauucuccugccucagccuccugaguagcugggauuaugggugugcaccaccacgccuggcuaauuuuuguauuuuuaguagagacaggguuuuuaccacgucggccaggcuggucuugaacuccugaccucaggugagcugcccgccuugaccgcccaaagugcugggauuauaggugugagccaccacaccuggccaagucagcauauuauuucuucuuguaaaaagaugucaugguggcucaugccuguaaucucagcacuuugggaggcugaggugugcagaucaccugaggucaggaguuggagaucagccugcccgguguggugaaaacccgucucuacuaauaauacaaaaauuagcugggcauggugaugcacgccuguacugcccgcuacuugggaggcugaggcaugagaauuacuugaacccaggaggcagagguggcagugagccgagaucgcaccauugcacucuagccugcaugacagagacucugucucaaaaaaaaaaaaaaaaaaguguguagguauguauaccuaauaaaauuagcgcuuucuaaaaaugcagugcuugucauuuacuauuaagucaagccauaugaaaucacauuuugucaguaaauaaauguucagauauccacaaucuuauacaguucuaauagauacucaagaaauuuugucgacaugaagagagucaaaucauaaaaugguagacugaaaaagaacuucguggagaauucuuuucuuuuugcaaacagaggugacugggaggucgaggcugcaguaagucauggucaugccacugcacucgagccuggacaccagagugagacccugcuucaaaaaaaaaaagaaaaagaaaugauugcacugccuuuuuuugguuuuggaacaaauauugugauaauaacuuuuacuuauaaauguagcacagaaaucuuuuacuuuguaaaagucccugaauagaaagucaggagaccuguuucuccuaccaacuaguauaauuuuuggaaagcucauuguucaucaguuuccuuauuuguaaaaugaggauguuagauauguaagaucucuguauuaauuaggauaguugaugcuaacucuuuaacauaacuagcauuucagugacuuaacacaauaaugguuuauuucuugcucacgucauagugugaguguuuagccuguggcugucauguaauugaggaauuucaacuccuuccaucuggugucuuggagucuccugcuggauucuuuguauuuaguugguugauagcaaagagcaccagcaagcagaauuucaucaagugcuuuguagugaagcauaauucuucagcucacauugcacugucuagaacccacucacauggucucaacuucuaacuccaagggaaauaggaaaugucuuucugagcacccagggagaagaaacagaauccccaucuuugccacggucccuuucauuuuguacauuuuuaaaauuuuuuuauuuauuauuuuuuuuaaagacagagucaaacucuguugcccaggcuggagugcaguggugugaucucagcucacugcaaccucugccucccagguucaagcgauucuccugccucagccucccgaguagcugggacuacaggcacgcuccaccacgcccagcuaauuuuuguauuuuuaguagagacaggauuucaccauguuggccuggauggucucgaucucuugaccucaugauccaccugccucggccuccccaagugcugggauuacuggcgugagccacugcaccuggcccauuuuuugauucuuuauucacacccaaauacuuucuccuguugcauauugcuuuuuguaucuuugguuacucugaauuuacuuccaaauuucuuggaaggaguuuaguauugcaagucaaagcagcccuuuggugcuugcuauguuuaggagagggucuccccccaaccccugccauccccagaugaguauauuuguuauuuuuguuaguaguuucauuugugguguaaguuugucuuuuauauugucauggcuugcuuaguuuuaaaugauuaaaaauacaucaauugcaaaaaucucccagugcuuguauaagaaaaacaauagaauauugaacacagccaacuucagagggaaagucauugucuaccauguucagucuagcagccugcuagcagaagggaaaacagacaaaccuuauacugucuuuuaaaggucagcacaugcagacuuagagaccaauagagaaacacauuccagugagcaggcaaaguucucuuugacuucugcccacuuaagaguaaacucagagagucagcaaaagucuuucaguugauuucagcugcuguuuuggagucaucuccaucuuuccgaagccuccuucucuuuucuccuuuuuuguucuuucuugauacauuauauuguacauguucauuuguauguaaauacaaaauauccuucuuuauggauccaucuuauguugguaaguuugaugagaguguucuaauucuaagccuugucuccuuaaaauauauaauuaucucagaauaaugccauaguucaguuugccuuauguuuggauuaguacuuucuuguguaguucucuuucaguaaacugcuccccuccccuguuuuuaauugcaccuuuuuucauauaccauuugcaccacaugucuaagucauuggucuuuuuaaauuacacuauggaaagguuaauuuuggacagaguuguuucuagauccuagugcauuaucgucauccuaggauugcauuucauuucucuuguaggcuaaugguacuauuuuuuggauauugcagcuuuaauaggaugcuguguucauuuuucauuuccuggagucugugcugaaguucauuuucagaaagaaugccuggaaaauaaauuuuuuuuuuuccccccugagauggagugucacucuguugcccaggcuggagugccguggcgcaaucuuggcucacugcaaccucugccucccggguucaagugauucuucugccucagcccccugaguagcugggacuauaggcgcaugccaccacgcacagcuaauuuuguuguguuuuucguagagacgggguuucaccauguuggcuaggauggucuccaucucuugaccuugugauccgcucgccucagccucgcaaagugcugggauuacaggcaugagccaccacgcccagccaauaauuuuuuuuaaauuguguguuugaauuucccauuuuagccuucacuuaauggaugaguuggcuguaaaaaucuagcuucaaaauaguuuuucucaguuuuaaaggcaucacuucauuuuuuaaaaaaaaucauuuaguguuacaauuagaaauaagcccaucuguuucuuguaaguugguaaguacugcugaggggaauuucccucccucccuucuugccaccuugccgaggcuguauucaaauuccugggcucaaaugauccucccaccucaucaucuucuuuuugcuuuucuuuuuuccuucuuuugucccugucucucuacucucuccauugucuguucguuuucuucaucugccucugugaucaugaaaauauucgccauguuauuguuuaccguucacauuuagggcugccauccaccuggaauuacuuuuuguauauacugugagguagagcucaaaauauccaguugacccagcaccacuuauugaaaagacaguuaauucccccacuauuuugcagugucacauuugucagauauuaaguauccauaugcaugugguuccguuucaaaaccauuuuuuugcauuggccucuuguuuuguuuuguuuuguuuuuccauauguucagcacaccaaguacauuggccucuuucuuggugauugugcagguaccacaauguuuucauuacuauauuuauguauuuuuaguuucaaacauaugacauugccauagguuagaaacucaucaguuuucagcauuuucacaugguucaauccaucaguaaguuuugauauccaguaguuuaaguuccucuaaguuuguucucaaagauuaucuuagcuguucuugacuuuuuaaauuacuauguaaaacuuaggaucaacuuuucaguuugauuugaaaagaaaaaaccuacuggacuuugcuugggguuauguuaaaucuauagauuaggccgggcguggugucucacgccuguaaucccaacacuuuaggaggccaagacagguggaucacaaggucaggaguuugagaacagccuggccaacauggugaaacccugucucuacuaaaaauacaaaaauuagccggaugugguggcgcacgccuguggucccagcuauucaggaggcugaggcaggagaauugcuugaaccugggaggcggagguugcagugagccaagaucaugugccacugcacuccagccugggcaacagagugagacucugucuaaaaaaaaaaacaaaaacaaacaaaaacuauagauuaguuuggggauaguugauaccuuuaaaauaucauaaaaccuuaaaauaaaauaaaaccuuauagguuuuuccuaaaagcacucccuuaguaaaucacuuguacaaaaauccgugccucagauucuacaucuaguaaacugauucuaaaacaccuuccuaacaagggggagugugaugucuuucuauuguuaaguuguauuaauccuguguugcauuucauuucagugaauuuuaucuugaauggauuagguagauuguugauuaauucagugacccucaauugugggugccucucggacucaacuuuaaugagauuucucugugucaugauuacccuuacugcaagaaaaccaacaacacugagauuuuuggugcaguagcacaugcuucuagucucagcuaccugggagguugaggcuggaggaucgcuugagcccaggagcuugaagcuguaguguacaaugagcacaccugugacuagccaaugcacuccagccugggcaacauagugugacuugucucuaaaaaaaacaaaacaacaacaacaaauaauacucauauugcuuaacccugucccugaacaauucugauccagcguguuuuuuuuguuuuuuuaauacuuuuaauucagauuuuuacuuguauuucagguaaaauauuaaaaguuauguuacuaauaacuugaaagaucucuucaacuuuugcuguucaauuuucauuuaauaaugauauucccccccuccuuuuugaaagcaucuguaagauauuaggucaaaguaaggccuuugccacgacuacaaaaugcuuguuaaguacucccauagaguuuguaucuucuccuucuugcucagaaaagcugagcuacucuacccuuagucgugccuagaaccaauacuuagaagaacuaugagggugcuuccagcugugcaaacaucaaccccagcaagagaaggcugguaugguauggagcagagcgcaccuagcaggacaaaugugcauuuaaugagagccugugagguuucaaguuuauuauauuuagauguccaggauaaaaggugagaaagaugcuauccuagccaucgaggaacucaagcguuaaggggaacucugggugggacacacauuguaaauaaacaauuacaagggugggcaugguggcucacaccuguaaucccaacacuuugggaggcugaggcaggcgaaucacuugaggucaggaguucaagaccagccugacuaacauggugaaacccugucucuacuaaaaauacaaaaaucuccgucucaaaaaccccacaaaaaacaaaacaaaacaaaaauuauagaauuggcagcacaaauuccuauguccucuucuaccuuccacuuuucuuuauuuucacugauauaaaauagagugaaacuucacuuugcuuaaugggagaaguuuuucuuuuguuaucuauuauuuucaagacagggccucacucuguagcccaggcuggagugcaguggugcuaucacggcucacugcagccuugaacuuccucugcugaagugauccguccaccucagccucccaagagcugggaccacaggugugcaggcuaauuuuaaaauguuuucuguggagacgcagucucaacuguguugcccaggcuggucuuguacucuugggcucaagcaguuuuccugccucagccuuccagaauguugggauuauaggcaugaaccaccaugcccagccaaaagagaguuuuuucuuuaauaaaauaguucucaaaagcuaagagcugaucaaguaugaauauucuuccuuucuuccaaucuccucagcacuaagucauccuaaaguuacaugauaugcuuauuacuuucugacagauauaugagcugauaacuauagagauuuaauauuuuaauaauuauaaaguuuuaauauuuauaugaucauauuaacaugaugguaguggcugauaucuuucucucuuucucucucugucccucagagauguggucucacuuucucgcccagacuggaguacaguguuguaaucauagcucacugcauccucaagcuccugggcucaaggaauccuacugccucagccuccugagaggcuggcacuacaggcacacaccaccaugcccagcuaauuaaaaacauuuuuuuuuguagagauggugucuugccaucuugcccaggcuagucuugaauuccugggcucaaguggucuuccugcuuuggccucccagaguucugggauuacaggugugagucaccaugccaggccaguaacuggucgaccaucuugaauauuuguuuuugccacauugcaucaugucaugcuuuucuaaaagcagagagagcuauuuuuauugcuaugccuaauaaugauaagaugaccagcauggagagcugguucguacgguuacuccuuacuggcuuucuuucuauaauuccagacaacaugcuugcucuuguacaaacuguguuuagaaaguggaagaaaauaggugaauauucuuuuuuauuuuuauuuuuuugagacagagucucacucugucacccaggcuggagugcagugacacgaucuuggcucacugcaaccuccaccucccagguucaagugauucuccugccucagccucucgaguagcugggacuacaggugcacaccaccacgcccggcuaauuuuuguauuuuuaguagagagggguuucaccuuguuggccaggauggucucaaucucuugaccucauaauccacccaccucagccucccaaagugcugagugcugggauuacaagcaugagccaccacaccuagccaaggugaauauuuguaauuggugauaaccuuucagccuugaaucuguuuauucuuuuucuaguugugaagaguuuuuguaauuuuggaacuucugauuaauuucaaauuagauucaauuucuaauaacuuucaucgugucauuuuagaaauguguuuuuagccccuuguuuuguugguuuuuaucauuuuggccugucuccucuguagucuacuaggaacagagaaggugugcacaucacuuugaugugguccucucuucugggacccagcaguuuacaggagcugguauauacaacuaacuacagugggggguccccaacccucggucuguagauugguaccaguccauggccaguuaggaacugggcugcacggcaggaggugagcagcaggugaacagcauuacauuaacuuugcgauaagugugccugaguucugccuucugucagaucagcagugguuuuagauuaucauaggagcgcaaacccuauugugaacugcacaugcgauggaucuagguugcaugcuccugugagaaucuaaugacugaugaucggagguggaagaguuucaucccgaaaccaucuccucccucucaccccuccugcuaucuguggaaaaauuguuuuccacgaaaccugucccuggugccaaaagguuuggggaccacugaacuacaguauagaucagacucuacuguuacaaguacagaugauguauuaguucugaauacuacugggagaaagauucuaaaaagcagucacagaaaaggugguaagacaauuuauguggaccuugauuucaagacuuucacaaaugaggagggagagaagauaacuucaaguuuggagagcaaaugagcauaggguguacagugauaauguaagaugguagauggucccaugugacuaaauuguagggagacccuacauggaaagcugcugaugauuauggugggugauaggacugagucuugucagucagccuugauauuacacguaagaguuuggauuuacaaaaaaaaaaaaaaagaaaaaagaaaaagacaucuaggcauuggggucccuuuaaagaucagguggaauguuuuccugauguucaggauucuuccugccugccucccuccuugcagaagaaaagauagguagguauaaguaguagguagguaaagguauguauaagcagguauaauucaaaagguauaugaaguacagcgaagucauuguguuagauaaaagcagaaacuacaaaacuguaagguuuugcuuauuuugucacgcucugcuucuguuuuugguguucuguggcucuuuucgccgauccuuugucucagccucauuuguaagugacuuguuuuuuccauuucucauuuuuuuuuccaucuauuaaagugaggggauuggauccuagaucaguucaacugguguaagccuuuagagccaggcaugguggcucaugccuguaaucccagcacuuugggaggccaagauggguggaucacuugaggccaggaguuugagaccagucuggccaacaugaugaaaccucgucucuacugaagauacaaaaauuagccaggcaugguggugugcaugccugcaaucgcagcuacucaggaggcugaguuaggagaaucacuugaacccaggaggcggagguuguagugagcugagaucaugccacugcauucuccagccugggcaacaggccaagacccugucucaaaaaaaaaaaaaaugccuuuagaaugugguuagaaauaauuuuuggauugguauagauuaacucugaauguuuuccuguguuagaggaaggaagugggauaaauguaaaguuuaaaaaaaaugcuccuuuuucaaaauuuugagggguuagguauuaagaaucuuuuaaaguuuuacucauuuaaaaaauuuagauaaaauggaagauucauucuuaagguuggugauaucagaaauguaagugcugugucauugucauuucuuauuuuggccuacauaaccguaaccagacuucagacaucaugcugccuguaucacauggcuaacagugggagguaucugguguguucuuccuggagaaauagauugaaauucauuuggacagaaauguugaaggcaggugccugauccaaaaugcauuuagucaggacugaacacaagcugccuggauaguuccuguaaguaagcaagguagccuuuuaacuuugugaugcaagguuuuauguaugugaguaugugugugcaaguguauacaguauuuuuauauccagagaacagggcucccuuaaauggggggugggggggacucugguaacuacaugaaaguaaaauauaacuucuuuaaaccuauaucaguguguucuuucauguaggaauguagcugugugauggccucagcuauucuaguaaucaagggcucucugcuguugcuaauccuaugaugaacaggacaaauggugguuacgaacagaacccugucaagccuggaaauuccaucaguuuguaauagcacagcuguuguccuugaacuguguagggaggaaccuagggguggacaguuaauauauucuucagggggguuguaguuuauugcucaggauagucaagaucuuccucaguugucuguugcuaucugcaagucugguuuggaggagaagcaggagaaauucagauuugucugaggaaucauaugugucugugaacuguguaaguugguaguugauuccuguagacauccuugcuaaagauuuauuuuuaaguaaaauaucauuuugcuugaaaguauaaaucaagguuuugugguuaaauaaauuaaaaacagcacagcugccagacaaaguucagcuugauguauaacaggccucugaaagaaguucaguaagaaacaaaucuggguaauaaaguuaauuaguaacuaaaaaccugcuaggcauacuaaaaaaaaaucugauguugaauauuaaauuauuaugaagcaggcuauaccuguauccaucaagauuauaaaugaucucccacacuggcgacgugggguuccuuucaagccugaggaaugagcacuauauuuuggccacagcauucucacuaauguccuaggauagcagcuuaguguuggcuuuagaauucucugucauuuaaaugucaugcaaaaacaaacguauaaaagaaaacauuaacccagauaucuuuaugguuccuugucuuguccauaaccgcccccgcccccacccacccaaaaaggacaggcuaucaguuauagagaaaauauaagugagcauuauaagcaguauccuaccuuuaguaauaauuauuuaaaguuuauuaaauggguuguuuggaacucaaaaugauuugccucaaaguagccuaggucacugagaagaaaguuuauuucuuucugcugaaacugacaggaggcgauauuuugaaagauagcaagcuugucuuuggcaugguauuaacucccuuucuuuugccuccuagggcuccugggccuguauacccuuucccuacuuugauaccauaucuauaucugcuuuauucccugaaaguucccauguugccauaauauuuuucuuccuuuuucacaccagaaccaagaacucagacaucuucaauagaaccaucucugggaugaacaauggucuuuccagggauguacauuuucuuacccacuuuuaaauuaagaaauaggauucuauacuuuuaaaaagagaaugcuggcuacugcaaaugaaugucgguagaaauuuggcuaaugugacacaguaaaaugaagguuuccuaacacagugguuaggaaaagugaguaugauggugggaaucaggcuucuguucuugcuuuuuuuuuuugagucaggguuucacucuguugcccacgccggagugcaguggugcaauaguggcucacugcagccucaaccuccugggcucaaucaguccucccaccucagccuccugaguagcagggacuacaggcaugugccaccaugccuggcuaauuuuuacauguuuuuguagagaugggguuuugccauuuugcccaagcucuguucuagcuuuucaugaguuuuuucccugcauuuuagcucccauaguagcaccuuucaaggggugaauagaagaggacagagacagcaacaggccauugguaaaccagauugccaauuucucaucagacagaaugagcacagaccccgagugaguggcucuagaugcgaaugaccuaaaauuuucaggaggacuucauggagcuuaaaagguucuucagaacuucuguguaauuaaguuagauauuaacacuguuuaaucuguauagaccuguaaaauauuuuuaguacaguaauuaauuccagaguuugugaacuauccaaaguaaagcauacaacaaaguacuguggccucaucauauauccuuauuuccuguuuaugagcaccuagcucuuaauagugagauuguagucaagagaguauuuuaucaucaugccauguaguugccucuugccuuaguuuaccuauuuuaaaaaacccggcucacuaauaguuucacuucaggcaugucaucagaaugaaagaucagauauacaaagugcugugcuugaaaacuguguguucccuuagugccugguuagauaauacagggcuuauuuucuggcagagugguguugagucuccuuugauguuagccagaacuggguggaguuucuuaagcuccagucagauuggcucaagcagggcaccaugcaguggugaauuuguuuucagucccucccuuugccaaaaagcuuuuuuuuuuuuuuuuaauaaaccucaacccaauuauaaaugagaauacuugauauaugaaauaauaugaaaugauaguuguucauauucacacugagggucuuaggggguuuauuuauagcuaacugaaaugaugcagcugaauuacaaguagcugauagaauaaucaaccucaguaaacauuuaacauaacacucucauuuuacagauuagagaacucagcccugaaaggugacucauucaaggccacagugagugucagauuaaacuggugcuucaguaaagcauacagacuucuguacccagcuuucaaauucucuugacucuuacucacaaaucuauuuaaaguuaacuuuauuaucuguauggauagaagaggaauaguauaaauggucaauuggucagugagagguuuuuuuuuuagaguaaaugcuucucauucacaaggguucauuuuuugauccuccugaacauccagauuugaaaauaauagugucauauccuuuuauccauaaaauauguaacuaagcauuuaaggcauaaccgaauaguaaguaacuucaagugauucugugugagaugaaauucauacaugaauuuauuaaaauuaauuuuggaauacuugaaccaguuuaacaucuauagagcauuuaaagaguguauuguacuuauacauguuucagaauaaaauaacuauaaaauuggauaaucgcuuuaauuuauugaaaacuggggauuucugggaaaaaaaaaacaacaguacuuuaacuugaaagaugacacuagcauuaccuuucuaggaucauuuuccauaaggggguguguguguguauuuuaaaaucauauucuauuuauguggugacaaguaaagaauagcuuaacuguugaugaaauacagaugcuaaguggcuagcuagaugugcucauagcuucaugaccuucccacuuuccaauuguauaauuuucuaucaguuuuacccucuuaggcugaauuucagcuacuguucauauuccaugaaccacaugcagcccaggaagucaucugagaguguguggcugggggcggggugggggugcugaggguuggauaggggaaagauuacaauggauaaaagcugcccuuugauaaucugcauucugauaaaugauauuuaaaauguauugguguuuuugacuguauuuuuacccugugccuuaaaugaggaaaagauuugaguagauugcaucuuaugucauuauguauuucuggggaaaauuaaauuuuggauuuuuaugguauguuguuaaggauggcacagauguccuuuuaaguucucuuugaccaugaaacugaugcaggauuuuugcuccuuagcucaacuagguccagguucuuaucucaggagcggaagaauuaggcacguggacaucaaagagugaguggaguagaaucuauuaaucgaaaggaaagcucuuagcaaaaagagagaacaugguaggugguucuacuaccugaagacaggaaaguuccguaauauggcugagccuggggcucuuuauugguucagaaugggaguguguggucauugguuugugaguaugcaaaaaaggucaaagcgaagacaccacuccaaggugggcaggacaguguagaaaaccaauuaggaaaggguagguacagguuaaauaggugaaggauggggaucaaucaugccaaacgggaaggcagguucuuaauccgaucucaggauuuacccaggacaguuuccggauuaaaguucggguuucacugaggacccgccccugucugccuagacauuuguuugccucuugccucuaucaaaacuaguuacagacguccuuuuuaguuuuugguucauaacagcucccaaaggauaacuacuaauaauaguugucagagauagaauagggaaauggcauaaccgaauaguaaaagcaacugaauaguugcuuuucauggaacccuuugacauuauaaucuguuaggcuuuuaaaagcucuuuaaugaacucauuucucagcauuuucccugucaugaucuggaguuacaauaauacuuuauauguaaaguaggcuggacgagcauagaauagggcuucccacccacauucgucuguuguaaaugggucacaggugugccacuacuacuauaggaacuuuuuuuuuuuuuuuugagacggagucuugcucuguuacguaggcuggagugcaguggcgugaucuuggcucacugcagccuccaccuccuggguucaagcaauuuuccugccucagccuccugaguagcugggauuacaggugcauaccaucuaaauaauaaaaaucagugcccagcuaguuauucuguuuuuguauuuuuaguagagauaggguuuuacuguguuggccaggcuggucucaaucuccuggcuucaagugauccacccgccuuggccucccaaagugcugggagauuacaggcugggauuaccaaguccaguuccuacuauaggaaccauugaauuccuauuuaugguuccuucagaaaagcugcuaaauccugaauucggcagugguuauucaaauaguggaauuuauaauuccaguagugugagauggcauuugcuguggacaacagcucugucaugccacaggagccccuuuggcagcaaagcuaucaguuuuugucacgagccccacacuacuuguuuuagucaggauucucuuagagggacagaacuaauaggauauaucuccaaaggagaguuuauuaaguauugauuuacgugaucacaaggucccacaguaggcugucugcaagcugagaagcaaggagagccaauccgaguccccaaaaugaagaacuuggaguccgauguucgagggcaggaagcauccagcacgggagaaagauauaggcugggaggcuaggcccaucucuucauguuuuucuuccugcucuauauucgcugguggcugauuagauggugcccacccaguuaagggugggucugccuuccccagcccacugacucaaauguuaaucuccuuuggcaacacccucacagauacacccaggaucaauauugcauccuucaguccaaucaaguugacaguauuaacauuacaaguccacuccuugucaacuugaacccauauacaucugagaucguauguaaucuuaaaauaaagacaauaauaaggucauaauuacaccuaauguaauaaaacuauccuucauacaaccagaaacacaccaauccccaacccaaauacuauuacauaaaguuaauaauacuuaaaugcuguuaugaaaucaauaaaucuuaugucacaugauaaaggaaaaggaaauauaaagugaagauauuaguacauguguauacauacacaaacauguuuuuaacaaaugaaggaggaaauacucauggcaguuacaguccucauuucugcagcuggucacguggucauagcugguauugaugacuaccuucuucuacccauucuguauuaacuuugccuuccccaaauaccucagcaggucauggguuuuuuuccugguggagugauccaaaccuucauuccugaaugguccggaucauuuguaguccugccuggauuuggcuguugugguuuugcauugacaguaaucacagggcaugguaauacgaagagaugcccuaaugggucucauguauuccaugcauacucuuccuuacuuccguugugaaguuguagacugauuucaucuugauagucugggucagucaccuuagccaacacuguaacucccccucugagccuguugacuuaaagggaggaggagcccaaaguguccaggugacaaucuuaacuuccaguuuaauggaaucauuguugugucuccugguggcagcauucuucccucuggaauuaagaccucuaggccagcagaacauaauguugcaggagaggaagcaaaaauuuugcuaguggaucacuaggggugauggugaguggugccacuuccaguuccaccccucgauuccuggaccugugaauccuggcuaugggagaaacaguaccuuauauuggacgcugauucagaggauacacggccuucuggaggacuuucccacaguucugcaaaguauugucaccuaguuggcguuguaauugugacuucaauaggccauuccacuguucugucaauccagcugcuuuaggaugauggagagcaugguaagaccagugaauuccaugagcaugagccuacugccgcacuucuuuagcuguaaagugagugccuuggucagaggcaaugcugcguggcauaccaugaugguggauaaggcauuccaugagucagcugggugcgguggcucacgccuguaaucccagcacuuugggaggccgaggcaggcagaucacuugaagucaggaguucaagaccagccuggccaacauggugaaacccugucucuacugaaaauacaaaaauuagcugggugugguggcgggugccuguaauccuagcuacuugggaggcggaggcaggagaaucacuugaacccgggaggcggauguugcaaugagccaagauugugccacugcacuccagccugggcaacagagugagaccccuucucaaaacaacaacaacaacaacaacaacaaaccaaaaaaacauuccacaaaugguagucuugguagaagcauugcauacaggauaggcgaacccauauccagaguaagugucuauuugagugaggacaauccucugcccuuuccaugauggaagagguccaauauaaucaauccgccaccagguagcuggcugaucacccaaggaauggugacauacugagggcuuggugucggucucugcugcuggcaaauuaggcacucagcaguggccguagccaggucagccuuggugaguggaaguccauguugcugagcccaagcauuacuuccaucccugccaccauggccacuuuguuggccaugggcgauggcaggggaaagaggcugagugguguccacaaaaugggucauccuauccacuagauuauuaaaccccuccuccgcugaggucacuuguuggugagcacucacaugggauacaaauaucuugucuuugaccacucagagagguccauccacauaccucuuccccaaauuugucaccaaguuuccaaucaugcuccuuccaagucccugaccagccaaaccauuggcuacagcccaugaaugaguauauaaucacacaucuggccauuucuccuuccauucaaagugcacaaccaggugcacugcucgaaguucugcccacugggaagauuucccuucauuguuguccuucagggauguccuagaaagggguuguagugcugcagcucuccacuuucggguguugucugcauaugaugcagaaccgucugugaagcaggcccuaaucuucuuuuccucugucagcugaucauagggaacuccccaugaggccaucagugcaggcugggagagagaaggcaggguggcaggaguggaggccaugggcauuugagccacuuccucauguaauuuacuugugccuucaggacgugcuugagcccgaucacguauauaccacuuccauuugaugauggaaugcugcugugcacaauccacuguauggcuagaugggucugaaagcacccagcucaugauaggcagggcaguucaggucgcauggugacuugaugacccauagucaaacauucaauuuccacuaaagcccaguaacaggccaagagcugacucucaaaaggagaguaguuagcuguaaucagcacuuugggaggcugaggugggcggaucacaaggucaagagaucgagaccauccuggccaacauggugaaaccccaucuuuacuaaaaauacaaaaauuagcuggaugugguggcacgcaccuguauucccagcuacuugggaggcugaggcaggagaaucgcuugaaccugggagguggagguugcauugagccgagaucgcaccacugcacuccaguuuggcaacagagugacacugcgucucaaaaaaaaaaaaaaaggagaguaguuaucuguagaagauggcagggccuugcuccaaaauccuagaagucuccauugcgauucaccuaugggagccugccaaagacuccaaacaacauccccaucugccacugacacauuaagcaccauuggaucugcugggucauauggcccagguggcagagcagcuugcacagcagccuggaccuguugcagagccuucuccuguucuggaccccacucaaaacuggcagccuuucaggucacucaguaaaugggccggaguaauacacccaaaugaggaacguguugcuuccaaaauccaaauaugcccacuaggcauugugccucuuucuugguugugggagagaccaaacacaacaacuuauccuuuaacuuaaagggaauaucucaacaggucccacaacacuagaucccuagaaauuuuacugagacagaaggucccugaauuuuagucggauuuauuucucauccucuggcaugcaaaugucacaccaauaaguccaguguguuugcuauuucuugaucacuggauccagucagcauaaugucaucaauguaauggaccagugugauaucuugcggaagcgaaaagcgaucaagaucucuccaaauaagauuaugacacaaagccggagaguugauauaccccugagguaggacaguaaagguauauugcuggccuugccagcugaaggcagauugcuucugaugggccuuauggacaggaauagagaaaaaggcauuugcagagucaguggcugcauagcagguaccaggagauguguuaauuugcucaagcaaugaaaccacaucugguaacagcagcagcaauuggagucaccacuugguuaagcuuaugauaauccacuaucauucuccaggauccaucugucuucugcacaggccaaaugagagaguuaauggggauguggugggaaucaccacuucugcaucuuucaaguccuugaugguggcacugaucucugcauaccuuccagggaugugauauuguuuuugauuuacuauuuuuuuagguagaggcaacucuaagggcuucuauuuggccuuucccaccaugauagcccucaaccuagcagucagggagccaguguggggguuuugccagcugcuaaguaugucuaugccaauuaugcauucuggcacugggguaaugaccacaggaugaguccagggacccacugggcccacuguaagucagaccuaagcuaaaacuucauuaauuaccugacuuccaugagccccuaguuuaacuggaagaccacagugauguuuuaaguccccuggagucaucaucagcccagagccaguguccaguaguccccaaagugaaagguuggauggaggucuccuuggggaaggaugggagaaagauucacugcauaaauugucaguaaaguagugggguccuuucucaaggguaccuggccuccccuucauucaagggguucugggucuguaaacuggcugaagucuggaaauggauugagugaggggccaugauucucuuuuuauaauucaaauuagucuuuuguccauucgaccuagaaguuuuguguuuguauaaauuaagugggaaugcaguaggcuuccuguccguuucacuucuaggaauaccgugauuaauuagccaaugccagagcucuacaugagucagacuauucugauugucacuuugccucugcuguccauuacgguagcuacgcccaccuugccuuugaugguugagugcugcuacuuggccccugccaccuugggauccaguuauuccccucguauuucaauuuuguaauugagugacugcgguucucaccauuaggucugacaugcagagaagagcaauuacagggcucuucaaagauucaagugcugcccucacaaaucuauuucacaaggcauuggucaaggguauaucuucuggacccucccagcugggaugaguaggucuaaagugaguaauccacuccaccaccucaaucucccuaagcuuuuggaugccuuccucuacauuaaaccaagagauaucaggcauuuccagcucccucacagugggccaucuuuuaaugcauauuucagcuaaccaagcaaauaaacuauuagaaccuuauuuuaacuccccgagcugcaacauuaaaugcagagucccuacuuagugggcccaaaucaauaaauucagccugauccaacucuauguuccuuccaccauuaucccauacccuuaauacccauucccaugccuguucuccagauugcuguuuauauaaauuagagaacaguucuuuuuuuuuucuuagagggagucucguucuguugccagguuagagugcaguggcacaaucucagcucacugcaaccuccgccucccggguucaugcaauucuccugccucagccugccgaguagcugggauuacaggggugcaccaccacgcccggcuaauuuuuuguauuuuuaguagagacaggguuucacuauguuggccagacuggucuugaacuccugaccucgugauccgcccaccucggccucacaaaguauugggauuacaggcgugagccaccgugccuggccgagaacaguucuuuuugaguguagcgcaccuccuccugggucacacucucaaccucaccucuagggaccugugggacuugaguuauaggucuagaagcaaauggguguugcagguaccuucuaaggagaaucaacauuaucuugccuggcaacugccugagaggaggccaugacucuugccucaggcagcucaggguuuauguccguagacaaagauggaaagguugauggcggggaugggggguuaugcugccacuaugggggauggggaagcuguuccuucuggcaaaaaaaguucaccagaguuuauaaacucaguguucccagcuucaucaggguccucccacacauccccauuccaaguuucugggucucauucuuuuccaaucaaugcccucacuuuagcaguagacaccucagguggcugugcaugcaucuuuuguugcaggucagccacucgcaugauaagagcuuaugucuguuuuuccacaauuucagcucuuucucaacaggagcuaagacucucacucagggcaaucuuagcagauuugagacucaguaucugcuucugaagccaggaaacagaaucccugaguucaucauuuucuuucaucacuuuguucacugaacuuaggagcaaccaaccagcuucauuauguucguugguuuuccacauauggucaaagguauuauguauagagucacuaaaguccuuaccuuucaugagcagugaaucaggagugucaaaugcauuuauuuugcauaacucucuaaauaguucacgccaaggacuaugaauguucuccaugcuauuagaaguagaguccucagcauuuuuggaucaaucauauuaagcagccaacuccagaaacccccaaaccaacaaaagaacuccauccuuaacauucuguuccucuggaaccacuccugguaccagagucuguguuagucuggggucagaguuuucuuagaggaacagaacuaauaggauauauauguauguuuauaaaaagaggaauuuaguaaguauugacuuacacaaucacagggucccacaaaaggcugucugcaagcugaggagcgaggaaagccaguccaagucccaaaacugaagaacguggaguccgauguucgagggcagaaaguauccagcacaggagaaagauguagacugggaggcuaggccccucuugccucuucauauuuuucugccugcuuuauguucgcugguggcugauuagauggugcccacccaauuaagggugugucugccuuccccagcccacugacucaaauguuaaucuccuuuggcaacacccucacagacacacccaggaucaauguugcauccuuuauuccaaucaaguugaugcucaguguuaaccaucacacuaauaaaaguguaauucuugcugaccaaacugagcugugggcuaagaugggaguggaaacagcucuagacaaaagggccauagacucuuccuggucuuaaccaaagcucaagcagauuucgagaaugcaaagcuucucaacuuguguucuacaguuuguugauguccagugcuuuggaauggcugaucauaacaguuuuguacaauuuaauauguuuuuuuuuuuuuuuuuuuugagaaggagucucacucugucacccaggcuggagugcaguggcgcgaucucugcucacugcaaccuccaccuccuggguucaagcgauucuccugccucagccucccgagcagcugggauuacaggugcccaccaccaugcuuggcuaauauuuuguauuuuuaguagagaggagguuucaccauguuaaccaggauggucucgaucuucugacuuugugaucugccuacgucagccucccaaagugcugggauuacaggugugagccauugcgcccggcccauauuuacuuuuuuauggagaagauucaacagcuucuuuaugacaucuauuauuaaacucucucagugcgugucuuucuuugacauaauuugcucuugucgcuauuuuucuucuaacagacugauuaaauuggauuuaacuuuauuauaguuauuagauauuucuaaauggaauuaaauuuauuuauuuauuuauuuauuuauuuauuuauuuauuuuuggccuuaauguuaacagccagagugugauuuauuuuuuacuuauuuauuuaaaaguuuuuaaauuuaauuuuuguuuuuugagacaaauuuucugucacccaggcuggaguacaguggugcaaucucggcucacugcaaccuccaccucccagguuccagugauucucaugccucagccuccuaacugggaccacaaguaugugauaccacgcccagcuaauuuuuguguuuuuaguagaaaugggguuucaccguguuggccaggcuggucucgaacuccuggccucaagugauccagcugccucaggcucucaaauuguugggguuacaggcaugagccucuguacccuauuuauuuuuuauuuuuauuuuuaaaaauuuuuugagacagggucucacucugucacccaggcuggaguacaguggugccaucacaaucauggcucacugcagucuuaaacucccggguucaagcgauugugacacuucagcuuccugaguagcuaggacuauaaguguaugccaccguacccagcuaauuuuuuuuuaguuuuuguagaggcagggucucaguauguugccuagcuggucuugaauuccuagucucaaguaauccucccacuucagccucugaaagugcugggauuacaggugugaaccaccacgccuggcucagagugugauuuuuuuuuucuuuuuuuuuucuuuuugagacuagagucuugcucugucacccaggcuagagugcagugaugcaaucguggcuccacaccuggaguugugguggcuauucacagacgugaucauugcacacuauagcuuggaacuccuaguuacaaucucccugccccagccuccugaaaggcuagaacuacaggugcaugccaccacaucugggucacacguaucuuuugacauuuuuugagaccuaaaugaacuucaucaaauuccaaguaguaugaugacagagucgcaugaaccugggagguggagguuccggugagcugagauggugccguugcacuccagccugggcaacaagagugaaacucugucugaaaaaaauaaaaaauaaaaagauaugauuuaggaacucauuaguauagucacaggaaauuuaaauaucacauuugcuuuaagaaaaguaagcaggcugggcgcaggggcucacaccuguaauccuggcacuuugggaggccgagguggguggaucacuuugaggucaggaguucgagaccagccuaaccaacaugguggcacccugucucuacuaaaaaugcaaaaauuagcuggguguggcggugcguaccuguaaucccagcuacuagagaggcugaggcaggaggaucacuugaaccugggagguggagguugcagugaggcaagacucugccucaaaaagaaaagaaaucagagaaacagcucuuuucuacuacauuuuuguauaaugguacuaccuagaauuugaaaagauaaucauuuaaaauuauugaugaggaauuaagguuguuauuucaaauaggaaaacucauaaaauuaggcacauggaagaaggcuuaaauuuauuugaaauuuuuagauuuuauuuggaagucuauauaaauauaauugauuauuuaauaucuuuccaaaucuugguauuguauuuuuuucuuagauaauauaaagaauauguaaugaauguuuucacuaagcuccauauagguagagacaaacuaucuccagcauucccaguacugaacacauacuaucuuuuuuuucuagacacuugccuagaagauguagaucuugccccuggccuuaauuauccugucuguacuuauuuggguaucggaucuugauucuuaagccucugugccaccacucuaauauauagcaacacccuuugcuuguuggauuugggaauuggggguacgaugacuucugauuuuucagggucuggaaguauuugcuuuguacauguuuuguaaucaugguagccucacagcauguaagugggaggagaggagugugugggaacaaagaugaagauaaaauaagaaggaaggaagauaggaccauauuccuugcuuuaauucuauuucuuuuuccuaaguacauuuguuggagagagguagacgguggauaacagcuugaaaggaaagccugaaaauuaaguggcuugaaucauaguauauuuuuacuuuuucaaguuuggguuggagaaagacuguguauuaguugagauucuuccauuguaaacaacagaaauagauuggcuaaauuaggcaaaagaaagaugaaggccgcucacuuagacuugaaguagucaaccagggcaacuaaauagcugucacucauggacuuuucuuccagcguguagucaauaaaugauccuuuccaacugucuucuucuugacuucugauugacccaacucuagucaugucccaaacccuauagggguagggauugguuuguauuaggggagauaggaagaauagauuucuggacaaacacaaguaguggccauuacauugugcaacuaaggaucuguuugacuuguauuuaccuugucaacaacauagcuuauaugucaacuuauccuauggagucucuuggaguuucuguuagacuuuuugaaagcaggcguaguaccuugcacacuuuauuuccuauuaugcccugcauuugaauggugcccaauuuauugcaggccuuuggcucuuuuuuuuuuuuuuuuuuuuuuuuuugaugggggagucggagacuuccucugucgcccaugcuggagugcaguggcgcaaccucgguucacuguagccuccaucucccggguucaagcgauucucguaccucagccucacaaguagcugggauuauagguguccaccaccaugccuugcuaauuuuugcauuuuuaguagagaugggguuucaccauguuggccaggcuggucuugaacuccuggucucaagugauccuccugccucggccucccaaagugcugggauuacaggugugagccacugcaccuggccccuuuggcucuuuuuacuacauuauuucuguauuuucuaggcuauucaccuaugguuugcuuauagauuuacuuuuuuuuuuuuuuuaaacuuuauuuuagguucaaggguauaugugaagguuuguugcauagguaaacacaugucacaaggguuuguuguacagauuauuucaauuaagucuaguacccaauaguuaucuuuucugcuccuuucccuccucccacccuccacccuccaggagaccccagugucugcaguuucuuuguauucguaaguuaucauuuagcuuccacuuacaaguaagaacaugugguauuugguuuucuguuccugcgucaguuugcugcggauaauauccuccugcuucccaucuauguucccacaaaggacaugaucucguucuuuuuuauggcugccaguagauuuacuuaacugcagauuauguaauuaagaagcugguagucuguaaaaaugguaauauacgugacuacagagagggaccaucucccuuagcuaauugagggaaacgugucuuuuuuuuuuuaugcuggcagggcuaaguaguuugguugacaggacuauccacaagugauucaugaagaagcagguacucacuccaagauaagauccauacucacagucuuuggucaagaaaguugauuucauuuguccgauaguaauguaacuauguaaagaccugauuugaaucuuacuggcuauagcuuuggauauguugauugugggguuuuuuuacaccucacuuuucuuauaaauagaaaggacacaauugcaauugcuuuguccugccaccaccaccucccuccacccccagaaaugugagaaaagaguaacuagcggugaguuaccuugggucagacuguccauuucuuagcuuuauuuuucucaucuuucaaaugagggagccucuucuagcuguaaaaucuuagauuuugauucuuuuguuuguuucaaacaauugacaagaguuucuagaaauguuuuuccuuuugcagugcucguuacaugaaagaucuuuuuccucuucaccaggcaguugcaguggugcagaauggcugaccucagucuugcagaugcauuaacagaaccaucuccagacauugagggagagauaaagcgggacuucauugccacacuagaggcagaggccuuugaugauguugugggagaaacuguuggaaaaacagacuauauuccucuccuggauguugaugagaaaaccgggaacucagagucaaagaagaaaccgugcucagaaacuagccagauugaagguaaguauuuaaaccagacugcuuauauauguucagaaagcagguuagggauuaugccuuugguauaaucuuggaaacugagaauugagcugaguuuuuuuaguguaggcuaguaacuuuauguuucuuuguuagauaccgaggagguagacuuaccacccuuugagugagcguucaugagucuguggaugacuuuuaacccuaauguuucuucucuaauguuucaacaaccauauaaucuucuucuuaauuuccuaaauuaaacugucuacugugccuuuucucugaaaguagcuuugaaaaguuaaauaaaauucugcgguuauaucagaacuucauuuagacuggaaucagaugccauuuguugucuuuggagucaucccaccucaggauuaaagcauaauuaaagccuuuaagagaaauuugccauuuuccuggaucagaugugcuaauaauuggcugaguauuuuuguaucuguguucaugagggaauuggucuguaguuuucucauaaugucuucuguccaguuuuagaauugaggucacgccgacuucauaaaaugaauugggaaguguucccuucuuucucuuuucuagaauaguuugcauagaauugauauuuuuucuucuuuucaguguuugauagaauucaucaauaaagcuaucugggccuggaauuuucugucggauuuuuaaacuaggaauuuaguuucuuucagagaucauagaacuauuccaguuaucuguuucuuaaguuagcuuugguaguuuguaucuuucaaggaauuccuuggucccuuuccuggcauaaauguugcagauuaauggagauaugcuuuuaaugucuguaggaucuauuauguccccuuuuucauuucuuauacuaguaauuugugauguuucuuucuuucuuucuuucuuucuuucuuugauaagucuagguagagguuuaucaauuguauugaaagauccagcuuuugguuucauuaauuuuuuucuauugucuuucuguuuuuaauuucuucucauaucuuuguuuuuuccuuucuucuguuuacuuaaguugauuuauucuuuuucugguuucuuaaggugacagcuuaaaucagguuuugaucugagacauuucuuuucuaauguaauuacuuaauguuauaaauuacccucuaaucaccauuuuagcugugucccauggauuuugauauguuguauuuuuauuuucauucauuuaaaaauauuuaaaaauauuuccuuugugaauuccucuuugugucugccuuuaagauuuuaucuuuuuuuuuuuuuuuuuuuagcaguuuaaauauguuguguuuagaugauauuuuggaaguuuucuucuugggcuuuucugagcuucuugaucugugcuuuugaagugguuaagucagcugggaaauuuuuggccauuaucuuuuaaaauauuucuucugccccauucuuuuucuuuucuccugggauuccaauuauauuuuuguuaaauuguuggauaguguccuguaucucuuggaugcauuguugguuuuuuucucucuuuauuucuguuuguguuuuacuuuggguacuuucuuuugaccuaucuuccaauucccugaucuuuucauaguuguguugaaucuaaugaugagcuuucaguggcauuaucuacuuuagcauuuuuuauguuuuuaauuucuagcauuucuguuugccucucuuauaagcuuccuuauuucugucaaaauuucccaucuguucaccuauguuuuccaccuuuucuacuguagacuuuaacauauuaaucauaguuguuuuaaaucucugugugauaauuugaaaaucugggucaucucucagucugauugcucugugugugugugugugugugugugugugugugugucuuaguuuuugauugaaugcuggaucucacauguaaaauaguaggcugaggccaaaagguguuaugguuggaaauaggcaugucucuuggguuuagucauuuuaacaggagcugagcuaguuuuggguuuugucauuaccguaauugccuucaguguacuacugucuucaaucccuuuaauucuaugcuuagaguggggacugaggcccuggaagguauuucuuuaaugugcuugcuccacucuuucagccuucccuguguacccgugccucagagggguccuuguccaugcucuuuucucucuuaucggaagaguucuagccagguggcaggcagaguuuguuuuuuuauugucccauuuugugcuuaauccugugcuuaaucucacgguuugggucuuucucaacguuauuauccuuuucacaguaguagcgucuucucaugguauugguguaggauccuggaugaggaguuuuucuugcuccucucucagguuuauaaaguauguuucuauuacucuuucccuagcuacagccggucuucuugugugcucugggguugacaggguuuguacuccuuccccaggagagaaagaucccagugggagggguucaugcuuuucccuuaauggugguggccuucuccaggucuguaccauggagggaggcucugucuggucccucacccugcuuccaaucuuuccugugagcaugcggcagacaucugugaagacaauccugcaaaugagugugaauucccuuugugucuguggauuugaggggccccauagucucaugcuagccuucauuuaccuuugacaaaucacuacaauuuuuacuugaauuuuucuuaccugcuuguaggguacccaaugucucuucugcacaugcucugauacaggagagcugguguucaccucccauauuuccuggaggggcuuguuuuucuuuggauuucauacuacuagguggcuuuccaauuaauucaaguuuuuuguaguugauauggcuguuucuuguuguuagggugggagugacguugcuuuuggcuuucuacagccaaguggaagaagaaaaccugcuuccuuaauauauguuuaauuuguguguuggggagggggggcagaccacaacucauuuaaaaaaguaccgagaguucuaauuauauccauauaaauauuuacuccagaccaggugcaguggcucacgccuguaaucccagcacuuugggagaccaaggcagguggcucaccugaggucaggaguuugagaccagccuggccaacauggugaaaccauaccucuacuaaaaauacaaaaauuagccagggguaauggugugcaccuguaaucccagguacucaggaggcugagguacaagaaucacuugaaccugggaggcggagguggcagugaguggagagcgugccacugcacuccagccugggcgagagaacgagacucugucucaaaaaaaaaaaaaaaaaagaaaagaaaaaaaguugcuaucauugcuuacaaaaguaucuugauguugcaaaagcuuauguugagaaguaaaguucauauuuuauuuuuauccuuuaauucaauuuuccagaaacucauacauuuuuugaacaggcuaaaaaauacacauguacaaaauccaauugguccaaagggauguacgguaaaacaaauucucccaaucccuacacccuagccagacaguucuccuuccuggaguaaccacucgccaauuucuggaguagucuuucugaguuaaugaacuuuuuuuuuuuuuuuuugagauggagucccgcucuauugcacaggcuggagugcaguggcacgaucucugcucacugcauccuccgccucccagguucaagcgauccuccugccucaacaccccaguagcugggauuacaggccugcaccaccaugccuggcuaauuuuuguauuuuuaguagagaugggguuucgcccuguuggccaggcuggucucaaacuccugaccucaggugauccacuugccuuggccucccaaagugcugggauuacaggcaugagccaccauuuacauaucaaaaguagcagggaggauuuaauuuuuuauaaauaaaauaaugucuuaaaaacuuuccuccucuugggccaaguuaauguuacauggaucaaauaacucaagaugaagcacaagaaaaucuacugcuaccaccucacuguccuuauccaccuaggcucauucccagaugauggaaacaaugcacaguuaaaggaaauuagaaaacgaaaagcagcuagcuucuuucaccuaugacugaugaggguaaguuaauauuaggaugggaagagcaucucaaccaugacuaguugcuaccauauuuacaucuuaucauuccuuucuucauacuagguuuucuuuguuuauguuagucagucaaagaacaaaugucuccaccgugcauuauggauuaagagagaauagauuuucccguuuuccauuaaggaauccaaauuuuuuggaguaaauauuuguuuuucuuuugugcugggauuauaggugugagccacugugccuggcuuuuuuacauuauuaaaugaagaaaaaugaagaaaugaagaaaaauggaugcccuuuaaaguuuuuuuugguuuaaguuuuuaauuuuuuguugcuaccaaagauuuuuuuaaagauuaggaaacaaaaaagaaggaaccaaaucaggacuguuguaaggugguugccuaaugauuucucaucaaaacugucacaaauuaucuuuguugaugaaaggaaugaacaggagcauuguccugguggagaaggacucucugaugaagcuuuccuggcuguuuuucugcuaaagcauuggcugacuuucucaaaacacccucauaauaagauguugucauucuuuggcucuccagaaagucaacagacaaagugcuuugagcauccuaaaaaacucuuguguuugcucuugacugauccacuuuugcuuugacuacagcacuuacgccucuugguagccauugcuuugauugugcuuugucuuuaggauuauacugguaaaaccauauuucaucuccuguuacaauucuucaaagaaaugcuucaggaucuugaucccacuuguuuaaaauuuacaucgaaagcucugcucuuugcagcucaucuggaugcaaccauuuuggcaccaguugaguggaaaguuugcucaauuuuaauuuaucagccaaaauuguauaaacugaaccaauugagaugucugugguauuggcuauuguuucugcuaauugucaauccucuucaauuagaucauucuuuuuuccucucaaauugauauugguggucugccacggugggcuucaucuucaacaucaucuccuccuuuauuuuuuuucuuuuuuugagacagagucuuacuacauugcccaaauuagaguauagugacuauuuacagguguaaccauagcacacuacagccuugaacuccugggcucaagugauccuccugucucagccuuccaaguagcugggacuauaggugcggaccacugcaucuggcugaugucuuaaaacaaguuauucauguguaaacuacugauuuguuuggggcauuguccccauaaacuuuacacaaagcaucagugauuucaccauucuuucauccaagcuucaccauaaauuuaccauuugcuuuugcuucaauuuuagcagaauucauguugcuuuauuaggggcucuuuucaaacugauguuuuauccuuuuuagugcuucaaacuagauccuguucagacguguuauaacaaguuaguaugagcuuuuuuuuuuuuuuuuuaagauggagugucucucugucacccaggcuggagugcgguggcacagucucggcucacugcaaccucuaccuccuguguucaagagauucuccugccucagccuccugaguagcugggcuuauaggcacaugcuaccaugcccagcuaauuuuuguauuuuuaguagagaugggguuucgccauauuggucaggcuggaguaugaguuauuuugauacaaaaaaacucccuugaaauccaugaauaauuuuuucauagaaugcauuuuccacgaacuuguugaagauaccauguuuaaaguuuauaauuauagcugggcgugguagugugcgccuguaguccgagcuacacaggaagcugagguaggaggcaaucacuugagccccagaggucgaggcugcagugagccauaaaagcaccacugugcugcagccugggugacagagagagaccccgucucuaaaaauaauaauaauaauaaaguuuauaauuaugauagguuguaaauuacuacauuuuuuccauaccagcuuccuaaaaguuguagaagucuuaacuuaaaggaaggggugauggcuguuuggagacaucaaauaagaaaaacgaaggaagccgccuuauuuagucuuguagaaaucuggugcaauuagugaguucuuuaugaauggagacuucucugcugugggucugauuuuuauacauuaucggacugaugguuuuugccauaaugacagguuucauauuuguguuuuuccuggagaacauucuaaacaagauguucuucugaauacaucuuuagaagugauggaagggcccuagacuucauuaauguuuuauuauacaucuaacuuuaaguuugauuuuguucuuagaugagguucaguaaacuacugcugauugcugacacuuuuuuuuuuuuugaagacagggucuuacugggcgcggugguucacgccuauaaucccagcacuuugggaggcugaggcggguggaucaccugaggucaggaguucgagaccagccuggcuaacauggugaaacccugucucuacuaaaaacacaaaaaaauuagcugggcgugguggugggcaccuguaaucccagcuacucaggaggcugaggcaagaguaaucacuugaacccgggaggcagagguugccgugagccgagaucgugccauuguugcacuccagccugggcaacaagagcgaaauuccgucucaaaaaaaaaaaagaaaagacagauucuuuccaugucaccuaggcuggagugcaguggcacaaucauagcuuacugcaacaucuaacguaacuccugggcucaaacguuccuccugccucaggcuccugaauagcuuggacuacaggugcgcgugccuugcuuauccuuuuauuuuuauagcgacagucagacuguguuccucuggcuggucuggaacucauggccucaagcgauccuccugccuuagccucccaaagcacugggauuacaggugugagccaccacacccagccuagugcucucgauauguucuuacaacaggcuuaguuaggccaaccaguggaaguuuaucaaccauuuucuugccucuagauauagaagggacgguugaguagguuacacauaauagaacucuuugaacaaugguguuuuauuuccuuuaauucuuacauguccacccuaauugucuucaacuuauaaaaugagaaguaagaaagcaggguugcuuuuauggcauuuaugacaaaguaggaaaauugcuuuuuucucuaaguaugauuucugccuucaugccuggcaacacaagaaccccccgaccuuuauuccuuuucuuuggaucuacuauacucauuuccuuuugcacuucaacuuauucuugcuucuacaaguauuuuaucuuagcauugccuguguaaaccaucuaaauaccaauaccuagaaauaaaauuggugucaaacucuucuucuaaaaugccuaucaccuugggaaacaauucucaaauacuuuuucaggauauguguacuacuuguuuugcaccacggcuguaauaagaaaaaaauaaaaagaaaauuauguacuuccugacuuuuuuccuuaaaaaaugguguuuuccuuaauuguucauuaucagcauuauauggcccuauuuucuaggugagggagacaaaagauagaacccuuucucuuagaugugaaugacgaagcaaacaucugugacucuuguucuuucagaugaucaucuagcacaguauugacccucagacacaaauagcacauuuauggaacaagucacuuaauuuuucuguucucugugugauuaaauaguucuucuucugaagucgagaaaaugcuuucuccucaacauuccauaaggccuuugaagcuaaaagcuuauucccauagaauaagaaguuaacacagggcaauggccuggcuaaguuuuuugcauuuuuaguaaagacaaggucucacuguguugccuggacuggacugguuuugaacugcugggcucaagugauccuccugccuugacuucccauagugcugggauuacaggugggagacaccguacccugccacacaccagcagucuguuuuaacaagccauaauaggugacucggauacacaugcaugauugagaaacacuaauccauggaaaagggccuaagugacaacuauuaauagauacugcagaauuucuccuuaauacacugguauuucuuuugcagaaaauugcaaccagcuuaauuggccaguagagggcaguguuggcaugggucugacagcaccagaggguucccuugcauugagaccuggcuguuuugcccaaggcugacucacagcacacaugccuucucagguucuugcuacuucucugccaagcugauuugccugcugugggaaucugacaucuccuggggagagggaaucaacaaaauaaaguaaauuugaauaucuuuauaucucagagaaugugauuaguuucuaaaaaaaaaaagugugcuauuuucgaugcuguguguauuucacugagaaaguuuucauuucaugaaauggggguucucuggggaagucagucagugagaaaacacauuauagcaucuuuugaauuaggacuuuuccaguaaugugcaguaugauuaggguccaguaugucuuaucuggcagggaaauauacaagccuuuuuucuacuugucaaccuuauuguuuuuaguguuguuacguuguuuuuauucucuccugggcuuauauuuuuagauugugagguguuguauguauaguagaauccagcuucucuucuuccuuucuaaccucuucuugcuuucauuuuauuuuauucuaguaaaguuucuugaucagccuacaguuauucuauaggugguugauagauaaauuuacaguuggucaacauauaguuaauaacagugagaauaacaauagcuaauaacagugagaauaacaauuacuauuuagcacuguacaguugacauccuguauuacugcauuuagucccacuucccaggugaagcuuaaguauuagaaaugagaagguugcauuugaucauuuaguuaauaaugacagcacaaccugaacccagaucuucuaaucucacuuuuauuuuuauuaaacaauuaaaacaauauuuuuuaaauagagauguggucuugcuauauugcccagguuggucucaaacuccuggccucaagcagcccuuccgccuaggccucccaaagugcugggauuacagacaugagcuacuggaucuucucauuuuaaaccccuguucuggcugggcaugguggcucaugccuguaauccccagcacuuugagaggcugaagcaggcagaucacgaagucaggaguucgagaccagccugaucaacauggugaaaucucaucucuacuaaaaauacaaaaaauuagccaggcgugguggugcucaccaguaaucccagcuacucagggggcuggggcaagagagucuugaacccagaagguggagguugcagugagccaagaucgugccacugcauucaagccugggcgacagcgagacuccgucucaaaaaauaaauaaauaaaauaaaccccuguucuuucugugaaacuauaccuuuuucaugaacacauacuuucuacuugaucuaguaucucacugauaguuuuuaaaaacuaaaaauccauuuuuuaaauucaaauagaauuauuagauguauguucaggaaauguaaaagaaucuugcuucauuucaauacagagcacaaacugagggacucugccacuaauucacaugaguuuguaaaauauuucacuuuccuagacaacuguuucacaucuacucucugaaacuucuggcacuugcucuccuguucauauucauaagucauauucauaaauuaauuggcuuaaucagaacagaacuuccacauggucccaccacauauuuccuccucaccuauguucaucuaugcccuuauugucugcucuuuuucuguuaugggugaacuguucaugcugucacucaggccacugcugucacaguuaccucuucugucuccugcaucaucaguucuuuucuuucaauugggucauucaccagcaucaaacauacuauaauuuuuuuaucauuaaaaaaaaaauccugucugaaucucacauccaucucaucuaucuuuuugcuuugcuuucuuuuuuuuuuuuuuugagacggagucuugcuaugucacccaggcuggagugcaguggcgcgaucuuggcucacugcaagcuccgccucccggguucacgccauucuccugccucagccuccugaguagcugggacuacaggcgugugccgccacgcccggcuaauuuuuuguauuuuuaguagagacgggguuucaccguguuagccaggauggucucaaucuccugaccucgugauccgcccaccguagccucccaaagugcugggauuacaggcgugagccaccgugcccggccugccuucuuuuaaagagacguuucuacuaccugucaccaauuccuuuccuuccauuuccucuugaauucacucucaucagacuuuaacauaugcaugaccccaaaacuucucuuaccuaaaguauaaggccuugauguugccaaggacaaauccaguauuacuccagggguuuugccugagcaacugaaaggaaagaauugccaucaucugagauggggaaagcuacagaaggaguaggauuugaagggaagagaagaaauuuagcuugggauauguucacauuuaguuaccugcuagucaucgaaauggagaagauggauacacagauaaggaguccggaguuuggaggacgguucugggcuggagguugauguuauauaaagcuuuugcuagaguuguuguucuaaaauccuuuaagauuggauuuagauguaacuuuccagaacauucccugacuucuguucccuuucccuucuagaccucccacuacccccacacccugccagccuuucuuuucaucuuccucuugguaagugcuuuucuucccugaacuuuccucuuuccucugugguacuuguaagaucauaauuaagcuauuuguuaucuuacacuuauuaacaugcucuagcacaggaauaauauuuuguuuacugccauauuucauggagaaugacacauuuagcgaaagcaggauggcacagcauaaucaaaguuuacuagcgaccucaaguuucucaggguuaagaaaucaaagguuacagugacaagugaccggagagaaucauggagaagcagaucaagugaaauuaugaagaaucucaugguuugugagaaacugagggcgcagggguacugagaaaccuggccagaucugcauuagagaccacugcucuuggcacaugauagauguguaaucauugcuuauuacacugaauugaaaugguuuuuguuugucaguuuauucagguuuggguuguguuaauguacagacuaacaaacaauugugucuccaaaaugguagauauuuauuuaggguagguguacuuggucuaauccuaaacccucuuaauagucucaugaucauauuuagggaaguuuauauauaugcauaaaaaauuagugugacauuuuugcaaaaauaguuauuuucugacuuugauuugaaaacagacuuuuaucucauaacuaauaguucuuuuuggggaaaaaaaauaucguaccaaaauguauaguucauaauaauaguacccuagucugaaagaagagcaggggaccgggacccgggggcucaagccuguaaucucagcacuugggaggccgaggcagauggaucaccugaggucaggaguuugagaccagccuggccaacauggcaaaaccccgccucuacuaaaaauacaaaaauuagccaggugugguggcaugcgccuguaaucccggcugcucaggaggcugagaaacgagaauugcuugaacccaggagguggagguugcagugagcugagauugugccacugcacuccagccugggcgacagagugacuccaucucaaaaaaaauacaaaaaaaccccccaaaaaacaaaaaacaaagcaacaaaaaaaccacuucauugcuaaaaauauucugcaagcaagccaggauggugguauguaccuguagcccugcccgagcuacuuaauaggaaggaggauugcuuaagccuaggaguuugaguccagccuggguaacauagcaagaccccaaagaccccaccucuuaaauaauauucugcaagcaaaugacuuuguuaaacuucacacugcaagaacagagccaagaaccuaccauguacccuuuacuuggauuuaucauuacuguuuugcacauuugcuuuaucauucuuguuauauuuacauauaguuccuuccccuuggauuauuugagaacaaacugcagaacucacaccucuuuccccgaagaacuaggcauuagcacauuacaagaauacgaugauagagaucagaaguuaaaugcugaugagauauuccugucuaauccacgaaccuuauuucauugucaucaguugucccaacagauucaacacauuccuuucucauuuuuuucuucuugucugcaauuaaaucuggaaucacguuaguuuucaugucucuucagucuucuuuaauuggaacaguuccucaacucuucuuugucuuucaugaccuuaauauuuugaauaguaugggcaaguuauuuuuuagaaguccccuaauuuggguuugccuggcauuuccucauaauuagauucaaguuccacauuuuuggcaguaguacuauguaaauaugauguguccuaagugcaccacaucaggaagcacaugaugucacuaaaucacauuauuggugauaauaacuuucaucacuuguuagugucugccuguuuucuuuacuguaauuuuuuuccaauuaaaaaaaagcauuuauuuauuuagagacagggccuuacucugucacccuagcuggagugcaguggcacaaucuuggcucccugcagccuugaccuccccaggcucaagcagucuuccagccucagccucccaaguagcugggacugcaggcaugcaccaccaugccugguuaauuuuuuuuuuugacaaagucuugcucuguugcccagacuggagugcaguggcaccaucuuggcucacugcaaccuccgccucccagguucaggugauccuccugccucagccucccgaguagcugggauuacaggcaugcaccaccaugccuggcuaauuuuuguauuuuugguagagaugggguuucaccacguuggccaggcuggucucaaacuccugaccucaggugauucacccaccucugccucccaaagugcugggauuacaggcaugagccaccccccagccuaauuuuuauuuuuauuuuuuaauuuuuuuuaagacggggucucacuuugucucccagucuggagggcaguggcaugaucucggcucacugcaaccuccgccuucuggguucaagugauucuccugccucagccuccugaguagcugggauuacaggugcgugccaccacaccuggcuaauuuuuguaucuuuauuagagacagguuuucaccauauuggccaggcuagucucgaacuccugaccucaugugaucugccugccucggucucccaaagugcugagccaccaccccuggccaccugguuaauuuguguauuuuuuuuuuuuuaauagagacaggguuuugugauguuacccaggcuggucuugaacuccugggcucaagccaucugcucuccccacccucccaaagugcuaggauuacaggcaugagccaccacgcccagccucuuuacuguaaaauuuauauuuuucuccuuguaaugaauaaguaauuugugaggagauauuuugaggcuauguauguauccuguaucuaauccaacuuucaccuacuauuuuaguaucuaagcaaauagcuuuugaauaauuuucugguuuccaagccaguugaaauguguucugcugcaucuuauaugaaagucacauuuuaugaaucagaaauucccuuuugcacauuuuaggucaaaaauaccagggaggccgggcauggugacucacacuuguaauccuagcucuuugggaggcagaggcgggaagaguacuugaagccaggaguuugauaccagccccagcaacacagcaagacugcaucucuacaaagaaaaaaaaaauaaaaaauuaacuggguguggugguagucuuaacuacucaggaggcugaggcaggaggaaaggcagggagaaaguaaacagauaugugcaaaugagacuuccauuaugcauauuauucgcaauuaaaucucauuauuuaugcccuucacuggaaaaaaaaauuaccuuuaauugcacagaucauuuauaaaaagacuguuggaguuaugcuccaaagcccacaaugacagagauagugugucagagggacacaggagucaacugaaagaguucccaauagccaacacuggaaaaauuugagcaacaaaauaaauaaaguagcauugaauuaaagcucaguggacgaggcugaucaugguggcucacgccuguagucccagcuacuugggagacugaggcaggaguaccacuugagcccaggaguuugagaccagccugagcaacuuagugagacccugucuuuauacaaauagaauugucugggcgugguggcucacuccuguaaucccagcacuuugggaggccgaagcagguggaucaccugaggucaggaguuagagaccagccuggccaacacggugaaauccuguuucuacuaaaaauacaaaaaauuagccgggcaugguggcacaugccuguagccccagcuacucaggaggcugaggcaugagaaucgcuugaaccugggaggcagagguugcagugagcugagauugugccacugcacuccagccugggugacagagggagacucagucucaaauuaaauaaauaaauaaauaaauaaauaagccaacuguggcggugcacaccuguugucaccauauacuugggaggcugagggaggaggaucauuugaacccagcauuuugagguuacagugaggugugauuauaccacugcauuccagccugggcaacagagcaaaacccucucucuuaaaaauuaagucaaaaucuuugccgggugccauggcucaugccuguaauucuaucacuuugggaggcugaggcaggcagaucacuugaggucgggaguuugacaucagccuggccaauauggugaaaaccugucucuaaugaagauaaaaaaauuagcugagagugguggcgcacgccuguagucccagcuaccagcuacuugggauguugagacaggagaauugcuugaacccgggagacagagguugcagugagccaagauugcgccacugcacuccagucuuggcgauagagcuagacucugucucaaacaaaaaacaaagaaaacucccuucauuuucauguaaucuuauuuauuuccucaagaaggguagaucuuuuaagacuuuauucuuugcaguuacaaacauacaauaaaaaauuuaguggcuuuacuuucauuugauuccauuuuacaaauggaaucaaaucguaugaauuuuaacuugcuuuuuuuaguuuauuaucuuagaaaacuuucugucaguauauaucaagcuuucuuuuuaacuuggucuaaaguaguggucuuaacuuuuggucacauacucagaauucugauaaauucugucucuuuguacauuaaguuuacaucuaaaauuuuguagcaaaaguuuaguuguaaaacauguaauuuugagaauguuuuacuuuugccacauaaaaauaaguuaccucauucugcuaaauguauccaaaugcuucuaaauauauagcauuuugguuuccaucaucuaguuuaaaaauauacgaacaagcuguucuuuaucauuggaaauuuaaauucuucuuuugaguccuugaacuuuuauuuccauaacaugucucagacuuuuauccuaauguaauauauuuuuaugcuuaaaaguuuuuucuugauugugcuaauauguuucugcuacuaaauauguauguaaacuuaaauuuuaauuuuuaaaguuccugugacaaagguucuguguuuuaacuugguccagaggaaauuuaucagucuauugcauguauuauguuuuuuuuaaaucucccuucauuuucacuuaauccuauuuguuuccucaagaagaguagagaugggcuuuacuguguugaccaggcuggucucgaauuccuggccucaagugaucugcucaccuuggcuucccaaauugcugggauuacaggcaugagccacugugcccggccaacauagguuguaauuuuugauguuauuacuauacaaguugaauuuuauuggaaaugcuuuucuuaugagaugauggggucuguuauuuuucucaauuaaaucaugggucuguggaucaauauuucuuucucugaugaaauaggauuggcaauuuuuccuguuuuuguagcuaucauagugaagaaacccuaaucacauagguaaauauaugggaauaaagcuuuuuuuuuuuuuugggagauggagucuugcucugucgcccagacuggagugcaguggcacgaucucagcucacugcaaccucugccucccagguucaagcuauucuugugcuucagccucuagaguaguugugauucacacgccacuaugccuggcuaauuuuuuguauuuuaguagauaugggguuucaccgcauuggccaggcaggucucgaacuccugaccucaagugauccaccugccucagccucccaaagugcugggauuauaggcuugagccacugcaccuggccagguucuuuuuuauuauuauuauuuuuuauuacgagauaaggacuauaggcgugugccaccacacccagcuaauuuauuuauuuauuuauuuauuuuuagagauggggucacacuauguugcccaggcuggucucaaauuccuggacucaagacaccccucugccuuagccucccuaauagcugggacuauaggcauacccuagggugucuuggccuuuaucuauauuuagcuauuagauaccuguuaucuuccuguaucgguaacacgaagugcucucauuucuuuuauuacuguguacuauuuuacaauauuauaaucuguugguggacauuuguuguuuuuaagcagugccaucauaaacauucuguuuauauucacuuuuuuauacuuuuaugucucuuuuugaacuaaauaccuaaaacugauuguugaguugaguauugcagaauuugauaggcugccaaauugucucauaaaaagguuauuccuauuuacauucccccaaaugauguaaugaaauuacccuugucaaugcugguuaucaaauuuuaaaagguuuuaucacuguaauagcugcucuuauaccacucgcuggauaucaguuuuuguaauuuccauuuucuuauaauaugcauucuuuaaugaagcaaguuuuuaaaaauaugcauucuuucuugagcgaggaagaauaaaucuuauaagcuuauugugugaaugugaaagggaauuuacuuaugccaaaugugggauggagcauauuuauggcaucucucuggauaaguaaaaugcaguuugugaagacuuagcaggguauauguuacauagcggcuauuuaauagaauucuguugucuuuccuuccuuauuucuuucuuuuauuuaaauuauauucugguuuuggacugccuuguucuuuuagauuguucucuuuggcuguuccucuuaaguaacagaaugaaugaucuuuucaacaagaagcuugugugaaagauuucugccuuguauuuaugaggacuaagggguuggacagcauguuuguggucuuccaaaguaaaaucuugcauuuuuuauuuuaguagcauauauuguagauauucacuuauugucuuaggaauaauaucucugaauucuucggucagcaaggugacugcagagcuaggcugguugcuaaaauguuagauauagucagagacuuucagaaaaaguuguacauccccaaauugaucuauauagucaauccccaaauugaucuauauagucuuauaugcaauugcauauaagaucccaucaagaauuuuaguauaaaucaaaaacugauucuaaaauuuauauggaaaagcaaagaaacaaaacaaggccaggcgcagugacucacaccuguaauaccaacacuuugggaggccaaggugggaggauugcuugaggucaggaguuugagagcagucugggaaacauagggagaccccguuuuuccaaaaaauaauaauaaugaaaaauuaggcaggcgugguagcaugcaccuguggucccagcuacuugggaggcugaggcgggaggauugcuugagccugagcagucgaggcuccagugagccacgauugcacuacugcacuccagccugagugacagaaugagacccugucucgaaaaaacaaaacaaaacaaacaaaaacauuuuuggaaaagacucaaguuggagggcucauauuaccuuauuuaagacuuauggcugggcacaguggcucaugccuguaaucccagcacuuugggaggccgaagcaggcggaucaccugaggucaagaguuugagaccagcuuggccaacauagugaaaccucgucucuacuaaaaauacaaaaaaaaauuagcuggacgugguggcacgugccuguagucccagcuacuuggggaggcugagccuggagaaucucuugaacccaggagguggagguugcagagcgucaagauugcgccacugcacuccagccugggcgacagagagagacucccugucaagaagacuuacuguacaaauacaguaaucaagacaggaugguauuggcaaaauggauagccuuacaaauugauggaacauaacagcccagaaauaaacccaauguaauauggucaguugauuuuuuuacaaaggugcaaaggcaauucaauagaaugcagaugacuuuuuccacaaaugacucuguaauaauuaccuaauuaccuaauuauuaggugauuagguaacuaccuaaucaccuaauuauuagguacaggaauagaaacuuaggaauguacaggaauagaaacuuagacccacaucauuacaccauauacaaaauuuaacucaaaauguaccguaggccucaauaugaaauguaaauaugaaaacuauaagacuucuagaagaaaacauggggaaaaaaauccugugaccuacuucauaaaaauuaaaaacuauuugaaaggcacaguuaaguaaaugaaaauacaguauaaguuagaaacagggaagaaauuuuuacaaaauuuaucugauaaaggagugauauuuggaauacauaaagaauuuucaaaacucaauaauaagaaaauaaacaguucaguuuuaaaauagucaaaaaauuugaccauucaagucaccaaagaagacaaagggauggcagagaaacacaugaaaagaugcucaacauccuuagucauuagggaauaagauacaacuaauuuccuuaaaaaaaaaaaaaagagggaaaaaaaaaaaggaguccucugcuuccagaaauacagcugguuaccuccaugcaaucuucauccagaagcaaugaugguacccuggauuuccugugugggaauuaauaaguaauuaauaaauggccuccgcugggcaugguggcucacaucuguaaucucagcacuuugggaggccaaggcggugaaucaccugaggucaggaguuugagcccgccuggccaacauggugaaaucccauuucuacuaaaaauacaaaaauuagcuggucaugggggcgggugccugcaaucccaacuacucgggaggcugaggcaggagaaucacucgaacccagaaggcggagguugcagugagccgagguugcaccauggcacuccagucugggugacaagagcaaaaccccaucucaaaaauaauaauaauaauaaaacaaaugcccucguguucuuggagcguuugauuuggauuugaauugcugauaccaaaccuguguugcuccaugaugguuuuacugaauuuaaugguaaucuuugauaauuuacagaaugaaaaagauuuagacuugcuauuaugaggggcucuccuauggaacugguacuuuacagagcuugggugcccuaggaauuaaugauucuguucaguucuguuucuggguuuccuuuuguuaaauguuuaaauuuugaacaguuuuuaauugcuuuaaccuaaugcuacaaagagugagaaaaacuccauuaauaagacagugguuggaucuguuuuucauuuuucugucugucacaauggguaauuauuugucauuguugcagauacuccaucuucuaaaccaacacuccuagccaaugguggucauggaguagaagggagcgauacuacagguaagugauucccaggauuccccaaauguguaggugaugcacuuacaaugaacaccuugauaaucuccuuugaagagcauuauuaauggaagcauaugaauuauuucugagggugguaguguucuuguuggagguauuuaaacccaggacauugccauguaaaaucuccaacaauggaaggagaauaaugaguuugcuuugauauuuuuugaauauuuauuggagcuguaccacacaagaacuggaucaaccuuaaaauacuuuuguagaugcagaauaaugaucaccaaaauauguuacaugggaggaauuuggccacuacaacucuuaaaacagcaggucuguucccugaaucacauugcguuuagcuuucuacaguucaauguuaggaagccagugaacaacaaauuaggaguuauuuauuuugcccccaguguguuuccuuuaucuuucccuuaacuguugcuuuugaaauuuacuucuaauuaaacucuuagcucuuuacuaggguuuugauauucuuucaguuagcauugaguuucuguggguuccugucucauaaccagcaccaacccccugccccaaugucuuuguagugagcaaaauucucaaagcaguagcaggagucccagggauauacuauauaaauauuuucuuaaguagcugaugugagaguugcguguuuuauuuucauaaauaccugcauuuacuuugcaguugugaucaggccaacacugcuaacccaaaugaguugacuucuaaugaucaaucccauuguuuccugcaagugugcucuuaacugggccauacauuugauucauauuauugcaguggagguaguuacuagauuugucauauuucuguauuucucuuauaugcauaccucagcuaugagaagcccuucugugaggcaccacaguauuucucuuuuucuaaggcuuccagaaagccuucuguuagcaauagcagcuauucuaggauuuauucuuuauucuaugaccauaggaaaguuguauauaucuuuauacaucagauuuuuugaugaccaaguucuuuuuguugugaauguuuaccaagugacauauacauccuuauuagcaacuuaauaaauuaggaacucuuuacuuuagaagcuagaaacaaccagaaaugccacuuuaucuuccaguuuugugaauugauguuuuuguauuucuuugauaaucucagucaaauguaguauugacuuucugugucugcuuugaaagcagucaucuaugugaugugguuuuuaagaaaacauuuaugcaaauaucccugugauuaaaggagaaguuugaacaugaacuuuuaaaaaaugaguaaauucagcuuucuuuaagcaggaaccaguuaaccaggguaaggaaaggcuggaggggauugacuugauuaggcaguugaaagaguggaugccauuuucauccaggaaggaaacaacuacaaaaacgaguagauuucuucuccaguaggaagucaugccugaccagaagagacucaaacucuguguagcaggugcuuaccgcugccaggccuuaguaguacagaauagaaggguaaaaacuguauccuggcccucacuguuucaggauucccuugugacaaaaaagaaccuggcucuuuaugaacuacccaguggcauuaugagaguaggucguucuguucuuggauaccucucugcccuuagguagcauauaguuugcacaccuggauugaguuuugaauugaaccacuuaacuguauuaaaauagauacuaggccgggcgcgguggcucacgccuguaaucccagcacuuugggagaccgaggcgggcggaucaccugagguugggaguuugagaccagccuagccaauauggugaaaccccaucucugcuaaaaauacaaaaauuagcuggacgugguggcacgugccuguagucccagcuacuugggaggcugaggcagaagaaucgcuugaacccaggaggcggagguuucagugagccgagaucgcaccacugcacuccagccuggucaacagagcaagacuccgucucaaaaaaaaaaaaaaagauacuuuacugaaaauaugcauguuuuauuuggggagggaagguggagggaggggauggcagugcauguuuuuggagcauguggugacuucauucuaauuuggccaucacuaccuggagcaucuaacucaaugccauuuugaaaauucccauuucuguuuccuucagaauguuaucuauagucccgagagcaaaccagcuucauuaauagcuuugguuuaugagcaucuugugauauugaacuugcuguuuacuaaugaccugugcuuuuccacccuuuucuuccccuuccuacuucuuccucccucucuauuuuucuccuccuagaagccuagcgugucucucaacacuggggcugcugcaacaccagaccagugaucuuuccuaagcaucguuauacuucuaaaaccuucagcauuuugcagagcuuugcuuuucauuccuggacaugauguagaagaaacugaggguaguucuucggggccuauuucugcugaugccugagcaaacaaccugcuuccucuugugcucugcaggguuugauggagccucauuucccuuugugaacacaaagugcaaaaugaauucuuuuuaauuuuaguaauuuuuacaaagguuaucuaaugucuuuuauuucuuguuuucuuuaugauuuuaucauuugauucauucucacauuuuuuuccuuuaaauauuuuuaguugaccuuuuuccuuugguuuucaaauguucaacaugaaucagaauaguguaacaccaaaugagaacauguguuuucauaaagggguugaggccaccaguacugcagcgaauuuccuuuucuucucccuccuccuuccuucucugagcuugcuuuuagggaagguuaaucuuacaggcuaccuauguuucucuccaccuuacuaaaaucuaaauaaugauagauauuuuaaguuuuuaaauugaguaguucugaguaauccuagaauauuuuuccaaauuaaauaauccuuuauuauuugcaaguugggccaaauuuuuuuuuuuuuggagacggacucuuaacaaucuaagauuguuucaacaggacuuucuuauucccauuccuaauuuuuucaaacuaauugcuuaaaucuagaaccaguugagauuaguacuguacaaugguaugcuuugauuguauuuauagaaauauaacauaaaacauggaccauguuuugaaaucuuagaggaauucugguuuaaaaucugaaauacuuuaaaguuuucuauccuuuuacugauuaugcagcuucuuauaacccccaagguacagauuauuucagcuuaaaagaaauaauuggcaccauguucugagaaagauuuugagauauacauuguuuuuuguuuuugagacagggucucacucuugccuaggcuggagugcgguggcgcgaucuuggcuuacugcacccucugccucccagguucaagugguucuccugccucagccucccaaguagcugggauuauaggugugcgccaccacaccagcuaauuuuuguauuuuuaguagagacgggguuuuacuuuguuggccaggcuggucucgaacuccugaucucaagugauccacccgccuuggccacccaaagugcugggauuacaggugugagacacugugccuggccagauauacauuguuuuagauccccugauacagaacuacuuuugagaugguaagauuagaauaucaugaaaguuuaaacugaauccuugcagcgacuuccggaauuuaggaagcauucccucuucuacaggggucuggucacaagggcuggauucucugacaaaaauuucuucuauggauucuggacagaagacacuugagggugauauguuuuaaaggaaagagguuaugcuuaucuucuuagcaguugauaaaauauuaaaacucucuugccauagagaauacaccaucaaagaaaacacaacccuuucccuuugguguacaguuauuuauuaaguugauuuugggguuucuuucgccagggaucuuuucaaaacugguaguaguuauuuuuaaaaaucauguuugacaucuuucuauugcucguaaccagucccuguagcugucuaaguuauggguggagaagccuggguaugacuuuccguuguguacacucacacuucaugauugacauuuauuuauucuuuuauuuccauuugguuaugcuuauuuuuguuugaaauuuguuuuuuucaaauauguuuccuuuuugaacuuacagaauuguugaaauuuucuacuaacagccagcuaaaauuugguauauguuagcucuaucuguuucacuuggacguuucauuuugaaagaaagaaauuuuauguuucacauauaguuuuauacaaaguagccagucccauaaugaaaugcuguauugccauaguggucacacccaagugguccaguaucucaauggugaggcagccagacuggucagggcugcuuuguugaaaugugaugauuuucauaugccuucuuucucuuucucucucucuuuuuuuuuccuuuuuuggcccaauguugaagauguagaacuuuguuuuuaaauaauguuuuuauaauuucauucguauaccuaaguuuguauuuuuugugacuuuggacuucaacaguuuguauauugggacuucuaaugugauuacuguacuaaauaaauuccacuaauaaacaucuuacauuaacaccuuauggacuggauuugguuggggucauaauuguugaaauauaauguuacuaaaacacaaguuggguaaagacuugaggcccaaguucuaggucuaauauagcuucuaaucccacccggauuaauuguauggacuuuuaaguuuuugucaagcauuuucacuuaugaauuuuuuuuucuuuuuucuuuuuuuuuuuugagacggagucucgcucugucgcccaggcuggagugcaguggcaugaucucggcucauugcaagcuccgcuucccggguucacgccauucuccugccucagccuccugaguagcugggacuacaggcgcccgccaccacgcccagcuaauuuuuuguauuuuuaguagaggcgggguuucaccauguuagccaggauggucucgaucuccugaccucaugauccggccaccuuagccucccaaagugcugggauuacaggcgugagccaccgcgcccagcccacuuaugauuuuugauaguuauuguaaacucucuuuuauccagaauuauaaaaguuaagaaguucaaaugacuacugauauuuaaugucauuuggugagaaagucacuugacagaaaggugugaagaaguuauuccaaaaggagguuuccaugguauaucaauuguuguuagaugcuuucuaauacuacauuuauuaauuucuaacacuacauuuaguuuagugcaguuaaaauucacauucaaagucuuccuaaagugccuccugaauuaucagauaaaauuuacuacauucaguaacauuuaauuugauaacuuuguuauuugauaacccaguaugcaguaucugggaagaauucaacaaaaugcgcaguucccuagccauucuggguuaguguuuguuuacaguaggguugcaaguacaauauguugacugaauuaagacauuaaaaauauuuuauaucuaaguaauuugcauagcauaaggaacuuuuuaagcuuggcagacauuuuaguuaagaacacuuaauuuaauguuuuuagauuuccuuuuuauuaaaacagcucaguaaucuguucucagguuuaaagcacagauuuuaaauacuauaaggaauaauugaccauuaacuuucuuauacauacccuagguuuaaagcuuuugguaauugaagcaauucuugaauuuuguuauuguccucaucccugaugcgaagugaaaccuggcuucauuuggauucuuccuccuuauugacuugauaauauggugggaggcuagaggguguucuaggcaaagacacaggacugguccagcaggcacagaauguuaguuucauuccuaaaucauguguaauacuguauuauccucaauuuuauguugaugccguuuccauuacagugaagguuuaacaagacuuaacuacaaauuauuugugggauaaagcucugugcgaccauggagguaaauuacucuuauuuauaguguuuggggcuagacacauugcacuaagugcuguacaaauggcaguguuacugguuguuuccaucguaauuagaguagguaaacaguuuacuauugugauaacuguuugcauguguaaagucaugccagcagugaaacaguaaaucuacuuuuuuagaauaucaugacacagaagguauucugugugcuucaucacuaucucaucugguaggaugcaaaggauuuagcaucagaaaaaugcaaaagcaccaaaaaugugaaauauuaacagauaaauaaaucugugguguguuagaguuucugaacagcuauuggagccacgcuguaaauuggcaucauaacucacaaguggagcccagacauaagcugcacauuauguugcuauguauagacagcaagacauccauccgaacuccaccaaauuccuggaacaaaguuuuauuucuuuucuuucauuuuccaguuaaugaguugcaugcuggagacacaucagcaaauuaacagcacguaauguuucuuaaaguuuuuuugguucaugguuuucuaauaaaaauacagaauuucucuucagaaaaguccacauauacccauauacaagauguuacauuuacguuuagaguguuuaggacuccauugaaaccagcucauggacuacaauccuuuucuaagccaagcauuuaauuaauacucuaagccacguuauuucaguuucuuuuggggcuuuguauugaauaagacaaaauagcuucuucuugagcuuuaagugaaaauauaauucugauuuuuuuuuguuuguuuuuguuuuugagacgaaguuucgcccuuguugcccaggcuugaaugcaauggcacgaucuuaggucacugcaaccuccgucucccagguucgagcgauucuccugccucagccucccaaguugcuguagcugggauuacaggugcccgccaccaugcccagcuaauuuuuuguauuuuuaguacagauggaguuucaccauguuggccaggcuggucucgaacuccugaccucaggugauccaccugccucugccucccaaagugcugggauuguaggugugagccaccacgcccagccuucugauguuuuuuggguuuuuuuguucuuguuuuuugagauggaguuuugcucuuguuccccaggcuggagcgcagugcaauggcacaaucucagcucaccacaaccuccaccuccuggguucaagcaauucuccugccucagccucccaaguagcugggauuacaggcacacgccaccauaccuggcuaauuuuguauuuuuaguagagacgggguuucuccauguuggucaggcuggucucgaacucccaaccucaggugauccacccaccucggccucccaaagugcugggauuacaggcaugagccaccaugcccagcuuuuaaagacuuuuuaaaaaaccuaucuuaaguucuaguuacugagagaaaauccauauugaggcaagggcuuugcauguagguaguuuauuuugggaaguggccccagggcacaagagugggauacugggaaaagugaaauuagaggaaaagaauacagugaaguaugacuacugaccuagucacugcugugggcaaagugggcuuaagucuuuuggggucuuuugaggaccuguauagaaugccucucaguguucacuaccugaguaucuugguuauagaaguggauaacauuuauucaccauuuaccaucucucauugcuuaagacucuuuuuuuuuuuuuugagacagagucuugcucugucgcccaggcuggagugcaguggugcgaucucggcccacugcaagcucugccuccugggccuaacacucuuguacuucuggauuugcacauguguggugccaggaugcagaugucuugucucuuggugucagagaaguuguagggcagaaaacucugguuugguugauacaaagugcugucaaaucacaccuaugugcagcuggaugcuguagcaauagcuagaauaaauagugaacuuaacagagugugaggugggggcacaagaagugucuaaccaagagguuacuucaaagcaagauucucuuaacauaagauuugucugcuuaugccuuaccauagaggaugagauccuucaacucuguagaggaaauuugaaggaacuccaucuauuaugguacuaauccuuuuuuuuuuuucucuccccgcgccccgcgagacagaguuuugcucuuauugcccaggcuggagugcaauggcgugaucuuggcucacugcaaccucugccuccagggcuugugauucucuugccucagccucccgaguagcugggguuacaggcucccaccaccaugucuggcuaauuuuuguguuuuuaguagagaugggguuucagcauguuggccaggcuguucuugagcuccugaccucaggugauccacccauguucgccucccaaagugcugggauuacaggcgugagccacugcaccuagccaggugcuaauucuugagcugcauuguuagaaacuauagagauagccacagauguuaguuuuggaauuuuccacccaaacguuuuuuucuuuaguuaguuuuaguaguuuuuauguuucuagaaauuuguucauuucaucuagguuauauaauuuguuugccuacaguucuuaguauucccuuauaaaccuuuuuuauuccuguaagauucauagugauaucuccuuuucauuucugguuuuaguaguuugaauccucucuccuuuuuucuucauaaauguaguuaaaaguuugucaauuuuuuucaucuuuugaaagaaccaacuuucaguuuuggugaguuuucucuauuuucucuccucuguuuccuuuauuuccacuuuaaucuuuuuuauuuccuuccuucugccucauuugaguuuaguuugcuauuuuucuaguuucuuuugguagaagguuauguuagugauuggugauuuuuauuuuauuuuauucuuuuaauauagguguuuauggcuauaaauuucccucuuaccacuguuuuagcuguaccucuuaagauuugauauguuguguuuucauuuucauucaucugaaaguauuuucuaauuucuuuugggauuucuuugacguguugauuauuuaggaguguguuaauuucugcauauuugugcauuccccaaucuucuguuuacuuucuaauuucaucccauugugguuggagaacauaauugguauucuuucaaucccuuucaauauauggaggcuuguuuucuggccuaacauauggucuguccugaagaagaauguauauucggcucuugaugcggguggaauguucuguaagauguccauuagauguaguugguguauaguguuauauaggucuucucuuuccucguugguauucugucuuguuguucuauccauuagugaaagugagguauugcaguauccaacaauuauuauugaguagucuauuguuugcucaaguucuguuagcuuuaaauuuuacaugcuuuuuacauuucucaaggauaaauuccuugugaaaaaugcuacgguuguggauaagaaagauacacacaaaugaucgcuacaacuaugagccucagaagcagcaguugaaaugucggucgcugguaggacgauuuaaaguguuuuuuuguuuugaggcagggucuuacucugucacccaggcuggagugcaguggugugaucauagcagccuggaacucuggguucaaguaauccucccgccucaguuucccaaguagcuaggacuacaggugcacaccaccaugccuggcuaauuuuuaaaaucuuuuguagagacagggucuugcuuuuuugcacaggaugggcuugaacucuuugcuucaaguguucuucccaccucggccucccaaaguacugggauuacaggugugagucacugugcccggccuaaauguguauuuuauuuuauuauuuuugagaaggagucuugcuuuguugcacaggcuggaaugcaguggcaugaucuuggcucacugcagccuccaccuuccagguucaggugauucucuugccucacccugccgaguagccgagauuacaggcgccugccgccaugcccagcuaauuuuuguauuuucaguagaaacagcauuuuaccauguuggccaggcuggucucaaacuccugaccucagugaucugcccaucucagccucccaaaguguugggauugcaggcguaagccacugcacccagccuaaauguguuuuuuguuuuguuuuguuuuguuuuuugugacggagucucgcucugucgcccaggcuggagugcagugacccguucauggcucacugcaaccuccgccuccggguucaagcaauucuccugccucagccuuccaaguagaugggauuacaggcaugugccaccacgcccagcuaauuuuguauuuuuaguagagaugggguuucuccauguuggucaggcuggucucaaacuccugaccucaggucaucugcccgccucggccucccaaagugcugggauuacaggcaugagccacugcacccggcccuaaauguguuuuuaaaagaugauauuuuuuccucaaaaucugaacaauguuuuuugcagaaauagaaaaauccauucggaaucucaaggagcccuccugaauagacaaaacaaucuugaaaaagaacaaaguuggaagucucauuuguugauuuucaaaacuuacugaaaugcuauaauaaucaaaacugugugguauugacuuaaagggagacauauagaucaaggaacggaauggaaagcccagaaauaaacucuuuuauacaugguaagaugauuuuagacaacgguaccaggaccauucaaugggaaaggaugguguuuucaauaaaugaugaggggaaaacuggauauccacauaaaaaaguuggauccugcugggaacagugguuuaugccaauaaucccagcgcuuugggaggccaagugagaggauugcuugaggcaaggaguucaagaccagccuaggcacuauaggaagaccucaucucuuaaaagaaaaaaaaauuggccaggugcgguggcucacaccuguaaucccaacacuuugggagucccaggagggcagaucaugaggucaggagaucgagaccauccuggcuaacauggugaaaccccgucucuacuaaaaaauacaaaaaauuagccgggcaugguggcaggcgccuguagucccagcuacucaggaggcugaggcaggagaauggcaugaaccuaggaggcagagcuuacauaagccaagauugcgccacugcacuucagccugggcaacagagcaagacucugucucaaaaaaaaaaaaaaaaaaaaaaaaaaaaaaaaaaaaagguagugugggccuguagucccagcuacucaggaaacugaggcaggaggauccuuugagcugaggaguucaaggcugcagugagcuaugguaaaguacaccgcugcauucacccugggagacagagagaaauccugucucucccucucuuuuuuuuaaguugggaccauuaucuuauauucaaaaauuaacuuaaaauggaucaaagaccuaaacaaagcaccaaggcuauacauuucuuagaagaaaacauagagggaaaucuucaugacauuggauuuggcaguguuuucuuggauauacaccaaaaacacagacgacaaaagaaaaaacagauaaauuaggcuauaugaaaauugaaaauuuuugucuaucucuguagagugaaaaggcaacccauggaggcaaaauauuugcaaaucuuauaucuucucaggaguuaauauccagaauauguaaauaacuucuagagcucaacaaaaaaaaauuaaaaauaugggcaaaggacuugaagaaacauuucuucauaaaagauacaaaaauugccaagaaauacaugaaaagaugcucagcaucauuaaucauuagagaaaugcaaaucaaaaccacaaugaaauaucacuucauacucauuaggauggcuaguaugaaaacaagaacagaaauuaacaaguguuuacgaggauguggaaaaauuagaacccuuguguacugcugauaggaauguaaaaugaaagugcuauggaaaauaguaugguggcuccucaaaaaauuaaaaacagaauuauuguaagauccagcaacccaacuucuggauauaugcccaaaggaauuggaaucagggacuugaacagauauuuguacacucauguuuguagcagcauuauucacaguggccaaaagauggaagcaacccagaugucccaucaacacauggaaugaauaaacaaaaaugugguacauucauauaauggaacguuauuuagccuuaaaaaggaaggaaauucugauaugguacaacaugaauaaaccuugaagacacuaugcuaagugaaaaaagccagucacaaaaauacaaauuuauaugcgguaccuaaaguagucaaauuuacagaaacaaauauaaauauacuccauuuauauaaauuaccuuaaguagucaaauuuacagaaacaaaguagaauggugguucccaggggcugggagaggcggggaauggauguguuugguguugcuuaauggguacaaaguuucugauuugcaagaugaaaaaguucuggagauggaugguggugaugauugcacaacagugugaauguacuuaauaccacugaacuguacacuuaaaaaucguuaaaaucguagaaauaaacaaaugcagcucauauuuaaagggaaaaaaauuucaaauuaaccaucauaucacagaucucuucagaauuaaagggaugcuuuauauguuagguauuuuguacguuuguucugguuuguccaguugcagagagaaauacacaaauaugucaacauugcuuaaaugcuaagcaguuauggggaacauuuuguaagaacagauacaauauugguuaaauuccaugaggggguugagugagaacuaaggaaauuugaaauucgagcuugaaaucuccauuuggauguagaauugauaucucaaauuugaaauguucuaaacugaauucaugauugccccaccccaaaaucaaaacagagaagaaaaagaagaaaaaaaccaccugccuccccaucuccuuaaauggaaauucuguccugguuguuaaggcuaaacauuugguuucccuauccucuucugcuccucucacaccccacacccaguuugucagaaaaagauauuuggaaccugaccacaucucaccaccuccacugcucucucccugauuggaccaccaucauuaaccuuggcuacuguaauaacuucccaaauuagucucucugcuuccauuugcuugcucccugcagcauauucuuaaaaacaucuacagugguccuguacauugaucaugcuguucuuuugcacagaacccuccagugguugcccaucucaaaguaaaagccaaaguccuuaugaaauaccacaaggcccuaugaugucguugucaucuuucugaccagaucuuuucuuaguuaccccuuuacuuacuuugcuucaugguguucuugcuacuguuccuugaacaagccaggugggcaucugccuugagcucugagcacuagcaguuuucucugccuggaauguucuucccuuugauauauucaugauugacucuucacuuucucaaugaguacuucucgacuaucuuuuuaaaaauugcaccccuucuauuuuuucgucccacuguucuacuugaauuuucuucguggcuuuugucaugucacuuucuaauaauuuguauaguuuacuuaucucaucugccuuuccccaccagaagaagauauuauagaaacaaauuuuaugagagggacagggcuuuuguuuuggucacugcuguggcccagcaccuagaacacugucugguggauaguagauccucuguagcuauugaaugaauaaucuuuaauaucuauuuguuucuggccucacaugggaaaagaaacuuaaaaacaagaccagauacaaucguaauaauucuugccagguuauugguacgcaucuuucuggaaauauguuaucugucaugaauuuguuuaaauuuugaggaagcuguggauagagcaccuacuagcuuugauuucuuaggcaaguuguuugcccucuuugaggcuaagauuccugcuguguaaaaggagagcucuauaaaaauaguuguuugccugaagugacagaaauuauuuucagugcuuugaaaccucguugaagggguuaauauuuaaauguaagaugauauuagaaugaugauuaauguccacauagaaaguucuuacaguucaacccauuauauacuuuuguuaaaucauucuguuugaccaucagccccuuuuccuacuuaauugguuguguaacaguauuuuaaucggauguaacuggagcauauugguccauugugaagcagaaaugcucuguuucuagaggacaaaacuggaggugaaacuucaaaagugagcuccaggcagacugaaagaagaguuuuuuuguuuuguuucuugugaaaaaauuaacuuaggacucucacugcaaaaaacuggcaagccuggcccuccaguggguuuucagcaauuuaaaaugaaaugagaagaugcaaaacuaugucaacuguaaacuuaaguauuaacauuagacuccuuagaggucuucauugaaggauuuugcuuucuauuuaacaaauuaauauuucuggucuucaguuuuucuguguaaaacgaacaggcauucugcuguuucugcugcugcuguuagugcugagcaacagagauacaguauguucugcgguaggugauagcuuuuuagacauuuagagauuaacauuugccuucugauuuauuuucuuuggguuaaacaucuuucauuuuuucuuccacucuuuccuauuauguagauuuaugcuguuuuuaauggccaauauuuggaucagagucuauucaggagacagaagcuacaccauaaauugaacagagaauuuacuauagggguaaagagaacucuaaagaauacaggaaugacagauauagggaauagucacuacccuuagggcuggggcagaguacacaaagaaauaacaaauuuggaaaaguaugcgccccucccccacccugcccccaaagcugauugcauaucuuggaggaagucuccauuugguaguaaagauguuugcugaguugcugcaggucagggugauguggggcaaacaagcccccagacuggggcuuaacccaggaggguucuuggcuuugccaggaaagaauuuaagggugagccaguagugagagaaagaaacuuuuauugaaccagugcugcuucuugcugagcagggcuaacccauaggcagugugcccagaaucggugucugugagcugcuagcuagcuguuuauaucuguuauuaauuacaugcuaauuaagaggcagguuauuuagaacuuucuggaaaaggggcuggaaguuucugggaaucagauaagguaacuucuaggcuguugccauggcauuuguaaacugccauggcacugguaggagugucuuuaugcuaauaaacccugagggcaacucgagguuacuuuugucagcaucugcugguuucagccagaucuuguuccaaucagcagggugcgacaggaaauuaaguccugcuggucuucuaccucaaagguaguuaagcaggaagcuguacuugggggugcugcggcaucaccagcaagccuguuugaggcacugguggaacuugccugggaagauguccaugagaaugcccacuaaagcuuguugggaugagcaccaugggguguucugcacaccagcagagcaccauggaaguaagaagaugcaaaagcacacuagaaccaggaagagaaacccuuuccuuccaugcccucuacuaagcuuagugucaucaugcccgcucucuaggaagaaauguuuacauuauuacaggcagggcaaugaaagguagauuuggaauugagaggcaauauauugauuacuugcauagccuauuauuuuggcuacuuagcuuccauaugcacuuuacacacauuugagcucccauauaacaaugaaacucuuauguuucuaccuaacaagauacagcuaugucagagggugaaacucucacccuuguucuaaaaugaggaaugaggacaugcucagccccauagucauuguauccauugcuggcuauauuuuuguuuguuuguuuguuuuaauagaaucaggguuuugcuguguugcccaggcuagucucaaacuccugagcucaagcaauccuccggccucagccucccaauguccugggauuauaggugugagccacugugcuuggccugcuggcuguuuaucaguccucaaauagaaguuccagcuucagagggccaaggucaugugaugggagccaggggcuuggaguucugagggaagaggagugaaguauugggggauguggcaguaucacugacagugagguuuuuuggaggcuuuuuuggucugauuugugagauugauauuguccuuaaugauaaggaaacaaagaaaauggcagaagugaaaacugaaaauggcgaaguagaaaaacaccaucuccucuaugauggagaaucuguuucaggaaaggugaaagagucuagaaagagcuagagcaccacaacauuagaauugaauuuguacgucaaauugaacuuuucuaugauaagaguaauauucaagaguuuguaaaccuagugaaagaacuagccuuaccuggagagcugacucagaaguugucauuuggaauuuauacauguugaaaagucaugagaaucuuacauuggugcuaauguccucuugauguauugaaguguuaguaguaagaagacugacagacuugguaaaaagaaugugaucuuacuguucaccaacuugccagcuauccugauggaagugggcauugaagauugucuacauauagaauuugaauauaaugaaguaucauuuaaaggaugugacuguuacaaaaauuuaccucuuauaaguaagaauaaaaacacaacauaugggguuacaacugaucaauaagacuguuguuagcaggauaugaccuaacuccaacaaugaaaguuaugaacaaaaaaguuucaguaagguacuuuuugaauuuagcgccuguugaugaggaagacagaggguacuuuaggcagcagaucauuuaauggagaaaagcuccugaaaaacugaggaaacagaauaaacuuuuaccagugauuugaaccuccagaaucacaagcaucugcugaauagccugaaauauacugaauaagaugaaaaaagaaaaacaaaacuauaaucauuaaguuaaacagguuaaagauggcugcagcauguggaggggcaaaaugggcauaacucugcccgggcaugguggcucacaccuguaaucccagcacuuugggaggcgaggcaggcggaucacuugagaucccaaguucaagaccagcccggccaacaugaugaaacccugucucuacuaaaaauacaaaaaguuagcugggcaugguggugagugccuguaaucccaguuacuugggaggcugaggcaggagaauugcuugaacccaggaggcagagguuucauugaaccaagauugcaccacugcacuccagccugggcaacagaacaagacuucaucucaaaaaaaaauaaaaauggccaaaacuccauuuauauucaucuuccuuuaucuuacagcgcuacauuuauuucaugauauagcaaaauguucuucauguauauacauuuuuuuuuuuuuuuuugagauggagucucgcucugucgcccaggguggagugcagcggcgcgaucuuggcucacugcaugcuccaccucccggguucacgccaugcuccugccucagccuccugaguagcugggacuacaggcucccgccaccacguccggcuaauuucuuuuuguauuuuuaguagagacgggguuucaccguguuagccaggauggucucgaucuccugaccuugugaucugcccaccucggccucccaaagugcugggauuacagacgugagccacugcgcccagccacauuuuuuuuuuuuucccuugaaaaucgcucuuuugcccaggcuggagugcaguggcacaaucuuggcucacugcaaccaccgccucccagauucaagcgauucuccugccucucagccucccaaguagcugggaccacaggugugugcuaccacgcucggcugauuuuuauauuuuuaguagagacggggguucuccaggcuagucucgaacuccugaccucaggugauccacccgcuuggccuccaaaagugcugggauuacaggugugugaguuaccacacccggccaccuucauguauauacauuuuuaaaagugcuuucuuugaaaugcucaaauuuucuuaaacugccuuuuuuuuuuuuacugcacacuuugaugacaagcauucagauaugcgucagcauaagcuuuaaagauuuucauguggcagaaaacaaaguuccacugacuaguuuguuaccaaaaguuguauuauaaaucuaauuucaaggcgggugcgguggcucaugccuguaauuucagcacuuugggaggccgaguuggguggaucacgaggucaagagaucaagaccauccuggccaacauggugaaaccccgucucuacuaaaaauacaaaaauuagccaggugugguggugcacgccuauagacccagcuacuugggaggcugaggcaggagaauugcuugaaccugggaggcggagguugcagugagccgagaucuugccgcugcacuccauccugaugacagagugagacuuggucucaaaaaaaaaaaaaaaaaaaauuagccggguguggugcacaccccuggaaucccagcuacucaggaggcugaggcaagagaaucacuugaagcugggaggcggagguugcagugagucaagaucgcaccacugcacuccagccugggcaacagagugagacucggucucaaaaaaacaaaacuaaacugaacuaauuccaacuuauaauaaugggaagaaggaaagaagaaaaugguuagaauauacaaacaaauaccaaauauaacaaagagaaaguucauccucauuucugugauuaguaaugaggccacaguugauaucuaggcuucuuucuucaguuaccuauuucauguuucccuugccuucagcacgaaccucagcugguugagguucuuuaccuggugaaaugacucaaacauuuauucccucauuaguccaguccuuuuuugguugcuguaguuuuccauuaaucuuuauuuuuggcauggaaguauuaagaggugccuuagauaaucccuuggguuucagacauaguccuccuugcuuucacuguguagcagcaaccguuuccccuugacaauugggcucaaucuuucccaaccaguagguucagccuguugguucagugguguaaggagucccaaguagccaaguggcagucucaucuucuaaugcaauugaaccauuguuguguaugcuaguagauauauuuccugcuuagggacuagcacuuccaagccagcagaacucaguuguuaggagugaaagcaaaaauucagugauugcuagauauaauagugaguggagccgcacauacuucuacccuuugauucccagaccuguauauucugauugagggaggagacagcaccauguaaggugucucugauugaaaucauuaccccauccuuucaggguguugucucccugaaacuguaacuuagucuucaguaaucaauucccuauuuuaauuaggccaaccauucugugugauaggaugugacaacaccaguuaaguccauggacaugagcccauuucugcauuucuuuacuaugaaaugacuuucuuggucaggagcaaugcugugugggcuuggcaugguggcauaugccuguaaccccagcauuuugggaggccaaggcaggaggaucacuugagccaaggaguuugagaccagccuggguaacauagugagaccuugucucuauuuuaaaaauacaucuuuuuuuuuggccaagcaugguggcucacaccuguaaucccagcacuuugggaggcugaggcgggcagauugccugagguuaggaguucgagaccagccuggcuaacauggugaaaccccaucucuacuaaaaauucaaaaaaaauuagccgggcaugguggcacaugccuguagucccagcuacuugggaggcugaggcgggagaaucacuugaacccagaaggcagagguuucagugagacaagaucgugccacugcacuccagacugggcgacagagggagaccucaucucaaaaaaagaagcagccgcaacacuguguggaaugucauggugguagauugggcacuuauauauaaguucaugggugguggaacugccaaaaacauuauaggcagagaaggcaaaucuguauccagaauacaugucuauucuagugaggacaaaucucuucccucaccccugcccuuauuccccauaauagaaguccagcguaaucaacuugccaccaggugguuagcuaguuuuugggaaauggugcauauucagggcucagaguuagucugugccauuaacagauuagacauuuagcaguagcuuuagucaggucagcccuguuuaggggaagaucauguuguugaguccaugcacagccuucaugaugauuuuuuccauggguuuuauugagcaagcacucuuguagcuauggaaagugucuaacauuuauauucaugaaguacgucauuuugucaacuugcuuauuaagagccuccucuacagugaaugcaaaugauuauucacaugggacacaaauaucuucacagucugugccuguucugagaguuucaucugcauaucuuucccccagauuuccuugucaccauuuccuuccaaguuccuaacuagccaacaaaauccuuaauaauuguucauaaaugaguauaaaucucugcuucuggccaugucuuaccucaggcaaaagggaaaaccaaauguaccccucaacguucugcccucugaaggaaagauuuuucuucaucacugcccuucaguccuaccucuuuaaauggggcuguagugcugcagcuccccacuuuugggugauacuggcauguugugcagagcuauguguaaaccagacuugaguuuuuucuuuccccagucagcuggucauauggagcucucaggaggccauugacuuggauugagggagaggaagcaaugcaacagaacucaaugcugaagucugagcuaccuccuauguaacuuacucauauuucuggaccugcuugaauuuuuuuuuuuacguguuuuucacuugaugauagaucgugcugcacaugccaagcuagacuacauagguuggauaacaucuaguuccugaugagaagcucaggacacgugguugcauuaugucccaugguuaggcauuuggucucugccaagacccaauagcaagccugaaacuauuuuuugaaaggugaauaauuuucugcaaaagagggcauagauuuucucaaaauucuagaagucugggcagugauucucuuauucuugcuugcuaaaggcuccauucagcaucccuauuugccauggacacuucaaguaucauuggaucugccagaucauaaggcccaaauggcagagcagcuugaaccacagcuugaacuugcuauagaaucuuuucuugcucugaaacccacucuaaacugucaaccuuguagguaacuuuguagcuggguugaagccuaccaaacauuguacccucuuuuucauuguuggugauguuaauuagagcaacuuaaucaccuuggaagggaaauuuugacauguuuugagcaauugaauccugacauuucauugcugcagugggucucugaauuuuuguaggguuuaucucgcaucaacuacuuuguauaugucuuacuaaagcaucuaacguauuugcuacuugcuauuuaucagacccaauuagcauaaugucaguauaguugacuaguguguguguguguguguguguguguguguguguguguguguguguacgugcuuauuuauuuauuuuuuuggaaugucacgcgaucaagaucucugugggcuacauuaugguaggagaauggcauagcccugaggcuagauucauaggcacguaaaaggcagguaaaagcaaugugcuucuggugguucuugcagauuuguaugaagaaaaaggcauuauucagguuaauagcaguauaccaagugccgugacccauguugauuugcuccaguaaagaugcuauaucuggggcaucagcugcaauuggaaucaucaccagauuaaguuuaugauaguccacgaguuuaugauagucacuaagauccaucugacuucugcacaggacaaacuggcgaguuaaaucaagauauaauagguaucacuacccuguuucuuucaagucuuuugauggugacauuaagcucuuuaauucuugagaugugguauugcuucuggcuuaauaucuuaguagggaggguaaguucuaggggcuuccauuuagcccuuacuauuaaaaugacucuuaucaguugggucagaaagccaauaugggagcucugccaauagucaaguaugucuguuccaaguauuuauucaggaacugaggagauaacaacaaaguaggcccauuguacuaugggguccacugugagguggacuugagcuaagcauuucaucuauuaccugaccacugucagcacucacuuugacugauaggccacaguagcauuuugaguccccaggaauuaguaaucccugaaaggucuggguauuuccuuuucucuaauccguagucacucuaguaaauggccuuuggggaagcuuggaugaggauuuacaguauguacuuguacuugugggaacacuacagguuuuuccucaggggaccugggcuuguuaauugacuugggucuagaaauuagaugagaggucaaaacuuuucuagucagguuuuuacuaccagagcuggaguuuuuuucaguuguacagaugaaucuguuuugguaggcugcuuguggaauacugugugaucaauuacugccaaagauccuggugggccaagguguucugauuaccaguacaacuuuacuguauuuauaguagauuucccaccuugucuuuggugauuacaugcugcuacuuggccucuguuauuuuaggaucccguuaccccuuuaaaucagggaacccacuuagugguggcauuucccauggccauaccuagggguugugacagagaccuuagggacuguaaaaccuaaaauguuuaucuguggcccuuuauaaauaaaguuugccaacccaugucuaggggaacagggacacacugcaaaggggagcaaccacagagcuuuucaaggaugaaggugauccccucacuaaugcauuucuuuuuuuguuguuguuuguuuuuuuuuuuguuuuuuugagacagagucucacucugucacccaggcuggaguacaguggcacgaucuuggcuaacugcaaccucugccuccuggguucaagcaauucucaugccucagccucccaaguagcugggauuacaguugugcaccaccacaccuggcuaauuuuuguauuuuuaguacagucgggguuucaccauguuggccaggcuggucuugaacuccuggccucaagugauccaccuggcucggccucccaaaguacugggauuacaggugugaaccaccaugcccaccucacuaauggauuucucaaugccugagugaaaggauuaucuuccgagcuuuuuuuugcaacauagguuacacaugaaaaauccauuccaacauuucuaucucccuaaguuuuugaauugccucuucuacaucuugcuagggaaacuuuggcaucuccaccucauuaaacauaguggacucuuuuuuaaagaaaguuuuauuuauuuauuuagagacaggcucucacucggucacucaggcuggagugcaguggcgugaucauagcucacuguaauuucgaacuccuaggcucaaguaguccuccuuccucagccuccugaguagcugggauuacaggcaugugacacugugccugguuaauuuuuuauuuuuuguggagauggggucucuguguguugcucauucuaggcuugaacuccugggcucaagccuccuaccuuggccccccugcugagauuacaggugugaacugcacccaguccuuuuguuguuguuuuguguuuuuuuuuguaaguuuuuaaaguccuguuuauugaagcaugaauuuacauucaguaaaguucacccuaagauuugacaaaugcauagucauaccauacucaagaugcagaaccauuguaaaaucacucuaucaauucccuccugccccuuugcaaucaaccccuuuuugaucccaaggaacuaauugaccuguuuuucugucaaaagugucaaauuuaaucacuaaaaugaccuacaguaccauggaaaaauauguaagcauauaaaauacacaaaccaauuuuuuuuuuguauuuuauuuauuuuuugagauggagucuugcucugucacucaggcuagaguguaauggugcgaucucggcucacuacaaccucugccuccaaaguucaagcaauuuuucugccucagccucccgaguaguugggacuacaggcucaugccaccacacccgaccaauuuuuguauuuuuuaguagagacagaguuucaccauauuggccaggcuggucucgaacuccugaucucgcgaucugaccaauuuuuuauuuuuauuuuuauuuuuauuuuuuuuuuaauuuauuuauuuauuuuuuccauuuaacccugaguggacacagcacauguuucagagagcacaggguuggggguaaggucauagaucaacaggaucccaaggcagaagaauuuuucuuaguacagaacaaaaugaagucucccaugucuacuucuuucuacacagacacagcaaccauccgauuucucaaucuuuuccccaccuuucccccuuuucuauuccacaaaaccgccauugucaucauggcccguucucaaugagcuguuggguacaccucccagacugggugguggccgggcagaggggcuccucacuucccaguaggggcggccgggcagaggcgccccucaccucccucccggauggggcggcuggccgggcgggggggcugacccccccaccucccucccggacggggcggcugccggguggagaugcuccucacuucccagacgggguggcugcugggcggaggggcuccucacuucccagacgggguggcugccgggcggaggggcuccucacuucucagacggggcagcugccgggcggagggucuccucacuucucagacggggcggccgggcagagacgcuccucaccucccagacggggucgcggccgggcagaggcgcuccucacaucccagacgggguggcggggcagaggcgcuccccacaucucagacagugggcggccgggcagagacgcuccacacuuccuaguugggauggcggccgggaagaggcgcuccucacuuccuagaugggauggcgggcgggcagagacgcuccucacuuuccagacugggcagccaggcagaggggcuccucacaucccagacgaugggcggccaggcagagacgcuccucacuucccagacgggguggcugccgggcagaggcugcaaucucggcacuuugggaggccaaggcagguggcugggagguggagguuguagcgagccgagaucacgccacugcacuccagccugggcaacauugagcacugagugaacgagacuccgucugcaaucccggcaccucgggaggccaaggcuggcggaucacucgcgguuaggagcuggagaccagcccggccaacacagcgaaacccugucuccaccaaaaaaauacgaaaaccagucaggcguggcggcgcgcgucugcaaucgcaggcacuaggcaggcugagacaggagaaucaggcagggagguugcagugagccgagauggcagcaguacagcccagcuucggcucggcaucagagggagaccguggaaagagagggagagggagaccguggggagagggagaggagggagaggagggagagggagagggucugaccaauuuuuuaaaaagugagauacuuuaaaaaguuucuucagcauaccaacaaaaaaaugaagguagcauugcauuuuacuacagaugugcagauauucauuaaaguucaccauugucauauauauggcucaacaguaguauuuaagaauaugcuguaaaacaacaaucuuuagagucaaaagaauguaauuuuaaaaccuuuauaaauuaaagcaguuuauaaaguugucuuaauuguaaaauagcuaaucuaguuacaauuaauguguuccaaaacugaccuacuugaaaaacuagucuuauauauuuguugaguaugugaaccaugauuaggucuugcuauuugguauuaacacugucaaguuacagaccacagcugguucauagaaaagcuacuuuaaauaauggaauugaauuccguagaaauuuucuacaagaccaacucagcuauggggagaaacacgaaacugucaggugaauauuccuacagaugauuggggccaccucagaauucaccccugcuaccccuaugaaagggaccaaaaaaacaaaaaaagcaaccucuauucuguaguuacuaaagguuacauauucaaauauaucucaucuacuugaaaagcuucacugauucuuucaagcgccagaccuuaaauucaucagcaucuugaaacuccaccaagcccagucaugugccacagcugaaauuuguuuuugguuuuuuuuuuuaaacauaauuuacucgagucuaaaauuucagucaaccaaugaggugaacuguuagagccaccuccagcuauaugaucuacuccuacacauguucugaagguuuuugccaguauauuauugccacgaucuugcauguccuggauuacuagcauccccuuucccauuggcaaggugcuuagcacugcacuuaaacccaagagugccaccaaaccaauuucuaaaucccauguuuuuaaguccguccucugagaucacccuacuuuuuguaccaguucuggaucaggguucagucuggaaacagaaauauugcaauuugaacaagggaaaguuaacauaaagaauuauuaacuaguaauagauuaaccauuaaaggguaaagagaacucugaaagauguagguguaucagcuauaggagcagcuacucccucugugccugaggcagaguaugaaagaaagagacagauuggagagagagccuacccaaggcggagauucagaccuuuugaggagguaaagcuguagucuguugcaguuuuaaguuccugaggauggcaccagccgaggguuaaaagcaagaguauuguuugcuggagugccaacaaaacugucuaggaagcugcucuggguggugcugucgaaaaucacugggaaguuagcuggggugacuggaacucaccugaagccacucauugugguaucccuaaaacuggugggugagcaccgcugggugucccacgcaucacaugaggccacgggagaaagaagaggaaaacacaguggaaccaggaggaaauccucuuccuccuguaguauuccuccagugcuugcuauuggcauaagaaaaacauuugaagaguccagcuucauuauugcaaagcagagcaguaaaguauagauuuggaacugaaaggcaauaaauugauaacuaauauaucauaccucuuaaccuaugccuagaauggaauacaauuuccagauguaguuuagccagcauaaguagagcaggauaccuaccccacuccgcaucauuccugguacuauguuguugauguugcuugccaagaauguaagcucucuauggguggugauucuuuuuuuuuuuuuuuuuuuuuuuugggacgcagucuugcucuguugcccagguuggagugcagugggacaaucucggcucacugcaacccccgccuccuggguucaagcaauucuccugucucagccuucugaguagcugggacuacagaugcacaccaccacacugggcuaguuuuuguauucuuaguagagacgggguuucaccauguuggccaggcugguguugaacuccugaccucaggugaucugcccgccucaggcucccaaagugcugggauuacaggcgugagccaccgugcccagcuggguggugauuuuuuauugcuuuaucccuagaaccuaaauggaaccuggcacguaguauauguacuuaagggauaguugaaugaauaagugauuacagcucaagauagcguuaaauuguugucuuuuuuauguuagauucauccaaauuagugaaagaaaaacugcaguuugaccuagucaaccaacugaaauggauuaauguagaauucugaguggcugaguuaaaggacaccuuauuugauuugguuuaagaaaauugaucggccgggcgcaguggcucacgccuauaaucucagcacuuugggaggccaaggcagguggauaaugaggucaggaguucaagaccagccuggccaacauggugaaacccugucucuacuaaaaauacaaaaaaauuaguuggguaugguggcgggcaccuguaaucccagguacuagggaggcugaggcagagaacugauugaaccugggaggcggggguugcagugagccgagauugcgccacugcacuccagccugggcaacagagcgagacucugucucaaaaaaaagaaaauugaucaccugccagagcauggauugaccccucuucugaugacuugguauguguuuguacacacuguuaacaccccuuucuauagaauaggucacaauuauggguugggcguggugacucaacgcuuguaaucccaagacuuugggaggcugaggcagaaagauugcuugagcccaggaguucgagaccagccugggcaacauagugagaccugucucuacaaaaauuagccuggcaugguggcacaugcccacagucccagcuacuccauauguugaggcaggaggaucgcuugagcccaggagguugagacugcagugaauuaugaucacaacacugcacuccauccugggcaacagagcugagacccuaccuaucucaagaaaaaaaaaaaaaaaaaagaauaggucaaccagccuucccaacauggcgaaaucccaucucuacuaaaaauacaaaaaauuagccgggcgugguggcgggcaccuguagucccagcuacuugggagccugagucaggagaaucgcuugaacccaggaggcagagguugcagugagccaagauugugccacugcacuccagccugggcaacaagagugaaacuccaugacaaaaaaaaaaagaaagaauaggucaugguuaugaccaguggguacaaaagacauagacuuguguauuuauugcauguuucaagguagaaagcaaauugcugcaucaaguauuguugucauagccuuuaauuaccuauuaguaaugcaaagaagcagagauuuuuguuuucuuuucuuuuuuucuuuuuucuuuucuuuuuuuuuuuuuuugagacucucucugucgcccaggcuggagugcaguggugcgaucuuggcucacugcaaccucugccucccggguucaagcaauucucuugccucagccucccgaguaacugggacuacaggcgcccaccaccacgccuggcuaacuuuuuuguauuuuaguagaaaugcaguuucauugugcccaggcuggucucgaacucgugagcucaggcaguuugcccuccucggccucccaaaguggugggauuacaggcaugagccaccacacccggcuugagauuucucucuucuaggagaguucuggcagaugauuuggccuuuccucccuuguuguacacuaagaggaaaugaggcagaguaggaaagaaagguacccaagguugaguguugaaugagaggaccagggauuaaaaucaaaaucccuaccuggcugaauguggcucugcugccuugggguaggagauugggccacaaguccagcugggugccaggaggaggaagggguaaaaagggaguggaaaaccccuccaaggacccacugacccugcuggcagacuucuuauucaagugugaagaaaucugucagaaucugagggaaccaaagacaagaaaaaaguacaauguuuggacauaaauuuccuuaauucuuguaauguuuuaggauucuaauaaucuucuauaaggaggauauuaaauauccuuaaauaauuugcuguacuugggaaagugguuuuucuucuucaguuuagagcuagaaucucaguuaccuauaguugccuggagucaauugguagaauggguuugaagccauugaaaauugagcguggauaugaauacaguuuaauguuuacaugugauuucugccacaguugauuuugauuauggcuacuuguaaaucauuuuucuggcuuuaaaccaaaaacuuuuaaauuucuggcauaauuuaaauacuuucauaaauauaaccugcuuaaccuguuuaacagaaugugaaaauagaaauaggguucauuauaaguuauugacauuuaaagggaauuccuguuuuguauaucacaucauagauauaugauagcccugguuuauuaugucuauuauccugacauaauuguuaauaguugcuucuuuuuuuuuuuuuuuuuuuuuuuuugagacggaguuucaccuuugucacccagacaggagugcaauggcacaaucuuggcucacugcaaccucugccuccuggguucaagcgauucuccugucucagccucaugaguagcugggauuauagguuugugccacaacacccggcuaauuuuuguauuuuuaguagagaugggguuucaccauguuggccaggcuggucuugaacuccugaccucaggugaucugcccaccucagccucccaaaaugcugggauuacaggcgugagccaucaugcccagccaauaguuguuuauuuuacucuuguuuuggccuacucugaccaggcaaauuuauuucuuagaauguguugauuuaguuuaguauaaauuaaacuaaauuaguguaauaguccugagcauuuaaguuauggggccgggugugguggcucacaccuguaaucccagcacuuugggaggcagaggugggcagaugacaaggucaguagaucgagaccauccuggcuaacauggugaaaccccaucucuacuaaaacuacaaaaaaaaaaaaaaauuagccaagcaugguggcgggcgccuguagucccagcuacucaggaggcugaggcaggagaauggcaugaaccugggaggcagagcuugcagugagccgaaauugugccacugcacuccagccugggcgacagagcaagacuccaucucaaaaaaaauaaaauaaaauaaaaccagucuuggcaacacggcgaagcccugucucuacagaaaaauacaaaaaauuagcuggguguggugaugugugccuguagucccagauacuugggagacugaggucacuugagcccaggagguugaggcugcagugagccaagaucgcuccacugcacuccagccugggugacagagugagacccugccuccaaaaaaauaaaaaauauuaaauuauaauauuuuaauauucagcaaaaaaaguaaauaaaauucaguagaacaaagguguugcaaaaagaagaaucuuaauuuguagauugcaucuuuuaagaaaaacucauaagaauaccagccaguauuuuuaucuccagaugaauuuuuuccccuccaaauuacaaucauuucuccauucaacauccuuuauuaggcaccaccuagguaucaggccagauacauggugcugggaauagugaagagaaagacacaguccuuguucucaaaggacuaaacagagaauggaggaaccguaucuuguauucagauguuuaaauguaugcauagguugcuuaugcauacauuaugagaaccuaugcuacauguuuuaaauguaugcauagguucucaugacauacauuuaugagaucucagcucacugcaaccucugcuuccuggauucaagcaauucuccugucucagccucccgaguagcugggacugcagucgcaugccaccaugccuggcuaauuuuuguauuuuuaguagagagggguuucacccugugggucaggcuggucucgaacuccugaccucaggugauucacccgccucagccucccaaagugcuaggauuacaggugugagccaccgcgccuggccagcaaucugauuucaucuguucccaaucacucccuccauuuaacccuagguguuuuuuggaagcaaaccccagaucauuugaucuuuauauuagcauguaucucaaaaaaaaaaaaaaaaagguuccuuuuuagagcauaauugcaauaccauuaacaaacacacaccgguucccuaguaccaaauauccagucaguauucaauucaccaguuaucucauaauuaaaaaaaaaaaacuagcucguuagaauuagaaucuaaauuuauuuuaauccauagauucuucuauaggggauauauauauaaacaguuuggauuuuacuuguguuuuaaagaugccagagauuuaacugugcucauagccagagggggagaaaugaggagagaaggaaugaaaaauuaagucuagaagguuggaggacuggguggcaagaaggugauaaagggcauauuugcuguccuuggaaaggagaaucacguguauuuugcauauucucugguuuagcauuuuccccaaauuaaaaagaaauaaaaaugggggauuauauuuuucucauaaauaggaaggaaagaaguaaugauggacucugauguagauaaauuuaugguagaggaaacagcagucauauaauaucauuuucuauaaaguaaaauacuauauuuuggauggagugagcuggaaaagaaaguauguauaacagacuguggagaaugagaaaggaaguugcauggggacacauuuuguuuuuguuuuuguuuuugagacagaguuuugcucucucgcccaggcuggagugcagugacgugaucuuggcucacugcaaccuccgccucccagguucaagccauucuucugccucagccuccugauuagcugggauuacaggcgugugccaccacacccagcuaauuuuuguauuuuuaguagagacaggguuucaccauguugaucaggcuguucuugaucuccugaccuugugauccaccugccucagccucccaaagugcugagauuacaggcgugagccaccacgccuugccagggacacauguuuuuauaggaaguuguguagagagguguguuuauaggaacaaguacauucaguaugauaauaaaucaaguguuguaggagguagaauacugaaacuauucaguauucugaguugacagcucagcuacugccaacuuagccuguauuguggucucaggguagcauccuucaccuguggccacucugagacacauccagcagaauuucugguugaagcaaaacaagugugcuaugugaucuuaaaguuaucuccuuccugcuggagauuuccuucaaaugccuugguguuuucaaauauugcuagagggcuaaacucagagucuuccaaccauuguagggaugucaaauaucauuaauuuauuuuuguuuuuuuaauugagauggguuugaagccuuuuuuggggagagugggggaaagaguccuguuuugucaccuaggcuggaaugcaguacgggaucugggcucacugcacccucugccucccgaguucaagcaauucuucugccucagucucaguggcugugauuacagacaugcaccaucacgccuggcuaauuuuuguauuuuuaguagagaugggguuucaccacaugggucagacuggucuugaacucuugaccucaugucaucugugggccucagccucccaaagugcugggauuacaggcaugagccaccgcaucuggccuaaaauauuauuuuaaaucaagaaagguuagugggcuuuuugcuaguuuaauacaguggagaaggacgcuaauauaguuggauaugaacauuuggaucuauuuaauuauaaaaaauggagucggcugaaaaucugagaaaggaguaggcuuucuccugucacuuuuuuuauugaaauacuuuuauuuuuauuuugaaaguuuuuuuucuuuuguguuuuuggagacagggucuuggucuguugcccaggaauacagugguucuaucauagcucacugcaaucuugaaauccuggcucaagcaauccucccaccucagccuccaaaguaacugggacgacaggugugcacuaccgugccuggcuaauuuuuuaaauuuuuuuuguagagguuggggucuugcuacauugcccaagcuggucuccaaugccugggcucaggcgauccuccugccuccaccucccaaauugcgaugauuacaggugugagccgccaugcccagcuuauuuugaaauaauuucaaauuuauagaaaaguugaaagaacuuuauacauuuuuccagauucaacaaucaauacgauuuuaccacaacuauuuuagcauucuguaagauauguauguauaugaauauacacguauuuuccuugucaccuuuguuugaucuaauaaucuaagauguucucacauguguuacuuacaaugucaacaguaacugguaucccugugugcaugaaaaaagcaaaaaacaaaaaacaaaaacaguggugauugucagggcacaguggcauguaccuguagucccugcuacaugggaagcugaugugggagaaucacuuggggccaggagcucagucaaggcugcagugagcuauaauuaugccugugaauagcuacugcacuccagccuaggcaacaaagugagaccccaucucuaaaaauaaauagaaaaaaaaguuuuuaauuuaaaaaaaacugucaguaguaaaugaaaauaccacauucagacauuuuccccuuucuuuucugugaagcaccuuugccagcauuaauuuuucuuaauuuuuauuguuaugccauuuuaacgucuuuaugauuaaguuuagcucuuaaugagauacuguguuguguauuuuuucauuucucacauggcuaagcuucuaucccaaaagcauaaugaagccugaacuuugucuuggauuucuugacuuucugcagggaauggggagagggaagaacggggcuguaggaggcuagaagugugagcuugcacuggaguauauagggauuuggacuaacagacuucuaaaacuguaaaggaguuuagagaccaaauacuagcacagcccuuaguaaagacccccaaagagcuuguguuugugaggguuauaucuauuuaucaaacuaaaacuggagaaaccugaaaaauacuuaucucauuuuaaaaaguaauaauaaacaauauuuuuauugagaaguauaguuucaaaaaugaaggagauuaguaagaacagugguagcguuuucgccuuuuuuuuuuuuuuuuugagacggagucuugcccuguugcccaggcuggagugcaauggcacgaucucagcucauugcaaccucugccucccggguucaaacaguccuccugccucaaccuccugaguagcugggauuacaggcacacgccaccaugcccaguuuuuuuuuuuuuuguuuuuguuuuuuuaguagagacuguguuuuacuauguuagccaggcuggucucgaacuccugaccucuugauccgcccaccucggccucccaaagugcugggauuacaggcgugagccaccgagcccagccaugguuucgcuuuuaaaaaucuuuuuaaugucugucuuaauagaacacagcuguauuuuuauaucugccucugcauucagucugucacaauauguuguuuggguugcaguauaugaagaaaauccauuucacacaaauauguaguuaggaggaggaauauuuugacaguuuuuuuuccagguaacuauggguauuugauuugacaucaaaacuucacaaaugguaguuucuuuucuucuucuucuuccuuuuuuuuuuuuuuuuuuuuuuuuuuugguagagauagggucucauuauguugcccaggcugaucucaaauuccugggcucuggccaggcgcuguaaucccaggacuuugggaggccgagguggguggaucaccugagaucaggaguuugagaccagcuuggccagcaugguaaaaccccgucucuacuaaaaauacaaaaaauuagccaaguguggugguggcugccuguaaucccagcuaccugggaggcugaggcaggagaguugcuugaacccgggagguagagguuacagugagccgagauugcaccauugcacuccagccugggcagcaagagcaaaacucugucuccaaaaaugaaaaaaauauuccuggucucaagcaguucucccaccucagccucccaaagugcugugguuuacaggggugaacuacugcaccuagccaagugguaguuucuuaaagguuguuugcaauggggaaucugaaaccauaucaaugaacuuuuuguacuguuauuuaaaauccauuagucuaucuugcacuuggaauggaucauaugugacagaauuagucuaguuuugauauguagauaugcuacuuguuuaauuaguacuuuaaguguuuagccauaugccuuuucuguuaaaugccuucaauuucacagagauagaaaacuguccccuguccuuccccauucuacuuuuauaggagaaucaaagucucuagggauggccagugguagugguaaguauuuuuucuacugcauuauguaaauugcuucuuguuuagaauuucauuuuccauaguuuuacugaaauagacucucugaguagauugcaaguaugcuaaaaaauuuauucugaaggcuguuguuucuacaggggaguuugccugcuucugcuguguaguuuuaagaacaaaaucuaggucagcaguauugaauaaagaugugggagugagccucuggucaaacaugcuccuuaauaauaaugguggcgggggacuggugauucugaacuuugcuguugagauagcugcuccaggcugugcugcacccuguggaagggaauaaccagcaaaauucugcaucuuaaaaccagauuugggccaggugugguggcucacaccuauaauugcagcauuuugggaggccaaggcggguggcucaccugaggucaggaguuugagaccagccugaccaacauggugaaaccucgucuccacuaaaaguacaaaaauuagccaggcaugguggugcacaucuguaaucccagcuacucgagaggcugaggcaggagaauugcuugaaccugggagguugcagugaguggagaucaugccacugcacuccagccuaggcaacagagugagacuccaccucaaaaaaauuuuuaaaaaaaugaaaaaaacaacaacaacaaaaaacagacuuucaugcuccuucuccaggaggggugaggaaaauguacccauuucucugauuaaaaacuuauuuuuugaucaagaggugguuguuuaaaaaaaaaaaaaaaacuauuucuuuacaguuucuuaccaugaguaagaaauauaagcagaaucagaguuuuuaaugucuaucuuagaaaugauaggcuauuguuuaaauuauuuuggaauuccuuaugcuuuuuuaaaaaaaaacauuaugucaccaaccuuaugcucuuuauaauaaaugcaaaucacuuuccaagaaguuugguguauaaugugaauuuaacuuacaucauuuagcccaaauaaugaucuugugauaauuugauagcaacuuauuuauugaauacuauucugucucaugcaguuagcuaggcauugugaggaaauaaaaguaguaaaagcacaguauuuucuuuuuaaacauuaaugaguucacuuacuaacauguaaaauaaugaaaauuuuaaugauaaauagaauacuuaaaggcuuuuuaauuuuuuaaaaaaagacuaacaggaaaacaugugcuuaaggacuaaauucuuuccuaguaacagugaaugguaaaagagcuaaguaguggaaaaugagcauuaaagucaucagagagguucuguggaagcuaugaggcccaagugguggcuuuggaauuggaucagggaggagacauuucaagcaggggaucagugaucucaugagcaaaggcacaggggcagaguggagcacaggcucuagcaggagccaugaggggacagcauacuuacugcaugacuuuccuguuggaguaguagggaacaagccugggauggguucauuugauggguaaggaaggcuuuagauuagcaucuaacauuugccguaauaauguuuuguguuguugaagcccuaaacacaucgucuuuauaagcuuugaaauagauggauaggugcaccuucucuaaauaggaugugacuugaagaauguuuuuuacuuaaccauaauuuuagaacugaacaaguauccuuagaggucauuacugugacuaagagagaugaaagggcugucccaaauuuacaugguuagccuguggcaaagccaggguuaagaacucaaauaugggccugguauagaggcucaugcauguaauccuagcacuuugggaggucaaauccggaggauugcuugagcccaguuguucaacgccagccugggcaauguauggagacccugucucuacccccaaaauaauaacaauaauaaauuagaagggcauaguggcacacaucuguguccuuagcuacuggagaagcugagaggggaggauugcuugagcccaggaaguugaggccgcagugagcugugauugcgccacuauaccugggagacagucagaccuugucucaauuaacaauucccuuuuuucuuuuuuuccuuugagacagaaucucgcucugucgcccaggcugggugcaguggcacagucucgguucacugcaaccuccaccucccagguucaaacaauucuccugucucagccucccgaguaggauuacaggugugcgccaccaugcguggcuaauuuuuguauuuuuaguagagacagcguuucaucauguuggccaggcuggucucuaacuccugaccucaagugaucugccugccucugccuucccaaagugcugggauuacaggcaugagccaccacacccagcagagaucuugucucaauaaaauaaaaguaagaacucaaauaugucugcuggugcccagcuguucucucccuccuuucccucuauagauuuuuuagaauauuuaauaauaauaauaaaagaagaaaaauggcugggugcagugguucaugccuguaaucccagcacuuugggagacugaggcgggcggaucaccugaggucaggaguucgagaccauccuggccaacauggugaaaccucgucucuacuaaaaauacaaaaauuagccgggcaugguggcaggcgccuguaaucccagcuacucaggaggcugaggcaggagaaucgcuugaacccgggaggcagagguugcagugagcugagauugugcuaucgcgcuccagccugggggacaagagugagacuucgucucaaaaaaaaaaaaaaaaaaaaaagaagaagaaaaaggaaaagcuguucuugaagguagccaaagguucugagauugauuccuaccuucaaccugagaacaucagaaacaucuuucuccuauaauuuucugauuaauuucacugcaguaauccagaaugggguuguuuuauuacauuuguguuuugugauucaagaacuaagacaaauauauuaauccuaugaaaaaacauauugcuuuuaauauuuuuacuaauuuaaaaaggcguuuauccaaguuucaucaccuuuucuuccccucugcucaguguauaugccacuugugaaccuucccgaggaugcugugguuuguucuuuaauucaucgucauuuuucuggcuuagacaaguaaugaguacuuucaucuacuuaaaugaccaaguauuucaucugucuaauaacugcugagucuuauuuguaaguuauguuuuaccagauuuuugagaauuauaaagaugaauggauaagucaaaagucucagaauuaauuuuaaaauuaaaaugggcuucagaaauuauguagcacaauuuuuuuuuuuaauucuggaugaguaguguagcucuaacagucuuaaggucacacccaaaguuaaguggcagagucaagauuagaaccugggucuccugauucuguuuucuuucuuuucuuuuuuuuuuuuuuuuugagacggaguuucgcucuugucacccaagccggagugcaguggcgcgaucuuggcucacugcaaccuccaccucccggguucaagcaguucucuugccucagccucccgaguagcugggauuacaggagcccgcuaccaugccuggcuaauuuuauauuuuuaguugagacgggguuucuccauguuggccaggcuggucuugaacucuugaccucaggugaucugccuaccuuggcuucccaaaguguugggauuacaggcgccagccaccgugccugggcuccugauucuguuuucuaguucuguuuuccuucuuuagcauaucucuuuuugguuuagauugcuuuucuguccugugaagaagcuuuguuuuuagagauuuccucaauguuacgugugccauuauaagaacuaggcauuguauauuuguauauuuuguugcgugcuuguagcuagauuuuuuuuuuuuaacauauaaggguuuuagaauaauaccugauccauaagucucuccuuucuccucccccuuuuuucuuuucuuuuuuuuuaagacagaguuuugcucuguugcccaggcuagaguacagugaugugaucucgggucacugcaaccucugccucccagguucaagcaauucugccucagccucccgaguagcugggauuacaggugccuaccaccacacccggcuaauuuuuuguuuucuuaguagagacggguuuucaccacguuggucgggcuggugccaaacuucuggccucaagugauccaccaccucagccucucaaagugcuaggauuacaggugugagccaccaugccuggccucuuucucuccuucuucuccuucuuugucucucucccacccuccucuuucuccccuucuuuccucccuacaccuucuuuggcuucauucuuaggcagugucuuucaggguugagaaagauggccacuggcagcuauauucuuaauuuuauauucuuauauaaaauucuuaauuuuuuugagguauauuccuaauauuuuuuuuuuuuuuuuuuggagacuaagucucacuacgucacugcagcuggagugcaguugugugaucucggcucacugcagccucugccucccggguucaagcaauucuccugucucagccuccugaguagcugggacuacagacauacgucaccacacccccggcuaauuuuuguauuuuuaguagagaugggguuucaccauauugaucaggcuggucucgaacuccugaccuuaggugauccacccgucucagccucucaaagugcugggauuacaggugugagccaccacgccuggccagcucagguauauuauuaugguucaauaucuuaaaaugucuguauaucagguuucuccaaaagggcuuugggccugcuugaaucacaagucuacuucuucgguggggaaagcaaaacaccaggaccaaauagaggaaugggaugguuccuagggguggguuucccuuuagaaggcauucaggcagacaaaucuuaaguuucuauuuggccuuugaaacucuagcugccguuuaugaagaacugcuguccuucauaaauguguuucauccaaagugauaugcucuugguuuucccauucuugcccauggcccuaacuucuauuuugcuugcugugugucuuccccacuuugucucuuucucuguuucccagcuucauuuaauuacauccuucuaucuuccuagauucaauuaaguucuagucuccuacaggaagauccuagaucaucccacgacuguguuaugugacuguucuuuaaacuccuauaaguagcacuuacugcauuguagacacuuguccuacauaaaccauaaugguuauuauaggauuagcaauaauuuagcauguuucucauaauuuucuaagcacuucacauaucuuagccuuaugaaguagguauuaguuaugaaaacuaaagcuugcagagguuugcaucauugggcaugucuuaaacucucaacuaggcuaauacuugcuucuguguuuucguagugccuaagcauaggguggugaugguggugaucuaaguuccaugagagcaggacauuucaccauuugguuuacugcugaaucacuaaugccuggaguagcgauugacaguaugugcuuaaauugguaaaugaauuaucuggacaaauguggcaugguuuaaacuucagagguuuggauuaggugauccucuagguuccuuucacuuuaaaguucugagguuaccacugggggaaaaaaacaaaaaaacaaggaaagagcugagggugugaaauagaaggagucacugauucguuuguuaguaauauguaaauuaugagccgcacuaauauuguuuauaagaaagcagacugggccaggcacgguggccuguaaucccagcacuuugggaggccaagauggguggacuccuugagcccagaaguucaagaccagccuagguaacauggugaaauccugucucuaccaaaaauacaauaauuagccgagcgugauggcacgugcuuguagucccaguacucaagaagcugaggugagaggauaauuugagccugggagacggaguuuagggugagcugagaucaagucacuggauuccagccugggagacaaaaggagacgcugucucaaaacuaugccaucaguauacagcagauacuaaaagguauugaaaggguagaaauuugacuggggaaaaguaggguucaaaacccuaaucacuuuuuuaaaaaaauuauuuaauauguuguggugcuguugauucagugcugccuggucaccaccaguagauuagcucuugauguccugucccucucuuuacccagugccugagucuguugcuucggucagccuugagauuucuucuccagcaguguuuaaaaacaaguaugugugaccuauguaaaauuggccuuacauaucuacugaaauggugaugaauacauacauagaguacagaaaauuaaacuacauaauuaacccaauuucaccacauucagcucuggggaaccuacuuguguugaaaugccauuuaaaguuggcuuuuggggccaggugcagugacacaugccugucaucccagcacuuugggaggcugaggcaggcagaucacuuggguugaggaguuugagaccagccuggccaacauggugaaacccugucucuacuaaaaauacaaaaaauuagccgggcgugguggcaggcgccuguagucccagcugcuugggaggcugaggcaggagaauggcgugaaucugggaggcggaucuugcagugagcccagaucgcgccacugcacuccagccugggugacagagcaagacucugucucaaaaaaaaaaaaaaaaagcugggcaggauggcauaugccaguagucccagcuacuuggcaggcugaggugagaggauugcuugagucagggaggucgaggcugcagugagcuaugaucguacuaccgcacuccagcuugggugacagagugagacccugucucaaaaaaaagaaagaaaaaaacuuuauugagguguaauuuacauacccaaaaauuuaccuguuguaaguguggaaguaaaugauucuuaguaaaauuacggagucgaaaugauucuuaguaauauuauggaguugugcaaccaucaguguaauccaucguuagaacauuuuuuuauuacccuaaaaguucccuugagcccauuuacaaagccagucccuuuucugaccuacaguuucaggugaccauugaucugcuuccuguuauaguucuguauguucuagaaauuucauauaaauggaaucauacaauauauauucuuugguaucuugauuuccucacuuagcauaaugcuuuugagauucuucucuacaaaaauuaaaaaaaaauuagccaggugugguggcaugcaccuguagucccagcuacucuugaggcugaggcaggaagaucucuugagcccaggaguuuaagguugcagugagcugugaucgugccacugcacuccagccugagcaacagagcaggacugucucaaaaauaaaaacaaaaaaagauagccaagcauggugguguacaccuguggucucagcuguaggugucucuugcagaggcaagaggauuacuugagcccaggaguuugaggcugcaaggcaguaugauugcaccugugaacagccgcugcacccgaauagucugggcaacauaaugagaccccacucauuucacgucuccaaagaaaacauacaaaugccagaugaacacaugaaaaaaugcucaacaucauuagucauuagagcaguccaaaucaaaaccacaauaagaugcuacuucuuaccacaucuagggugacuacgauaaaaaaagauaacaacauguuggugaagaugugaagaaacuggaguccucauguauuguuauugggauuguaaaaugacgcagccauuuuggaaacaguuuggcagugucucaaaauauuaaacauaaaguugcuuuaugacccagcaguucuacuccuagggauauaucaaagauaauugaaacacguucccacaaaaaccuguacgugaauguucauagcagcauuauucacaauauccaaaaaguagaaacaaccaaaugucagcugauuaauggauaaacaaagugugguggaucuacacaguggaauguuauuuggcuauaaaaaggaauaaaguucaguuaccauacuacagcauggaugaaccuugaaaacauugugcuaaaugaaagaggucagucacaaaagaugacauauugugugacuucauuuauaugaaauaucuagauuaggcaaauccuuaggaacaaaaaguagacgagugguuaccgagggguaggggaaagugggaaaggagaaaagauaugggauuucuuuuuuggagugaagaaaauguucugaaguuagauaguggugaugguuguauaacuguguauaugcuaaaaaaccuuugaacucgacuuuaaaagagugaauuuugugaauuauacucgauaaaacuguuauuuaaaaaauaaaaagaggcugguccaaagguagugaguuaucucaauuguucagucaguuacagauugaacuccacguuccacucuuucccugcuucucacuguuguacuugacuagucuuuaaaaauacagauggagccaggcacaguggcucaaaccuguaauccuaggacuugaggagguugagaucagagaacugcuugagcccagaaguuggagaccagcuugggcaacauaaugagacccugucucuacaaaaaaaaaaaaaaaaaaauuuuguuuaaauuaggcaggugugguggcaagugccuauauuuguagcuacuugggaggccgaggugagaggauugcuugagcuugggaaguugaggcugcagucagccaugauccacaccgcugcauuccagccuggaugacagagcaagacccugucucaacaacaaaaaaagagcaacuuugagaaaaacaaaaauaaguaaauaaaaggaaaccaccaaacuaccauuuuacacauucucaaaauugcuccugucagucuuuuuguacagccuuuuuuaaaaaauagggccuuuuucugucaccaaggcaguagugugaucacaggugacugcagccucgacuucccaggcucaagcaaucuuccugcuuuagcauccugaguagcugaaacuaaaggcacucgucaccaugcuuggcuaauuuuuuuuuuguauguuuuuguagagacagggucucacuauguugcccaggcuggucucaaacuccugggcucaggugaccuucuugccucagcuucccgaaguacugggauuacaggcaugaaccauugugccuggccugauaacagccauuuuagugguuuuguaguaggaguucauuguaguuuuaauuugcauuucccuaaggacugaugagcuucauucaugugcauauuacgcauuauauauuuucuuugguaaaaugucuauugaaauauuuagccaauuuuuuuuuuuuuuuuuuuagacagagucucgcucugucacccaggccggagugcaguggcgugaucuccgcucacugcaagcucugccuaccagguucacgccauucuccugccucagccuccugaguagcugggacuacaggcauccuccaccaugcccggcuaauuuuuuuuuguauuuguaguagacaggguuucacuguguuagccaggauggucucgauuuccugaccuugugauccgcccaccuuggccucccaaagugcugggauuacaggcaugagccgcugcagcuggccaucaaguuuuaaauugaguuguuuaucuuauaauuguauuguaagagauuauaaucucuucuacauacaaaucuuuuaucagauuuaugauuugcagauauuucucgaagucuaugacuucucuuuucauuuucuuuaauaguaccuuuguuguugucuuuuguuuuuuuuguuuguuuguuuguuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccugucuuuuguuuuuuuguuugguuuuguuuuuugagacgcagucucacucuguugccccaggcugcaguacaguggcacaaugucagcucacugcaaccuucgccucccaggcucaggugauuauccugccucagccuccugaguagcugggacugcaggcacaggccaccaggcccagcuaauuuuuguauuuuuuaguagagauggggugucacccaguuggccaggcuggucuugaauuccuaacuucaggugauccgccugccucggccucccaaagugcagggauuacaggcaugagccaccaugccuggccguuuaauagcaucuuugaaaagcaaaaguuuuaaauuuucauggugucccauuuauauauuuugucucuuacagauagugcuuuuggugacaugucuaagaaaucuuugccuaauccaaagucacaaagauuuuuuccuguuuauaaguuuuuuuaguuuuaacucuuacauuaggucuuugucuugucuuuuuuuuuuuuuuuuuuuuuuuuuuuuuugcauaauaaguuagcaagugagcuacguuaggucuuugaucuguuuggaguuaacuuuugcauaugguauguggucaguguccaauuguuucuguaucauuuguugaaaaaaaauuuguuucuggguugaauauaauuauguugaauuauauuauguuuguagauagccaguugacccuaacuuuguauguuucuuucugaaccuguucuguuccaguaccacguucugaaccuguucuguuccaauaccacguugucaauaccaugcugaguugguacagucuugcucugucacccaggcuguagugcaguggcgcaaucuuggcucacugcaaccuucccacucccagguucaagugauucucgugccucagccuccugaguagccagaauuacaggcaugcaucaccaugcccagcuaauuuuuguauuuuugcuagagacaggguuucaccauguuggucaggcuggucucgaacuccugaccucaaagugagcugccugccucagccucccaaaguguugggauuacagguggugagccacuucucccagccugaguugguacauuuauaauaacuuuugaaaucagguuauguaagcccuucaacuguuuuucuucaaaauuguuuuggcuuuucuagguuuuuugcauuuuuauauaaauuauggaaugagcuuauuuuguacuuucuucaauauauuggucauuuucaggauugccaucuuaacaguauugaaucuuucauuccugagcauguuauaccuuuccacuuauuuaggcuggcuuuuuuuuuuuuuaauuccagcucccugaaauuguugcuuuugacaguuuuauccuuguucuuucauguggagaaaucacuacccucuucgugccugcauaaccuagaagucacucuguaguguuuuuuuaaccuuaaugaccuacuuuauuuccuucuaucuaaaauuuuuuuuagugacagagucuugcuauguugcccagguuggagugcaguagcuguucacaggugugaucauagugcacuacagccucaaacuccuggguucagguaauccucucucagucucccaaguaaauggggcuacagacgcaccauugcacccagcuccuuuuaucuuucaauuaaaagaaaaaaguuuucuuguaagacacuagcuagauaggauuuuuuauauuguacuagcuguaauacuuuguagaaauuccacuguaguggaggagaaaacuguaauaucuuguaacuuuuguuuugugucucuauuuuaagggucuccaacugaauuccuugaagagaaaauggccuaccaggaauacccaaauagccagaacuggccagaagauaccaacuuuuguuuccaaccugagcaaguggucgauccuauccagacugguaaguguuggcuugcucgugacuacuaaaugugugcuaugacauaaaugugaaaaagcuacaaccaccauucagaugaaaaugcuuuagcuuaaguauagaucacaaaguacaaccuuagcauugguuugucccuuucucuucuucauuuauccuuuccuuugagacacuuaaugcccucuaguucccugcucuucaaaaccuauuuuaaauacauuaugugaaauucauauacacugaagauuagaggauccauaguaccuuagaaccuuaauucuuccagaaggaauuauuaugguaauguuaaaccagugcuguucugugccaggcacagugcuagagccuuuauauacacauuaucgguauuucuuaccuaacucugccaaauauauguauccucuuuugacagaagagaaagcugauucauacccacuuucuauaaaauuaaaaacagaccaggugcgguggguuaugccuguaaucccagcacuuugggaggccaaagugggcggaucaccugaguucgagaguucgagacaagccugaccaacauggagaaacgcugucucuacuaaaaauacaaaauuaggcagguguaguggcauaugucuguaaucccagcuacucgggaggcugaggcaggagaauugcuugaaccugcgaggcggagguugcagugagccgagaucgcgccacugcaccccagccugggcaacaagagcgaaacuccaucucaaaaacaaacaaacaaacaaacaaacaaacaaaagccuaucuguaguagcccagagcuagaguugguaggaagaaugaguuccaaaagagccuuaaaggaauagcuuugguacuucccuguuagccagauugagagcucaaguuauguuuccacuuaaauauggcuucuuuuuugacaucuaacuuauaagaugcucaucguuuguuucaaauaaccuaguaugugauguucuguaccauuugucaguuaucggcuuuccuagguacaaaguaauuauggggggagggugaagaaaaagcuguauugagauacaauucuuuuuuuuuuuuuuuugagacagagucuugcucugucacccuggcuggagugcaguggcgcaaucucagcuuacugcaaccucugccuccugaguucaagcgauucuccugccucagccucccauauagcuggaauuacaggugcccacuacacccaacuaauuguauuuuuaguagagaccagguuucaccauguuggccaggcugaucucaaacuccugaccucagaugaucugcccaccucagccucccaaagugcugggauuacaggugugagccacugcgccuggccaauaauucacaguaccauacaguuuacccauuuaaaguauauaguucggccagauucagugacuugugccuguaaucccagcacuuugugaggcauaggugggaugaucacuugaggccaagaguuugagaccagccugaacaacauaaugggauucugucucuacaaaacauuuuaaaaguuagcugguuguggcagcacaugccuguaguccuagcuacucgggaggcuggggugggggaaucacuugagucugccacuucaaagcugcaguuaccuaggaucgugcuucuguacucuagcgugggcaauacagcaagacccugucccugauagauguguagacagacagacagacagauagguagaguagauagaguagauaaauggaguaacuuaggccaggcgugguggcucacacuuguaaucccagcacuuugggaggccgaggcaggcggaucaccugaggucaggaguucgaggccagcccagccaacauggugaaaccucgucucuacuaaaaauaaaaaaaucagccgggcaugguggcgggcgccuguaaugccagcuacuugggaggcugagguuggaggaucguuugagcccgggaggcagagguugcagugagccgagacugucccacugaacuccagcuugggugacagagccagacccugucucaauaaaauaaaauaaauaaaauagaguaacuuaauuccacugaauuggccgggcgugguggcucacgccuguaaucccagcacuuugggaggcugaggugggcagaucaccugaggucaggaguucgagaccagccuggccaacauggugaaaccccaucucuacuaaaaauauaaaaaaauagccaggcaugguggugcacgccuguaauuccagcuacuugggaggcugaggcaggagaaucacuugagcccgggaggcagagguugcagugagccaagaucgugccauuguacuccagcuugggcaacgagcgaaacucugucuccaaaaaaauuccgcugaauuguacucuaucuacuuaccuaucuauuuaucuauuuaugguuauaaccauaaccagauucaauuuuagaacacuuuuauuaccacaaaaagaaacucuguaccuuuuaaauaucacccccaucucccuauccacugcaacccuaagcaacuaccaauuugcuuuuugucucuauaaauuugcuuagauuggacauuuuauauaaagggaaucauauaaagugguuucuuugugacugcuuuuuuucacuuagcauacuguuuugaggaguccugcauuuuguggcauguaucaguacuuucuuuauggacacguaauacuccauuauauggcuauaccauauuuuguucauuauuuuauuuuuuugagacagaaucucccucugucgcccaggcuggagugcaguggcacagucugggcucacugcagccuugaccgcccaagcucaaaugauaaguacauaaauaauuuaaaucaggaagaagaggagccagcaaggguaacaaaggaaugaccaauuuugaguaggaaaaaaaauucaguggaguuuaauuuccucagcggaaaguugagugugguagucaacugccaagauggcguccaaugaucccugccuccugguauugauacccuuguguagucaccucccaugugguacuagguuuggucugugugauuguagaauagauggcagaaauaauagugugucauuucuaagauuaaauuacagaaaauaucauagcuucagccgggcacgguggcucacgccuguaaucacagcacuuugggaggcugaggcagguggaucacgaggucaagagauggagaccauccuggccaacauggugaaaccccgucucuccuaaaaauacaaaaaauuagccaggugugguggcggaugccuguagucccagcuacucgggaagcugaggcaggagaauugcuugaaccugggaggcggagguugcaguaagcugagaucacgccacugcacuccagccugggcgacagagcgagacuccaucucaaaaaaaaaaaauaucguagcuuccaucuugaucacucuguguuuacuaaucaugaggaaagccagcugauauagagaggcacacaugggagaggagcagaggccuccauucaacggccacguaagccaucuuaacaggcagguucugcagccccagucaggucuucagaucaccacagccccuggccaaccgcuggacugcaaccuugugagaaacccuagucauggagcugggggagaaauagguucuggggcacauuuugaaggucaagggcaauggauuuucugauggguuggcuguggugugugaaaaagaggagguccaggaugacuccaagguuuuuugcaaaaaacauagaaggauagaaugccauuagagauggaaagacuauauaaugaguagauuuggaaacaugcuacauaaaagucugaaaauaaggugagaggucuagaggucuugaauuauaaauucaggugucaucaaccuauagauggaauuuuaaacugugggauuagaggagagggaauguagagagagaaaagguuugucuuccuccucauaaccacucaguucuuuaguucucagcuuaaauacuuaucaagcaaagaucucccuugacuugaaccaaaauauauccugugggaacauauauaaauguucccaucccugaccuuguacaucuuuggguuuuuuagagcauacugggucugccaugugguaggcacccaguaaaaaauuaaugacuaaaugacagaacucuguaagaaucaucuauuuuuacaaguaauuuagcaagcucccaucuuaaagugcaaaccauccagaauuuagucuguuugaugcuuuaagaauccuuuuuucccucaagggggaagugugagaggcagagcaagcagcgagcuaucccaaaccauauagaacugggaagaaugaauguuuaucaucucucucauauucuaucuccccaucuuuucuuuuucuuaauuuuguucuguuuuuauuauuuauuuugagaugggguuucacuuugucacccaggcuguagcucagugguacaaccacggcucaccacagacucaaccuccccaggcucaagugauccucccaccucagccuuccgaguagcugggacugcaggcaugcgcuaccaugccuggcuaauuuuuccguuuuuugaaaauaaggguuuguuuuuuuuuuuuuuaaacaaaaagcaggcuguguuuuuuguuuuuaaagaugggcggucucgguguguugcccagacaggagugcagugacuauucacagucgccauaucauagugcacugcagccuugaaccccugggcucaagaagauccucccaccucagccucucaaguagcuggggugugugccacuuuuccaggcucccaugguuuucugaagaagaagccucaacaaguuucccaauauugccuucugcuuguucacacuucccgaugcaguggucuccccuaauccugaaauuucuuacaaaaagagggugguauagcugccucagagccaagaaaaugaacauucucucaaggccugggcuuuuaugcggcugucucugacaauugaagugucuuaagggagugauguguuagugucacucaggaacuaguuggaaaugcagauucucaggaaccagcaaucuuuauuuuuaacaagucuucaggaugauuaagauaauaaaauaaauuccaagaaggccucuucagaaaguggaacucuuguuuagccugaacagcuuugcuuuuuuuucuuuuuuuuuugagacagucucacucuaucacccaggcuggagugcaguggcgccaucucggcucacugccaccucugccucccguguucaagcgauuuuccugccucagccucccggguagcugggacuacaggcacgugccaccacgccugacuaauuuuuuuauauuuuuaguagagacgggguuucacucuauuagccaggauggucucaaucuccagaccucgugauccgcccgccuuggccucccaaagugcugggauuacaggcaugaaccaccaugcccggcccugcuuuuuuuucauguacaaaagcacaaagaguuuaccugauguuuugagugcuuuuauucaugccagcuccugagucaagaguuuauuucuucuguuaggauaacaauuguuuaucuugucccauucagacaguuuugaaaugcaguuuucuucaucauguccacaugaggugaaaaauuacuuguugguuuuuuuuuuuaagcuuguuaauggcucugucuuuuuaaaaaguaacuuaaaaugaauguuauauaaauauauauugaaaauuuaguuuauacuuucaccucucagaguguuuguuauacagcugagcauuaguugcccuuuuuguuuuaugcauuuguuggcuaucugauguacauaaccaaaucuuagagaagggauuauuuauuauuaacucauaacaaaugaauuagugaauauugauucucuaccaugugcagucacauaugauuucgguuuacuuacuauugacaacucaucuauauucaucauaggauaauaagaaauauuggccaggcaugguggcucacgccuguaauccuaauacuuugggaggccgaggugggcagaucacuugagaucaggaguuugagacuagccuggccaacguggagaaaccuugucucuacaaaaaaauacaaaaauuagccaggcaugguggcgggcaucuguaaucccagcuacuuaagaggcugaggcaggagaauugcuugaaccugggagguagagguugcagugaaccaagauggcaccacugcacuccagccuuggcaacagagcaagacuccaccucaaaaaaaaaaaagaaagaaagaaagaaauauuaaucuuucuaguugcauucaccaggaaugaguuuuggauuucuucuauauuccagaucccuuuaagauguaccaugaugaugaccuggcagauuuggucuuucccuccagugcgacagcugauacuucaauauuugcaggacaaaaugaucccuugaaagacaguuacgguauggcuucuucaaauggauuuauucuguagggaaggaaaaaaauuuuuucuuuacucaucuuugguucacugacuagggcucugugacaaaagauuaacaagaaaaaagagaccaaaguuuaaaaugugaauuuaauauguacaugagagguaccuagggaaugaguaacuccgcaagagguggcuuuagaauuccaccuuauauagcuucuucaauaaagaaugacaaauuuuuuuuuugagaggugagaagaugaaggaaaagacuuuugagucucuaggggccgcaaauugugggagacagguaaaugguagguaaaagcuaguuaguaaagguugcuguguagauuccuauggugccaucuccaggcuaauaauagccuucagcuuaaaaaaguccuuaugccaaaguagcguauuuugggguggcauauucugguguccuuuaguuguuuaaugccaaacaaucaacauggccuuucacacaucaccuuugaagcuaaccacuaagaaaagucagauuuaggggcugugggugugacaaggcucucuuuggauuaaucaaaggagacaauucacagauucacaguugggcugucaucuccccuuuuuuuugagacagggucucacucugucacccagguuggagugcagugaugcgaucacggcccacugcagccuuggccuccuggucaggugauccucccaccucaaucuccugagcagcugggauuacagguguguaccacuaugccuggcuaauuuuuuguagagaugggguuuugucacguugcccaggcuggucuugaacuccugggcucaagugauccacccgcuucagccucccaaagugcugagauuacaggcgugagccuuugcacccagccacauuuuucuacuucuucauuuacaggcagacacaguggcucaugccuguaacccuagcacuuugggaagcugaggugacaggauugcuugagcccagcaauuugaaaccaaucugggcaacauagggagauccuguccuacaaaaaauuuuaaaauucauccaggcgugguggcacaugccuguagucucagcuacucaagaggcugagguggaaggauugcuugagcccagaaggucgaggcugcauugagccaugaucaugccacuguacuccagccuggacaacagaguugagacccugucuuaaaaaaaaaaaaaaaaaaaaaaaaccaucugggugcaguggcacacgcccguaaucccagcacuuugggaggccaaggcggauggaucacuugaggccaggaguucaagaccagccuggccaaaauggugaaaucccgucucuacuaaaaauacaaaaauuaggcugggccuaauggcucaugccuguaaucccagcacuuugggaggcagaggcgggcagaucaccugaggucaggaguuugagaccagccuggccaacauggugaaaccccaucucuacuaaaaauagaaaaauuaggccgagugugguggcucaugccuguaaucccagcacuuugggagacggaggugggcagaucaccugaggucaggaguucgagaccagccuggccaacauggugaaacacugucucgacuaaaaauacaaaaauuagcugggagugguggcagacaccuauaaucccagcuacucaggaggcugagucagaagaaucacuugaaccugggagguggagguugcagugagcugagauugugccauugcacuccagccugggcaacgagcaagaauccaucucaaaaauuaauaaauaaauauaauaaaaauaagaaaauuagcugggcaaacaacaacaacaacaacaacaacaaaacugcuacaaaguauuuuaauaaaauugucuucuaauguuggaaagggagguguuaaucucauuuugcagaugaagaaauuaagacucgcaguuuuuuacuauaguauauuauguugguugugguguuggaacuagaguucaaucauuaauauuuugaaucuuuauauuacccuuuauauauuauauagaaaguagccagugaauguugauuaauggcacuacugggauauacuauaccaccuacuaacaacuagcuaaaaccugaagaaugucagcaguguuuccuuuaaaacuuguuugcguugucggccgggcgcggugucucacaccuguaaucccagcacguugggaggccaaggcggguggaucaugaggucaggaguucgagaccaaucuggccaacauagugacaccccaucucuauuaaaaauacaaaaaaauuagccaggugugguggugugugcuuguagucccagcuacuugagaggcugaggcaggagaauggcgugaaccugggaggcagagauugcagcgagccgagaucgugccauugcacuccagcccaggcgacagugcgagacucugucucaaaaaaagaaaaaaaacuuuuuuugcauuguuuuuuauuagucugugucuuccuggcaauauaugcagcugauuuuaaauaucaaauaccucuuaggccgggcgcggugguucacgccuguaaucccagcacuuugggaggccgaggcgguuggaucaagaggucaggagaucgagacuauccgggcuaacauggugaaaccccgccucuacuaaaaauacaaaaaauuagccgggagcuguggcaggcgccuguagucccagcuacucgggagacugaggcaggagaauggcgugaacccgggaagcggagcuugcagugagccgagaucacgccacuucacucugucugcgugggcaacagagcgaaacucugucucaaaaaaaaaacaaacaaaacaaaacaaaacaaaaauauaucaaauaccuuuuguuuccaauguuuacuaaguuucaaaauguauuuguuuguguuucaauauuagguaugucucccugcaacacagcuguuguaccucagggguggucuguggaagccuuaaacucuccacacucagaguccuuuguuuccccagaggcuguugcagaaccuccucagccaacggcagguaaacuauuagagacucccuuuaucaguuaaugguugcaguauugguaaucaauauaaaucaucagguguauuuuuuagcagcuuacagcagguauaaaaauuucagaacaaucacaaauguuuugcuuauauuagugauaucaccacuggaggaauuaaauuguugaacuauaacacuuaggguuaacgggcacauaaauacuuuuuuuaaauuuuuuaacauauauauauuuuuuucaucacauuuucauuguauuagguaucagaauuuuuuuuuuuaauucaguacagauuuacggccuggugugguggcucacacuuauaaucccagcacuuugggaagcugaggcaggcagaucacuugaggucaggaguuccagaccagcccagccaacauggugaaaccccauuucuacaaaaaauacaaaaauuggucuaggcacgguggcucacgccuguaaucccaacacuuugggaggccaaggcgggcagaucaccugaggucaggaguucgagaccagccuggccaacauggugaaaccccgucucuacuaaaaauacaaaaaauuagcugggcgugguggcaggugccuguaaucccagcuacuagggaggcugaggcaggagaaucacuugaaaccggaaggcagagguugcugucagccgagauugcgccacugcacuccagccugggugaaagagcuaaauaaauaaauaaauaagcucagcgugguggcguguaccuauaaucccagcuacuagggaggcugagacaggagaauugcuugaacccgggagccgagaucaugcuacugcacuccagcuugggcaacagcgugagaccgugucucaaaaaacaaaaacaaaaauucaguacagauuuagaacucuggaguuuuucuugauaggaagcaugacugaccugcugucccacagauuaucuuucuaauacuaauucugugcccguguuauuuuugaagccuauguuuucucucuucuuugccauuucuccuccacuacuuguccucccaguauuuuacaucuuauucuuccaaguguugagacugucaaagaguaggcagaauauguuacuugacauuagcuucuucuucuuuuuuuuuuuuuuuuuuugagacggacucuugcccugucccccaggcuggagugcaaugccgugaucucgguucauugcaaacuccgccuccuggguucuagcaauucuccugcuucagccucccaaguagcugggauuacaggcgccugccacugcauggcuaauuucuguauuuuuaguagagacaggguuucaccauguuugucaggcuggucucgaacuccugaccucagaugauccauccgccucggccucccaaaguucugggauuacaggcgugagccacugugcccggccuaacauuaauucuuaguuauguguacagucuuauggucacaaaagccaaauacucucaugccugaagaaaguaagcauuuuuaaugcaaagguaugaguagacaaugauguguccuaaauuuccaauuuaguucccuuagagcuagccaaggagauagaaauggcaucagaagagaggccaccagcacaagcauuggaaauaaugaugggacugaagacuacugacauggcaccaucuaaagaaacagagauggcccucgccaaggacauggcacuagcuacaaaaaccgagguggcauuggcuaaagauauggaaucacccaccaaauuagaugugacacuggccaaggacaugcagccauccauggaaucagauauggcccuagucaaggacauggaacuacccacagaaaaagaaguggcccugguuaaggaugucagauggcccacagaaacagauguaucuucagccaagaaugugguacugcccacagaaacagagguagccccagccaaggaugugacacuguugaaagaaacagagagggcaucuccuauaaaaauggacuuagccccuuccaaggacaugggaccacccaaagaaaacaagaaagaaacagagagggcaucuccuauaaaaauggacuuggcuccuuccaaggacaugggaccacccaaagaaaacaagauagucccagccaaggauuugguauuacucucagaaauagagguggcacaggcuaaugacauuauaucauccacagaaauauccucugcugagaagguggcuuuguccucagaaacagagguagcccuggccagggacaugacacugcccccggaaaccaacgugaucuugaccaaggauaaagcacuaccuuuagaagcagagguggccccagucaaggacauggcucaacucccagaaacagaaauagccccggccaaggauguggcuccguccacaguaaaagaagugggcuuguugaaggacaugucuccacuaucagaaacagaaauggcucugggcaaggaugugacuccaccuccagaaacagaaguaguucucaucaagaacguaugucugccuccagaaauggagguggcccugacugaggaucaggucccagcccucaaaacagaagcaccccuggcuaaggaugggguucugacccuggccaacaaugugacuccagccaaagauguuccaccacucucagaaacagaggcaacaccaguuccaauuaaagacauggaaauugcacaaacacaaaaaggaauaagugaggauucccauuuagaaucucugcaggauguggggcagucagcugcaccuacuuucaugauuucaccagguacgugcuugugcuuauucucaguauuucucucuaccagguuguagucucgagaagacuaaggacaaacaucaugccagguaaaguacagacagucacacuguacuuugcaaguuuauucauacuccugcucuccuagacaacucuuucccgccuuuacccuccucccaccuccaacaccuuuucuauguucauucucugcugauuguccuguuuuucuugcagauaagucaagcaauaaaauagaacaucgacaaacuucuauuccauuaucuacccaacuacuuguaucuguauccauggucucugcuuaugaaaguucccguuuuuauaaguaaacuguuccugcuccuaauuaagaccaaccucuccucauuuugcccuagauuccaucuccucuuuccuacucgauauauugccccauguauucuucccuuuuuugccccucauaccaauuuaaaucuuuuuucauuggaucauucccacccauuuaacaaacguuuguuauuuuucccaucuuaaaaaacgaaacauugaccgggcaugguggcucacaccuguaaucccagcacuuugggcggccgaggugggcggaucaccugaggucgggaauucaagacuagccugaccaacauggagaaaccccgucuccacuaaaaauacaaaauuagccgggcaugguggcgcaugccuguaaucccagcuacucgggaggcugaggcaggagaaucacuugaaccugggagacggagguuguggugagccgagaucgcaccauugcacuccagccugagcaacaaagagugaaaaacuccaucucaaaaaaaaaaaaaaaaguaacauaacuagacauaccuucccaacuucagcuuccaacuaccacuucacuccuuugcugccccuuguaggagaacuccucagaaacuaaucccauauccaauuucuggcagauggaaaauagcugaaaucaugcuucucugaaacguguguggcuuuuguuauuaccuuuagaaaccgucacaggaacggggaaaaagugcagcuugccggccgaggaggauucuguguuagaaaaacuaggggaaaggaaaccaugcaacagucaaccuucugagcuuucuucagagaccucagguaaguuaggaaaacaaaaugaacucuuugaaacaaauuaggggcgauagaguagugaugguagacauugucucuaguucccuguuguauggugguaaucagcaguauaguuuaugaagucaauucucuuagacagauuuuaucugguuuagacagaaugucagcuuguuauaucuuuaaaaauuacuacuacagcaaaucaggauaccuaauuuuuuuuuucuccacuguuuuuuuuguuguuguugucguuguuuuuuuuuuuuugagacagagucucacucugucgcccaggcuggcgugcaauggcgugaucuuggcucacugcauccuccaccuacuggguucaagcgauucuccugccucagccuccugaguagcugggauuacaggcgccugccaccaugcccggcuaauuuuuaguagagaugagguuucaccauguuggccaggcuggucucaaacuccugaccucuggugaucugcccaccucagccucccaaaguguugggauuacaggcgugagcgaccgugccuggccuucuccacuguuuucauagugaagaaaggacacccaaauuuugaucugguucagcuauucacuauucuauccuguguggucuuaagcaaguuacauaacuugccuauaucucaguuuacuuagcuauaauauaaauuaauuggucaaauguucucuaaagucuuacuaguuacaguguuccauggcccaacagcaucuacauuaccugagaggcugguagaaaugcagaaucuugggcucuaccuuaggccuuuguaauuauuaucugcauuuuaauuagauccccagauaauucuaauuuucauuaaacuuugagagguacugcucuaagauacuuuccaauuuaaaguuugauuauucagugaauuugaagauuaccuguuuuuaauaacccagaagcauauguauaugauuaucaacuugauuuucuguuuacuuuucugugacuaugauuggaauguggacauccugacauaugggacauaagggcccaugacuuauuucacuuagaaucucuaaugcuuugcacacuaccuagcacaagacuagagcuuaaauaaaugugugauuuuuuuuuuaaauguuguuuuacugacucaacaaaucaguaaagauuuaucaagugcuuaugguauacaaaauacaccauguuaaggcauauagauauuuaaguccccguccuugcccccugaauuauuauauuauaaccugaaugaagagauaaguucucaggcaugaacucugaaacccaagauuuacauaauaauugaauaaaauaguauaaaagauggcacugaauagcugcugauuaauugcugaauuaaauguuauaaauacugggggauacuauagccuagcaauuuuuugagcgaugcaauaauuaaccugagauauuaaacaaaggcuaggauuuagaggauauuggagggguaaggacaagaaugaaauccacuauuuacauauuauaauauucuuggaaaucaauuuauugggucagacuugacaggagcuggcauauaccugcucuuaaugagacucuugccaggaucuuggauccauauuauauuaacugggaggaagguuagaccagaucaccugcugaaacucuuccaaagguacucaucuuaauuguuaaaauuaauuauccuacuuaacauuauauauauuucucugucuuuugggaaguacauuuaggagcagaauguugaaauuuaacauauuugucuuucaaaguaggaugcucugguucuggaaucaugagaauuuuucucugaccaaaauguggauucaguauauuuugugugugugcgugaagugacuuaagucuggccuucugaucuaguucccagaaucugucugguuuguuugacaaguauuaguuuaauauuggugaccuagucuuagaauuauaaauuuuguccaaaaucauguauauuuaacugaagcaauuaauaaauuucaccaaaaagaggcaagcacuaagaaugaccaauauaaaucagaugagauuuacaggcaguaagugcuuauuuuuagagguuaaaagaugugaaauguuucauuuuuaaaaguucaauccugcuacuucugaaauuucaaauauuuuauaaauguuugaaaacaaucuuuaccugagaugaugaucuguuaaauauuuuugcuagcgccaguuaaaagugagaaauguuuuagaaaagacuguuuuccugagcaaauuacaguaaguacuauauguauuagugaaaauagccuccuuaaauuagucauuuauauggucugguuuuuuuguuuguuuguuuguuuuuuguuguuuuuaagaaacaauaacgaggaguuuuuuguuuggaauuuuagccaacuucauguauugcgguaccccucccacacaagccaaacaaguuugcagacccagugaccgcaggucaacccggcccaagccugccagggucccuccugagcugcugggaggcucuccuccauggaagacucuugaucacaggcugggccacugcucuuugucugagucagguugggucucugguucauccuccuguggugggccugggaaccaaagaaaaaguauucauguugacucacuugaaccccagagggaucuuggcagggaggccugggauauagaaagcacaccaauaaugaugaagaaaaagaagaagaaaccaaagcaaaagagauauucucaaccacgggcuggaggaccuucggaugaugacaaugcagauaagccuaaaggucauccauuugcagcugacacacaaaaaucagguguucuccccagccagccuaccacuauggguacagaauauggacuuguaucuggagaaaacuugaaaagggaauguuuaguuaacuccagugcagccagacugguagcugagaacuuugucucagagagucucagaauuccuuuauauccuucugaagaagcccccaaaacugcaauaaguucucagucuaagcugagaguagaggaagagagcaaaaguaacaagucaguacuacaaaaccaagacaagaaauugcugaagcaacaugaauacaaaccacagccugcaccccaccugaagacuccuguagauaaaagccagucaguaggcccucucaaucugaaaggaccccuagcagaaguuucugcauacaauguagaaaccccuuuggauaucagacuuaaagaggguugcucuccuuucuuggaccaagagguuauggguguaguuucaaaacccacagcagcaaaagaaauaccaaauuugguacccacuuugauagcaaguaauccauuagaauguaaucuaaaagaagggaauaaugaaaguaaaaugacuaaacugcagaaugucaaacugaaggaguuuccugaaggagcugaagaggauaaagaacuaaaaaaggaagcuuuucccaacgaaagacaagagaucagcaucuuuacuucugagcagcugcagggccaaguguugguacaggucccugggguagagaaugaaccauuuaagagaauggcaggugauggcaaaagcaggaagggaaggggaaguucugggaaaaugagaacagauucugggaagguaaaagcaaaaucugagcugccauuucuucuggacagccagaaggacggaagggcuguucucauaccgagugagccagucucuaaaacugaaggaaugacuacucaggauaagagugaggagcuggggcugaauucuucaaagcaaccaggcacuaaggcugaucucacggaggcaguggugaugggggagccuaaagagaugacucagccuaagguggcaggcaccaugcaggcauugauuccuuuggaaaguggaucaggcaugacucagacuucugguguuagcacagaaacaggagauguagucaaagauaugggugucaauaaccagagcaaggaaggaagguguccauggaaggaucaugaggcagcucccuggauuucugaaaagccuaaaaagagaggcaaugaaggcaaaagcaaaaaguuuaaaaauaauuauuccacacagccugcuagaauggagaggaaggaagaaauccuuaacccaccuuuugaagggaaggauggagauacugguaguauuccccauaaaagcaaggaaauaggauuuacuuuccccaaaaugcaugauucuucguucucacauacaccagauacacccacaguggaagcaguugacaggaaggguggaaauuuucagguuaauuuuguugagcuugggacucuuggggaaaacaagauaagcacagucaaggcuucuacuguuacugaaccaccugccaaggugacagaugugagcugccaagagcaaauccagggggcaggauuuguuccuucaguaguaucugaggagaauaagacagaugcagccaauagauacacugcaguggcugacaaaccaaguaaaaggaguaaugauggaaaaaguaaaaagguuaaaaauaguucuccugagaagcacauucuggagaauaagauagaugcaacaaaaauacauguucccauggaaaccacaggggaccagggaauugaaggaauggccuauauggacgaaaauagaaauauuacauuuaccugucccagaacaccaucagagcugauaaauaaaucaucuccucuagagguucuggaaucagcagccugugaaaaacugcccacuccuacuccucaaguaguaaaggaaggugauuccuuuccagauaccuuggcaaaaaaugggcaagagauagccccagcccagauuuccaaaucauuaaugguagauaacuacaccaaagauggagucccaggucaagaaagacccaagggucccucugcuguugugcccucuacaagcacaggaggaguugcucuaccuauuacaacagccauagaaacaguuaacauucauggagaucacucucuuaagaauaaagcugagcuugcugauuccaugaaaaaugaagcagggaucgaugaagggcaugugauaggagaaucugagucagugcacaguggugcgucuaagcauucaguagagaaagucacagagcuagcaaaaggucaccuccuuccuggagugccaguagaagaccagagccuaccaggagaggccagagcccuagaaggauaugcagauagagguaauuucccagcacauccagugaaugaagagaaagagacuaaagaagggucuguugcaguucagauuccugacuuacuggaagacaaagcacaaaagcucaguuuuugugaggaccaaaaugcucaagauagaaauuccaaagguucagauaguuugaauaagaagguagaucugacucuuuugucuccaaaaagugaaaaugauaaauugaaagaaauuagucuggcuuguaaaaucacggaauuggaaagcguuuccuugccaacaccagaaauccagucagauuucuuacauagcaaagucgaagcuccuccuucagagguggcggauacguuaguaauaaugacugcuuccaaggguguucgacucccagaacccaaagauaagauuuuggagacaccucagaaaaugacagaaaaaucugaaucaaagacaccaggagaagggaaaaaggaagauaaaagcagaauggcagaaccaaugaaaggcuacaugagacccaccaagucccgaggacuuacuccacuuuugccaaagucuacaauccaggaacaagagagacauaagcaacugaaguccgcugguaugaaccugccauggggaaaugugugugcuuguggcuuuugagucagcaucagaaaggcaaagagcuugugucuuggcuccauccagacucuaaucauccuuguuaaucauugguuuguuggcaugaaaccuauaacugcuacgguguguuuucugcagccaauguguuccuuguguccugcuugaggaggcugguaacuugguugcaugccuuuuuuacccagcacugaacguugaauuuuaggggaaguugaauuuucaaugaauugucuaacaaaagaccuaucaucauccauuucuuaauuuuuuuaaaauugugccuccuauguaucaaguuuacagcuaaauuuuaaucauuacuugguauaaggauucacaggaggaaagaaaauauuucaugucuagcuaugugcaugagauuuuuuucaauuuauauguagcuugugcuggugggacuaaauauccaaacugcuuuuagguuaaaugaaaucaguccaccuccuuaugaggaaaugguggccucaaaccagcauugguaggcaccgauuuauuuguguuucuaguaaugggaaaugaucucucaaugauacagauacauuuuuugaccaguuuguugcuuauauccauugccccacaguuccauguggguuugaguuuugggcauagucuguguccaucaaacauaguccauaaaacuugcccauguuguguuccucauaauuuuacucuuuuuuggcucuauucagucaaguaauuggaaugagauuaagaagaugauuccuuuaagauuuagaaaugguagccccguuuccccccacccccaauuccccaaaaaaguauacauuuaaucguggcuucccugaaucuagcuuucaaaaaauguucccuugucuuugagauuuuucacagccuacaagugacacuauuucuuaaucacuguuucccagcuugcaugauguagcuacuaacuccagaauuuaaaaaaaacaccaauugguuuuaguagccagucaggcuuuuagagagguuucaucaugggauuguguucugcaugguauggacuuguucuuuuggguaaagcuugucuaugcaugaguauguacccacuaaggaauacugcugugugaguaaagaaugcuaaagguuguuauuugcauaagacauucucaucuucucuguuuuuaucuucuauuagcuacccuauuaccaaggcagaaaaugaaauaguauguagagggcuuuccagcauucauugagauuuccaguguucuauccaguucuuucguuuugguuucuagacccauucuuuaguuucagcagugaucuaaaaguuaacauguaauuucugugaaaucccagccaucucuuuuugcucaguauuuccaaagaaaugcagaaagaggauuuguuuuucuugaggaagcaagaccaguacugcagaacuuuuggggcccugccugggucaggucaggcucagagacuguguuagcaguggccuuacagaguggguaugggaaggauaauggguuugggacaaaauuuauuguuucuucuauaaauucuaccacaccuuuccccuaaggacaauguauaccuuuuuaauaguuaaaaaaaaauuuuuaaacuaauugucgaauagguuaauacauucacaugguacaaaggaguauacaguaaaacguaaguuggccucccuccauuaaccgccuuccagcuuucccucuccagagcaaccaguguucacaauagcuuauauauccuuccagacaauuuauguauaauaaguaauaacauauauauuuccugauuucauauaaaugagacguauacauacauacugaugugugcuauucuuuuuaaacuuaauuuuuaaagagaucuuuuaagacucaguauaaagaagccaggcgcaguggcucacaccuauaaucccagcacuuugggaggccgaggcaggcggaucaccugaggucaggaguucgagaccagccucaccaacguggagaaaccccaucucuacuaaaaauacaaaacuagcugggugugguggugcaugccuguaaucccagcuacuugggaggaugaggcaggagaaucacuugaaucugggagguggagguugcagugagccgagaucgcgccacugcaccccagccugggccacaagagggaaacuccauuucaaaaaaaaaaaagaaucaguauaaagaaagaggccucuuuuuuuuguuuuuuuuuuuaaucuuuuuuccugguacaugucucuagauaugacucauucuuuuuugauagcuguauacuauuucauuacauagguauauacuaauguauuauaguacuuuuuuuuuuuuugagacagaguuuugcucucauugcccacgaaggagugcaauggcaugaucucaguucaccgcaaccucugccuccuggguucaagugauucuccugccucagccucccgaguagcugggauuacaggcaugcaccaccacgcccagcuaauuuuguauuuuuaauagagacgggguuucuccauguuggucaggcugaucucaaacucccaaccucaggugaucugucugccucagccuccccaaaguguuggaauuacagguguugagccaccgugccuggccaguacuucuuuacugaugcacauuuagguguuucccaacuuuuuuucauuagaaauaugguacauaaacuaucuuuguaucuauaggaugucaucuucaugugugugcgucuguguaauaaaaaggggcuccggaguaagaaucucugguuugaagaauauguauucauaauuuugauggguguuccauauugcucucuguaggccuacagagaugucccuuguagagaaagguacaucucuacucccacccucaacauagacaaauaccuguuucccugccuuucucuacuagugugauuuuuuuuuuuuuuuugguuauguguacugaucuaaucggugaaaaauuauuucauggcauagauuuugugugugugcuguuuuuuguuuguuuuuuuuguuuuuugagauggaguuucacucuuguugcccaggcuggagugcaauggcacgaucuuggcucacugcaaccuccaccucccagguucaagcgauucuccuaccucagccucccuaguagcuaggauuauaggugccuaccaccacgcucagcuaauuuuuuguauuuuuaguagagcuggguuucacuauguuggccaggcuggucuugaacuccugaccuuaggcgauccacuugccucagccucccaaagugcugggauuacaggcaugagcuaccaugccuggcuguguuuuauuuuuuuuuuagugacuucuucauguauuaacaaguuuauaaaagccaauccaugcucugaaauuaugaaaauauuuucuuuucucuucuauuaauauuuuucauuuuaaauuguuggccaaucuagaauuugcuuguuugugggguuuuuuuuuuuuguuguuguuguuguuuugguauguuuuguuuauaagguugugaggcaggguuacuuggucaucccaccaucauguuuauaaucgaucucccacugaacugccaccuuugucauacccuaaauuucugcauguauuuggucuauuucuggacuuucuuuccugauccauugaucuuuccaccaggcuuccuaauauauuuuaauaucuaauagggcuagcccaaccccuugcccuauuauucuuuuucagaguuguccuauucuuauuuuuuaguuuuguagaagaaaaauuaauccacucaauauuuuucuugaagucacuguuucuagcuuaucguagggagaguuuaugucuugcauaucgaguuuuucugucgaacagcauaauguguucacauguuuuguuaguccaucacugguguuuaucuuuguuccucacuuugaaucauucauguuaacugcccugcccccauauugcuaccaauucucacauaucuuguucucauucgucuuguggucaaauggugucacccaugguuuccauuguuuggacaguaaagauauuacaaaugguguuggcugggcacaguggcucacaccuguagucccagcacuuugggaggcugagguaggcaaaucacuugaggccaggaguucaagaccagccuggccaacauggugaaaccccaucucuacuaaaaauacaaaaaguagccacgcaugauguugcaugccuguaauuccaccuacucaggagacugaggcaggagaaucgcucucuugaacccaagaggcagagguuccaguaagccaagaucacaacacugcccuccagccugggcgauagagugagugagacuccaucccccgccccgccccucucuagcccccccgcccaaaaaaaaaaaagauauuauuagugguguuaguaaaaauaauaguaccucuaacuaauccggguguuaauaauaauagcacuggccaggcgcagcagaucaccugaggucaggaguucgagaccagccuggccaacauggugaaaccccaucucuacuaaaaauacaaaaauuagcuggguaugacagcgcacgccuguaaucccagcuacucaggaggcucaggagaauuucuugaaccuaggaggcagagguugcagugagccaagaucgcaccacugcacuccagccugggagacagagugagacuccaucucaaaaaauaauaauaauaauaauagcaccuaccaccuauugaguugauuuuauuugccugguuaucuggaaauagguaaauagaucauacacacacacauaaaauaacacuauuaaagauuaucuccauuuuucaggugagaaaauggaggcugucaaggucacauagcuggugaagugccaggguuagaauuugaauccaagucuuuauguuucuaagauccaugcuuuucuuagacuugcuucagaagcuuccggaaguuucagguacuuaaaaagaaaaagaugaagguugacaauuaguaaacauaaaauagacuuuuuuuaguaucuaggcacuaauuaaacacuuuucuacuuggagaaauaaagauacaucaugaaaauauaaacugugaauuagagguuaauuuaggauuagaaucuaggucuuuugacucugucuagcauuuuauuguccagagagucuguguuugauuuauuuacauguacuuuuuaacacccagccuagagcuuuauauauacaugaugccuaaugacauuuuuugaauuauaagugaauuaucuuuuugcugaucuuacccuguuuagaaguagggaaagugaauauauugccaaagucucuuccagcuuacuguuugcucuacuguuauuuuuucaugcugcugucaaauuuagggaaacuuuaacagaagguuucuuugcauacuaugcauguucuuccaggcagggaagauuaaugcaauacgucaggaagucuaagcucaacuuuucagaaaaggacuuuuuuuuuuuuuuuuuuugagacggagucucgcucuuucgccaaggcgagagugcaguggcgcgaucucggcucacugcacgcucugccucccagguucacgccguucuccugccucagccucccgaguagcugggacuacaggcgcccaccacuaugccuggcuaauuuuuuguauuuuuaguagagacgggguuucaccguguuagccaggauggucucgaucuccugaccucgugauccgcccgccuuggccucccaaagugcugggauuacaagggugagccaccgcaccuggccagaaaaggacuucuuaugggauuguguuuuuugugaagggaagcacaaacuugaaaggaugauccacauuagauuccaauacccgcuccauguuaguuguuccccuggaaaccaaguagaacugugagugacaguguacuugcuaugcugcuacugugaaugggacaguuugggaucccuguaaauaggcccucccuuugccauagugaagccuggucuucuuauaaucuggcuuucauuucuuucuucaguuugcuugagcucaucaacugucuaccagcagcugggaaugucaguuuauggugagaaacucucuuggugugaaacuugaaguaauuuauaaacccagaauucuaacaguuucaaggcccuuguacauaaauaaaauaugcucagcagaugaaaaaaccauuuguuaucuuagaacuugcuacuauuuuacaacuggagaaguacccauuugguaaugucuuuucuuaacuguagugccauuugugaaguuccuuuccucauuacucucaccccacuugcccucugauucaacuggcuucuuuuuuuuuuuuuuuuuuuuuuuuuuugagacagagucucccucugucgcccaggcaggagugcaguggcacaaucucggcucacugcaaccucuggcuccuggguucaagcaguucuccugccucagccuccugaguaguugggauuauaggcaugugucaccacgcccggcuaauuuuuguauuuuuaguagagaugggguuuaaccauguuagccaggcuggucuugaacuccugaccucgugauccacccaccucggucucccaaagugcugggacuacaggcaugagccacugcgccugacuccacuggcuuuuuuuuacuaccaugcugaugaaauuuauugggacuagucacacaacuaaaaauagcuaccauuuauugaaccuuacuauauacucauugccauccuaaacucuuaaccuccaaaaaauacuguguggucauuaccuuguuugagccagaacauuuaaauauucuuugaaaugaaucaagcaacaauugauuauccuacuuuguuuuguuaaauuuguauuuauuuuuuugagacaagguaucacuuugucacccaggcugaagugcaguggcaugaucacggcuuacuacagccucgaccucccaggcucaaguaauccuccugccucagccucccaaguaguugagacuacaggugugcaccaccauaccuggugaauauuuuuuguagagauggggucucacucuguugcccaggcuagucucaaacuucuggccucaagcaauccuuccuccuuggccucccaaagugcugagauucuaggugugaggcaccaugccuggcuugaauauccuacuuuaaaagaagcuucuuccccucauauucccucacccuucacuuguacccucugguugacaaauagcauugggggauucugaacacacuguuaaaauaaaaacuuaguuuugauuuacaguauugcagauauaguuauuucuuuaagauauggaggugacaguaagggggcuuccauucuuuuuuuuuuuuuuaaauagggucuugcucaguugcccaggcuggggugcagugguacagucucagcugacuacagccuccgccuccugggcucaggugauacucccaccucaguugcaaguagcuggaacuacaggugcgugccuccgugcccggcuaauuuuuguauuuuuuguagaggcuggguuuggccauguugcacaaccuagucuugaacuccugagcucaagugauccguccaccucggccuccugaaguguauaaacauugccuauugcucugcaaauagcggacacacagcaugauuuguacuuuuuaguauuuaguuuauucauucauucaguagauaccaagugacauuacuccuacucuaaaaauagacuaauaaaacacauucuauacucuucagagauuccaggguggaaaacagacaguuuuccucuaguaagagaaguuuacuccucugaaaaaggauagaagugugagcuagauccuauggaaauacagagcagaaagggacuaaguuuuccuacaagaccuagagaaaucuucacacaggagacucugaaaguauggcuaagaguuugcugagcaaauuaagguaaagaauucuaggggacagcuguguaaaggcaugcauagugaagugcaggugcauggaauaaagucaaguuuggggaaacagggacaucuguuaaacauuuugagaugaaauuggggaaaagaaaguaagcuccuaaaggauccuagggguauugugugccucuaaaagcagaagaucuuagauuuuugcuugaagaaauggguuaucuuucuaccuaguuuaguuggaugauucucuuuucuuuuggggagggcuaugggaggguccauacuagacuuaaaagaacaaagacuugauauuuccaaguuguaguuuuuagaguuguuguuguuguuguuguuguuguuuugagacagucucccucuguagcccaggcuggagugcaguggcgccaucucggcucacuguaaucuccaccucccagguucaagcgauucuccugccucagccucccaaguagcugggacuacaggugcacaccaccgcacccagcuaguuuuuguauuuuuaguagagacaggguuucaccauguuggccaggcuagucucaaacuccagcaggugaugcgccugccucagccucccaaagugcugggauuacaggccuuagcuaccaugcccggccuuuagaggauuucuuauccauaagcauuuucaugucuuugguucacauauaucagauuauucgccucagcuuauucauucugucuguuugcuucucauccuuuuuuuaaucagggagaaucaugauuuauuuucuugaguuaaaacaugagaaauguuucuaaaauguagaauaugguuucugaaauaguuuuaccuuuauguauguaugucuaaacacuuggaacguuuacuuccagggaagaaacuagauuauaacuugacaacuuuaucuuuuauuaacaaggagugagugucaucaaucauuguuaauaguagaauuauugacuuucauuguaaugauaauuguuuccuggaggcaauaacugggaacaguuggucaaucuggaaaguaguguugccuugguaacugauaagaaagaaugcagagaaacuaguugucugucauguauaaaaaccaaggcccugaacagguuaaauacuaacuccaagcacaaggcuaaaacagaaauaucugccaguacauguacugggauuagagaccugcaggcuuugccaagaguccuggaaaccaccuucugcccagacacacaggaauccaugcgcuuucuucaaacucagacagaauggaauagaacuucacaauauuuagcucaaaggacauuccagaucaccaccgcuuggguuggguugaagacagcuuuaaugauggaacggaucaggucaaaugaugcagaugcaguguaaaaggaaacuacccauccuuucacugagcagaucuuuuuugaaagcuuauuuacugugagucaagcacugugcagugcacccacauggcacaaaugcacaguucacauuccuaccuucuagaagcuccugggaaagucauauaaauaaaagauuacagugugguuucuaaauucuaaaaagagauagaguauuaugauaauauaaagaacucaggagggguucaaagagacuuugcagaggugagugaguaggaauaggaccuagaggcaaggggccgggugcggugguucacacuuguaaucccagcacuuugggaggcugaggcaggaggaucaccugagguuaggaguuccagauuagccuggccaacauagugaaacccuguguauacuaaaaauacaaaaauuagcuggguguggugauuagcugggacaccuguaaucccagcuccuggggaggaagaaccuagagacaaggaaucccaguggcagcugaaucuaggacuuaguccuucugguucuuaaguguguuucuuuuuaccuaggcaggcucacccuuuucaaacuucauguauuuaccucauccaccaacuugauauaauuuuacaguggcugggagauuggaguuucuugcuguggcuauuuccuguggauaaaucugcaucccugauugagauuaugucuguaauucuuauuuggacuggaguacugaacuggccauucucaggguguucuguggguuguuuuguuuuguuuuuaaacaaggucucugucgcucaggcuggagugcaguggcgugaucauaguucacucacugcagccucagacucuuagguuuaagugauccuccuucuucagccucccaaguagcuaguacuaugggcaugcaccaccacaccuggcuaaaaaacauuuuuuucuuauuuuuuuuguauagauguggguccugcuauguugcccaggcucuugaacucuuggccucaagugguccucccaccuaacccuucuaaagugcugguguuacaggcgugggcuacuaugcccagucuuucuugaguuuuacuaauuauucuauacuaggguuuccccaucauuugucauccagguggcauucaccucauuuggggugcaacaaagccauuaauuauucuuccauuuaauaucuuuguaugccuugcaaaagcaauaguguaaucuuuuuuuuuuuuuuuugaggcggagucucgcccuguuggcaggcuggagugcaguggcgcgaucucagcucacugcaaccucugccucccggauucaagcaauucuccugccucagccucccggguagcugggacuacaggugcgugccaccacgcccagcuaauuuuuguauuuucacuagagacaggguuucaucacguuggccaggauggucucgaucucuugaccucaugauccaccugccucugccucccaaagugcugggauuacaggggugagccaccaugcccagccuaguguaaugaaacuagaagcuacucugucccuucccccucuguaaaagcgucugguucucugcuuuuucuuagugaggcugaaucugucuuccuacucagaagccacaugaaaggaaacuuacagugcuaaggcaccauagaaagauauuaacauaaaucuaaguucucuuaagacuggaaauuagaaacagaaguuugcuaaggaauaagucacccacaucuuacucuuugcauaauuaaagcaggaccauucuuucuuuuuuuuuuuucccccccccgauauggagucucacucuguugccuggccuggagugcaguggugggaucucggcucacugcagccuccaccucccagguucaagcgauucuccugccucagacucccgaguagcugggauuacagguaccugccaccacacccagcuaauuuuuuguaucuuuuuuuaguggagacaggguuucaccauguuggccaggcuggucucgaacuccugaccuugugauccgcccgccucgaccucccaaaguacugagauuacaggcaugagccacuacucccggccucaaacaagaccguucuuaagauauaaaguaaacaccgaaaccaagugcauugccucuuuuucucccuuacuucaaacacgcguuugcuccccuaaacacacauacauacacacacauguguaugcauacuguguauuaauuugggaguuuuggagugaucacaaaagaauuaaauuauaauuccaaauuaaaguuugaaguacuucaaugaucacaaaaaagauacauugggccgagcgcaaugcccacagcuguaaucccagcacuuggggaggccgaguugggcagaucaccugaggucagaaguucaagaccagccuggccaacaucgugaaacccugucucuacuaaaaauacaaaaauuagucaggugugguggugugggccuguaaucccagcuacuccggaagcugaggcaggagaaucgcuugagccugggaggcagagguuguaguuagccgagaucaugccacugcacuccagccugggcaacaaagcgagacccccucucaaaaaaauaaagauacaucgaaaaggagagucaucuagugacuaagauuaauuuuugcucagcgguuugggaagacuggcagucagaaaccuagcaucuucuuuguggcuuuuccauuaaguuuucaccaugugaucaugggcaaaccacuuuuuuucucuggacaccauuuuguuccucuauaaaaugaggggucuguuagggaagccucagcauucugacucuguacugucacacauacuuuagugucuuugcaguacuguugauggauauaauggacccuuguccuaaaagggauucagggaauagguuauuuacuuuccuuaggcagugccccagauuuugaaauuuagcuuuucuuuuucucuuaucuguuagugauugcaauuacgauuuauauguuguuucuugugaguaguagugguuguuuuguuuuguuuuugucugucuuuaccagagugcagcaguucuccaguccagggacuuaggcuuucucacuuuuguuguuguuguuguuauuauuacuacacaucagauucccuauagggaguaggaaaaccuacuucauauauauauauguacaguuucuugguuguuuuuuuguuuguuuguuuggagauggaguuucgcucuuguugcccaggcuggagugcaauggcaugaucuccacucacugcaaccucugccucccggguucaagcgauucuccugccucagccucccgaguagcugggauuacaggcaugugccaccacgcccggcuaauuuuguauuuuuaguagacacgggguuucuccauguuguucaggcuggucucgaacucccaaccucaggugauccucccgccucggccucccaaagagcugggauuacaggcgugagccaccgcgcccggccuucuugguuguuuuuuuaaagcuagcaucaguagauacauuauguauuuguguguuuuaacuacuuugucaaaugcuuuuuauauauauucccucaauccucacggcuauguguuuuguuguacucagaccccugggugaccaccaaacuuaucuguaugccugagcaccuggcugacaugaugucuuggguacucgccccuucuaugggcuugaacuucuuguucugaccgcccccccaccccagauugcuucuuucaacucucugucuccugagccuuguaacuaugaagccagugcuuggcccaguugcuagauguugaccucauaauuauauuuuuucaguuugaccacauuucugaucuacacaguaugaacuguagucuggaauaugcacuucuuugugccugacuagcuucauucuucugguuucugcucuuggucuuuuggcugguucacauuuugcagucugcuguuuauggauagaauuacugaggcagaauaugugauaucugaagguagcagagaccuguaauuuuaguuauugccuuagcuguuggguagggaugaacuagugaagugggucuggguaggcuggccagaacuaaaaauaauuuggcuauaaggaacaaguuucuaugcuuguucuuugccuugguauuuuccacuucuucagaauauaagggccaacuaccacuuucuucagacaugcugcaacguccgccaugcccagucaugccucugccaauaggcagcacucccgcaugagacagaaagguuacugaagauacugccuaguggagucccagguugaagucauacuuugagcuggacauagcagugggccugugauuacuugaauggcuguuucaacuucagaagugaaagugguaaaacugaauccaagagcaccuuaaagauuccccuccuuuuauagaggaagaaacugaagcuaagagcaguuaaaugaguuucuaagacucuuaacuauuaagugacacagauuuuaaaaucuggccuucugacucaaagucaaauuaauuuuuuccccaccaugucaguaaauuaaggguguauaugugugugucguuuguggggggugacuaguuuacacagaaugggguuguugaggcuuaccugauuucuaagguauuuuccagaguuuuccucugguauauucagacuguauuacaacaauaucuuccucacccccuuuuuuuuuuuuuuggacaggguuuccucucacccaggcuggagugcagugaugugaucacggcccacugcagccuugacuuacugggcucaggcaauucucccaccucagccuucugaguagcugggaccacaauugugaucaccaugcccaccuaaauuuuuguacucuuuguagagacaggguuuugccauguugcccaggcuggucucaaacuccugggcucaagcaaucugcccaccucagccucccaaagugcugggauuacaggugugagccauggcacccagccaucuccagacuuucauaauuuuccucacauauuguacauacuuaauuauauuauucaauuauauguauaaaaaaagaaagcaagaauucaacuauguuguauuaccaaggccuuucuguacccaaucucgccucauauuuuuucuuuuuuuuuuauuuuuugagacggagucuugcccugucgcccaggcuggagugcaguggcgugaucucagcucacugcaagcuccgccucguggguucacgccauucuccugccucagccuccugaguagcugggacuacaggcacccaccaccaugcccagcuaauuuuuuguauuuuuuaguagagacaggguuucaccauguuagccaggauggucucgaucuccugaccucgugauccaccugccuugggcucccaaagugcugggauuacaggcgugagccaccacacccggccaaucauauuuuuucuuguuacuaauuagaaucaugauucuccuggcauucuucauuuuguuauaccucacuuccuuuuccuuagcaagaucuuugccauagaguauggaaaccagguuccuugccaguuaaucuguauugugcuuugucauguauuguuacuaaacagcucaagaucaaggggaagaaauguauaugaggcucaguucauguucaguuuuuuuuuuucagcauugcaacauugccacucaucaucaugaguguagcccugugucagguacugaagguaauggaaaagguauauaagguugaucccuguacucuuguugggaacuugagugguaugaauagagaaggugaguucuuggggacagaggcuacaguuuagcaagcuuuccuaugcggaccuugguaauuucuuuacauuuuauagaccaaagaacaaucuuaacuugcccuuuuuucuaaaggcauuguuuaaaaacugucaucaaaucauugcaguuuauggcaaauggccuuuuuuuaaaaaaaaaaaaaaagcaaucuaaaucuuuucuucaucuuggaaaaagacuucucuuggauuucugauagaauauuuccaguaugcuauguuauugcaagacaguaacuuacagcuagacaagaaaaaucagcuuuguucaaaguaagaguauagccuguccuuauaguguaauuuuuuucucacaguuuuguuuuaugguuccuucaguuugaauauacaauauuugagcucaaagcccagggcagcaaaggaccaugcugaguuaaaugggggcaguaagcucuggugaguggggaaaacuccaagcuacaauuguuagagucccuaagucuggaggucagagaaagaugcacugcccccaguguguucacaugacaccuaacagauuauuaggcuggaaagagcagggcuugguaguggagggagcaacccagcucauccaaggaaccaagugggggcagggacaggcguaaaugcauaagggguauguugucacacaaaugucuuauaauuagaauaucuauccccaaagcccugaucacugaagucuuuaaaugaacccuuuauuaaacucuuccauuaugcagagcuacagauggagcucuuacggguuuuggggaccccacucaagucaguuuucaaguuaguuugauaaguugcuaugacagcaaacccacucuuccucugagaaugaaugccugcaaucuuaauacuacguuaaggugugguuuuuuuuuuuuuuuuuuaguccaauuuugaacaauuuccuggauucauuguucuucaggguuauagcuggggauuggcaaaugagucucgguuauuuuuaaaacaguuuucugagugguugaauguggaagggugggcaugguaucagauaaaugaguguguggguaugcacguaucuauaucagugaaagccaaaauaauuacuauccuuagugcuuggauuggcaccauacuguguuuuaaauugcagaucuaaacagagugcuaguucacgggaaauuacauucucagauuaaaguagcauuuuguugugcagaaagcagcagguuccuuccuuucuuucgcuuucauucauucuuccuuucuuucuuucuuucacauuuguaagugcauuuaauacucaacugcuugaggagagaggggcauugagggagagaugaauuuugucaugaauacuggggaauuggugugaugucacugcaagcucugugugaucguaggugguauuagagcuccaggagcgaaagcagggagagcaguggaggagagacgaugucgcucucagacaagcagacagccucucucacugccgcguacggucagcucaguaagggcaagccugcagagugccgaauggacuccccaaaagaaaucagucaagccggauucgaauggcagaggacagagggcaaacugaaugaaauugggcugaaugucagcauggacgggcaaccaaaagaugggcuugugaagaaugccagcuuccuggagcagaacaagcucugcuuuuuugaggggaagcuagacaaagagcugagcauugaaaugcaggacaaggacugucaagaagccucaggucaccuugagagcagguaugugauuucagagaccugccaucccuuggaggggaacucgguacaccagaagaccuccgaguuccaucugggacucauagaggggccagacaaaaacaaaaccauuccaguucaggggaagguggcagggaagaauggacuagagaccaagagccagucagaucuggauuucccuggggcugcugacaucccuaccagauauguuaaggagcaggaaaccaguguuuggaaccccagcuuucauccaguggcucaaggcucucugggcucaagggaagcaacuccgggagagauggagaauagcaucaccccuggcugcccagugauuggggugguaaaugauaacucugagcagcugaagugugaguccccacuccuggugucucuagcccacccagcccccauuauugagcauucacccaccaccauuccgccaaucacuaugguguucacccaggaacauuugaaugcaagcugucacaucagagaccaugauaaggaguuggagaaauugaguucuaccgaggaggcugugcucaaccaagccccccagcagaaaaaggcagugcgcagggcccugucugaauguucucaccucucaguucccccagcugucaaccuugcagauaaguacccugaacucccugcccgagaagagccuucuucuggccugcugccucccccuaguagcccaaugccuaguccuacaccugggaaacugggagcuccugcuaugaagcgcuccaugacugugggugaggaacagacagcuagcuacaaauugagcccugggaaacugcccaucuugucuacuaaagagauaccuccuuucaucugugaggaaccaguggccaagaagagagaagaauuggcucacuucagcaacagcagcagcaacucugggaagaaggaacucggcacugcuggauuauaucuccauaguaagcuggagcagauuccugaaggaagcagcaaggaaaaagggcaggaagauuuuagugaaacuagaauugauucaugcucgcagguuugccagcgaggagagaaacagccaggacagacggcucuggcagggaagaaagaaauugaggucacugcaacccagagcacuccaucguuccuguuugaaaagcccccacgugaugguauguuucuaaauuuugccuccauugggaacaagcagacagcaaggaaggaaccaaagugacagauuaccggcagagcacuaagcagcuuuuuacagcuggguucugugacugccuggggaaagcuuaauucccuuguguuggaagcuugcugggagugaggcaaggaagagaacaaagugaaucuugcagggucaagcugaaugucuugcuagcaugacagauaaugugaauugagugugcaaguuugggguggaauggggucagagaaugguggguauaaaaacuagacccccuuucuugaccucaugucacccuguccaacccaucccccauccacccagcccucagcucccuguugguuugaaccagaugauuccugagcucuaaauccuucaaucccaacugauugauuuccuugcuugaaaaucugucacuuuauauagauucacaauggguuuaucagcacuaaccuccucucauuaaguugcacaaucuggguggaagcucuguuuucuguuuuugcuuuggagaacguuuuacuuuuguucaaacugaaaaagagcccuuuaaagcuagcuauuuaauauucuuucuguguucuucauguuugacccaaucuugcuucuaguuuucucuuuuuguauguguuuugagaggauuuguggggagaaaaagaagaaagagaaagcagggagagaaggagagacuugcaaccuaauaaacagcuaaauuuugcggucuuugugacagccuuuugugucuuucuuccuggcccuuucuuuucuuccccaucucccauccccccacagcucuuauugugguggucuaaaaaagcuuguguuucuccgaguccaguuugagcacaaagggccauaauucacaaacuuguaaauggggauuuaaaacauguguuuugcuuguuuaaaaaaaaauagucuuguuuccugggaccuguuuucucuaauauuuauuacucucaguauauuuuuaugaaauuguacuuuuuuucuuugaaaguaagaaaugguauuuucuaggggagugguaaguagaagacauacagauguuuuggguuuuuuuuuuuuauggagauaaaaaacauuuuuuguuuuuuauggagauaaaaaacacguuuuuuuauggaggcaaagaagcuuaauaguuccucuuugauuucuuaugacuccagaauuacaagcauucaggugucccaugcuguugcuuccuucuagcugggacagaacuguaagcucuuccuggacaggacuuugucaucuuuuucuugauccccaggugcuuuguucaguaccacauaacuucuaggugaucaugagugaagacuuuguuucagaacaaguucuuucuaauucagacuaacagaaguuugugcuaauagaaaaaaauuucagaugacugacaaauccaccgauccauucacccgauaaauguuuaaaugcugacucugcuaaccacucuguagauaaaacuuuuauaggaagauuguuucauuuaacaugccuaccauuugcauucacuaucuaggcacuggaaauuauccuuauccucaagcaacuuuugauccaguuggaggacugggaggcagugggaggguugugaauuguggaaacauuuuggaggaagucacauuugaggugggccuuggaacccugggaugccaaauaaugcggagggaaagccuuccaggcaagggaacucauauuaaacaaagauaugaagccuagacagcucauguuagguaaaagaacaauggaggaaucucagggcauccagucacaggaaauguggccaggcugcugccauuguguauaucucucuugggaccucugcuucucccugcacauguacuccauucucuucccuuuaaaaaucuguauuuccucugucaucucuuuuugcuucccuuguaacucugcccaggacagaauagcauugaguugccaugguuugagcucuguggccagcuuuguuaccaccauauaugucaggguuccgauguugcaugacugucauuuccaugucuuugucuauacugacaaugagugaguaauuauaucuuauuggcucagcuugguccagucaacucuauaccaggucccauagccuucuuaaccaaucugagccauuuagacccacccgcuucauucaccuugaggcuucucuaaaggagagaguauagguuaaggaaauauuccaaagccgucuuuacauaugugacaagaaauaaugggagaaaauucuagaaaguuguuuggaauccaaucuugcuaagcuucaaaugucccacugaaaaguuuaaagcuuacuacugugucuggaauugguggguucuuggucucacugacuucaagaaugaagccacggacccucgcggugaguguuacagcucuuaagguggugcgucuggagucugucccuucugauguucagauguguucggaguuucuuccuucugguggguucguggucuugcuggcucaggagugaagcugcagaccuuggcagugaguguuacagcucuuaaggcagcgcgucuggaguuguucguuccucccgguggguuuguggucucacugggcucaggagugaagcugcagaucuucgcggugaguguuacagcucauaaaagcagaguggacccaaagagugagcaguagcaagauuuauugcaaagaacgaaagaacaaagcuuccacaguguggaaggggacccgagcggguuaccagugcuggcucgggcagccugcuuuuauucucuuaucugggcccacccacauccugcugauugguagagccgaguggccuguuuugucagggcacugauuggugcguuuacaaucccugagcuagauacaaagguucuccguguccccaucagauuaguuagauacagaguuucgacacacagauucuccaaggccccaccagagcagcuagauacagagugucgauuggugcacucacaaaccuugagcuaaacacagggugcugauugguguguuuacaaaccuugagcuagaugcagagguucuccaaggccccaccagagcagcuagauacagagugucgauuggugcauucacaaaccuugagcuaaacacagggugcugauugguguguuuacaaaccuugagcuagauacagagugccgauugguguauuuacaaucccugagcuagacauaaagguuuuccaaggccccaccagagcagcuagauacagagugucgauugguggauucacaaaccuugagcuaaacacagggugcugauugguguauuuacaaucccugagguagauauaaagacucuccacguccccaccagacucaggagcccagcuggguucaccuaguggaucucgcacuggggcugcagguggagcugccugccaguccugcgccguggugcguucgcauuccucagccuuugggugguugaugggacugggcgccguggagcaggggguggugcuugucagggaggcucgggcggcacaggagcccauggaggggugggaggcugaggcauggcgggcugcaggucccgagcccugccccgcgggaaagcagcuaaggcucagugagaaaucgagcgcagcacuuaugggccggcacugcugggggacucaguacacccucugcagccacuggcccgggugcuaagucccccauugcccggggccagcagggcuggcuggcugcuccaagugcggggcccaccaagcccacgcccacccggaacuccagcugacccgcaagugcugcgcgcagccccgguuccugcucgcgccucuccuuccacaccucccugcaagcugagggagcuggcucuggccuuggccagcccagaaagggggucccacagugcagcggcgggccaaagggccccucaagugccgccaaagugggaacccaggcagaggaggcgccgagagcaagcgagggcucugaggacugccagcacgcugucaccucucacuaccauguucugaaacuguggugacugccuaugauagcagauaaaguagcuccaggucagcuuuaggaagauuuacuuguucucaguaagugugaugaacuggaagacaaagaguugaaagcaaacaauccuguuagaaauuugauucagguaguggcagaugaaacgcugaggauaugagaggggaaauauaacaggugaagauaaagugaaacuggaauuuggaaggugugugagaaaaaggaauugaaggucaugcugugaugugaggcugguuuucccagccagugguaguauagguaauggaaagacccaacagaagagcacaguucauugaaggaguuaguaaguuccacaucagacauugcuuuugugaaacucuggggauaugugggugguggucucuagaaauugccugauagcugggcuugguggcucaugccuguaaucucagcacuuugggaggccuuggcaggcagauuacuugaggccaggaguuugagaccagccugagcaacauggcaaaaaacccaucucuauggaaaaauacaaaaauuaggugggcauaguggcauguaccuauagucccaacuguuugggaggcugaggugggaggauugcucgagcccaaaaggacaaggcugcagugagccaagaucaugccacugugcuccagccugggagauagaucaagaucaggucucaaaacaaacaacaaaaaagaaguugccuuauauauccaugagacaagggaaagggcuuggugagaacuaccuucugggagagagaaagcaguuucugcuuaugcacaguuacauuuauuuguauaggucgaguuacugcaugccuguaucauagacaaugcgacuuuaugaaauauguuguuuacugaaaaaugcugaacuuauugaaaaauauuuauaguggucuggggccaguggcagcuaguuacacaaguaagaucuucuuugagcuugcuguagaacaaaggcauuagccgggcgcgguggcucacgcccguaaucccaacacuuugggaggccgaggcgggcggaucaugaggucaggagaucgagaccauccuggcuaacacagcgaaaccccaacucuacuaaaaaugcaaagaauuaguugggcgugguggcaggcgccuguagucccggcuacucgggaggcugaggcaggagaauggcaugaacccaggaggcggagcuugcagugagccgagauggcgccacugcacuccagccugggugacagagcgagauuccgucucaaaaaaaaaaaaaaaagaacaaaggcguuaacaaauuugcacaguuguuggcuaugguuuuuccccauuacauuuuaaaacuagaaaaauacucaguuuuugacuaaaaguacauaugguucaaacaucaaaaaguacaaagugcucuccauuacaaaaaccuccuaccaagacaagaugguaucaucucauuguuuucugcuccuccccuguaaauacaacuaaauagucuggaaauaauugaagauaauuccauaaaagaauaugagguagaaagaaggcaaaccugguagggaucucaggacuugaggaauggcaauacagugaauucccugggacugaugaauugauugauugauugauugauugauugauugaugguagagaugggaucuugcuauguugcccaggcuagccuugaccucuugaccucaagugauccuccuugcuugaccucccaaagugcugguauuacaggcaugagccacugcguccauccccuggguuuucuuuuugucuccuacauaucccuggcugggcacuggagaggccuguaaccuggaauuaccaacaggcauagacugaaaagaaaaggaaaggaaaaaagaaaacaaauagagaaaaucuguucucuauugccaaaaaaacaagaaagaaaaaaacccagcaaagaccuaauggugagcccuguuucacuacccauccccagcagugggcucagucugccugcagguacagugucaaugcagcccauaagggccuuccuguuguccacuccauacucagcagaagcuauaggccugguccgcccacaucaccagcaacugcagggaggccuguccccuaccagguaacagcaccaguggcuucuauagcccuggugucuuguaauccucuacccaggggcaggagacuuucguagguuucagaaccucuacuuccuuccccuuagcaagagaaagcccccgagguagguguuuccugcucccagcaaccccagcagagaucaaacaggaggucugccugggucccaggcagccagagagcaguccagaggaagcucucuauucuauguuuccagcaucacucagccccuaugugcugacacugggugacacagguaagucccuacagcccuuucaggcaguaccaaaagggauuaguuagaaccuuagcagaaucagaacacaacaggccauaaaugcauugcaagggcucuaggaaccaaauugucaucagaacuacagucauaaccuguagacuaaauauaaacagggugauugcaugcuaaaguacaaaaucagaauuuuaaagcagccaucauaaaagugcuuuaacaagcaauuaugaauucucuugaaacaaaugaaaacuaaaaaccucaguaaagaaauagaaguuacauaaaaagaaccaaauguuaauugucaauaugaaaaauauaauaauuaaaauuaaaaacuucaaugggcucagcagcagacugcagauaacagaggacagaaucagugacguugaggacagaucaauaggauuuauucaaucugaacaacagacgaaaaaauggucuacaaggaaaaaacauaucuucagacccaugggacaauaacaaaagaucuaacauuuguaucaucagaaucucaggagaggagcaaggaugcaaggcugaacaacuguucaaagaaauaaugacaacaaacaucccaaauuugacaaaagacaaaacuuacagauucaagcaacugaacaaauaccaaauaggauaaauguggagaaaucaugccaugacuuuucauaauuaaacuuuuauaaacuaaagacaaaaaucuguaaaaaaagcaaagagauaugaugcauuagggaaacagcaauuuuuuuuuuuaaccuuccuuauggugcugaggaaacagcauuuaaaugacagccuguuucuuaucagaaacuggggaaugcaaaaagaaguggcacaacauuuuucaagugccaaaagaaaagaacugucaacugcaaauuauuugguaaaacaauccaucaggaaugaaggggaaauaaauaaaaaagacauuuuuagauaaaggaaaacuaagaauuuguugcuaguagacauacccuuagagaauggcuaaaggaggcucuccaaaaaaauaagauuugguaacagaaggaggcuuggaauuucagaaauaaaagaacaacaauggaauggguaaaaauauggaaauagccagguaugguggcucaugccuguaaucccagcacuuugggaggccaaggcggguggaucaucugaggucgggaguucgagaccagccugaccaacauggagaaacccccgucucuacuaaaaauacaaaauuagccgggcguggugacgcauaccuguaaucccagcuacucaggaaggcugaggcaggagaaucgcuugaacucgggagguggaggucguggugagccaugccacugcacuccagccugagcaacaagagcaaaacuuggucuccaaaaaaaaaggaauauaauagacuuaucuccucaugaauuuuuuaaagucauaaaucauauuugaagcacaaauuguaaugccaucugauguagugcuuaaucuaugaagaggaaacacuuaagacauauuuuagggcugggcgcaguggcucacaccuguaaucccaccacuuuuggagaccaagguggguggaucaccugaggccaggaguuugagaccagccugggcaacaugacgaaaccccaucucuacuaaagauaaaaagaaaaauuagccaagcaugguagcgcacacguguaaucccagcugcucgguuggcugaggcaugagaaucacuugaaccugggaggcagagguugcagugagccgagauugugccacuacacuccaaccuggacgacagagugagacucugucuuuaaaaaaaaaaauuaaaguagggagaaaauaaaggauccuaaauggaaguaagguuccaguaggucacucaaaguaguaaaacauagcuggguguggcggugugcaucuguagucccagcuacucaggaggcugaagacggcaggaucacuugagcccagaguuugagaccagccugagcaacacagugagaccccaucucuagaggaaaaaacaguaguagaacauugauaccaguuuguuguauguauauuguaauaccuagagcaaccacuaagaaaacuauacagagcaauauacucaaaagcuuuuuuuuaauaaaaauagaauucuaagaaauguucagguaaccuugggugagauguaauuugaaaaaaugaaaaaaggaaauuaaaaagauuaaaaauguucagguaaccaacaggaaggcaggaaagugaaacagaaaugagaaaaagagagaacaaauaaaaaauaaaauaucagacuuaagccuuaacauagcaguaauuauuuuacuuuauuucauuuauuuuuuuauuuacugagauggaguuucacucuugucacccaggcuggagugcagugguacaaucucagaucacugcaaccuucacuucccagguucaagcgauucuccugccucagccucccaaguagcugggauuacaggcgcccaccacaacgcccggcuaauuuauguauuuuuaguagagaugggguuucacccuguuggccaggcugaucuccaacuccugacuucaggugauaagcccaccucggccucccaaagugcugaauggauuacaggcgugagccacuguaccuggccaucaggaauuauuuuagaagcaaauggucugaguacuacaauuaaaagacaaagauuggaagaguauauuauuuuuaaaaaaugacucaaguaggccagguacagcggcuccugcuuguaaucccuuuaggaggcugaggcagaaggaucacuugagccuaggaguucgagaccagccugagcaacccagggagaccccaucucuacaaauaauuuaaaaauuagccaggcaugguggcacaugccugugguccuagcuauucaggagcugagguaggaggaucacuugaaccgaggagguagaagcuacagugaguacagucagccaugaucacaccugucuuaaaaagaaaaaaaaauugcccaaguauaugcuaucuacaagaaaugcauaacaaacauaaggacauagguagguugaaaguuaaaagauggaaagaaauauaucauguuaacaauuuuuuaaaguagcaguagcuauauauaaugauuaugcauauauauauauauauauauauauauauauauauauauauauauauauauaguuguuuuuucuuguugcccaggcuggagugcaguggccugaucauagcucacagcaggcuugacucgcugggcucaagcaaucuucccaccucagccucccaaguaucugagucuuauaggcauacaccaccaugccccacuaauuuucuuucgauuuuuguagagaggaagucucacuuuguugcccaggcuagucucaaacugcuggccucaagugauccucugccucagccucccaaagugcugggauuaaagauuacguguccuggagugacuauacuaacaucagacaaaguagaugucggagaaaagaauaaaggaucaaucccacuaagauugauccuuacauuuagaaaacuuagcaauucuaaauguauacacaccaaaaaacagagcaucaagauauaugaaacaaaaacugacagagcuaaaaggagaaguacacaaagucacaauuacagcuggggacuucuguaacccacuaugaacaguugauagaacuacuagacagaauguuaguaaagauguaacagugccaucaaacaacaaaaucucauaaacauugauagaaauuccacucagugacagaauguacauucuucucagguguccauuaaacacucaccaagauggaucuugggucauaaaaccaacuugaaucaauuuaaaagauugaaauuaugauggggcauggugguuugugccuauaaucccagcacuuugggaagcugaugugggaggacugcuugagaccggucaguuugggccacauggcaagaccuccaucucuucaaaaaaauuuuuuuuguaaauuauucagguaugguggcacguaccaguagucccagcuacuuggaaggcugaggcauuagggucucuugagcccaggaguuccagguggcagugagcugugaucaugccacuguacugcagccuaggcaacagacuucaucucuuaaaaaaaaaaaaaaaaaaaaaacugaaauuggaauuauuucagguauacaagguuagugcaauaaucaaaaguaauugucagccaggugugguggcucacaccuguaaucccaacauuuugggaggccgaggcagguggaucacgaggucaggagauggagaccauccuggcuaacauggugaaaccccaucucuacuaaaaaugcaaaaaaaaaaaaaaaaaaaaaauuagccaggugugguggcggguacuguagucccagcuacuugggaggcugaggcaggagaauggcaggaggcggagcuugcagugagcugagaucacaccacugcacuccagccugggcgacaaagugagacuccaucucaaaaaaaaaaaguaaucuguuauagucugaagaaaauaaauuguaaacacagaaaaaucguuuaacagaaucaaauagccauucauguuaaaacucucagcaaaguaggaauagagaggaacuuauuuaacuugacaaagagcgucuacagaaagccuacagcuaacaucauauuuaauggugaauaagugaauacuuucuaucuaagauugggaacaaggcaaggauaucuacuugcaccacucuuuuaaauauaguguacuggaaguuacuauagagauggagaacauaguaguugccauauauuuagggauuggaaaggggaugggguagauauggcuauagagggguaacaugaagaagcccuauugauuguaaccagccacuccaggccagguaaucuguaaucccagcacuuugggaggcuaagguggugguggugguuacacaaagcuacacuugauaaaguugcauagcacuacacacacaaacacacacacacacaaaugagugcauguaaagugaaaaaucugaguaggcucuguggguugucucuguuucuugguuuugauaguauacuguauuuacguaggauaucaacacuuggggagacuggguaaaaggguacacagggaccuucccuauguauuucuuugcaacuuccuaugaaucuguaauuauuucucaaaguuuuaagccuccuaaccuccccaguuuugugucccauccuuucccucaaaaacguuguucuguuuaauuacaauccuuucaaaaauucuuuuaaaaugcauauauaaguguauuugcaauaucuuuucccucaucccuuuucaagacaaauaguuucacauuauacuuaugcuuuguuguuuuuuuuuucacuuaauagagaccauugcauaguaaucauaaaagaauuucuccaugcuuuauuuuuucacauucagagauuacauugauauuucuaccauaauaaccaguuuucuauuaacggacuucuggguuguucuuuugcuuuuagaaacaaugaucugguggaaaccuugcacauuuacuauuuggcugguguguaaauacacuucuaggauaaauuacuagaaauugguuuucuagauuagaauuuaucuguccuuguaauuuucagaaaaugacacugccaggcagcccugccuaugggucauacaguucacauaccuaccaaguauauuucccuauauuauucucaguaguuauuuuaaaauuuuaggacuuuugacaauauguuaauauuaauggcauuucaggccaggcauggugguucaugccuguaaucccagcacuuugggaggcugagguggguggaucacuugaagucaggaguuugagaccagccuggccaacauggugaaacccugucucuacuaaaaauacagaaauuagcugggugugguggugcaugcuuguaaucuagcuacuugggaggcugaggcaggagaauuguuugaauggggagacagagguugcagugagccgagaucgcagcauugcacuccagccugggugacagaucaagacuuugucucaaaaaauaaaauggcauuucagugggguuuuuuuauuuuucuuauacuuaacauuguacaucuuuucauaguuucaaaaaacuuuguaucucuuuucuauaaagucuguucauauuguuuugcauuuucccaguggauuauuggccuuuguagcaguuacugauuugugggaguaauuuauagaauaagcucuuugucuuugguaugagggucaaguauuuuuucuguuugucauuugccuuuugacuuuuauuauaguguuuugucuuauuuuguuuuuugccacauugaaguuuuuuauuuuucuuuagucaaacuuaucucuuguggccucuugacuuugugccaguuagaaaugccuucccccacagcaagguuauacauuucacaguauuuuaaugcucucagguauaguccuauugaaauccagaguaaccucuccacagagaggaggcuauguugccuuaggcaggagacuuuauuucuggcccugagucugguuccaugggucuccuuggccuuguugaaaaucugggucacuguuagaacuggaucagguuaaucucacauccuccauaaagugguucuuuauagggaaaggaaggaaagggagucauugaaugaucuucuggcucuuaucccaucucacagcaaccuuuauuccaaagauagacugguagaagagguuuuuguccuauugcuuggagagcuagugguuggaagacagagucccuuuggucucuagggaagggaaaccaaacuuaaaggaccauuuuuuuccacugaucauuugugcaugugucccuuagacugcuucuccacagggucaggcucucugaaucugaggaaucuaaaacuguccuccaucacaaugagaacuugggaggcuuguccacauuucagcagcacaacccuguggacuuuuuucagaaugaagugcuaguuaguggucugucuuugcuaaaccuuguauuuucaaaaugggcauguaaaauguuugcuuagcauaauucccacucacccucuccccuuaggaauagccaggccagaagaaggaaggccuguggugagugggacaggaaaugacaucaccaccccaccgaacaaggagcucccaccaagcccagagaagaaaacaaagguaggugccagaauggugguuaucuucuacugccauaauuuuuaaacggaguaucuucugcuguuauugcuugaaucacgaaugaaauuucuuuuuucugagcuguuauuguccuuccucauguuuggacaugcuuagaaaauaucuuguauucucauuuaccacaguggccuaaaccaacuuuaaaaucucagccuuugacccuauuaucuuauauaucuguaaaaaauguucuguagaggccgggcaugguggcucaugccuguaaucucagcacuuugggaggccaaggcgggcggaucacaucaggagauggagaccauccugaccaacauggugaaaucccaucucuacuaaaaauacuaaaauuaacugggcguggugaugcaugccuguaaucccagcuacucaggaggcugaggcaggaggauugcuugaaccaaggaguuggagguugcggugagccgagaucaugccacugcacugggcuccaucucaaaaaaaaaaaaaaaaguucuguagagauuguuucaacuucccuuaacaacaacaaaaaggacaauugcaaaaauauucugaaauaaauucugaauuauuuacuauuaucucagcguuagaugaaagaaaaaaaaagauucugaaauauccauucaugaaaagagaaugcagauuuugaagguggaucauauagcuucagaugcauaacuaguacuuauugcaaaguucaaaagccacacuguaggcuguggcugcuauugucccaucaagauacagguaguuucagcauguuguccagggucuucaaaaaauuaaaaaguuauuaaaaaaaauacagguaauaauggcugaaucaccuccugaugcuuuucuuuuagaauagccaccaaaaguuaguuaauuauuaagaguuaauuguuuuacugaauuaaaucuucaggugccaaacugccagaauuugugccacuaucauuaagaaacuauucccaggccaggcgcgguggcucacgccuguaaucccagcaccuugggaggccgaggcgggcagaucacaaggucaggagaucgaggccauccuggcuaaaacggugaaaccccgucuuuauuaaaaauacaaaaaauuagcugggugugguggcacacgcugguagucccagcuacuugggaggcugaggcaggagaaucgcuugaaccugggaggcagagcuugcagugagccgagaucgccacugcacuccagccugggcgacagagagagacuccaucucaaaaaaaaaaaaaaagaaagaaaaagaaaaagaaacuauuccccauuuucuuucucuauccugguuucauuccauuauuuauugagcucagaagaaagaaaugcuaauuuuaaguugcaucuauccucauugcuuauaauuuuacuuugaauugugcaauuuauacuuuuuuuaauuuguuuuuauucuugucuguuugauguugcccuuuaaaaaauaaaaauaaaaaauaaacaacaaucaaccuaaagccuuuggccaccacucaaccugcaaagacuucaacaucgaaagccaaaacacagcccacuucucucccuaagcagccagcucccaccaccauugguggguugaauaaaaaacccaugagccuugcuucaggcuuagugccagcugccccacccaaacgcccugccgucgccucugccaggccuuccaucuuaccuucaaaagacgugaagccaaagguaaguggucaccuaacuacugugccgaggaaaauuguuccccucugagugucagauagacagauccuuguugcuaacagacaacagaaucaggcugguggaauugggaaaaggcaagggaaaugggggagagggugauuugaaaauuggcauggcuacucuggacgcgcugccuauggguuagcccugcuccacgaggagcagccaaaaaaagaaaaaagaaaaggaaaucaauuuggggcccauugaugcagacauuaacauuuugaagcccuuuuaugcucuuaccuuucccuucccuguuuggagguaauacucuaucuacuuagguucuuccuccuuucucucagcuaccuacucuuuaccuauuuaagcacuuauuaaccaguuuccucuacuccacauaccaguuagauauucuuuuuugguauaauucccacaucaaauguaauucuuugucuuucccuguuaucauccugcagaaguuuuauccauuacuauugugauauaacuaguucuuccagcuuaucucagcauguuccagcaugaugugauaacuuacuuugcuuugggcauuaggccaccucucacugagcuacuucugaagucauccaguuuuccaggucacccacgguuucuguauugcccagaaacuggucacauuuggagcagcauuaguguuacagaauugcuccaggaggagaggauaguggaggcuguggcugcauuccuuaacaucuuguguuauuugagaagggccuuuaggucagccugauaguacucuuuaaauucaugguacgaaauaguuucccauguuaaaaugucaguuuuuaauuuaauauggugaagaaaacuguggaaccuaggaguugaagucuaggcugaagcccuggccaagaaacugaaaaauccucucauaaacuaguaaugauaaaaucuuguaaagcuuucucucugauccucauuuauccaguugguugcuuuucuugaucuuuagaaaacaauagguuugaauaagagggcagaggggaggugccuggagcccuggcagcagguccucccuguugcuuauucagcagcggcuucuggggggugacagaggagaguaggaaggagaggugucuagugaaauuucacucuauaauaaucauauaaaugaaguguaguguacuaguugcuguauauacaugaacuuuuuuuuaauuuuuauuuuuuugagauggagccucgcucugucacccaggcuggagugcaguggcacaaucugggcucauugcaaccuccaccucccagguucaagcaucucuugugccucagccucccgaguagcugggauuacaggcacccgccaccacgccuggcuaauuuuuuguauuuuuaguagagcuggggauucaccacauuggccaggcuggucucgaacuccugaccucaggugauccgccugccucggccucccaaagugcugggauuacaggcaugagccaccgcgccaguccuguucuaaucucuuuuauccagaugaggaaauaaagcucagagaggcccagcgauuugccaaauagcacacuuagaauuaaggggccaaaccaggacugcagcucaggcuucugacccagauuuggccaguggccucuucaucugcagcuuauuuugguagaaagauuuguagagacagagagagaaaaaccuauucagaaaaaauaaguagauuacgauucuggcagagaagaaaauguaaauugggaaacagcagaauagcuccaguuaacuucugcagguuuuugaagccaagagccugacaucuaaaagaugcaacauccuuuugagauuucuaucccacauaacuuuuuucuaacuuauuuuaucauuauuacccucauggcaaaauaauaagacuaugcuagauuauucugaauaauagucauagucuuaaaaauuugaugcacaucccagagagcaucugguuuaguccucaaauuuuagagcaauagaaaagggaauccucuggccaaaauccuacauguuuccagcagagcugguagcagaaccacuuucccugauuccagccuuagcguucuucacaccauacuuaaggccuuuauuuguggaaauugucauuacccuacauuugcagaguuagacuuuggaugccagcccuuaauuucuaguaccuccuuagcugauuuuuccauuuaacgauauccugcuugucgcuaccuacauacugcccucuuuauagccacuucucuuggaggaagagagcugagcccacugugucugugauuuggcauacucucuuuuguaaugugguaauuuguuuaucaaaauagugucuucauccccuauccccguagaaaccaggcuaaacugauucuuucccuuauucacuagagacgucauucucagccuccauguaaaaggaacuagagugacccagaugccaagcaucuauacuugagagacuuuuucccuuuugcuuucagacuguagcugugauaucagugcuuuuuaucccuucuguugaucaggccugccucuucucaucgucucugugcugagaccuuucauccuuuauuuccugacaucacauauuaucaaagcugguccuucaucacccuccauucuaaucucuuuaucccgaugaggaaauaaagcucagaggcucagugauuugcuggaguagggcuacagcucacgcuucugucccagauuuggccaguggccucuccaucugcagcucaguccuguucagcauucucuaggugcguguuagccaaaagaauggcucgauuugaacauaauuuuuaguuuuuguuuguguauguuuaaucuuuggucaaguauaauacauuagauuuuauuacauuaaauacauuaguauuuuuggcauuucuacagagguuacauuaaaauauaugcguguguguguguguaugauauauauagcaguagauuuggaggcaaacguagguuguggugauguacccaucagggcuguucauucucacuggcucaaguuggauugaaguaguuuuacucucuguugugugcccucagaucacauagcacccugcauggccaguuuguugcuuuauguggaggacuuugcucuuagaaccauauguauuuuccugucaguagcugcugaacccacaguaccuccuguucuccaauacaugguuguauagacacaucuuguguccaggugcaguggcucaugccuguaaucccagcacuuugggaggcugaggcaggcggaucaugaggucaggagaucgagaucauccuggcuaacacggugaaacccugucucuacuaaaaauacaaaaaauuagcugggcgugguggcacgugccuguagucccagcuacucuggaggcugagucaggagaauugcuugaaccugggaggcggaggcugcagugagccgagaucaugccacugcacuccagccugggcaacagagugagacuucgucuccaaaaacaaaacaaaacaaacaaaaaaagaagcaucuuguagcgugacuccuuggggcuauugcugaccugcaggccucauucccacuuuccuauuuccagcccauugcagaugcaaaggcuccugagaagcgggccucaccauccaagccagcuucugccccagccuccagaucuggguccaagagcacucagacuguugcaaaaaccacaacagcugcugcuguugccucaacuggcccaagcaguaggagccccuccacgcuccugcccaagaagcccacuggugaguauugccuuucucucccaugggaacuagggaggggaaaaugggaucuuggcuuugccccagccauagcucuagcuaguaucacaaacagcugugcaggccugcuuacgcaccgguccuuaguggacuaccuggaacagugguagcccugugggccugguacuuaacaagccuugaucucugugugagcuuagcaguuguauguauucagaaaaaucuugagugaaggcagaaaaauguacugcucaugaauuuccagguagaauuuacucuugccuuaguaacccacagcaccuagcacguggugcucaugggcuuacaugaugauaagaagagggcguggugcucaugggcuuacaugaugauaagaagagggcuauucaaguccauaggcauguauugacagccuacuuuuaaggccacauagaaggcuuaucagggcaguagagaagaauaagacucagugccugaccaucuaauuuaccacuccauucccagggacuaacacagucccuggcucaaaguagauauucaguaauuguuaaauaaugaggaaucucacuauuggaugaacuauccaacaggucaguuuguuaaauguuauauuaauaaguauauuuuguacagccauuaagacugagggaaaaccugcagaagucaagaagaugacugcaaagucuguaccagguaauagcccauccgccauuuuguagagcccuaacuugaacccccaccuccucuguggcuuaagucucccuuuuucucucucucccugaacccguguuaucucucacucccuucuuugcagcugacuugagucgcccaaagagcaccuccaccaguuccaugaagaaaaccaccacucucagugggacagcccccgcugcaggggugguucccagccgagucaaggccacacccaugcccucccggcccuccacaacuccuuucauagacaagaagcccaccucggccaaacccagcuccaccaccccccggcucagccgccuggccaccaauacuucugcuccugaucugaagaauguccgcuccaagguuggcuccacggaaaacaucaagcaucagccuggaggaggccggguggguccagggagcuugggguccuggcaugcuggccccugcaucuuccccuccauuuccacccacuguucccaggcccaccaaagaagcaggcagucaggacacuggacucagcaucaggguauuucagccggggcucuguaguggguuuugugccccagcagcagggaggcgggguaggcugagcucugggcuuucucuuccugucucaguaagaaaggcuccuguucuagauguuggggucugaguuuacauuuuugcuuggauguaaaaggauucuuuuguagaagaaacagaggaggccucagagacucugcaagugagagagacacuugacaugagccuaguuuuucaugguucuuagccugcacagagaaugucaggauaggcagaagguagaacaccucuuacuuccacaacccaugacuugaguggaauauaucugaaagaggacuaggguguccucuuauggccaggaugagucgugcugugagccucuggccuuccuaaacagcaggacugcacugcauauagugauggagaaagaucacagugcuucacuuuuaggauuuuccggugguuaagauuuucugguugcaucagucccagaauuauuuaacuguugguaaccaugggaacucugcgugaaaagguggugaugaaaguccgucugagaauguucgggucccuggaguagugaccaucucaucuccuaggucauucacuagcucuacaccaccaccaccauccagggcagcauacuuaaauugcuuaaucuggagcuguuaagaaauucaggagggacaaaaaugagguggaauccuggugcuguuggaagacacugauggcaagcugagaucagucuagagaagagccugagaguugcuugugguagcgacaguggcucuggugugcccagcaggccucugggcugugcugcugauggccuaucuccccgucuuugcucuuaugguuucauggugcaaaaguuacaggaguucuuggguggggaguugagugacuugaucuagugaauuguuuucugcuucaacauaccuaaagagucugacacuuucuaucaguauugacuuccugugaccguggcagcugcuuggggcauaucaggacauuuggcauggggugggggguauuguaauuggaaaaucaugccccagcacacucucagaaucacuaauuugguugucuuagccuuccuuugugccuuuucuucauuagcuagugucuugaucuguuccucaugucuuaagacuauggccugcagcuccuucuuuugugguccucuacucaaggaucuuugacuuggucuacccugggaaauguaugguuuugccuaggaucaaaggccaccugcuuuugccugguggccugaccuggauuugaguccccuacagccuucuucccuucuuggcuuuugagcucuuauccucuugguuugaaauuugcccucccuuuaucuccauccaggccaaaguagagaaaaaaacagaggcagcugcuacaacccgaaagccugaaucuaaugcagucacuaaaacagccggcccaauugcaagugcacagaaacaaccugcggggaaagugaguuuuauuuagacccaccucugcaaggugaagaugguaaaauacuucuuccagccugagccacaugcccucucuugcacuuuuucccuuucccuaacuaguuucuacuucuucuccccuauauucccuucucugugcuugaugacucggccaucagaaaauuuuuuguauuaaccuugaaaguuaauagaguugggagcccauuagcccuuuggagaauacauauguguauaauuuuuggcuggauaaaauggauccaaagacuuucauucauuuccuucacacugaccuugaugugaaaccuaccugguauggaugcaaauacagugcacccacauucguuaucaagaagacauggcagggguaauuuccaccaccuggaacccuggagccccugugcuuuaccuugaaguagaagaucccucucauaacgcugcuggguauggagauaacuucauuuguccugguuccccgggucaccucuuaacugaaaguuaggaugcucauucccaauggaaacccacuuaguauagguaugcagcaucaacuggagggcagagguaagcugaaaccacagguucuuuccccuugccucuguaaaccuggaaaccaggccccuccugagugcuugcaacaccuaccuuccuuagcuguagcagguaggugugccucugccagagaagcccgcacuccagcccuuagggaccagcaugggaagucucagccuagggcauuccuacagugaagaaagcugcaccguggcuucugggugacuacuagagguccuagguucagaccaaggcucauuaaguaguuugcuaaccacuugguuaccaucaaaguugugaaaaaggcuagaaaugaguagguacaaugagguauauggguuggaguuucucaggauuucuguacucuguggagaacucuucagccugggaccugcaucauuugcaaagaaaggaaguuggcaacuauuccuucuugagaagguccuaggauucuuuguuccagacucuuagagccagggccuugguguuucucaguuccaggggaagccauucccguacuauacagugugguugugcccccaggauugggcguccuugcugcccugcuuagagccuguucuuuccgcaugggcaucucacagggcagaggauuaggcauauggaggauucaagaagguauuuuacccuugagucaaaaauacuaugccuucucgagcccugagacaaaugggcuaaguguggaggcuguagccgcuccccugguguuggagauucuguauccauuuguaugcacaucugagcacuggccccuccuuccuguuaguaucauccgugcccuuguugccagcugcccagugcuucucagagcagccuuugcuucugagagugggucuggcugcagccauuccagggcccagauuuaagggaagcacccucuuugggugagaacagguccacaugauaagacuugcagagaagagccaaggacacugugcccagcucuugaggagggagcagagcaaggagguagggcugugccugguugggcaucagguuaggcugcugccugggccuugugaaccacaaccccgcccccaaaggagcggugaugaccaacaugcagugccugcgcagcucugcuccugucguuguguugucuguucacguuuuucacuccccuucuugcucuuucacauuucuuuuccugugcuuuuccacaucuguucuguagaagguggggguggagguuuaacaacacuuuuuguuggucauugugaucacguguggacucacugccuucccugugucgguucuaaccaguccucucccuuuguguuguuuuuucuauuuucuaacacuccagguccagauagucuccaaaaaagugagcuacagccauauucaguccaagugugguuccaaggacaauauuaagcaugucccuggaggugguaauguaaguauaagcucugguuagcuggcaucugagauauagcccacugugggguauacuagggagagagccaggugcccauguagauagaaucccagugaccugagcuguagcguucuguaagaagcagacuagcaaagugaggggaccuugaugcucccauguuagacaggguguuucuggugagccccuaaacaccagcauggugauauccacucaguaucuuuuuacccauaugggugggaggcuuuggauuuuucuccagcuaugucagagccugggucugagcacaguggucagcagcagaccuguugccugucuggaguccguuccugggauguguaugucggucugcaugcccuugaauuaccguggaaguaacuucucugagacagaugucuggauggaucuuuccagagcucaucuuugaauccuuguuauuauaaaauaagaauuaaucaacauuuucuuccuaucccuuccccacguuuuuuugagaugaagucucacuuuguugcccaagcuagagugcaguggugugaucucagcucacugcaaccaccaccucccagguucaagcuauucuccugccucagccucccgaguagccgggacugcagguacucgccaccaugcccggcuaauuuuuguauuuuuaguagagacgggauuucacuauguuggccaggcuggucuugaacuccugaccucaugauccacccacuuuggccugccaaagugcugggauuacaggcaugaaacacugcgcccggcccucccauuucccuuucugcucuccuuuuuuuuguccauuuucuaaucccuuccuccuuuuucuuccccuccuuuuuuagucccuuuuccuguuuuuuuguuuguuuguuuguuuguuuguuuguuuuguuuuuguuuugauacagaguucacucuguugcccaggcuggcgugcaguggugugaucucagcucacugcaaccuccaccuaccagggucagucaauucuccugccucagccucccaaguagcuggggcuacaggcaugcgccaccacgcccagcuaauuuuuguauuuuuaguagagacgggguuucaucaugcuggccaggcuggccuugaacuccugaccuugugaucugcccgccuuggccucccaaagugcugggauuacaggugugagccacugcgcccagacuuucccuccuuaucuuuuuguccucuuuccucuuccacccaaacauccuucuuuuugucuugcugccauugugugccagcucuaugauguguauuagggacacaggugaucccagcucacagggagguucuggucuagggagagacagggcgaagucuuacuaucgucgagugugugaagaacacccugugugcuuuccgcuugucacugugacagugccuagaaaagugguacucuguggaguugugccagaggcaccagaagccgccauguacagccccugcccucaccgcucccuuccaggccaagugagacagccugucuugccuccguuucuuuugaguucauucgguucuuucuccuuacuguccugaaccggacuagguccugcuccacuuacccuuaucauuuuuagacucuguuaacacuccugccuccuccuuggugaucaugacauccugcccauggccuacagauacccccagcaguuguaucaugaggaaugcggccaugagcuuucauucuugccccacacaacuccuuccugccccuccuuccuggucaucuucucaccacugccucuuccuggccuggguagaaauggcauccuuuacacucggguggaauugcuugaccagacuaauuagucagccuggaauaggaucagcugaagugaggugacaaagauccagcccacgaggggcccaggcagcugcugagccuggcuuuguccuggaugaaaacagaaggugaacagggguucugagggaacugggucacuuguguaggugagacauagagauauauuuguguguguuguguggugcauauaagagcucugaaaauagucaucauuaauguaucaccugcugugaucuuuccacacugccuacacaugaccucacauguguaggguuuuuuguuuuguuuuguuguuuugagggugaauguauuuuuaaagccuuuucacuuuaggaggcuuccuuaaacagagaauuagggagacuacugugagccaucuuuccuggugggaagaugaggauaaacaacagcugaccacagcuggacccaggugcuuuguuuccuuccauaaucucugucagucccucccuaaagccaccacaaggaaaugugcaguuuaaaaugaugagccccccagcugggcaccauaguaagacccccgucucuacaaaaaaaagucuugcucugucgcccagccuggagugcaguggcguaaucucggcucacugcaaccucugccucccagguucaagcgauucuccuucgucagcuucccgaguagcugggauuacaggcaccugccaccaugccuagcuaauuuuuguauuuuauguuauguuauguuauuauuuuauuuuugagacggagucucgaucugucaccaaggcuggagugcaguggugcgaucucggcucacugcaagcuccgccucccggauugaugcuauucuccugcuucagccucccgaguagcugggacuacaggcgcccgccacaaugcccagcuaauuuuuuauauuuuuuaguagagacgggguuucaccauguuagccagaauggucuccaucuccugaccucaugauccgcccgccucggccucccaaagugcugggauuacaggcaugagccaccgcaccugggcuaauuuuuguacuuuuaguagagacgggguuuugcuauauugggcaggcuggucucgaacuccugaccucaggugauccacccaccuuggccucccaaagugcugggauuauagcaagagcuacugcgcccagucccaaaaaaaauaucuuuuaaaauaaggccagguacaguggcccugggaggcccaggcaggaggauugcuucgaaaccagccuggguuucaaagcaauuuuaaauuagacaugugccuggcagcauuagguggcaugugccugugguuccagcuucucaggaggcugagaggggaggauuccuugagccuggguaguugagacugcaaugagccgugauggcaccaccacacuucagccugggugacagagagagacacugaaaaaaaagggaggaggaccugcugugcagacagaacagcauuacaccccccaccacuccccacacacacacacacacccacacccacacacacacacacagaaauaacgcaguuaccacagggaugagaggcuccaaacaggauccuaguuagugcuccaaaaaugcccccgacagacagacagacauaccccuugaugagagccaggaggacaccagcggaggggagggaggggagugaugagccagugccaauguaguggcuucuucuguggcuggucccaguuaagauuuuguguccguuuugguuccauuucacccuugcaaggggcugugcauguguagugggcacugagaccugcugacagcauguuuugguaccuggagugugccugcaggcucucauagagcggcaggcagccuguguaagcacaagcagagcaaggugugugaugccgugauugcuccuaggaccacagagagccagcguggcuucugcaguccccgaggaggggacacuugggccagcccaugaaggaggcgccgcacaugguucccugaggcuggagcauagaguggaggcaggguggugugggggaaucguuuggaagcagauuguagacuccuccacauagccaccuaaggagggagagcuguagccuagaggugguggacuuuauuaaagugagugaggcucaguuaagcuuuuuaaaacuuuuuacugggcugggcacagcggcucaugccuguaaucccagcacugugggaagccaaggcaggcagaucaccugaggucgggaguucaagaccagccugaccaacauggagaaaccccgucucuauuaaaaguacaaaauuagccaggccuaguggugcaugccuauaaucccagcuacucuggaggcugaagcaagagaaucgcuugauccugggaggcggagguuauggugagccgagauugugccauugcacuccagccugggcaacaagagcgaaacuccgucucaaaaaacaaaaaccaaaaaaaaaaaaaacaacuuuuuauugugggaauuuucaaacacagacaaguagaaaaaaacaguaaaaugaaccugauguaccuuuuacccugccucauuuacuaucuacaugagcagucuugguuuaucuguauaugccuaucccaaguauuuugaagccaguccuagauauauuauuuauuuguuaauacuucagcauauagcugggcgcgguggcucacaccuguaaucccagcaauuugggaggcugaggcaggcggaucaugaggucaggagaucgagaccauccuggcuaacacggugaaaccccaucucuacuaaaaauacaaaaaaucagcugggcgugguggcacgugccuguaguaccagcuacucaggaggcugacgcaggagaaucacuugaacccgggaggcagagguugcagugaggcaagaucacgccacugcacuccagccugggugacagagcgagacuccgucucaacaaaaaaaaaaggaaaaaauugauccauauauuuaaaauaguaacacuaauaagauaauacaagcuauaacucuuuuaaucuuaagcuguuuuuacucuacaaguccccacuccauucuuuuuuuuuuuuuuuuuuuuuuuuuuuuugagacacagucucgcucugucccucaggcaugaaacuauaacacauuuaaaaucauauuuuuguauaaauagcuuuaacauuucaaguuauuucucuaggauauauuccuaacauaggacucuuaugucagaaacuacaucuguuucauggugugggcuaccuagguuuuuuuuuuuuuuuuuuuggagacagagucucgcucugucacccagacuggagugcaguggcgcgaucucggcucacugaaaccuccgccucccgaauucaagugauucuccugucucagccuccugaguagcugggacuacaggcacccgccgccacgcccggcuaauuuuuuguauuuuuagcagagaugggguuucaccguguuagccaggauggucucgaucuccugaccuugugauccacccaccucggccucccaaagugcuaggauuacaggugugagccagcagcuuuuuuuguuuuguuuuguuuuguuuuugagacaaagucucacucuguggcccaggcuggagugcaguggcgugauuuuggcucacugcaaccuccgccuucugggcucaaucaauucuccugccucagccuccugaguagccaggauuacaggcgugcaccaccaugcccugcuaacuuuuggguucuuguucuuguuguuguuguuguuguuguuguuuuaaagacagagucuuggcugggcgugguggcucacaccuguaaucccagcacuuugggaggcugaggcaggugggucacaaggucaggaguucuagaccauccuggccaacacagugaaaccccggcucuacuaaaaauacaaaaaucagcugggcgugguggugcgugccuauaaucccagcuacuuggaaagcugaggcaggagaaucgcuugaaccaggcagucggagguugcagugaguugaaaucaugccauuggacuccagccuggcgacaaagugagauuuggucucaaaaaaaaaaaaaaaaaagacggagucucguuuugucacccaggguggagugcaauggcacgaucucggcucauugcagccucugccuccuggguucaagaauucugucucagccucccgaguaacugggacuacagugcccaccaccacacccagcuaauuuuuguauuuuuuguagagaugggguuuuaccauauuggucaggcuggucuugaacuccugaccucaggugauccacccaccucagccucccaaagugcugggauuacaggcaugagccacugcgcccagccuaacuuuuguauuuuuuaguagagacagggucucacuguguuggccaggcuguucucgaacuccugaccucaaaugauccacccgcgucagcccucccaaagugcugggauuacaggugugagccacugugccuggcucauucuuuuuuuuacugguaauuuccuugauggguaagcucagugguuuguccuagaaucuggauucuucuaauuacauccucaugguuuuaauuaacauauucuguugucccucaauuuucuuuaaauuuauuugguuuugguuuuuuccccacaugcuagcaugacauguaaguagguaaugagguuuauucugugagaaauuacauucaugucucauucuucgguugucucuuuuuuugugauguuggcaauuccuggaccuguggguucaguaggcauaugccgugguaagacuaauucuagcauuacuucuucauuuaccagcuggaauacauccauaaugugaaacugacugccccucaacuauucuuuaauugcauacuagacaaaaggucaagagauagaggcuucaaauauggaacacugucuagaaaucuguggcccuggccgaugcaguggcucacacuuguaauccaagcacuuugggaggccaaggcaaguggguugcuucagcccagaaauucgagaccagccugggccacuuggcgaaaccccuucucuacaaaaaaaugcaaaaauuagcugggcaugguggugugcgccuguagucucagccacuugaggggcuugagccugggagguugaggcuacagugagcuaaggucaugccucugcacuucauccuggguggcagagugagacccugucucaaaagaaaacaagaaagaaaucuguggcucuacaucuuggugagggcccugggcuuggagagugacuguuaacuucuugcaggugcuguugugguuacagcuaagaugagcuugucaccauugcuugaagacccauguuggguugguuuaagcagcuaccagaucuuuggcugguaaaaguacccuucccuaugcccucucuuaugggggauaaggauagggagauguuuggaugaggucuucaugucucccucuucuugaauuggccauuucuuccccuaacaaauaacaagauaccuuguuuuaaacccagauaaagcacuuacaguggugucaucagcacauacuuaggaggagguaucugugcuguauccuaaacuuccauuuuggagaugccuauaaauaucuguauaaugaacuauagauugaggagaaaagaaaaaaauuucuaucuagggaaaauugcagacuuuuuggaaagaugagacaaaguagaggcuguguguuuucacaguaguaacuacucuguauguaauuaucaaacacgugaagccauuaugguauaguuccugguggugucccuucaagagaugauaugagaaagagacggauugaagcgagagcuaugugaggccguauggaaggcaccuuuugagcugggcauugaaggauggggaagaaaacauaauggguuugcuggguuaggcaugagccaaguuuuagaggaaagauugagaauggcucuggcaagcuggggauuguggguaguuauucugugccaggccuugggcugugggugcaaauacaaaaauacugguggcauuauaucuguccucuggaaacauggugaagacuauauuuccugacaccaaagaagggaaaacagggcucaagaagguagcucaccauuuaacagcuuguggugaaacccaccagaauggugcaacacugcauggaguugauguguuggaaagucaggcucucccacaguaccuaccagaggacagcggggccgcucacaggaaugcuggaauccccauccagcaacccagagggcaugcauggcuauagacuuaaagaugcaccaccuuuuuuuuuugaggcggagucucuuucuguugcccaggcuggagugcaguggcacgaucucggcucacugcaagcucugccucccgaguucaugccauucuccugccucagccucccgaguacugggacuacaggcaccugccaccacgcccggcuaauuuuuuuuguauuuuuaguagagacgggguuucaccauguuagccaggauggucucgaucuccugaccucgugauccgcccgccuuagccucccaaagugcugggauuacaggcgugagccaccgugcccagccaaggugcaccaccuuuaaaugcaaauuuuugcauuuuuaguagagauagaguuucacugugcuggccaggcuggucucaaacuccuagccacaggugaucugccugccucagccucccaaagugcugggauuacaggcaugacccacugcaccuggcugggaaaauuguuauaacauggauuaagcaggaauacuaugauuacacacacacacacacacacacacaacgcgcacacacacacacacacacacacacacaccacccccucaccucucccaaggggaaaaugcauugaaaaggacuagaaguaaauauguuauuccagguucucugggcaaggaguugauagguaaggauuugagauggaauaaaggggauauuucaugggagccuuggugcugguguuuggaccuggugaaaugacagaagagcugucuggagcaugcauggacagggucugcacagaaagaccugugggguguggaaauggugguuuggucuggcuggaggugggguuagaagugaaggcugguggccgggcgugguggcucacaccuguaauuccagcacuuugggauccugaggcaggcggaucaccugaggucaggaguucgagaccagccugaccaauauggagaaacccugucucuacuaaaaauacaaaauuagcugggcgugguggcgcaugccuguaauccuagcuacuccagaggcugaggcagaagaaucacuugaacccgggagauggaggcuggggugagccaagaucgugccagccugggcaacaagagugaaacucugucuuaaaaaaaaaaaaaaaaaaagugaaggccaggcgugguggcucacgccuguaaucccaacacucugggcucuggaaaucugagguggguggaucuccugaggucaggaguucgagaccagccuggccaacauggugaaaccuugucucuacuaaaaauacaaaaaauuagccagauguggugguacacgccuguaaucccagcuacucgggaggcugaggcaggagaauugcuugaccccaggaggcggagguuauagcgagcugagaucguaccacuguacuccagccugggcaacagagcgagacuccaucuuuaaaaaaaaaaaaggaagugaagagcagggccagggugggucgagggcucuuuuaaguacuuagggagaugaccuugucuuugaccagacugagauagcagcuuacagagggagcgagaaacccugaacauggagaagauuuaaaagguagcaugggguuggcucugacaguauaccuucucucugaaugagucuuuuguguccuucucuucagguucagauucagaacaagaaaguggacaucucuaaggucuccuccaagugugggucuaaggcuaacaucaagcacaagccuggugaguggugccucccuugcccacugggucuccaggguaugucguccugccaugggucagcugggcagccagcuggcuggcaaggguuucaucucugugccuuuagcaucccaugaagacuacccaggacaccacaguccucauucugucagggagcaggaguucgggugcuaaccucuaaguggaggaggagcaguuucuuacagcagccaucugcacaggcauucucuugaguaccuacuguguguguggaacuauugagcuaggccuggggaaguggugcacucugagcugagaaccuggauuggcucuaaacgaggauuacagaagcuacugcugaaggagcuguauagagggcaguguucaggucccaccuaucagaugcaggagcaaagggugcucccaaccagugaagcaucagccgcuagcccuggcaggagaaugggaggcguucagcaacuugcacuaaugcaguuuccuuccagcaacaugguuggcccagcgccccuguggaagucgcugugcggaggcugggcucuugccuuggguaguccccuagcagccucguguccuaguuccugggucuacagcagauuugugaguaggacugcuguagcagcaggcacacuggcuggcagaccugguaucccagaaggcuagccaccacaggccagauaaggugaaggcaaaacucucuucccucagggcgggcgcggugucucaugccuguaaucccagcacuuugggaggccaaagcgggcggaucacuugaggucaggaguuugagaacagccuggccaacauggugaaacccugucucuacuaaaaauacaaaaacuagcuaggugugguggugcaugccuuuggagaauugcuugaacccaggaggcagagacuacagugaggcgagaguauggcacugcacuccagccugagcaacagagcgaaauucugucuccaaaaagaaaaaaaaaaaacucccuuucccucucagcgaagagcaugauccaguuuagaauguguucuauuuagaaagaucaaaacaguucuguccuuaacuaaccauuuuuuuccccuuuuaucugggaaaucuccuaucagauacuuccuucucuaaugacacugagucacuuagggucuaguuuuugccagggcuggguuucccaauaugggacaccgggagaccucggccagaagcugugcguggaggucugccaugugagcugagaggagauggaagaacaggagaaggggcccaagggaaaccacgcugcugggcgcgggaggggcuggguacucauugagggcagcucgucccgcacccuuccccuuggucucaugggcacacucuggccagugagcucugaacccugggcgugaguucagaccacuuucccuccccguccuagccugaggucacuagaucccaggccugccuugguccaugucuuuccuuccucagcgcacagccucggggccacucuguccuuuuuauuauuccuucuuuuugcuagagugugguacgguuuagggucucagacaauuuucacaaccugucacugucaaucagcagauuggugguaacucugggugagucccuucucuuuugcagcaucaguuuuaccggcugggaagcagggaccguggccgugaugacagggcauucaugagaauucagugaggcugugccugagaagcacugcauggcccaguuagcgggagggcauucccacacagaguagagaagcagaggcuucgcccuggaggcugugcucggagccccaggccugcccaagccuggccugcagcucaguggcuguggcauggggugguggaagggauggcuuuccuuuucuuggagguauucccacuggcuggacggagagauugucucagccucacugugauaugagaaguccucuuuagacaaacguguucacuguucuucauuugccacccagaacaggucacgucugucucauuucuagauugggcauaucgcuaguccugguuuugccugcagggauauuccucugccacccuaggugaccaguuccuuugugguuccagguggaggagaugucaagauugaaagucagaaguugaacuucaaggagaaggcccaggccaaggugggaucccucgauaaugugggccaccuaccugcaggaggugcugugaagguagcgagugggucacuggggagacacagcuggggaggggugggaacuaugcaguuagggucaggguccucacagguaggcaccugucaccgccccucagucucuucaggagucaugucuucacccacaccauugccguuuucccaccguguaucaucaguccugacugaggcagaagugaagaggccccagcccagccaccccucaccugucagcuggaggcagaaccuugcuccugagagccauggccuuccuaauugagcccauccagccauuugagaaggccacggacugggacacagaccacccccaggcgagcggggguucugcaccacacaguucuccccagcugucucgcgccaaggggaauguggguucccgccccaugucaggcuccgcuccuggguuaggagcaggacagcacauucuuagcugccagcgacagcaggcugccuggggccucccucugcagggccugccuggggccucccucugcagggccugccuggggccucccucugcagggcucugggacagagcucaaguggcagagguucccauccucacgacuggcugggccucuucucccuucccucucuccucuuuccucccuuccuccuuccacaguacugugagaccuuuugugugccaagaugcugucuguccuauguuccaugucauccguggguggggggcccaugaggggcaucuugcagaccccgagcacaaggauggcugcugcugcucggguucaggugcgcaggggagaggggccaggagccgcugcccugggccuucccuuccaucucugcuccccagugccagccacugcccagcccguccccugucccauccucuccugaugcucugacugaagccuugaucagcuuccaggaacaucuggggggguccuugcugccacaggcucucaguucgugccccccauaccucgugaggaugccguucucacgcccgucucaguggggcguuaacuuggcuuuagucucuuuuccaaggacacagcgagcgagcguggaccaggauucacaucugggcuuuucugacccuaagccuuguguucuuuuccuuguucacauuauaucccuuuauuaguucuggaauuauuguuuuuaaucgaggccuauuucucacuaugccgauuagaaaccacuucucccuugucacuuuuuggguauuuggcgacacacgcuuuccagcuccccaguggccucucgcagcuguucucucuucucugccuuccucacacugaguguuccaugucccccaaauguccuccuccuaugacgcccuccaggccuccacagugucccuggguuauaccuccuuggacaccuuucugccucccauggaccccuggucccagaauggugccccgcacagacaaggccucagcaccuguguuccugaccagacagaugugcaggcagggcugcccgggagcuacugaggaccccacucugugugcaggggguggccuggguucagggaggguuugggagggugggcuguacccuucagggggcuacccuucaggcuuauugcuuacuguugucauggcuacgucuuugguaccagccugaggccuggcaccucugcccucagagaggcuucaucagagccucacaugccacagaggggcucugagagugugucacugguccagcugcuccugacccucgggagucggucucccaggugaggugggguggguggggccggggcaccugccugggauucuccaagcgacugugccuugagccagugggugccagggcagcaagggugggggcugugugugaaacccaccaccaucaccccaucccacucccccccucgacugacccugcacugucucccccacuguuucauuguagacugagggcgguggcagcgaggcuccucuguguccgggucccccugcuggggaggagccggccaucucugaggcagcgccugaagcuggcgcccccacuucagccaguggccucaauggccaccccacccugucaggggguggugaccaaagggaggcccagaccuuggacagccagauccaggagacaaguaaguggcugggcucggccuaagggccagccaggggcccugccacuggccgcaaauugaaacuccuuuguuuuugacuagaguguggccuaaauuuuaaugaaguaaccuuuuauuuuccaggcaucuaaugaugacauucuggucucgucuuccgucucccccguguuccccucuugucuccccuguuccccucucccuucccuccucccaugucacugcagauugagaccuacaggcugacguuccgggcaaaugccagggcccgcaccgaccacggggccgacauugucucccgccccccacacuucccuggcggccccaacucgggcucccggguccuuggcccccuuucccgggcuguccacuagaccagugagcgcuugggcgccgugcugggcagcccgcuaggcucgccuucccuccugcuuugcgugcccggggcagcagcagcccugccccacaccuccucucacuccccagccugggcccaucucccugcuuuggucuugccccaucacugcgccacugcuccguggaggagguugggaggggguuggggugguugaggcuaaguugggaucuaggagaggagaaccagauucuauccucaucuuuuuuugguucuuugguccaaacccaaaagaaacugacaugcccucccuucucccuggaucuaccuggagggaagaguggagguggauuccgaguggugacaggacgcugaccguggagcuuaagccacugccucucccucuggucccacaaaugggcgccccccccuccccaugcagguggugucgggcccuucuugcugcccugccccaaguugggggucagugcugccuguccccaugcuuaacauacccgccuagcugcugucacauuuuucuuguuuuguccuuuuauuuuuuucuaauaaccuaaaaacuggcaaaauaguucugcagguugaagccaugucuacaugaaaguccucaguaaguguuagagggaacagggcggagauauccuuaugccacccccgcuggaggaugugggcagcuuagggcccuggaggcggugcggcagggaagaggggugcagaggcuguggcuggugagccggucaggcacacaaggggcccuuggagcguggacugguugguuuugccauuuuguuguguguaugcugcuuuucuuuucuaaccaagaggcugguuuuggcaucucugucccauucccugggaucugguggucagcccuaggauaaaaagccagggcuggagaacaagaaagggccaggagauggaauuccuucaggccggcacccacacccuaggacauguaagcccucauguccaagggagccucaugcagauaguaggaaaucaggucuggaaauuuaaaaauaaaaggcaugagacuaaggcuaucugcuucccuuaugcccugacuggagaggggagggaggagaggcaaggcccacagagggcaucccagcuaggccuugggauggcugcagugaggagaaaucccgggaacuguauugacacaaagauucuuauugcacuuguauuuuuuguauuaaaguuugcaugguuucuaauaaaggauucaaacauaaguuuguagugaaauggccugggagauuccaagggcuucucuggagggggauuggcugcaguguagauuugccucugaggaggcugccccagacuuggccuccucaugcccccuccugaccucugcccuucucugguccuggcaucccuggagaagguaggggucuugaccuaaguuuagauuugaucuccaugugcagggaggcuguccugggccugacagguccucccccuuucugagguagcagugccuuguggagguuugacaccaugucccuagcuccccaagcacacaccaggaaacugcaggggcucacggaggaagugcugccugggccagggggaccagcuuuccuccguagagaccaugugcagaacacuucugcugugccaagaacaugagggagccaguguuuugucagcaggaagaaagggccugcugggaugaaagugggaaggaaacaggguugcguagucaggagacaccucaggggcaacagcacaggcccagaguaccugcugccuccacugcgucuguccuggggucaugaggaugcugagguugacgacagguuccagguccuuucacuccuuuggccaaagguuggggguagguggcccaaguggcgugcucucuagguagacaacaggaguggucagaguucccucaaaggauccuccacuccagagcaccugagaaggccgggaccagaggcccugugugauguguacuccgcagcuguuuggggugggacauuucuguacuucucgauuugcuuauggcucagccauuaccugugucaguccaugauucuguuguaacaguuuuaagaguaaauaaauaaagcugccugaugucccaucacgcag

SEQ ID NO: 192100 - RNA, 147570 nt, Homo sapiens
uuaacuuuuagggaacacacaugccaaguucuuuaauugauuuuauuuuuuuacauaaaaaguucaguaaaaauuggauaaaguaaagugauuuuaagcaguaaaucaaucuuaucaacauagcacaaggcuggccaaaaccacaaggcagccugcuuuagaauauuuacaugauaacaaauuaaaccuugcaggagaacuuaaacuguccuuacaaagucuuccugugauccuagcauguagaggcuaaaagcaaaacgaaaaccaaacaaaaaccaggaaaaaacaaauuauuuucaauauauucacauauacauuaaaauauaauacagaucaucaggguaaaggguuguggguggggaugcgcaugggucugugcgcugacagcaccgccaaggagaagacccagguuuaagaguggagucaggucuggccagggucuuuucuaagcccuugcaccucugauggcuucuaaccacaugccaacagcucacaacuagguaaucacuuguagauggaguucauuuuuguggccuucaguugacaucugcaggguugaauuccccagggugauguaucaucaguagcacagugcugacaggggugggacagaaaggcccacaggauuuccucucccuagagucugucuuaccugaccacccauccucccacccuggcccaacagucacucuaauucaguguccucuuuggguuuguaaacagccccaaacuucugcauguacuucuuaauguacuccuugguuuuguguuucacauucucauugcacuccagguccucaggauucuuacaguacuucagcuccuuauucauaacaccgugagucagcuguccagggcacaggaagagagaccacagccaccaaucagagcagaaauuauaugagggggaggacaggggugguaauccagccugcugcuucagggcccuucucaccaagacaggaaguuaauaaggggguagauguuggggcaggcuggugcuaugaucaccagaaaggacaagcugagcucugaaaauuucuuagagaacuacugcugucauguaagguacgcaucccuccccaaaccuucccuccccguuccuggguccccagcucugacaucugacaagaaaaaaaaaaauacuuucuaugaugaaaagggcuucuuagaagguacacaguuugcccagaacauugccuggugggcuaccaaaagcaaggggaguaccuugcgagccagauguuuaaagucuucaguugugguaauucuucccacuuugcagucagguuuccgguaaggguucaggcacuggacgaugaacugggacaucugcaggcagagaaaagagaacacguugcucaacaguccagagagggcaaggaguuguacugaggaaauaacuagaaaagguagugaguaaagccagccaauccuucuccuuuuccucccucagguuaacugguuuggacaguggaauacuaguaagccaguaagaucugagaaaaggauacgggcucagccugagagggaaagagcuccccuggauggacuaagcaagccuuaaaggaggcuggagggacucaacagcaugacuucaaugcugaguccuucagcagccccagguuucagucaaugaauuuuguguccuuggcauaaagacaguagcuggguucucugggcccuggaggcaaggcagagcacagcagguguuccagagcuucuaugaggcuuagcaaucccaggaaccacaggaauuuugucauugaaggguacuuagauucuuuaaguggucauaccacagcaugugaagcagauggaagcaugauaugacagccagcaaaggaaaaccuaagcagaauccuuuuccuuccaccacuuacuauguccucccugggcugucuaaguauggucuguccuacccaggugcucccaaacacucuaggaauaggaccuucagagguauuuguggugcuaagaucauaggggacaaagagaauaaagaggccagucauagccauuucaucagagagcacuuugaacaaagucuacccaucacuaaaauucagugagccuucagguguucaaagaacaaggcuauaucacaagguaggcacuaaauaaacagcugcugguucaaugagcugaaauaccaguauguucacaaagggaccauaagaaacuaaauuuuaucccugcauaagccuuuuaacucaagguuuuucugggguuuccuggccuccaaacucucuuccuucagucuauccccucaaacacagauagggauuucauuacccccugcuuaaaauucugcaaugguucccgauaacccacagacacauaguuccuauaugaagaagaacaauaccauuccaccucauuuucaacagcccucccauaucuugugcuauagcccaucaggccacuuacaacucccuggaagggaagaugcucucucuugccucuguacauucuauugauauaaguuagauccccugcugauccaucuggccaauuccuaccccugauucaagcgcccuuccugacugcccagauuguggcucccagcccuaauauggcauacuuuucacacagcugucgcuacuuauuuacaggucuguuucuuccaaaacacuacaagccccuucagugaaugaagauuggaguuuagaaccuagaugcuaugaagcagacaaguuuagugucuugaugguugguaagacacacuucugguagcauaaaaaggagcagcauucucccaagcccuggagaauuaggcagcuaccaaaugagauauuacagaaagagaacuggacuuugagccagaacgccugaguucaaaucuuuugucuagaacuugccuucucugaaccuuaagaguucuuucaccugaauaagaggaaaggcaaucugucuugccuaccucaagggcuguuguggggacaaaaugagucaauggguacugaagugcuuaaccaguugaaaaaggccacaccucuuucaccaaugugucauucacauaacaacuaagucaaaucacagaagcaagaggaauacccaaagacaaggcagccuaccacuacagacagcuuucuuuugccauagaugcuacagaaggcccacagucaaacaagcaaauguggucugagaggggcuccugucaagccaagaaaagauggcugaggaguuuucagugcuaaaagaagcacuucagcaagacauacacacaaggaacaccuuguguuccugccuaucuuggggcaaaggagauauucgacauacuuaggacaagaaaugaaaggguucagauuuaagccugaggagcuuagugcuuauauccaccaaaccuuaccucuuuucugaauacuucuuugcuuuucuuugcuaguucacuggaggugucugcuucugcugucuugggcuuuuucgaggccuaaaaauggaggagaaaacacaguggugcuggcaugagaagucaguuuagugaugcccuacugucccagaacccuccuuucuuuccccuagcagggauaccugauucuugguauuagaauccguuuagaggcccugacucagguacaaggccuggagucaacuuggcuauuauguuucaaauccuguuacaugguuuggcucuccuucuuauaaguuaaguuccaauucucuacccuaagucaaagcuacaacuuugauauagccacacauuucagagucacucaugucccuguucuggguucagcucccugaacuaucaagcaaggccggcacaaaacaagcuccaucucucccaccucugacacucuaggauuccaggacagaggcgaaaugcucuguucugaagacucuugaauacucaucaccuuuccuccaaagguggaguuggcuagacuguagaagacagucucaguaugcaagagaggcuccuuggagguugguaccuucaguuuaggaacagaaagauuaaggaaguaucacgauauugacggggaggugaugaaggucaucaaagccagugaacagauaaguagaugaugacacagaagauacucuauguccccagcuggcaagauaaugacaaacccaggaacauucccuuccagcacugcuagagggaggcuuccaaguucccucuaacuagguacugcaccaggaggcgaugaguuggaagcuuugguauucagagcaccugucaugcaggccaucuccccauaccuuugcccaccacuagccaucaggccccuucccaguaaaugugcuuuuccacggaaaauaauaauuaugagcauuccccuccaaauauaaguuacuucauaauggaucuagaagcuggaguugauauuauagguacuucacacuuuuuuguuaggggcacaggguagaauaauuuuccugcuccccacccaucuccugguucugcuucuuccauuuccauaaacaguaugaaggcucugguucuaaagcagcuggacuagcuccagagaaagguggcacucccuuggcuuuaggcuguuacaaaucaacuuucucugcugugucauaaaagcuuuacguauuuucuauuuuuccaauuucuucauguagcuguauggggagauuaggggguagaguaaaaagaauauaaagauccaauuuguuuuuuaagaaaacaaaacuaagcaaaaauaaugcuaauaauauaaguuaagucuauuuucaaguguuuugcuuugggauuuuguuauuuuuuuucccccaguuguagaugguaugaguaugcuccacaguaagaccuuagguagcaagggaucaagaauuauuugaguaagucaagaaaacuucaacacauccccagcuacucucuuguagcucucagaagucagcagcaacagaaaugaguacagaaagccccuucaggucuggguaucucaaagaucuggguccuauagaagaggccaugcucucagcgaggguacuauguaaauagaaauguccuguuucacucuggauaggguaugcacucacaaagcuaaaugaacccaaagcacuuuuaauagauuuauaauuuaaucccugacuugaugagguuggcgggggauuggugggggguggccuuuaaaaacacaauuauagaauacaauccacugagcucugucuaggagcuuucuugguccuccugagugcugagcaauugggaucgagaaaggaaaugauaaaaugagggguccccagacuuacaucauggaaaucaugaaccaaaauggaauacucuugagaguacugaaauucaugaaacccucucuucauggucugugauuugcaaauggcaugggaaauaauuucagaaacuggcuaacauuuacucaaaucuaaugccaggcaaaguaaccagagucugaguugaggacagcacuuguuauugacaugaacaaccuuaggaccccccacuccaaaaaagucccauuuaaaaauuuagcagguaaggcugggugugguggcucacgccuguaauccuagcacuuugggaggcggaggagggcggaucacgaggucaagagaucaagaccauccuggccaacauggugaaaccucgucucuacuaaaaauacaaaaauuagcugggcgugguggcgcgugccuguagucccagcuacuugggaggcugaggcaggagaaucgcuugugccuguagucccagcuacuugggaggcugaggcaggagaaucguuugaacccgggagagguggagguugcagugagcugagaucaugccauugcacuccagccugggagacagagcaacaaucugucacacacacacacacacacacacacacacacacacacacaaauuuagcacgugggguucagugacucaugccuguaaucccagcacuuugggaggccaagauggggagauuguuugagcccaggaauucgagaccagcaucucuauaaaaaaacugaaaaauuagcugggcaugguggcuaugccuguggucccaguuacuugggagguugagguuggagaguugcgcgagccuaggagguugaggcugcagugagcugugaucaugcuacugcacuccagccugggcaacagagugaaaugcugucuccaaaaagaaaaaaagcacuuuuaaggaaaccaccagagaacaggguaggggcucugauacauaaaaaagcgagugcuuccagauccucagcaauaaacaauaaucaguuugccuuuucucuguguuggcuuauauagaguaucagucaauuaaagauucugguggaaaucuaugugaggccguggacaguuaagaguacacaaugaaaugagcaggcaaagggccuggcagaaagccagagcuuacugccuuuagaagcugacccugcugucagccuucaccuguggcacauuuggauuccuaggaaaucuguucugauuaugacaaggcaggccugaguaccuuuauauuacccaaggugaagcuugagaccuucuggauuaguuggcaauggccuuaagcuuauugggcaguucugguaaccauacacaggcuguguaacacaacagaaucacccuuuauuauaaauauugacaugacuaugucacaaagcccaugugacuuggaaccaagaggguauggcuugaguuacagaaaugaguccugacaaaggcagagcaggacauacccagcuaauacuucucucucccuguauuuaauuaaauacugauuagagggcugggcacgguggcucaugccuguaauccuagcacuuugggaggcugaggcggguggaucaugaggucaggaguucgagaccagccuggccaagauggugaaaccccgucucuacuaaaaaauacaaaaauuagucaggcgcggcggcgugcaccuguaaucccagcuacucgggaggcugaggcaggagaacugcuugaacccgggagguggagucugcagugagcugagaucgugccacugcacugcagccugggugacagagcgagacucugucucaaaaaagaaaaaaaaaauacuguuuagaacauaaaauguaaaucauucagugaggaacuacaucuuuuguggcagcaugaauccagaagcaggaggagaagcugagccaucauaaacacuauccacacaauucaaccuaagcucugcagcacaugaaccuguacaugucaauuuuuaaaagguuaagaucauugaaaauaauaaaaacuuaguacagcugguguucugcaucuguaggccagccauggauagaaaauauugaaaaaaaauacaauaaaaauaauacaaauaagaaccaauuuuaaaaaaccccaaugcaguauaaccacuauuuauauagcauuuacauuguauuggguauuauacgcaacacagaggugauuuacagcauaugggaguaugugcguaggugacauacaaacacuacgcccuuguauauaagggacuugagcaucuuuagacuuuggcauccaugauagggugucuugaaaucaauccccuauggauacagagugacaacuguaaugugucucaagguauucuucuuuugguugauuuuacuugggauccuuuaggcuucaugaauccguaugccuauuucccucucucaagaugggaaauuuucaacauuauuuauuucuuaaacaaauuuuauauagccuggaugugguggcucaggccuauaaucccagcacuuugggaggccgaggcgagcagaucacuugaggccaggaguuugagaucagccuggccaaaaaagcaaaaccccaucucuauuaaaaauacaaaaaggccaggcguggugacucacgccuguaaucccagcacuuugggaggcugaggcggguggaucacgaggucaggagaucgagaccagccuggcuaacgaggugaaacacugucucuacuaaaaauacgaaaaauuagccaggcgugguggcaggcgccuguaaucccagcuacuugggaggcugaggcaggagaauugcuauaaccugggaggcagagggugcagugagccaagaucacaccauugcacuccagccugggcgacagagugagacuccgucucaaauaaacaaauaaacaaacaaacaaacaaauuagcugggccugguggugcaugccuguaaucccagcuaauucggaggcugaggcacaagaaccacuugaaccugggaggcaaagguugcagugagaccagaucacaccacugcacuccagccugggcgacagagcaagaccccguuugaaaaauacauuggcucuugaugccaccucucugcaacucccucaaugcaacaaauacucuaaaacuacuauuuuaacauaacauaguuagaggagaucuauuauaccuuaugacuguuaauuaaaagccaggaggcagcaguaaauaaacugcugccucaauugugcaaguaguaauaauucaggucagaggugcucaaagggaagaccugacuuuacacuuuacacuuaccaccacuuacacuuaucuugauggugaguacaagacaaugaagggaacaacaauggauggaaaagagaaaaggaacagucucacaauguuuagucucaucaucaaaagcuuuuacuaccagacagcacucuucaaagaauuaucugaccauuauaugccuucccuaugucacuccauacagcucugucuccaacaagcaccaauuuacugaugacucaaacccagauuugccugccuagcagccacugcagggagcucaaacuccacaaugaacuuaaucuccacaccuccuccuccucuuucuuucauucccuaggcugaaugaugggaucuuauccacccaagcuaagaaugagggugcaggccauccaugacucccuuacucacuuguuugcuaaacccucaauccugcuuuucagucuuggcaagauuccccagcaucuccagucguaguuccuaacuuugccuaacuauuaacacucuccaauuugauuucacuauuacugaucucaccuuuauuaaugagcccauuucacuagaaggacacacauuugacugucugacucccuugcauuaaaaccauuuauugacucccaaguaccuauuauacaacauuacauuaaccauacuagcaaagcacuaagacuucagacaauuuaaaucuaaccuacuuuuccauaucuuugucuugcuaacuucccuauaugcauccaaacucucaccaaaccaaauuauuuuucagucuccuauauauacuggcuuguucuuucuuaagccuuugcaaaaaaucaccuuaucuaccuagcauacucaguccugguuaccuauaggugaaacuguacuccuauacaucucaaaccauguaucucucuguucccaaagcauuucauacuuucuucuacuauagcaauuaccccacuguauucuugcuuuauaaacuuaaacauaagaccuaaaaccauaaaaagccuagaagaaaaccuaggcaauaccauucaggacauaggcaugggcaaagacuucaugucuaaaacaccaaaagcaauggcaacaaaagccaaaauugacaaaugggaucuaauuaaacuaaagagcuucugcacagcaaaagaaacuacuaucagagugaacaggcaaccuacagaaugggagaaaauuuuugcaaucuuuccaucugacaaagggcuaauauccagaaucuacaaagaacuuaaacaaauuuacaagaaaaaaacaaacaacuccaucaaaacgugggcauggauaugaacagacacuucucaaaaaaagauauuuaugcagccaacaaacauaugaaaaaaugaucaucaucacuggucauuagagaaaugcaaauaaaaaccacaaugagauaccaucucacgccaguuagaauggcaaucacuaaaaaguugggaaacaacagacaccggagagguuguggaaaauaggaaugcuuuuacauuguuggugggaguguaaauuaguucaaccauuguggaagacagugcggcaauuccucaaggaucuagaaccagaaauaccauuugacccagcaaucccauuacuggguauauaccacaaggauuauaaaucauucuacuguaaagacacaugcacacauauuuuuauugcagcacucuucaaaauagcaaagacuuggaaccaacccaaauguccaucaacuauagacuggauaaagaaaagguggcauauauacaccauggaacacuaugcagccauaaaaaaggaugaguucaugucuuuugcagggacauggauaaagcuggagaccaucauucucagcaaaauaacacaagagaacacaaaaccaaacaccacacguucuuacucauaagugggaguugaacaaugagaacacauggauacaggaaggggaacaucacacacuggggccugucaggggguaggggacuaggggagggauggcauuaugagaaaaaccucauguaggugauggguugaugggugcagcaaaccaccauggcacguguauaccuauauaacaaaacugcacguucugcacauguaccccagaacuuaaaguauauauauauaaaauaaauaaauaaaauaagccaaucacaaaaggccauauauuguauuauuucauuuacauaaaaugcccacaagaggcagaucuaucaagaaagaaaauggauuggcucaugccuguaaucccagcacuuugggaagcugaggugggcagaucacaaggucaggagaucgagaucauucuggcuaacacggugaaaccccaucucuacuaaaaaauauuuaaaaaauuagccaugcgugguggcgggcgccuguagucccagcuacucaggaggcugaggcaggagaauggcaugacccgagaggcggagcuugcaguaagcugagaucgcaccacugcacuccagccugggcgacagagcgagacuccaucucaaaaaaaaaaaaaaaaaaaaaaaaagagaacacauggacacaggaaggggaacaucacacaccagggacuguugugggguggguugaagugggagggauagcauuaggagauauaccuaaugcuaaaugacaaguuaaugggugcagcacaccaacauggcacguguauacauauguaacaaaccugcacauugugcacauguacccuaaaacuuaaaguauaauaauaauaaaauuuaaaaaaaaauggauuagugccugggcuaggaagucacugcaaauggguaugagaggucuuauugggaggaggaaaauguucuaaaaccagauuaugguaauggcugcauaauuugguaaauuacuaaaagcuauuaaauuguaaaucuaaagcgacuagauuuuauacuagguuuauuauaccucaauaaaguugcugcugcugcugguuuuuuuuuuuguuuuuguuuuuuuuuuugagauggagucucgcuguugcccaggcuggagugcaguggcgcgaucucggcucacugcaaccuccgccucccggguucacgccauucuccugccucagccucccgaguagcuaggacuacaggcgcccccccgcacaccugacuaauuuuuuguauuuuuuuuaguagaauugggguuucacuguguuagccaggaugcugguuuuuuuguuuuguuuuguuuuuaaaaagcuuguccagacuugugcuucuggucaugacagauuaacuguuaaaugaauuagcccucucagaguuaaaaacuggaaaacuagacaaaauacaugaaaaaggcaguuugcacacacuggacauuaagcagcacuaaacuaugauccugagacaagggacaaaaugagguaagcccuaugauuaccuuggcuuuucugcguggagaaauuuaccagacucuggggcagagaggaaaacccacgcacagcauggaguucucagugagcuaaggagacaaggauuggaauuuagaguaucugagauaaacuauaagcuaacaauucucagagcucacaaaaggcugggaaacaugugagcuuccaucagcuaaagugaagagauauccauuagauaaccuguggcauucaguggagaucccagacaggugaugccuuaggagauacccuagagaaaaaauuacucuggacucaacccgacaaagauuaagaacagccucuaaaaaaucaaggugauccacaaguaacuugacuggcuaucagaacaaagcucaacauucuuaauggaaaguaacaaaauucugaaacucaacaauguaauggucacaauguccaguguucaacugaaaauagcaggcaacuauuaaaaagcuauuauaaaugcucacaguuaugaaagaaaacaugaacacagugaagaaauuaaaacuacugggccaaagggacagacuccugagaagcacagguggcaucauguuccugacuguccuccccaaccacaguagcauuccugguggcaguagauuggucaucuggagaaccacuacuggcugagcaugcccuaccugaccacagggcaggaguaggcuacacuguagugcacagggcagaggccuuugaggccaugaagacagccaacacuuccaaguuccccucacauagauuuguuguagacuagcucgaccaucucaaugucaccaacaaaugguccuaacccugaacuaucaaacacccccaaacuuuuaauuuuuuuuuuuuuuuugagacgaggucucacucugucaccaggcuggagugcaguggcaugaucuuggcucacugcagccucgaccucuggggcuuaggugauccucccaccuaagcccuccaaguagcugggacuacacaugugcaccaacaugccuaauuuuuuuuuuugcauuuuuuaaugguuuugccauguugcucagucuggucucaaacuccugggcuugagggauccaccugcuuuggcaucccaaagugcuaggauuauacaggugugagccacugcgucaagccacccuucaaucuuguagaucacagggcugcccugucuuuaucuggucauggaacucaaacuguagcuucuauaaaaauguaagccuauggaucagaaacuuauuaaaacacacaaauaaaaagcaaaaaaaaaaaacaaaauaaaaaacacacaaauauaaguauaguggucugcauauagaauaccugggacucuaacccccuuaauacuuaaaaauauaaucacuguccuauuguguuucuuguuucuuugaccugacaggaagauaucagggauuuccuggggaacacaugguauaaaauguauuuugaaaaaagcuacaauaaagcuacaaacuaugauuuggggguauuugcuuaaguaugagauacuugauaggggcuuuaucaugcaaaguuaguuugcuuaacugccaacacuuaaaugcaguuuuucaguuaaacauauuccuaaaaauagcauuuuauucugggacuugacuacaaaaagcggacauuuaaaugaaguaaaaauggcugggcacgacgacucacaccuguaaucccagcacuuugggaagcccagaugggcagaucacuugaggucaggaguuugagaccagccuggccaacagggcaaaaccccauaaaaauacaaaaauuagcugggcgugguagcaggcaccuguaaucccagcuacuugggaggcuaaggcaggagaaucacuuaaaccugggaagcggagguugcagugagccgagaucgcaccaccgaacuccagccugggcaacagagugagacccugucuugaaaaaaaauaaaauaaaauaaaauaugaaaaauacaaugaagugaaagguauuuaucagcacuguuaaaaauaaaaaagaaauuaaaacuauuaaaaaauaugcaaauuaaaauuugagagcagaaaaauauaacugaaauuuuaaaaugaaucaauggaugagcuuagcuaauucaauacagcagaagguaaaucagugaacuuuaaauagaggccaacagaaaccacgcaaacugaagcacagggagaaaagagcugaaaaaaauuugacagagauguggugcucugugagacaguaucaagcgguuuaauaacauguauguaauuggagucccaggaaaagggacaaugguauaaaaagauauauuugaaaaaauuuccauauuugaugaaaacuaccaaucauggaucuaaaauguacaagaaucacaagcagauuaaacacaaagaaaacaaaaccaagguauaccacaaaccgcuaaaaacuguuuauaaaaggcaaaaucaagacauaugggggaaaaagauaauuauauuuuuauuagaaacuauuauuaaaaaauggaaacaucuuuuaaguguugaaaggaagaaaauauaaauuuagaauuccauauccagugagaguaucugucauaauaaaccuguacauggauguuuuuaguagcuuuauuuauaauugccaaaaguuggaagcaaccaagauguccuucaguaagugaaugauaaacaaacugcggcgcacucagacauucagugcuaaaacgaaaugagcuaucaggccaugaaaagacaugguggaagccucaaugcauauugcuaagugaaugaagccgaucugaaaaggcuaccuacuguagcuaacuauaugacauucuggaaaaagcaaaacuaugaagacuguaaaaagaucagugguuaccaggaacuggggaagagggaugaggagagaaggcaugaugaguaagcagcagcucaaaugauuuuuagggcagugaaacuauucuguacguuacuaugaugcuauauagaugacacgauaccuuuguuaaaacccacaaauguacaauaccaagaaugaacccuaauguaaauuauggacuuugggugguaauaaugugucauaguagauucaucaauuguaacaaaguaccacucuugugcuuugauguugacagaaagggaagcuugugcguguguagugacaggggguauauggaaacucuccguacuuccuguucaauuuugcuaugccaaaacagaacuaaaauugcuuuaaaaauaaagacuacuuuuuaaaaagugguaagauaaauaccuuucuucagacaaacaaaagcugacaaaaugcaucaacaguagaucugaaauacuagaaauguuaaaggaaauucuuuaggcuaaaggaaaaugauuccagauggaaauucaaaucuacaugagagaaugaagagugcuggaaaugguaaauauguggguaaauauaggacuuaaugguagauugugauaagauaaauaugcauacuguaaaccuuacaacacuguuuuuucaaauguguagguacaaagaguauaaauaucccuuuauauucuuaaaacacugaggaccgcaaagagcuuuuauucguauggguuauagcuaucaaaauuuuucauauuagaaauuaaguuaaacugagaaaaaauaaagcauuauuuuaaaauaacauuagcaaaucuauuauauaacaauacauauaacaauaauauaauuuuuugugaaaaguaacuguuuuccaaaacuaaagcaauucaguuaagaguggcaguuuuacauuuuggaaaucucuuuaaacaucucgcuuagaauacagcugaagucucauugccuucugcauucaaauaugucaugugcccccuggaaaauuccaugguauauuugugaauguaccaaaugugacagaggcauguaauguuuucauauuauuauuaaaacagcuuugaccuuguggcucccuugaaagagucuuaggaaccuagagguccccacaccaaacuuugagaaccacugucuuaaaaccaccaccaagaaguaaagcaggccaggugugguggcucacaccuauaaucccagcacuuugggaggccacaacaggaaaauugcuugacaccagaaguuugagaccagccuggucaccaacaccaccagacccugucucuacaaaaauguacaaaacuuagcuacuuggguggcuaagacgggaggaucaucugagccugguagguggagacuacagugaacccugauggugccacugcacuccagccugggaaacagagugaaccauggcucaaaaaaauaaaaaauaaaagaaaauaaagagguauggcuaagccaauaggaaaaacaaaaacaaaaaaaaaccagaauacuugaaauaaauucuaaaucaauccaaaagaaagcaaagacaaauaaaaauuuaaaaacaaauaauaaagcugggcacgguggcucacaccuauaaucccggcacuuuaggaggccgagacaaguggaucaccugaggucaggaguucgagaccagccuggccaacauggugaaacccugucucuacuccaaauacaaaaaucagccaggcgugguggcaggugccuguaaucccagcuacucaguaggcugaggcaugagaaucguuugaacccgggaggcagaaguugcaaugagccgagaucgcaccacugcaccccagccugggcaacagaacuagacugucucagagaugaaaaaaaaaaagccauccuuaaagacugaauugcuuuccacaaguacuugucaauuccuuuauuuacaguaucauuucugaauuuuagggccuauaaacauaagccuugagauaaauuuuacuaaaaaaaaauucaaagguuucccaccauacaaagguucauauucuuuuacauuuucaaauccccaagaucuauccccaacaaugcccuuccaaccucaugcuggauuacaaguuuuaugaugccuauguucccauacaaguaaacagagcuauuccccaaacauaucccgaacacucccuuccuucccugccuuugcuccagcuuuccuuuuagccuaucuuugcuuacugaaaaauuccucauccuuuaaagcucaaaugccacuuucucacaaaguccuccuaacuuucucugguugaguuucuucuaugcucccaggaugaaaaagcauaacagagcuauaagcaaccauuuguaccaugcugaggaagcacauggugcaggacugccaguguaggcagggacaggcuugaaggagaaguaaucuagaaggaggcuggcuugaagccuaggggaauguguguaucuccuaagaacugagggggacucagcucuugaguauagagaaguuaaucugauugauuguauaugugaauuucugacugaaaaccaagaccaaaucuuaacacuugcacucaaguaacuaaaguuauaagcccugucaugguuugauuuuuuuuuuuuuuuuuuuuuuuuuugagacagagucucgcucuuguuguccagguuggagugcaguggugcaaucuuggcucacugcaacccccgucucccggguucaagcgauucucuugccucagccuuucaagcagcugggauuaccaugugcucaggcaugugccaccaugcccagcuaauuuuucuauuuuuaguagagacaguguuucaccauguuggccaggcuggucucaaacuccugaccucaggugauccaccugccugggccucccaaagugcuaggauuacaggcuugagccacaggguuucaccauguuggcuaggcuagucuugaacuccuggccucaagugaucgggccaccucagccucccaaaguaggcugccgugccuagccuaugauuauucuuuuugggagagaagaccucuaccuuuauuuguucacaacaggaaauacauuuggcagcuuaauucuuucugcacucucauuauuauuugcggauuuauuuauguauacauacaauggcagaaaagaauaaaagugccucuccaaucuucucuaacaacugagugaagcugauaccuuugaaucuccauuggaacuacuacucuauaaccccccgaggcaguuaagagcuaguauuaggaggaauguuuucucuuuauaaucucccguucccuuucguuuuuauacauguaccucccccaacacacaugagcauaucaauauaucagaauuaauugugaauuaaguguuagauuuaguuuagugcucuuuuccuuccuaggauagacuauauuuucuuuugcaggccucuaaaguccuuguuuguugucucuacaacaauuuuuaacaauuagccaggcaugguggcauguaccuauaguccuagccacucaggaggcugagacgaaaggauuacuugagccugagaguucgagguuacgguaagcuaugcuugcaccacuguacuccagccugggcuacagagugagggagacccugccucuaaaaacaaagcaaagcaaaucaaaugacaaaauaaauaaaucccucaguuuaccacuuaacauauaauaccguacauuuucaaaccuuaccuuccuaugaccccugggagcaauagccuugccuuauacuguuuuuguacccccaggucugggcauggcauuugugcugaauaggaacucaaaugucugauaaauaaccaaaaugugaaagagugagaugaaguucagaucuguguguauuuaaaauguguauuuagagauccaaaguuccaagcuaguagauuauaauucaggcauugccuuuuggauauaauacuuucaagagccuacuccccaggcacacaugcaccuaugguaacagaggaguaaagaucaaacauaaccugacaaauauacucacucugggugguuggauauaguaagguuuuaugaucauacuucucuuacaguugaucacagacaauacugccaauuauuuagacuugaauguguaauuaccuugggaccuuguaucacuucagauucugaucuagcaggucugggacagggagugagacucugcauuuuuaacagguggugccuggugcucuugggugcugagcagaccuaacuacuacaauaagcucauugugaaggcgccagcuccauggucaaccccuccaguccaucuccagcagagagccuuguaaaaggcaaauguuacugaucaaaucacuuuaaagguuucccuuucucaccagcuagccagagaaugaacgucuaauuguguagcauggcacauaagcugcccuuuuacuuggccccuacuucucagcuccuacuuugugcuuggcuaguuugaugaccuggauuuccuaacacaggucuucauauaagaaaggcaauuccuugagcauuaaauaagcaacagugaacuucaugcccauuccucauucgcuuugaaaggccuaauuuaauaugcauauacuagaccaaaagacugaaucaagauuaauaguuacggugcccaugaacuugggcuuuuaagaaggguaaggccuccaacaugcuuuauaaacuuggccccagaacucagcuguauugcugcaccagaucuuaucuuaaucccuuuguuuauuuuucaaaagauauaacuaacacaguacagaagucuggaaaugggaguugugauuuuuguuuguauuuaagcuuacauauaauuuaaaugucaagugccuagcagucuugggcauauuccuaaaugauucaggaaaacaagacagcacaacagcuggagugaaguggcuaagugauuuaugugauucauuugaaauuuagcaaacuccacauggauugaacguaaguguguaucuuuuugcaaaugccaaacacaugugaaaagaggaaaauauuuccuccaaaagugaauaaaauauaaacaagaaugaauucauuucuacuuuaaucccuucucacuccagcuccuuuucuucccucuuccuucuuccaccuauucccaauaauuuaaccacugaaguacuuaauucuuuucaaaauuaaaaaaauauuagucagguuuuagaacauaaaaauaugauaucugauuucauucaagacacuucauacggucagcugugguggcucaugccuguaaucccaacacuuugggaggcugaagcagccagauugcuugaggucaggaguucaaggccagccugggcaacacgauaaaaccucaucucuacuaaaaauacaaacauuagccaggcaugguggcgcacaccuauaaucccagcuacuugggugguugagacaugagaacugcugaagcccaggaggcagagguugcagugagccaagaucacaccaaaaaaaacaaaaaacacaacaacaaaacccaccccuccuauugguuuugaacagaccaaucacgaaagcauauguuaugggcacuaacaacagaaugcaaagagaggccgggcgugguggcucacaucuauaaucccagcacuucaggaggccaaggcaggcagaucaccuguggucaggaguucaaaaccagccuggccaacauggugaaacccugucucuacuacaaauacaaaaauuagccgggcguggagugcacaucuguagucccagcuacucgggaggcuaaggcaggagaauugcuugaacccaggaggcagagguuacagugagccgagauuguaccacugcacuccagcccgggcaacagagugagacuccgucucauuuaaaaaaaaaaggcaaagagaacaagagaggcccugaagcgaucauaguaauggguguuuugaacacccaucacaauucuuggccauauaucucccucaaaugaguaaguaguuaguaugcaucugagucucucaaugucuaaaaaaggccauucuuuuuuuuuuuuuuuuuuuuuuuuuugaaaagggauucaggguuguaaugggauuauuuuuuauauuuuuuuauuuuauuauuauuauacuuuaaguuuuaggguagaugugcacaacgugcagguuuguuacauauguauacaugugccauguugguguacugcacccauuaacucgucauuuagcauuagguauaucuccuaaugcuaucccuccccccucccccccaccccacaacaguccccagagugugauguuccccuuccuguguccauguguucucguuguucaauucccaccuaugagugagaacgugcgguguuugguuuuuuguccuugcgauaguuugcugagaaugaugauuuccaguuucauccaugucccuacaaaggacaugaacucaucauuuuuuauggcugcauaguauuccaugguguauauguaaaaaggccauucuuucucccugacuucaucucuacaccuugauacaugcauagucacucacuuauuuuucagaauaaagaaaaaagaaucccaagaccaugcgggauggucuuggacggacucccaaaugaucaggaaauacauguguaagccacacucaccuucaugggguuuucaucauauguuggaguucccagguccaucucagcuucaugcucaaggcuggcaucaucuccugggcuuucccaaguaggaggaucccacugagucugccuagaaagagacaaaaacagccaugcugucagggcuaggaaacagagaauccugacauaaacaucacugcucauacauacauaaaauacaacauacaauaagacauagaauaagucagcuccaugaguuaaagacaaacuuuuucuaucuuccuaacagcaaugauucuagcacagagauaugccccucuucaaugacuguauuucugugggcaaugauguggcaacacugacugggugucaaagagagcaguaaacccaaacauccugucugucucucaccugacucuuaaugucaugcaaauaagacugggcaaagccuaaaauguacaggaaauaggucccugccuaugucaccccucuguagaugaagagguaaacagugacuguaccuagcauauaaauggagcaaaauaaaucauguaacaccucucacaguccuugaccacgugagaaaauuaucccuugcuuuaggaguuuucuuuuuaauaguucugccccucugguuuaaugacugacaagaaaaauacguacagguuaaaaacuuguaccccuggccaggcaugguggcucaugccuguacucccagcacuuugggaggcugaggcagguggaucaccugaggucaggaguucgagaccagccuggccaacacggugaaaccccaucucuacuauaaauacaaaaaauuugccagucgugguggcgggcgccuguaaucccagcuacucaggaggcugagucaguagaauaacuucaaccugggaggcggagguugcagugagccaagaucgugccauugcacuccagccugggcaacaagagugaaacucugucuuaaaaaacaaacaaaaaaaaaaacaaaaacuuguacccucugcuaaaaauauucccgaccgacugcaaaaagaagguuucggccauguuaacccuuuaaauguuuacagucauuuugaaaauaagcaagcaaagauuuuucuuuuuuaaaaaagaucuguaggauaaaaaguggaaguaaggauauucacguucaggagucugaagccagcuguaacagagaauguuaugaggacagugacuuaaaaugucaaaagccucaaaggaucuaacaaaucuggcaggucagucuugucacuacagucuucugcuuuaccaccacaucaaucuucagucaacaacauaacaacauuaaagacacuugauauaaaucaguguauauacauauauauagacuauuguaaaaauaggcuuaccucugaccuauggaacucauuuauuuuaaaaggcucaagauuucuaccauaauaaaagaaccacaagcagcuaaggauguuauuauagaaacugaacaaauauauacaugucuguucuuagcuaccagauaaagaaaaccuagaaaagaugggaaagguacacauauaaauaagaaauacaaacuuuuuuuuuuuuuuauucugauauggagucucgcucugugacccaggcuggagugcaauggcgugaucucagcucacugcaaccucugccuccuggguucaagugauucuccugccucagccuccugaguagcugggauuacaggugcgugucaccacgcccagcuaauuuuuguauuuuuaguauaggugagguuucaccauguuggucaggcugguuucaaacuccugaccucaugauccgcccaccucagccucccaaagugcugggacuacaggcguaagccaccauguccggcccaaacuuuuuuuauuuuuggaagauugauagaauauuuaaaauuuguuuugguguuaaaaaacaaaguucuggccaggugugguggcucacaccuguaaucccagcacuuugggaggccgaggcagguggaucaccugaggucaggaguuugagaccagccuggccaacacgguuaaacccugucucuaccgaaaauacaaaaaaaaaaaaaaaaaaaauuaguugggcaugguggcaggugccuguaaucccugcuagucaggaagcugagaggcaggagaauuacuugaacccuggaggcagagguugcagugagccgagaucacgccacugcacuccagcgugggcaacaaaagugaaaacucugucucaaaaaaaaaaaaaaaaaguucugguuaaaccacacgugguuuuuaaaaucauuacacauucaauuagcaacauaaugaggacucauuuuauaaaagccuuuuuguuuuuugagauagagucucacucugucacccaggcuggagugcaguagcgcgaucucagcuaacugcaaccucugccuccaggguucaaguaauucucccgccucucggcuucccaaguaggaaggauuacaggcaccugccaccaagcccaacuaauuuuuguaucuggaguagagacgggguuucaucauguuggccaggcuggucuugaacuccugaaaucaggugaucugcccaucuuggccucccaaagugcugggauuacaggugugagccacugcacccagccuauagaagcauuuuaaugcgaguaaggaaggcccuucuaagcagaaagggaaaauauaugaaaauuuuaagcuucuuuaugucacaagauaucagaaacaaaacucuugauaaagaaaucuaacacuggacagaaaauggguagauggcccacacaaguaacucacaaaagauacaaaugaccaacaaucgaaugaagacaucccaucucaauaguaaaauaacugaaaauaaaaauauuucccaccuguuagacuugcaagguuaaaauagaugacaugagggaaaaggauuuuuuuuuuuuuuuuuuuuuuggagacaaggucuugcucugucacccaggccggaaugcaguggcgcaaucauggcucacuacagaucugaccuccugucucaagugauccucucgccucagccucccaacuaguugugacuacaggugcacaccaccaugccaagcuaauuuuguauuuuuuguagagaugggguuucacuauggugcccaagcuggucucaaacuccuggccucaagcgauccuccugccccagccucccaaagcauuaggauuauaggcaugagcugcuguacauggcuaaaaggaacuuauacauacuucuuuuugugagaguccaaauugauacaaacuauuguuuaaugguaagcugacaauauuucucaauuuaaaauguguaccuguuuugcccaacaauuccacuucuaaguacccucucgaagaaguaguaagauuagugucccuaaggaugcccaagguuauaguuagauauaaaauagugaagaccuaucaaugagagugaguuaaauacaauuugauauagcuauacaauagagcagggguuggcaaacuuucucuguaaaugauuagaugauaaauauuuugaccugugggccaaaugguuucuaucacaacuacucugucauuguagugugaaagcaaccauagacaauuuguaagcaaaugugcaugguugugcuccaauaaaacuuuauuugccaaaacaaguggccugugggcauaguuugccagcccugcagcaaaguauaaacaauuacuaaaacuaacaguuguagcuggguguggugccucacgccugucaucccagcauuuugggaggcuuaggugggaggaucgcuugaagccaggaguucgugcagaucagucugggcaacaaagaaagacucugucucuacaaaaaaaagaaaaaaaaaauuuuaaagaaaaaauuccauaguucuauguuaauugauaaagcucuaugaaauagauuaguaaauaaagcagacuacaaaaacaucuaucuuaacaauuuacguaagauuauauagauggguguauauauacacacacacacacacagagacacacacacacaaaguacauauacccacauaaagcuaucugucuaaacgguauuuuuuaaaaacauuaaaugaguuaucucugaguaguggcaguuccaggaauuauacuuccuuuuuuaguacuuuucuacuauauuugcuuucuacaguaagcauaaauaaugugugucaaggauaaacaaucuagcuauuuaauuuggaaauagaaaagcgcuguccguaaaaaaaauugaacagcagaguugaguagcuaugauauagacugcuuggcuggcaaaaccuaaaauguuuauuuucuggccuuuuacagaaaagaucugucuaugaccccugauacuuauacaauauuagaugaaggagcauuuaaaaaaucuccucagcuuucuccaagagucuugcagauuagaaauacaccaaaacugccaggugcaggggcucaaucccagcacuuugggaggccaaggcgggcagggcagaucaccugaggucaggaguucgagaccagccugaccaacauacauggugaaaccccgucuccacuaaaaacacaaaaauuagccaggcauugugguacaugccuguaaucccagcuacuggggaggcugaggcacgagaaucacuugaacaugggagcagaagguugcagugaguugagaucacaccacuguacuccagccugggugacaaaauaaauaaaauaaaaauacaccaaaacaaauacaaaaagaaccaaagucuaacgucuaaaauacacuuaagaugugauucuggaaauccagcagccuucaagcacagugaaaagcuaaugacaagaaguuuacaacuguaaaacuccccuuauaguggcaacuucuuugauuaaguaaaagcagacaugggaacgcccauacagcuccucuuaccuugugaucacaugguaguaauaaaucuucccuucuggaucucgagcugucuuccaguugggagguaagacaaugguuuuugguuugggaggagaggggggcggcagauccaagagauuauuugucacaaccauuucagacuacaaagaaaacacacacauuuuugaucagugaucucucucuuaaucuggcugaauaggacaaaauagcccacuuaaauauguaaaaauguacaucuaccuccucuuaaaaaaaggauaaaggaaagguacagucugggaaauaagggacaguauauauaaagagguuuacagagcuaucagaaaauugacaguuggcucuaaguuuaccauccaagauaccauauaguuuaucauauagagcagcauuuuucaacuuuaaaacaccaauucuaaggcauaucaacugcaggauaccaauuaacuaaaugggauacagaaauaucuuuaucuuuaaaaaaaaaaaaaaagaaaaaccaaaaaacccccugagaagcaaauaugacagaauguuaacauuauccauuauauuuuuuccguacuugaaaccucaaaacuauaaaauauuagugccacauucugaaaaacauaaaaaccucauaaucacuuauggacugauuuuuguuuccccaaaacauguauguugaagcucuaauccugcugugacuguuacugggacacagggccuguaaagagcuaauuaagauuaaugaagucaaaagagugaggacuuuuuaucuaauaggaugguguccuuauuaaaagagaacugacaccagaggacacucacagagaaaagguauauacagcaagaaggcagccauuugcaagccaaggagagaggccucaggagaaaccaacacugcugacaccuugaucuuggacuuccagccucaagaacugugagaaaauuucuguuauuuaauccacucagucugugguauuuuguuaccgcagcccuagcagacuaguaaucaccacaaggauauauacuuguuccuucuuucaagccuauuaaugaagaauacauuuuuuaccuuuaccuuugcuugcacaguuaaagaggaaccugaagaccccaggcucagauaaaauguguucacuuuuaagcaaacacgggucuuugagcauucuugcuuuguguauacucuuuuuuaucucuuauuucacccagcugggguuuucuggcccagcuuaaguuucaauuccuccauuacccuauccuuuagcuuauaaagugaccucuuuuccccaagcuucugugucccuuaauauuccaaaccauuuaucucuuaauaguuuaaggcaaaaaagaaaaaauauauauuccaaaccauucaguacuuauucccaacacaaaacuuuauuuuuaguguagucaccaucuuucucuugugaucaucaucucucuuauuugaaagaucagcuuuuaagaauacaaauggaaacuuauuuauguuuguauuaaaaaugccuagucggccaagcacaguggcucaugccuguaaucccagcacuuuggaaggccgaggcagguggaucacgaggucaggaguuugagaccagccuggccaacauagugaaacccugucucuacuaaaaauacaaaaguauuagccaggugugguggugugcacuuguaaucccagcuacucaggaggcugaggcaggagaacugcuugaaccugggaggcggagguugcagugagccgcgagaucaaaccacuguacuccaggcugggcaacaaagcaagacuucaucucaaaaaaaaaaaaaaaaaaaaaaaaaaaaaaaaaaaaaaaaaaggccuagaagggcucaacucguaacaagcacucaaacaucugcucuaaguacacauuaucuuauuauccuguuauuucacauauaguauuuuuaguccaucuucacuaacuguccugucuaaagucaucaucaauugcuggauugcugcaagagcuuucuccagaacuguagguguucuaaagugcugauuugaccaugcuauucuguuuaguuuuuucaguuguuucccaugccaaccucuuauuuuccacuuuauccaaaaacaacaacacuuugagauuucaccauauccuccuacauauguugcagaauaccaaaagcuuaucuuaauauuaaacaucauauaaaaaacuuuuuuuaaacauuguacaacauguauagugaaguauaucacacaauucuacaugccuaguccauggugacuaguacaguaucauauucuaguacagguuaagcagcccuaauacaaaaauacaaaacauuuugagugcugacaugacacucaaaggccauguucaaaggaaaugcuuauuggaauauuucaagcuauacauuuucaaauuagagaugcucaagugguaauuauagugcagauauuccagaauccauaaaauucugaaaugugaaauacuucuggucccgugaagcucagauaagggauacucaaccuguacgcgguaaauacugauagauagcuggucuaggaaauuguuacuucggccaggugugguggcucacgccuguaaucccaacacuuugggaggcugaagcgggcggaucaugaggucaggaguucaagaccagccuggccaacauggugaaaccccguaucuaaaaauacaaaaauuaagguugggcacaguggcucaucccuguaaucccagaacuuugggaggccaaggcggguagaucacgaggucaggagauugagaccaucguggcuaacacagcgaaaccccgucucuacuaaaaauacaaaaauuagccaggcgugguggcgggcgccuguagucccagcuacucaggaggcugaggccggagaauggugagaacccaggaggcggagcuugcagugagccgagaucaugccacugcacuccagccugggcgacagagcaagacuccaucucuuaaaaaaaaaaaaaaaaaaaaauacaaaaauuagcugggugcagugaugcacaccuguagucccagcuacucaggaggcugagacaggagaaucacucgaacccaggaaguggagguugcagugagccaagaucgugucacugcacuccagccuaggugacagaguuaaaaaaaaaaaaaaauuauuacuucaaaaauucauaguaaaauauaaaaauacaaggucaggguaaacaacaaauaaaaaggauccuaggagcauuuuuuuuuuuuuugagauggagucuugcucugucaccugggcuggagugcaguggcgcgaucuuagcucacugcaagcuccgccucccagguucacgccauucuccugucucagccuccugaguagcugggacuacaggugcggagcaaaauauguauuaacggaacuauaaauuccacagaauuaaaaaaauuuuuuuuuuacaaaaugguugaguucacgcccucaggguggcucaggugaauuugguggcuacacaaauuuaaaaacgggccgggcgugguggcucaugccuauaaauaaucccagcacuuugggaggcugaggcggguggaucaccugaggucaugaggucaagacgagccuggucaacauggggaaacuccgucucuacuaaaaauacaaaauuagccaggcgugguggcacacaccuguaaucccagcuacucagguggcugaggcaggagaaucgcuuuaaaccaggagguggagguugcagugagccaagauugugccgcugcacuccagccugggugacagagcgagacucugucucaaaaaaaaaauaaaauaaaauaaaauaaaacaaagaacacgugaaaaaaaaacccaaaaauaaaacccaaaacaaauccaaaccaaaaagaaaaccuuccaaagacaaaguagacagccaaugaguuuuaacaacugaaacauuucuuacuggcugcaagggcugaggcugcccuggugcaacuauuguagucacugcugcggcuggcuguaccaccacuccuuguggaugagcugugaaaaucuguugccccuggauauacugaagacuuggcugggcauaacucuaaaagauaaaaugaagaaaucaauaauuuaagcuuuugucacuuuaauaaacagacugacuuccaaguuggcacaaucuuaaagauauacccauaacauuuuaaaauuuuuuguuuauauauuuggacauaaaugugcaaaacaauuuuuuguuucaaaccccaaaguuucuuuuuuuacuaauucccuauucauuuacuuacuuugauuuuacuuuaucauaagaaaauaaaagcuuuuuuuuuuuuggucauagaaauucuccaacuguuuagcuuucaaugacauuggaaugacauugaaaauuaaacagguggacaguuucuauaagcaaaaaccaaugaagugcugcuccugggauauccaagaaacaaugccacgcugcucuuuucaggaaggcuuuugcuaccaacuuguaauaacaaacagguuguuuggaucagaaaaggucaaagggugugaaucauaguaaauaagaugaucaaauuuuaagcuaccuuuuguuuuagcuuuuuguagucuucuaugauaaaaccccuuggcagaaagcagaaucaaugcaucugaaauucucacaacacaccaauuuauacaguguucuaugaugcaagaagccccuuaacauacaucaucucauuuagugcugaccaccaucaaaaccagguacugcccaugccuggaguuucauaagaaauaaguacuaugcuagggcuuaaaccuacucuguaauuauuucucaagcauagaaaaucugcuuaaauaagaagaggugauaagaagacugaaaaauagccuugcuguccuaagagguggugacuguuaaggaauugaauagacauguauccugugcuuaaggagagauuuugcuccuauggacugagauucuagcagguaaaaugauuacagaaacaucaaaugcuaaguacucaaaauacaaaauauaauuccaaaugacaccaguaaaaacucaaguagucugaauaggcaaugcagcuaucuagcagguuucugaaugaauaauuacugacaggacacaggaaaaaggaaaagaacacuuaauuugguauucuggaucagcuuaaucuacuuggauaauaaaccagacugaaaaacauuaauuguuaaggcagaauuaccaucagaauaguaucacaaagccugagaggaaaauguacagucauguauugcuuaacaagggggguacauucugagaaaugcauuguuaggagauuucauuguugugguaacaucauauaauguacuuucacaaaccuacuaaguguaugagguacuuacacaucauacaguguacuucacaaaucuauuagauaccuaggcuauaugguauagucuguuguuccuaggcuacaaaccuguacagcauguuucuguaauaaagacuuguaagcaacuauaacuuaacaguaucuguguaucuaaacauggaaaaguuacaguaaaaauacaguauaaaaauuuuuuaggccggggcacgguggcucacaccugcaacccgagcacuuugggaggccaaagugggcggaucacgaggucaggagaucgagaccauccuggcuaacacggugaaaucccaucucuacuaaaaauacaaaaaauuagccaggcaugguggcaugcaccuguagucccagccacucaggaggcugaggcagaagaaucgcuugaacccaggagguagagguugcagugaaccgagauggcaccacugcacuccagccugggcaacagagcgagaugccgucucaaaaaaacaaaauuuaaaugguacaccuguauagggaacuaacuauaaacaaagcuugcaggacuggaaguugcuuugaguaagugaguggugagugagugaauaugaaggccuaggacauuacuguacacuacuguagacuauaaacacuugggcuacacuaaguuuauuaacauuuuuuuaauaaauuaacuguaacuuacuauaacuuuuuuacuuuauaaacaaauuuuuucaacuuuuuaacucuuuuauaacacuuaucuuaaaauacaaacacauucuacagcuguauaaacaacccuccucccuccuccucgccaggguggagagcaguggugcgaucugggcucacugcaaccuccaccucccggguucaagcaauucuccugccucagccucccgaguaccugggacuacaggugcgugccaccacgccuggcuaauuuuuuuuauuuuagcagagacgggguuucaccauguuggccaggauggucuccaucuccuaaccuugugaucugcccaccucagccucccaaagugcugggauuacaggugugagccaccgugccuggccuauauuuuuuuuaaaaaagagucucauucugucacccaggcuggaaugcaguagugugaucauagcuuacuguagccuugaacuccuggacugaagcaauccucccaucucagccucccgaguaugugccaccacgcccagcuaauuaaaaacaaauuuguagagacaggguuucgcuauguugucuaggcuagucuugaacucuuguguuugagugauucuccugccuuggccucccagauugcugggauuacagaugugagacaacacacugggccaaauauuuuuuuuauauccuuauucuuauucuauaaguuuuuuauagaauaaguuuucuaaauauauauauauauauauauauauauauauauauauauauauauguauucuuauauauauaaacuuauucuuuuuuuuuuuuuuuugagacagagucuggcucugucgcccaggcuggagugcaguggcacgaccucggcucacugcaagcuccgccucccggguucacgccauucuccugccucagccucccgaguagcugggacuacaggugcccaccaccacaccuggcuaauuuuuuguauuuuuaguagagaugggguuucaccuuguuagccaggauggccucgaucuccugaccuugugauccgcccgccucagccucccaaagugcugggauuacaggugugagccaccgcgccuggccuauauauaaacuuauucuaugaguuuauauuauauauuaaauauauaaacuuauucugaguuuauauuauauauuauauauauaaacuuauucuaugaguuuauauuauuauauauaaacuuauucugaguuuauauuauauauauuauauauauaaacuuauucugaguuuauauuauauauaauauauaaauuuauucugaguuuauaguauauauuauauauauaaacuuauucugaauuuauauauuauauauaaacuuauucuauaaguuuauauauuuguacauauauuuauauguuuuucuuauauauauaaauuuauguuucuuauauauauaaacauauauauauaugggaaaaacauacauuuugauagaggaaacaugaccaaguauuucauagaucaguaagguaucuauauuuuagaauaaucuuauuguauauuucaaaauagcuagaagagaauaauugaauguuucuagcauaaagaaaagacaaauauuuauggugauggauaucucaauacacugauuuuuacaaauuauaugaauauauuaaauuaucacauguacccugaaaauauguacaccuauuauguaucaacauaaaaaaacaaaaacuaagauauaaacacacacacuagccuaggcuuacacggagucaggaucaucaagaugucagaaggccagaagaauuuuucaccuccauaauaaucuuacgaggaucacugucauaaaugccaucuguuguugaccaaaacgccauugcauggcacaugauuguauuuauguacaggcugagcauaaacauuucugauuucccuaaucagaaaucccaaaugcuacaaaauaugaaacuuuuugagcguccacauggugcucaaaggaaauacucgcuggaauauuuuggauuuugacuuagggaugcucuaccacuaaguauauauaacguaaauauucccaaaucugaaaaaaauccgaaauacaaaacacuucaggucccaagcauuacagauaagggauacucaaccuguauacauuuccucucucuuuuuuuuuuuuuuuuuuuuuuuuugagacagagucucacucugucacccaggcggaagugcaguggcgcaaucucagcucauugcaaccucugcugccuguguucaagcaauucuccugccucagucuccugaguagcugggauuauaggcgugcgccaccaagcccagcuaauuuuuuuguauuuuuaguagaaacaagguuucaccauguuggccaggcuggucuugaacuccugaccucaagugauccccacaccucggcuucccaaagugcugggauuauagaugugagccaccgcaccuggccuauuuucuuaucccucuacucauaccaugugcaagugaccauauucucuugccaugaccauuauuugucucccuacauuuuuuuuuuucugagacaaggucucacucuguuacccaggcuggaacgcaguggugccaucaaggcucacagcagccuugaccuccugggcucagaugauccuccugccucagccucccgaguagcugggacuacaggagcaugccaccacauccaacuaauuuuuguauuuuuuguaaagaugagguuucgccauguuaaccaagcugaucucaaacuacuaggcucaagcgauccucccaccucagccucccaaagugcuuagauuacaggcaugagccaccaugccuggccagucuccuacuuuugcccuugacuccugcaaucucuuuuacccagagcagccagugauccucucaaaauaugucagaucacgcuauucaauucuaacugcuccaguggauuuccacauuacucagucuaacaaccaaaaauccuuuuaaagcucccccuaagacccuauuguaacuucuuugacuucauuuccuacuacugguaucuucacuuauuuggaauagaauggguuucauaauuaccuaacauauuuugagugugaacauuuaauauucugauauugauuuuauaaaauaauaaaaaagcuaguucgaauucuaguuuugaaaaaaaaaaaaucaccaggguaaaacauguuauuucuagagugaccaggaagucaaucauccaaauguacaauagaaaacugcuaauauuuuggaagacaaaauuucuuuggccaucagugacaauauguucaugaagaauuuuucugacaagaccggauguuuaaguaaggcucauuaugcagacacuaguauuugauucauauggaauaaagcugugguuuagaagaacacuuccaaauguuggcugggagauaacaacagcaguaucuacuuauguuaaaagccuagacuucuaggcuuuuaacaguauuaauuugguuucuauaaaccaguuugacuggaauaaugcagaagauauacacguuuguugacacauguacauauaucaugugacuuuucuauuugcuaaggaaaaaccuauacgagauuuuuguuuuuucuguaucacagaaaaacaugaauguucguuuuuuuguacccaggcuggagugcgguggcacaaucucggcuuacugcagccucaaccuccuggauuuaagcaaucuucccaccucagcucucccaaauagcugggaccacaggcaugugccaccacacucggcuaauuuuguuuacuuuuuguagaaacagggucucacuauguugcccaagcugguuucaaacuccuggguucaagugaucuuccugcuucagccucucaaagugcugggauuacagaugugagccaccacgcccggcugaaaaaccuguaucacauuuaaagagcccacucauucaaaugacuuaaaauuacacaaauguggccaggcauggugguucaagccuguaaucccagcacuuugggaggccgaggcagguggaucaccugaggucaggaguucgagaccagccugaccaacauggcgaaacccugucucuacuaaaaauacaaaaaauuagcuaggaaugguggugcacaccuguaaucccagcuacuagugaggcugaggcaggagaaucucgaaccugggaggcagagguugcaaugagucgagauugcaccacugcacucuagccugggugauaaagccagacucugucuccaaaaauaaaaaaaaauuguuacacgaaugcuaguuucucaaauauauacccacuagaaguaucuuuaaacugugacuuuuuuuuauuuuuugagacagagucucgcucugucucccaggcuagagugcaauggcgcaaucuuggcucaccacaaccuccaccuccuggguucaaaugauucuccugccucagccuccccaguagcugguauuacaggcacccaccaucaugcccagcuaauuuuuguauuuuuguagagauggguuucaccauguuggccagacuggucucgaacuccugacuucaggugaucugcccaccuuggccuccaaacgugcugggauuacaggagugagccaccaugcccggccuaaaaugugauuucuaaugggaauuacagaagaaaugugagaagguccaauagguuauagagagaaaaauacaauuuuucuguuaccaccucuagaauaauaaaaaaucauuauuacuuuauaucuggaucacuucacuuuauacuaugucagugcaaaaguaguuuucaccauuuuuaacagcaaaagccaugacuacuuuugcaccaaccuaaaaugaaaaauuauagucuaagcacucaaacucuugagauguaauuuuguauaacuuugugagaguaagucacuuauuagugucacaagaccacuacaaauuacgugaccucuguuaaaauugagcuuuuauguuuaguaugcaguuguguaaaaaaaucagucaccucugauaacacauuugcuccaaauauuaaagauacugaauauguagauacacagacguaaauguauauuauaucauguuacauauuacuucaccgccaagguuaucacagcuugcaaacucugaguagccauguuguaugguuaacacugggcuucaacaacacaaacuucaaggcuccuagaggucagauuuuuagggcuagacaacagauggaugaacaugaccagauguuacuucacagcccauuaaugucaauaaucuccccugaauacuauuaagguaacuauuuguguaaguaaccaucaagguauauggugcuuugaaucuaucauuauuaauaucccuuaucuuaaugcaaaucaaaccauucugaggcauucugcucauuuuauagaugagaaaacaaagacucaagaauauuaaugccuguuucuaggaugcacaguaaaugauaaaccaggacucaaaacacauacuaacaauauauucuauguuucucaauacccccaaagcccaguaucaucugaucaauuaaucucacacaguggggaacggaaggauaguugaaccaccacagcccauuuaccuacuacuuaaguacacacaaaguagauuagggaaucaguaaguacuucuugauagggacagaaugaaagacuagaagcaaguaaauugugaugcuuggcucuuagggcuaaugaauaaaaccaagagaaucuuuuuuucucauugggaaggaauaaauggauuuuauuuuauaagaaaaaucauaugaccagggagcucuuuacugaggagucuuuaauggauaucuuucauugcuguugcuuaggcucuaguacugagaugggaccuauuucaggaauaggaauggggauagacauaaaccauuuuuacuguaucccugauacauauuuuuagggaaaaacucaaaacuaauggcuugguccaagaaagaauauggcucauacccaagucaaacugacaguaaaacaaaaccaaaaccaaaacccaaaacauucuguaggagggagaaugaaacauacucucucccuacacacacacacaaacaauucacaccugaugaccaauaaugcccacauuuuuacuagccuucuguaacaacagucauuuuaaaccaaacagcaaacaaaaagcagaaaaaaacuauaagcauguuuaauggaaugcuauuuauaauuaugaaaaauaacuuuucauuuaaaugacuacccccaguaaaauggaugacuauauaagcaaauaggguauuauacccauuaaaacauuuauguauguauauguauauguacacacacacauauaguauaauaguaaauaauuugaaaaagugguuacaaaucauuuuaaggaauugagucaaaucucuuuccccuacuccaagaucccaucacagugguccccauacuuauccccacuggcuccucuuaaauaaagucugacuuacuaucuuaaaaaaaaaucauuuuaaguaggaaaacaugggauaaaaaacuucaagucaagacaaauauauaaaauacauaaaacuugcuuuaaaggaucauaaaaaaugaaaguaguuaauacaguuaggguuuuaguaauuaaaacaggauaccuugucauggccauuuuaacaaauguuuuaauacagcuucauuaugaaaauaugaacagaaguaaaaauuacuguuuaauacuaaguauuaugugcaggaaacauuguugggagucuucaacauccacaauaauucauuuuuaagggguaaugaggagugcugggagagagacagaaauguggugaugauaaugcuuugaacauuuuuuuuucaaagcuuuaaauguacugcuggccaggcacaguggcucacgucuguaaucucaacacuuugggagggccaaggcaggagaacugcuugaggccaggaguucaagaccagccugggcaacacagugagaccgcaucucuuaaaaaaauuagcaggguacagugaugcacaccuguagucccagcuauuugggaggugggaagaucacuugagcccaggaguuuaaggcuguagugagcuaugaucgcaucacuguacuccagcccggguggcagagcaagaccuaaucucuuaaaauaaaauaaaaaauaaaaaaaaguucugccggccaggcacgguggcucacgucaguaaucccaccagcacuuugggaggccgagguggguggaucacgaggucaggagauugagaccauccuggcuaacacggcgaaaccccgucucuacuaaaaauacaaaaaaauuagccaggcgugguggugggcgccuguaguccaagcuacucgggagccugaggcaggagaauggcgugaacccgggaggcggagcuugcagugaaccgagaucgcgccacugcacuccagccugggggacagagcgagacuccgucucaaaaaaaaaaaaaaaaaaaaaaaaaaaaaaaguucugccuuguauaaucuaaaaaaaaaaaaaaagaaaagaaaacaugauuuuuauuuauuuauuuauuuauuuauuuauuuauuuauuuauuuauuuugagauggcaucuugcccuguuguccaggcugggguacagugacgcuaucucagcucacuguaaccucugccuccuggguucaagcgauucuccugccucagccuaccaaguagcugggauuacaggcaugagccaccauggccggcuaauuuuuuuuauuuuuuaguagagaugggguuucaccauguuggcccggcugaucucaaacuccugacuucaggugauccguccaccucggccucccaaagugcugggauuacaggugugagcuaccacgccuggccugaccaugauuuuuagaaaacacaaaaauauuaccaugaugaaggguucucccuugggagaaauggaggccugcuaacaacaaugugaguagguuggaaagugaaucucuauaucuaguucagccuucagaugacugcagccauggccaacagcuugacuguaauuucauggaaaacccugagccagauccacccugcuaagcugcuucugaguuacuuauugucuuaagcugacaaguucuggcaauauuucacacaauagauaaccaauacauauaaaguugaucaauauauacaaguaguccaugguaagacuuccuccccuauaccagauuuaacuaacaucccaugaacagaccauaaagcagaaaagaaaaguuucagaauuaguuaccuguacaauugguggaguugucugugaauaaggugaugucacaccauagacuguuggacaugucuguccuugauaauauaugguugcuugagacugugcaggagaguacugcugcuguacacugacagacuguugguuugaaucccaaacacuauaauucugucccugaacugggccgggggccggcacuggcaagacagcaacgcuggagucuugguguacuacaccaucacucugggccacauacugggaacuggaaacuuccacaggagcugccacauguggcaccacugguacugguggaggggcagaaagggguucuguagaaugucccaccaagggcugagcaugaucauaaggagcaggagaacacacuggguccaugcugggugugggcaggagcaccuuuccagcauuaggguugcugggauccacauaggccugcaugggauaaccugguggguaaccagcaaagggaugaugcggggcauuauaaccaagagagucauagggcaguggugaugucauucccagguucugcaucuguugcuguuguuucugagccucccguugagccaccucuugcucaaacaacuuccggcguuccucuguagaaaguuuauugcggucuuuaauucguacuuucuuuuuagaaguugguguaucauaucuagaaagaaaauaaggaccacaaaaaguugcucccuaaaucauagacacaaucaaagcacuaauaaguauuaugucacucaugacuaaaccacuaaccacaucaaacccuauuuggcacugguuuacaacuauacucaaaauuacucagcuugucuugcacacagaacagaaucccaaggaauugacaaagagaugaaaauaauuucaucucuaauuucaucucuacccuuaguuucuagaauuuuaagauuaaagauagauacagcauccuauucuuuauagcuggggacauuucuauaaucacaaauucuaaaauuaaaauaaaaaacaaaauaagugucauaaaccaagaaauaauccaauacucaauccaauuuauugucccuaaauuccacaguacgguuaagcaggagauuagauaugaagagaaauaguugaaaaauaaccuucaaauucaaaaguccaaugaauuccaacugggaaaagaaaaagaaauccucauaaaaacauacagcagaaagacauauacaaagagagccucuuaaaagcagaccaagagaaaagcccgauuaaagaaggaugaaaauuagaccaagucucacaaaaccaguuaagggaagccagaaaacugaagaauaaauagagucagaauguugagagaaacuauuuccccaaaaaaacuuccuuucaaaaaugagggagaggccaggcaugaugaggcaggcagaucaccugaggucaggaguucaagaccagccuggccaacauugugaaauacccaucucuacuacaaauacaauuagcugggccugguggugugugccuguaaucccagcuacucaggaggcugaggcaggagaaucgcuugaacccaggaggcagaggugggagugagcugagacuacgccacugcacuccagccugggcaacagggcaagacaccgucucaaaaaaaaaaaaaaaaaaaaaaaacacaaagagggagaauauucacauaagacuuguacauagcagcaacauucacaauagccaaaugucucugaaaugaugaauuuauaaacuaugguacaugaauacaauggacuacucagcaauuaaaaaaaaaccuaccgagacacaaaauaacauagaugaaugaaucuaaaaugcaauacgacaagugaaagaaggcaaauucaaaugcuauauacuauauaucacuuuuuugacauuauggagaagacaaaaccagagggucagaaagcagaucagugguugccaggaguuagggauguggaagggacugacuacaaaggggcacaggggaauuuuuuuuuuuuugagauggagucucacucuguugcccagacuggagugcaguggcgcgaucucuguucacugcaagcuccaccccccggguucaugccauucuucugccucagccuccagaguagcugggacuauaggugcccgccaccaugccuggcuaauuuguuguuguuguuguuguuguauuuuuaguagagacaggguuucacaguguuugccagguuggucuugaucuccugaccucgugauccgccugcuucaaccucccaaagugcugggauuacaggugugagccaccacgccuggccuuuuuuuuuuuuuuuuuuuuuuuuugagagguugucucauucuugucacccagacuggugugcaauggugugauaucagcucacugcaaccuccaccucccggguucaagugcuucuccugccuuagucuccccaguaacugggauuacaggggugcaucaccaugccuggcuaauuuuuguauucuuaguagagacagguuucaccauguuggucagguuggucucaaacuccugaccucaagugauccgcccgccucagccucccaaagugcugggauuauaggcgugagccacugcgcucggccgcaaauuuuuuguuuuuuuuuugagacggagucuugcucugucacccaggcuggagugcaguggcguaaucucagcucacugcaaccucugccucccggguucaaacaauucuccugccucagucucccgaguagcugggacuacaaucaugugccaccacacccggguaaucuuuguauuuuuaguagagaugggguuucaccauauuggccagacuggucucaaacuccugaccucaugauccacucgccucggccucccaaagugcugggauuacaggcacaagccaccacgccuggcugggaauuuuuuaaggugauggaagugcucuguaucaugauugugguggugguuacaaaacuguaugcauuuuauuuauuuauuuuuucagacagucuuucucugucacccaggcuggagugcaugguguguucucaccucacugcaaccucugccuccuggguucaagugauucucaugccucagccucucaaguagcugggauuacaggcaugagccaccaugcccagcuaauuuuuuguauuuuuaauaaagacgggguuucaccauguugaccaggcuagucuugaacuccugaccuuaggugauccaccagccucgagacccaggaauucaagaccagccugggcaaaauggagaaacuccgucucuacaaaaaaaccaacaaaaaaaccgggcaucguggcacuuccuuguagucccaucuacuggaugggugcugaagugggaggacugccugagcuggugcagguaaagcaaggcugcagugagccaugaucaugccacugcacuccagcuugggcaacagaguaagacccugucucaacagagaccucauuagacagagauaagcauacucaaaauuguaucaaugucaagucgcuacagaaucaucucuuugguggguaggguucuaaggaagcagauuuuaaagaagaguaaaagucugagaaaagacaagauuucccagaggaaaaccaagaaggcaguagugauuugcuaccaagaccuaauagaagcuacagucaucaugagccccagaaagagaucuucccauauaugaaaauuugugggagagaggcaccacugcagacaagugaaaaggauggguuuucaaguaaauggugcugggacaauuggguauuaaauaaaacugaaucccucccuuauaauauauacaaaaauuaauugcaaauggauuaaggauuuaauucucuuaaaauacaaaaaaaaucaccuccucaagggaggauuucuaaaaacacaauuuaaaaaaccauaaagaaaacauaccauauaugacacauucagcuaaaccauaauuaauaaauuccauguaucaaaagguacaaaaagugucaaaauacaagccguaaacugggagaagauauuugcaacaauuaucaccaagacaaaauuauauuuagaauauaaaggacacauaaaacuaaaaaagacaaauaauucaaugaaugaacaacacauauaagauacuucacagaacagccaggcgcaguggcucaugccuguaaucccgcacuuugggaggcugaggcagauuacgaggucaggagaucgagaccauccuggcuaaaauggugaaaccccaucucuacuaaaaauacaacaaauuagccgggcaugguggcgggcaccuguaguuccagcuacucaggaggcugaggcaggagaauggcgugaacccgggaggcggagcuugcagugagccgagaucaugccacugcacuccagccugggcaacagagcaaggcucugucucaaaaaaaaagauacuucacagaacaggaaacagaaauggccaauacaaaccuauaguaaccaaaacaacaugguacuggcauaaaaacagacacauagaccaacagaacagaauagagaaugcagauauaaauccacccguuuauaaaccaacucaacuucaacaaaggcaccaagaacuuacaguagggaaaggacagcaccuuuucaaggacagcaccuuacaguagggaaaggacagcacauuuucaauaaauggugcugagaaaacuggguaacuacaugccaaagaaagaaauggacaauaaauacaugacacgauguucaaucuauuuaguaauuaggggaaugcaaauaaaaaucacauuacauaccgagauacuuuaaaacuaaaaaauucugccaaaugcaguauauaaaugcuuuaucucaauuuuuuaaaaagcaaauuuaauuuaaaaagaacuugucugggauaaauguuuucuagccuccaguaaacgauuacaugguuuguuuuucuaccagcauaacaagagagcuucugacuagauuuauuaaaaaucagcauuuuaauuaguauggcacaaaacucauaagaaaacaaaguucuagcuuuuaaagaauaaccauuaucuuugaagacuuaucucccaccaacccccauugcgcucgaaagaacaaaucuuuggcucccaaaacgacauuuaaauauuaucaaauaggagccauucaagaaucaaaaccuauuaaucuucacagcuacuacuacugucaacagagaaucugucuuaagauuaucaguaaaguuguauacucacucaucaaaaugcaaauacuaauuccaaaagcccuugauguucacaaucagaaguauaugacuuggguacuuuuuaacuugcucaaaacaaaaacaaaaacaaaaaaacucacacaggccacuuaccugucaucuggccuuuuuguuccccgcucauaggcagaagaggguggugagagggagcuucuucguuuccuuuucucuuuauuuugaguuugcuugucugggucucucucucuugaccuauuaggagucuucggggcagguguuugaucucugaagccaacagcaucccuuccucguucaguugcuaagggaaaagggugguuuguuuguuuuuuuuuuuuuuaaguuuauuugguggacuuuucuccaucaugacaauguaucaacuguauaauaaaacuucuauccaacaaauguaucuauggacuccuccgucaucuacccaguucugaauuugaaagagauacaaggucuuaugucuguguucacucuacucacuaaaagucucuuucacaaaugcccuuuucuccucuuucccuccaaagacucagucuaagccguuaacauuucuauaauaaguucugugagcacaugcaugcaagauauucccauuacauuuagcaaggcaguuuacuugccaguucaaaaauguaaaagccuucaacuacccuauaacucuucauauuuauaaucuauagaaaagcagccugaugugcuaagcauaagaaccucaaugagaaaaguuuauuuuuuuuuuuaaagguacgcaugguggcuguagucccagcuacuuaggaggcugagcugggaggauugcuuaagcccaggaguucaaggcagcagugagcuaugauugcaccacugcaguccagccugggcaaacgaagcaagaccccaucucuuaaaauuaaaaaaguggcuuaucaggcaacauuuuaaugaacuacaguuaucucuugguauaaaugggggacugguuccaggaacccccuucucuccauaccaaaaucugugcauacucaagucccacaauccaccucacggaacccacauauacaaaaaguugccccuccuuauaggcugguuucauaucuuaugaauacuauauuuucuauguagauuugguugacaaaaaaauccacuguauguguggacuugugcaguucaaaccuguguuguucaagagucaaagguauaaauauaaaaggaaaauauaucaaacccaggugauaacuuuggaagucaucaaagccagagagcuacaucuuaaaaaaacauaauaccaggcugagcauaguggcacacacuuguagucccagcuacuugcaagaggcugaggcaggaagacugcuucagcccaggcauucuaggcugcaaugagcucuguuuacaccacugcgcuucagccugggcaacagagcaagauccugucucuuaaaaaaacaaaccgacaaaccaaaaaaucagaaugccagcuuccuauucaaagaugguauuaauaaccuucuuaauuuacagugucucucuuuaccuagaaucguucuuaaucucacuguuuucacuuacccaauuccauuccagugcucuccaaagcuguccuaaguacuacuuuucacugaucacaccuccuaguuucucaucuccuuaagaagucaaucucggccgggcacuguggcucacgcuuguaaucccagcacuuugggaggccaaggcgggcagauuaugagguuaggaguuugagaccagccuggccaacacaguaaaaacucuccucuacuaaaaauacaaaaauuagcugggcacgguggcaggugccuguaauccuagcuauuugggaggcugaggcaggagaauggcuugaacccgggaggcagaaguugcagugagccgagaucgcgccacugcauuccagccugggcgacagagcuagacuccaucucgggaggaaaaaaaaaaacaacaacuacuaaaucucaccacuaaacauuucaguaucaauugacuggcauaauaugcuguugcuuuguguauguuaguauugcucucuuauugagaauuucucucauaggacaaggaagagucucaauaaacauuuacugcuuuuucuuuuucucaucucauaaaaauguucuauggguuguuuuacucccucagcaaccgaguuagguuucauaagcauuucucacaguucuuuuagguggcccaaaaccccaaguauuugcaacaugguuacuaaacuacagccagguaugagcauucgucaacaagaagcuaacagaacucauuuguaccacauccggguagaaaaugcaguauaauuaaauuaagugcuccaguucacaagguauuagcacuauauccuuuuaugagguaccauuauccaguugcaucuggaucuacccacgucuaucuugcuuccuccugcaaacccagguuucuuaccuaguauaaauuuccuuaaaaugugacuauuucuucacuauacccugauaaaacaaaaaaggaaucauaccaacaguucauauucugacucugcaccuuagaauaugugaggcagacaagucauuccauuuauucaggcugauuuccuaauauuauaaaaaugaggguaaaguuagacuacguauuuccugaaguguuucacaauccuuccaaauuuuaaagguucuaugcuuuguuugacauuaagaaauggaaaccaggcuuauauauauuauauauauguaaauauauauaaaauauauaaaauaauauaauauauaaaaauauaaaauaauuauaagcauuauauauuauaagcauuuucuuauuuuagaaaccugagacugagaugaaggguucuacaugugaaagagagacuaaggucggcagaaaagaggcuacucccugaaaagauauaguuguucauuacagaucauccucugcaucucauggaugcaaaauauuucuccacaauaauuugcaaauaucuagccacaccagacuagauauuuacaaaauauuauggagaaacgcucauagguauuuaagcuuugcuugugugcuacuaauaguuuuaacucagugaucccagaaagcuagcuucugauaaucaacccuauaguggugccacugguuuugccaaccacuauugcccaguccugccuucuuuuuuauaggaagaguuauuugcagcccuaaguagaaugugaggcuaugaagagacuaaaccagagaguggaacuaaaaauauucgaaagacaaacaauggugcaaagguuaucucacaggucuuuaaccaauaagacuaagauuauauaaaaaguuaugcacaccaaaaauaaaaagacaaaaaaaaaaaaucacacuggcuucuucauucuacuuuuagugggucagugguggagguacucaugaaaccaauaaccaccauaagugacccuauuccuugaaucucuaaguaagugugcuggaagaaaggaaggaaauucuuaaggcugggcauaguggcuuacaucugugaucccagcacuuugggagguggaaacaggagcacuuaaggacaagaguucaagccuagccuggguaacauagcgagacucugucucuacaaaaaauaaauaaauaaauaaauaaccaggcaugguggcacacaccuauagucucagcuacucaagaggcugaggcaagaggauugccugagcccaggaguucaaggcugcagugagagcuaugauggugucacugugcucagccugcaugacagaauaagacacugucucuaaaaaauaaaucaauaaauaaguuuguuggaaauguaacuaagugguaaaguccagaaaccagauucccauggccucccugcuauccauucugaaacaaugauucuaacuuuuucaggggugacugagaaucugaucaaaguuuugaacuugccucagaaaaguaaauacagucaacccuugaacaacaugaguuugaacuggaugaaaguccacuuauauguggauuuucuucuaacugugccacccaagacagcaagacuaaucccucuucuuccucgucagucugcucaaggugaagauaaggaugaagaccucuaugaugaucuauuuccacuuaaugaagaguaaauauauuuucucuuaugauuuucuuaauaacauuuuuaucuagcuuacuuuauuuuaagaauacaguuacauaauacacauaacauacauaauaugaggagucaaaaguuauguggaauuucgacgcacaggguaucuguaucuccuauguuguucaagggucaacuguguacauacagaauuuuacauguaaacaucuuuuuuccuuuuagagacagggccucacuuuguugcucaggcuggaguacaguggcacgaucauggcucacugcagccucaaucuccuaggcucaggugauccuccuaccucagccuccugguaauuaggauuauaggcacacaccaccacacuuagcuaauauuuuuguauuuuuuguagagacaggguuucaccauguuucccaggcuggucucaaacucuugggcucaagcaauccaccugcuucaacuucccaaagugcuaggauuacaggugugagccacccugcccagcugcauauaaauaucuugagguaaagacccucccaaagacaucuagaaguauagguuuaagaaugucugcucuaucuggugcgaaggaaaaaaaaaaucaaaaucacaauaauaaaagaaaaaaagacuaaauaaaaaaaauaaagaaugucugcucuagaggacaaacgaauagaaaaaaagcuaguaaagacugaguucaaggaaagcgacaacaaaacaguguaagagacauuuccuuuggcaaaaugcauuaagaauaaaagcacaaguuuccaaacuuuuacaccaaauauuucauuuaccuaguuauauauucucuaguuucaaaaacaaaaacgcuuaaguucuuaucaguuaccucugcacauaacaaaagaauauuuguaaagccaucaacacagaguaucucugaauaccuacuuguguuuuccuuuucaguuugacuuuucuuuggaauucgauauaccuccugcaaaaaauaaaccagagggaggguuauuagugaggguggaaauggugauugcuuugaaacugacuguuuucacaugacaauaaagaaauggaaaguaacaagcugguacuuauucucuaaaauuugacuuauaucugggcuuuaaauaagaauauauccuggccccuuaaaaacaagaaaaaauauauagcagaaauacauauauuuacaucuaucaagcuuguacgaucucacuagcaaagcagcauacuaaaugacugggcaaggauacgcuuccugagcaucuuuuuuuuuuuuuuuuuuuuuuuuuugagacaaggucuugcucugucacccaggcugaagggcaguggcaugaucucggcucacugcaaccucugccucccaggcacaagcaauccuucugccccagccucccaaguagcugggaccacagguggaugccaccaugccccgcuaauuuuuucuauuuuuguagagaugggguuuuaucacauugcccaggcuggucucgaacuccugggcucaagcaaucuacucagccucccaaagugcugggauuacaggcgugagccaccaugccuggccaaguauucauaauucuaaugugcacuugccaucucuacuuagagaaagaaaagguuaauaacuacccaguuauauaaaaacacuucagaaaaauuguauguguaaagacaauuccuacuauucaguguauuuuucuauaaaugcaaaaccaacaugacuaauggccaauguaauaucuacuuucacauuguguuuguuauaaaaaauaaaaaauauaaaggauaagcauuagaucacugcuccucuugaucacuguaccaaaauugauccugagaaaugugaacuguuuuaaaggcuuuuaaguaccuuuucuuguguuaucuaaggccuagaaccuauuuuguucuuuaacagcucuucacuauuccaccguccaucgaguaacuauugggcacaauacuuucuuauccagucaucuuaagugggacaguaacaagccuacacacucucaauaguacauaaggugauaucaucccuucagaggaaucucauaauauuaaccacaccuguggccuccucuccacaauuguugcuucucacaauauuugugaaaaauaauaagccacaugucacacaacugaggaaaggucaugauguaauauucaguugccauuaaaaaggaucaauauggacugcacagauccagggaaaucuauauaaaugaaaaauuuuuuuaaaccuccaauacuauaugcaugcugacaaauuaauaaagaugauuauaauuaauugugcacuuauacugugugccagauaucaugcugaacauuucaaauacacuaucuuuuuuuuuuuuuuuuuuuuugagacggagucuugcucugucauccaggcugggguaaagcggcacaaucucagcuuacugcaaccucugccuccuggguucaagcaauucuccugccucagccuccugaguagcagggauuauaggcacacaccaccaugcccagcuaauuuuuguauuuuuaguaaagacaggguuucaccauguuagccagguuggucucgaacuccugaucucaugaucuucccacccuggccucccaaagugcuaggauuacaggcguaagccacugcgcccggccuaucuuuuuguuuuguuuuguuuuuugaaccggggucucugucgcacaggcuggagugcaguggugcgaucucagcucauugcaaccuccaccucccagguucaagcgauucuccuuagccuccccaguaacugggauuacaggugcaugccaccaugcuuggcuaauuuuuguauuuuuaguagagaugggguuucaucauguuggccagacuggucucgaacuccugaccucaugaucugcccaccuuggccucccaaaguucugggauuacagaugugagccaccgcacccggcccuucaaauacauuaucuuauuugagcuucaaaacgacccuaugagguaaguacuauuaccucaauuuuccaaaaaggaaacuuacuuaaaaagcuuagcaaucuacccaagguuaugaugcuaccagacagucuaacucaagagcacuuuuaucuucuguauuagaugacacaggacaugccuaacaacauuauuuugagaaggaguaccauucugagauuuaugcacaaaugcaggugacauccuccauccccuuaaccucuccuuccuauguagaagaacuuucauuagagcugugauucucuacccugguuguacaauuaaaccacccaagaagcguucauggaaauaccaccccagacaaagugaaucuaaaucucuggauguggaugccagacaugcguauuuuuuagaagcuccucagaugauucugaugcacagagaaggcugagaacuacugaacuacuggcuauucuuauccucacccaccccuccccacaagagagaaucugggagaaaaaacuagguaggccugcccucagcuaagagacaucugggcucucuuuucucuugaucugcuuuugccuuuagagaggggguacauucccaucugcuacuaugagggacaucugaaguuacugaguugucaauuucuagcuguggguaauacugaaucaggaauaaagacaggaaggagcaagcuggcacucuuaguucugugugucuuacuccucugucugccucucagagggguuauuagacaggaaaaaguaagaacgccauuuauuaccaucuacccacacuauaagggaaaaaagguauucugcuaauuuuaagaagcuuggaaaugacauuugcauuagguacucuguaaaccuaggcacuccaaaagacagcagguucauucacaaaagguacuuagaauugguguauugagggucccacuaagaauaacacaauuuugaccuaguuucuuuugcauaauaucuuggcauuauaagcauuuauuacaaaaauuuaaaguaauuuauuacauaggccucaaguuggggacccacucuguagcggcaguuaauguaccaccagaaacgcuucucaaagauaaauucuuaguuacguucaaaaguuuagaucaacuacuaaguugaaaauguauuuugauguucacaaaauaaugauuacuacugacuaaugaccaggagcuacuauuuacugugugccuaaucacaugagaaacaauuucuaucaauauguaccuaagcacuuggagcugcuaacuugauccucucucuuucuagucaaggcuacauacaaaauuuaagcuggcaacucaaauuaccuacugucuccuccuuauuuuauauauuaagagaaugggguccugaaaauacaacugaaguuuuccaaagucccacaacauugaaagcugagaaggaagcagccacgcgaggauaacuuugacauuucuuaagaucauucugucuugugaauaauaguauuagucucagugauacuugagucugucuggaauaaugucacauccauaggccacagagucuguuacagaaaauguuuaaauuggcuucauucauguuaacccuuaauguaagaucaccuuacuuuguuaaauauuccacucaagagacuggcauacuauaacagaagauuucaaaaugauaauuauaugaucugccaaacaagggagaauagaauaaggacauuuuucagaucuauaaggucucaaaauguuauuuacuggaagagaauacugaagacaauacuguggauguucuaagauuuaauauuguguguguauauguguguauagcgauggggucuugcucuguugcccaggcuggucucaaacuccuggccucaagugauccuccugucuuagccucccgaagugcuggaagccaucauguccagugcaguggugugaucauagcucacugcacccucaaacucccaugcucaagggaugcuuugaucuucagcuucccaaguagcuggccuacaggugcgugccacuaugccuggcagguuugauauucuguaaguuagguucuaggacugcucuugcccucagacagaccuaaaagaaucugcuuccacacuccaucugauacuuuuuacauauuguccucuuauuucuuuagugucuaggugcaaaccucaacuaacacacaauucauacacacucaagcuauaauuauuaugggcccauacugucuuauucuuuauuguaucucuagcaccaagaacagugucuggcacauaaucaacacucaauuccuuucugaauggaccaacaagugaaauucuacuucuaauuuauagaaaucaccuacacagugcuacauaaacucaaaauacugcauauacccuacgcuuuuaucccuggaaagaacuacuguuuaaaggccucaccuacagcccaaaacauuguguuuccagggucagagugauaaauauacauuugaaauucaggaaacaggcuaaagcaaaagaucacaauuuggggaaauuuaagaaacaauaacauauagugauacugcuggagauugcccagacacaaaacauacagaaaaaaaaaaacaaauaaaaguaaaagguagaaagucuuuaacucgaaauaguauguuccauauaguauguuuucuauuaauaaacacuugaacaaguuaccuacuacuaccaggucacauggcuuacuuuacaacguuuucuuaugacaggcucaaaagguacucauuggaagcaaugcagcacuucauuaauacaucccaaauaaacucuaaaaauauacuguagaaacaggauuaaaacaaaauuauuaaauaauuuauaagaaaucuuuuucugacaagaaaaagguuaccacugguuuagacuguuccugagcuaaacaacacuuauaagaacaaaauaauugguggggcgcaguggcucacgcuuguaaucccagcacuuugggaggccgaggcgggcagaucacgaggucagaagaucgagaccauccuggcuaacacggugaaaccccgucucuaccaaaaauacaaaaaauuagccaggccugguggcgggugccuguagucccagcuacuggggaggcugaggcaggagaauggcaugaauccgggaggcggagcuugcagugagcugagaucacgccacugcacuucagccugggcgacagagugagacucugucucaaaaaaaagaacaaaauaauuuacaggcgcaagauuuccaccuuuuguuauauagagaucagauuaucuguucuguaauaacagauuuauuuuugaaaacuaagacuagauuuaguuauuccuuguuaacaaguacagaucaaaucucguauaggccaaccaaaccuuuuuuccuaaauauuuuccuaaaugacagcaauacugagaaagagaaaaaaagacugcaagcaagccugggugcaguggcucacaccugugaucccaacacuuugggaggccaaggcaggcagaucgcuuuaggccaggagccugggcaauauagcaagaccucgucucuagaaaaaugaaaaaauuaggaccgggcacggugacucaagccuguaaucccagcacuuuggaaggacgaggcaggcagaucacgaggucaggagauucagaccauccuggcuaacacggugaaacccugucucuacuaaaaaaauacaagaaauuagcugugcgugguggcgggcaucuguagucucagcuacucaggaggcugaggcaggagaauggugugacccugggaggcggagcuugcagugagccgagaucuugccacugcacuccagccugggugacagagcgagacuccaucucaaaaaaaaaaagaaagaaagaaagaaagaaaaaaaaaaaggaaaaaugaaaaaauuaccugggcauggcagcccaugccuauagucccagccacucaggagguugaggcagguggagcucuugagcccaggagguuugagguuccagugagcuaagauagcaccacugcacucuagccuggguaacagagugacauuccaucucaaaaaaaaaaaaaaauacugugaguaaacugucacuuucauagcuaaaagaacagacaaaacgcaguaggaauggauaaaaagaaaguagaaaagcaaagcuauggagccuagaaguucaggugccaacuucagguaaaaggcauucuaggaaagaagaaaauauuuuacaaaauuaagcagauaaauuuuccagaauuaaagaaauaugaaauacuacugagcaauaaggcuaagagggccaaagggaaaacagaaggauuaugaccuagcaagucugcaccugaguagaggggaagcgcaaguaggucaaagagauuugauuagaagauacuauacaugucuggaggguuucauaaaaaucacauacaugggugggaaagaggaagaaaagagugagagggagaagaggaaaaggggaaugaaauaauuuuguuuaugcuuuuaaaccccugaagaaacacucuaacuucgaauagcagggcuccgaagaaaugaaagguaacaagaucugugcaguuuucagccacuaagaaaaaugggugaagaauaugaacaaaguucuuaaaguaggaaauacaaacagaaagauguucaauaccuaauacauaugagaaaaauuaaaucaaaacugcaauauuccauuuuugccuaucagucugaccaagauaaaacuugacaguacuugugcuggccagggguggugaaauucucauucuuacguauauacacugccaaugagagcugaauugauauaauaacuaugaagagcaauuuggcaaugcuuaucaaaauuacaacacagacuguagcucaacaacacuaauuuuuaguaacuuagccaacaugcauauuccuacgugugaaugugugcaaugacuuaggugaaaauuacuugcugcuaaggcaaagaaagcaaucaaccuaaauggcuaugagaaugauuaaauaaauuauggcauaccuauacaguaaaauaauaugcaguucugaaaaauaaauucuuuauaaauugauaucaaguaaucuucacauucuauuaaaaaggagcugaauaaugcugccaauuuuauuuuaaaaaauaaaauauaugcauaauaugcauaaauuaucucuggaaagcuacacaagaaacugcuugauugccucaaggaaaucagauggaagccaaggguagggaggaaacauuucacuguaugucuuucauauuuugccucaugugcagaaauagccuguuuuuaaaacuaaaaaagaagaagaaaagauaaaauaccucagaaaaaguccuaggcauaguaccaaagacucuugugcauuauggguguauucuugguaaagaccauagcuacucacaaggcaacuuguaaauguuguucuucaguaagugccauaccuagaaaguccuccuaguucacugccucuauuuaaacuuggucccccaaccaccuucuuuucuagccuuacccacccuucacuacaaagcuaagaguaggagcccuccugauacccaaaucaucuagaaacacuuuuugaaccacaguucauuccuuucucaacccagauauauacacgccccuguuagagaaauugcuuauauuuauggacccucaccccagaaaugcuauagucuuacauguaauuuuagagguucuaaacaucuccugaaguucaauuauggaucacagauuaaaaaucucugcaguaggccgggaacgguggcucacgccuguaaucccaacacuuugggaggcugaggcagguggaucacgaggucaggagauugagaccauccuggcuaacacggugaaaccccgucucuacuaaaaauacaaaaauuagcugggcgugguggcaggugccuguaguuccagcuacuccggaggcuguggcaggagaauggcgugaacccaggagguggagcuugcagugagccgagauugcgccacugcacuccagccugggcgacagagcgagacuccgucucuuaaaaaaaaaaaaaaaaaucucugcaguauuaaaggaaaaaaagauacuugaacaaaacacuaaaaugguuucuaugacauuagaaugaauucagacuuauuauaguuucuaaaucagaagcagauuaagaaugaucuaaaaaggcugggcgcgguggcucacacccguaauccuagcacuuugggaagccgaggugggcagaucaccugaggucgggaguucgagaccagccugaccaacauggagaauccccaucucuacuaaaaauacaaaaagaaauuagccgggcgugguggugcaugccuguaauuccagcuacuccggaggcugaagcaggagaaucguuugaacccaggaggcagagguuguggugagccaagaucaugccauugcacuccagccugggcaacaaaaucaaaacuccgucucaaaaaaaaaaaaaaaaaaaaaaaagaagaaucuaaaaaguauuugccaaagaaacacaauugcaugaacugccuagaaaagacagagaaauaguuauuuuuuggaccagaaaagugaguggaagaaggcaguauuuaaaucagaagacauaagucaauugucagcugucacuuaaaagcuaaguuacaaccucaugggccuguuugauuccacuuuacagcugauaaaaacaccaccacuuaacuucacaggguugaaaagauaacaaugugcuuaugaaaauauuuucugaccaucuaucaaauaaaaaauauguucuagggauucgagaagcaguaugaaagaaaguaugaaguuaccacagaaaaagauggacuuucuucauauuuucauucacauauuuuugaaaugucaaacuacauuaccaagcucuucacaggacacugggaagacccaagugaccaagacauaagcagucucuuccuucacucaauguaccacuauaaaauguuaucugccuuugauuggaaaagauguugugagagccuauacaaagggcaaaacaaacacucuaucuuggagaaacaggaaagacuuuccgggggggaaaaggaagaaauuuaaaugagaagagacauccaaaacaaaagaguuuucaggaaugaauguaugugugugaauauuagcagcagaggucuacugccugucuacaauggcuugagaggagacugcagaaauaaauggaaaccagaccauggccaggcaugcaagccacguuaagaaaaaugaacuuaauuucaacaguguaauggugagccauuuaaaaauuuuaaauaggaaacugagaugaaggauuuauauuuccgaaagauugcucuagcuacugaauguagcacagauuauagagggcacauaguagucacucacuauuaguaagaaguaauuuauaauaaccauuacugccaagaugccacaauaaaaguaacucuuacuacaaagauuaaaaaauuguccaugccuuugaagaaagcaauuccauggucuagugaggggaaacaagcaucuacacaagaaguuuuaguaaucgguuaagauaauuacaguuguauagaaguacagaaaaggacaaagcaugaacugcaacucauucaaaagaaaaaaaaguauuccaaguaaggagaacaguauguucaaggacaugaagaggugaauauguaugagaagacugaugugccucaugcacugaguguguaaagagaaacugccugcuaggcaagaaguuuagacagauacggaauuacuuucucuaucauacacuaaaggcuuuguucuuagaguaauggagucucugagauguuacuagagguuccuguuaaucacaucuauguuuuuaaaauacuguagcauaaugaaggguuacaugaaaggggaaaagaaugagagcaagaaggauaaauguuguaaaaguguaaguaagaaauggcaggagccugaauuaaaaguggcaaagaagagaugcugugccuuauuuauuuuucgagacagaaucucgcugugucacccaggcuggagugcaauggugcaaucucagcucacugcaaccucuaccuccuggguucaagcaauucccccuccucagccucccgaguagcugggauuacaggcacugccaucgugcccggcuaauuuuuguauuuuuguagagacaggguuucaccauguuggccaggcuggucuugaacuguugaccucaggugauccaccugccucggccucccaaagugcugggauuacaagugugagccaccacgcccggccugcugugcccuauuuaacauguagaacaaaauacaucucagguaccccaagaaauacaacuuuuuaagggacaggcaaaagaagaaugaacaacugagaguuacagaaggaaucucaaaagauucaaaggaggguauggugucagauuaacagauggaaacaaaugauagauaauagaguggugaaguacauuguguguacguacauguuaauugauacacacacacauauauuuuauacaaucuacugacggguccuagaaacacuguccuaguaucgacaacuucaucuagaauccagauauugguuucaaaaacauuucccaacgcgaggaacaagagauucuugaagaaaugaccaauuccggggcuggggaagggacaguacaagaugagccuggaacagcauauuguagcaaaaagguaaaagaaaauaauggagauaugucagaaugacacaaaagccaacaugaaagggcuucuacuggccaaauaugggacaaugaaggcaucaaguaaauaaugaaguuaauggauuauaaucuauuggguaaaauaagaaucuaugaguaaaauaguauaaaucaaugaaugaacaaauaggagaacaaguaaacuucuugcuuaaaaaagaauguccaauaaacaaaguaaaaggaauaaugaauuagaaaaucaccauuuggcaaccaccacaguaaguaauucaagcaaaucacuggaugcuaaaucuaauggauacauuuuaugaaaaauaggguauuuacauauuuccaaaguugcucauaugugaugcuuuuuaauuauaaagggaaaaaucguaacuuuacacuggaaaagucuggcagacuacugcuuaaucgagugauaaaaguugacaaugcuaguaaugggacaauucaguaccaugagaagaacacuacuguaauauuccugaccaaaaaaauguauaccugaauccaagcaaaggaaaguuucagacaaacccaacugcgggguauucuacaaaaauucaaaaauacuuuaaaaugugaacuuuauaaaaaauaaaggcagaccgaagaacuauuucagaguaaaggauacuaaggagacauacaacucaauuaaugugugcucccauauuagauucucagccuuuuuuuuuuuuuuuuuuuuuuuuuugcuauaaaggccauuaugugaacaacuggcaaaaucugaaagaggucugcugauuagaucauaguauuuuaucacugugauuugcugauuuugguaaguacacuaaaguuacacagaagaauauccuugguuuuaggaaauacacaauauccaggggcaucauaucuauaacuuaguuguuguuguuuuguuuuguuuuuuuuuacacaaagucucacucugucauccaggcuggagugcagugacaccaucauggaucacugcagccucaaccuccugggcucaagcaauccucccaccucagccucccaaguggcugggacuacaggcaugugccaccaugccucgcuaauuuuuuaguuuuuguagagacaggguuuugcuuuguugcccaggcuggucuugaacuccugggcucaaaugaucugcccaccucugcuguaacuuacuuuuuuaaaguucagaaacagaaaacaauaaaaaaaauaagguaaaauguuaacacuggggaaucucagugaaaaguuuagaggaauuuuucacugaauuuucucuagacucgucacuagaauguguguaacauguagaauauguacagaaugcuguucuugcaguuuuucauugagccugaaauuauaucauaauuaaaaguuuaaaguauuaagaaggaaaauguauguguuuucauuaugguuacuauaagacuuaaauuauacugccuacaucuauacuaaaacagucucaaguuucugacuuggucacaguccuaagggaauaacaauauuccuuaaugaucacuucuagcuuggaaauucuauaauguauacacccucccaccucucaagauaguuguacaaccaaaucacuuccuaaacagcaucaagacuuuuuuaaaaaaacuaauuucaugggcagcaauagaaacaugaucauuaugucuuuagggaaacagaauuaagagcucacccaaaagaguaaagugaaaaugacuucauucaaaaccagaauguuuagagcagccagauucugcacuuuaucuuuuagaucagauguuggcaaacuuuuucuguaaaggacaagauaguaaauauuuuaggcuuugugagccauccagucuuucucacaacuacucaacucuaccacugaaguacaaaagcagccacagaugauaguacauaaaugaaugaacauggcuguguuucaaagaaaauuuuauuuacaaaaacagacaguggggcagauuuggccaacccuugauuuagaugaaaguauuugguuaaaaaauggaccaauaaauuuuagaccauuuuugccuucuaccaaacgagacauuuauuuaaaaauuucaauguugcuguagcuaaaacagcauucuuuaggggcaauucuaauuuuguuaaaggauaaguaauauuaauccuuauggauacagaauaaucuuacucuaguaagaauucaaaaauuaucacagaaauccaggaaacauaauuucauuuucaaauguugcacagcagauuucacauacaauauuagcgagggagugaaauuccaaacagugacucaaaacuucucaguuuaggcaacucuauguuuuauuuuaacuuuucauagagaguuuuaauacauagcuuucuagggaaauacuugauuugcugaauuaaagauaaugucuugagauaaagaugaaauaagagaagaauaagaauagucauuaggaagaguucaacuuaucacauguagguaauuuugucccuaaaucaucuaaauccagaugcaaauggaaauacccagacuucauucuaaggagaaaugcacauccuauaaucuaaguguuuauaagagaggcucuggaaucacuaaccauuacaaucucucgguguuuaauggcaaaugaaauugccaaguucacaggaaccuuaccuccucuucuuaugauccaaaugaaugaagauauuccagucaaguuacacuuagucaccacugguaaccagcuguuuugcccuaugaagucuaggguauauuuucagcaugaagggugauaugcaacaauuucuucugcaaacagaaauauaugcacauaucccugcugaaaauguagccuaguaaauuuucacaugaaaaugaauacaugcucacaaguggcaaugugcuaggugauguuucugguugaggucuacuuuaggagucaaaauguguaagccuuguggagucaaggcagugguccuguguauauagguauagaaaaaguagcucacuuaauccuuucucgccaggaguagggauuuucccggaacgacauccauugucggcaauggacgcaccaaaauaacgccggcgccagugaguuaaccaccucuguccucuuuucaccuauuauauuuuucaugcaucauccaacuucccaaccaucuuccuguuucuucacagaaugcacgcuagguucucguuuuucuucagcacgaaguuggaaauggaguugagaaaaggagacacauggucagcuggugauguuaacaagcuccuugcugcccugagaagcuagauggaaaugguucaaguuacaagggggaucaucaucagaucugggaggacaaagaguaauucaugaagcuucauucccuucccucccacccucuuucauuuacugaugauuccuauagucugccaucacagcaaaaccaagauuaaggaaucugaagcaaucccuuucuguucuucacuccauccaguguguagaaaagccaagcggaacacauguccaccaauguuaugguggcccccgguuggcuggggagacuugaaauggccauaaccacauaaccacaaucuuagaccaaugcuuuuuaguacgaucuuggaauuaaagaucagcaacuaacacaguguuugacaauaggugccuaauaaagguugguugaauaagacauuuucuuuucagccaaugucuacucgaacacauagguggaagucagacagaaguaguuaacucuuucaaugccgggaucguauggauauacaguaaucacaucaugucaauguguuucucuaaaacauguucaaauuauggauuccugauuucagacuucugguuaaaugcuaucuauguuugucugguuuuuuuaagaaccaccauaaucagaguuuugaaaacagagccauaguaaauguuaauuagaaugauggaugaauuaagaaccccagcaccaauguauaacaaaacaucacaguucacagucaaguaaaaacauuucucaguaauacaauucuagauggguaaugauuccagagcaaacuaaaguuugaagaagagaggagaauuuuacuuaacggcucccuugacacuaagaaucaggaaaaauccaaaguaugaaggauaagaaggauauauuuuaaguacaaauaaaguuuuaaaccucaaaucaagaggaucaucaagcuacauauaaaauugcuuugauguuucagauaggaguggggaagauaagaagaaggggaagaaauaauuuuguaggacucaaauguguguccagagugugaguuuaaauuaccaugguuacaucuaauuggguuaaguauauccuagagaguaauucauaccaucacaauuacagaaacccacuaucauacgaagaaacaagaauauuuacuuuuuccagauuuuaagauagcuuuacaaugauuacuucuuagcaguuuuaaaaaauaacaucaaccagagacuucuccggcaaaaguaaacuacuggucuacaacccuacuuauucuuccuuccauaaaaguacagcuauaaaggccuuuucuguguccauuuguguacuugucuucaucuccaccuucuuaacugagcuucuuuacaggcuccacuagcagccuccaaacacaagagggacuccuuuuagggacuccugugcugucacaaagcaggccuuaaauaaaaauccaucaagugacuaucccagcacuucuuucaauuaacugcaauucugauuccugcaguucacauacugacuucauaaguaaauuuacuacgaacucuuccuuucauauuuagaaaaaggccugauuuccuaagacauaauaaggcugacuuuauacugaauuguaagugaugaaaguaacaugaguaagagcucaaauggguaaacaaaagcugaaaccacaacauacuuaaagaagggucucaacacagcaaaugaggaagcauaguacacaaccaccaacuacucauuuugcucaguguuuaaggccaguuucauugggucaaaucacaggaucuaauggagugagcuuugucaucauaauuaggggcagggaggauucagguguucaucuugcugcaaagagucaggauugcugguuuauuugguugcuucaucuccggcagaagaaaggaggaacagaaaaauagaagcuaguuaaguaaccuguucccacaggguccucaagacguggaucccaaguccagaucacuuacaaaugaaauguaccacaccucuccuagguuuauccuguuauucauucuuguguuuauccaagacucagucuggguuuucugcaaagcaaacccugcacaucuugcuacauucuucaacaagagauuauguauguaauaggcauaagaguuccagaucuauuuuuccucuuuuguccaaagaaauaggcauuuaaaagcaggcccauuucagaaacaauaauagaagugaauacgaacuaguuccauaaaguuguuuuucuaaaauaaaaauuuacauucaaucauuuuuaguaagcugcuaaauuaucuuaguuuuccaauuauuuuuaauuuuccauuaauacaacugauuuccaauaaauuuaaacacuaauuuuuucucauuacaaauagaauccuaaguuugcuccucaaaggauuuuuguuuuuaaugugaagagcacuuaaaugacugaacucacuauugugauguacuuuucuaagugacagaaaagaagacauuuguauauuaguuuggcuaauaugacucuugccacgguuuagaggauguuugagacacuuauaaauaaaacaguaagagagacaguauuccauuuuucagaaauaugcauggcuaaaaaaaguaguuaauuuugcuuagguuuguagaacucuaaaccugaguaauucaaguugaaaugaacaaaagaugcuuccuuaccuuuaggucuuuccaacuguccaggaguuugguggccaaaucacuuauauccacuguuuuaucuggcuguucuuggcuccuuucacucuccacaucagacacacccuccucuucaucuugggaugguguuucuucauuaauagguucuucuaguuuugugccguugcucucuuugggcucuauuucagcgucagcuucugguucagauguagguagcuuacuagcuucuauguugguuucacuaucaacuuugcauucaggcagcuguugugggaguagcuguugugacugcaauucuuccucuuccucuacagggacauuuucuaauugaucaagauccucuuugccauccuugccuucuagcucacugguugcaucagagauugcacuguccaugcuauuuucacuuauaauuuucagucugcgaaacauuaguuucuugggagugucugugucagcuucugugcucagcuugguggaaggaucagguguguugagugguguaugagcacgcgauguauucucacuagaauacccaucuccuucacucaacggagggacagcagucuuagucugagaccagcguugaauaauuggaaguacuuugcuuuccuccaacauauuuuuaguaggaaugggcaaguguuccaaagucuuuauaaucugauuaaacauaaaaaaaaauuacaucacuuuguacaguugacuuuuuuuuuuuuuuuugagacagagucucacucugucacccaggcuggaaugcaauggcaugaucuuggcucacugcaaccucugccuccuggguucaagcaauucuccugucucagccucccaaguagcugggaguacaggcgcuagcugccacgccuggcuaaucuuuuguauuuuuaguagagacaggguuucaccauguuggccaggcuggucucaaacuccugaccucaagugauccacccaccucggccucccaaaaugcugggauuaccagcaugagccaccacaccuggcuacaguugauuuuguuuuuuuuuugagauggaguuucgcucuuguugcccaggcuggagugcaaugaugugaucuuggucacugcaaucucuggcucccugguuuaagcgauucuccugccucagccucccgaggagcugggauuacagggaugcaccaccaugcacagcuuuuuuuuuuuuuuuuaguagagaugggguuucuccauguuggucaggcuggucuugaacuccugaccuuaggugauccaccugccucagccucccaaacugcugggauuacaggcauugagccacagcgccuggccuacaguugacuuuuucaauuucuggaugggacucagauuauuucugcaagaguagugcaguuuugcuacugcuuuauuaagaacuacaucucuguaaacacaagcauauuuaaaaaucauaauauuguuuuccuuaagaaagaaaaacuuuuaauaagacugaucagcaagaaucacaacaucaaauaggacugauuaauauucucuaccaguaguuccuaaaccuggguagcuuuuuaaacauauacacuacuggaccaauccuggguaucuuuucuuaaaaaguuuaccaagugucugugauauacacuuagcagcuauguaacaacauauuuaaaugaugucugucauacacacaaaaaugcagacaucucuucagcuuuugauaaacagcugucuagcaaagagagauccccuccucauucuuagacaaccucccccauuuugaaauccaagaauuuuuucugaaguauuccucaauguaguuccacagaaaccccaaggcuuccucaauuuccucaagccaaaucuccugggagaaggacagaggcaagaacaaguacuuaucugcccauuccuuuuuguuuguuuuuaaaaguguuuuauuaaauaaaagacucugggauuauauuacaaauuagaaaguuagaaaauuuuauuaauuucauagaaagguaaagacaucguaacuccacuaauaaugcugccaaugaaccuuuacuuagaucuuuuaaaacacuuauuuaaaagauuccucaaaauguucauacucuuguuaugcagaauucagaucuuuaccaauucuuuagaccccacaguucaaauuuuauaugacuucccaucuuuuuaaaacucugguuuuaacaacaaacuggaucuuucacuuaacuauguuguuguuauuauaucuugcucuuguaguucccugcuauguaguaccaacuuuaaaaagauacuauaggaaaaccaugggacaaacuacuaacaagguguauguacgguuagauacguuaaaggaaugauacugagaugaaaaaauuauuugauuauuuaauaccaaugauacagugcuaaauucauaauuacugauauuaucacauauccacaaccgaggcaaucaauauaacaguuuuaagaaacaagcaagcuaaaugugaacugaccucuuccugaagcuucugguuacuuucccggccgucaccuagcucugccauccagauccacaacaaagacagcccaugacguuccagaaaggacuucaggcaggacugugaguguguguucuuucaugggggaagggagacacgaugcagagcauugggaggcaauaucagaauauuacaaagagcccgaggagaguucauguauacguuacacauuauaggguucacuuacauucacaaaaaaaaccuagaaacucuguuuucauuagccuaaauagaacucuacaacaaaugcuuuaaacagauuauaaucuucucugauacacaaaauacagccagucaacugggauuuuacuaacguagaaaauuauaugaauauuaauaggucauuuauaaugaaaauucugaagaacuaagaaaaaauugcaucuaacuuuuuaaauaaagcuaaaaccauaaaaauuaguccuuaaauaauucuuucuucucucccuuucagaugauuguugaaaagaccucuuuuuccuguuaguuuuuuuuuuuuaaucaucaugguuuuuuuacacuguggcuuacaacuacaaucucagcacuuucgaagguggaagagggagggacugguugaggccaggaguucaaaaccagccugggcaaaauagcaagacccuuaucucuacaaaaauauaaauauaaaaauuagcuggaugugguggugugugccuguaguccuagauacucaggcaacugaggcaggaggaucacuugagcccaggaguuccaaggcugcaguaagcuaugauugcacaacugcguuccagccugggcaacaaagcaagacccuaaaaaaaaaaaaaaaucauuuuguguuaucuaacaucuuguggcauacuuaauaaacugguguaaaaaaggguaccguuaaaauuuugugcuuggagaucacguaguacaaauggcuuugggaugcuaguaacuggaggguaaaaggcuauggcaagugugaugaauuauuacaaaaaaaaaaaaaaagccaccacauucuuugaauauagacagaaagcaaaccaggucuaauaaugccaugguccccaaccuuucuggcaccaggaaccaguuucagggaagauaauuuuucaacaaacugggugggggauggauucaggaugaaacuguuccaccucaaaucaucaggcauuagauucucauaaggaguguacaaccuagaucucucgcaugugcaguucacaauaggguucgugcuccuaugagaaucgaaugccgcugcuacucugacagcagguggagcucaggcaguaaugcucacucaccuccuccuguguggccccguuccuaaucagcccauggccuggggauuggggaucccuguacuaauagauuaaaugauacugaacucuuuagccauuuuaaauaauaugguacaagcuuugaaagucauacacaacucacauauccauuuaaaaaauaaaacuggccggccaugguggcucacgccuguaaucccagcauucugggaggcugagacggguggaucaucugaggucaggauuuccacaccagccuggccaacauggugaaaccccaucucuaauaagaaaauacaaaaaucagcugggcgugguggcuggcgccuguaaucccagcuacucaggacgcugaggcagaauugcuugcacccaggacacagaaguuacagugaaccgagacugcaccacugcacuccagccuggaugacagaacaagaccccaucuaaacaaacaaacaaacaaacaaacaaacaaauaaauaaauaaauaaaauaagacuaacucuuaucagaauuauuccuucuucauucaucuucauucauucauucccaccacaaaaccagaaauaaaaaacaaacauuaaaguguucaccuguaugaguuccagacagguaaguuucugcuccaaaguuucaauucuaaccauuagccgggauaagcugagcaccugguuuuuaucagagagacccucaccauuuuccaucagagcuucuagcucuccauccaccuaccacagcaaauaaaaauaccuuuuuauaaaacaacaacaacaaaaaaaaaaaccaaaaacccaaaaaguugcucaaccuuaucaauuaucaggaaaacacaaaugaagaccaaacugggaaaguacuagacugggggaaaaaguuaagaaggcugauaauaacaagucuacuguugaugaaaguauaaagugguauaauacauuugaaaugcauuucauucacucaucaaauacguagcaagaacuuauaugagucaaguauaauucuagguggagaucugcaaugagccaaaacagaaaaaccugcccuuaugggagaccaugaacaaauuacauuaaaccaaaaggacuucagagauccuuuaugguucauaaauaugaugaauggguuuucacgcugcugugugagauauaucuccuucaaacuuauauaauuuauauguuauaauauauaaugaccuuuuuaugaugucagcauaugaaugacccagcugauaggggccgggugcuucagaaaaaaauaaagcauuagccugaaaaauaaaauaguuguauccccaugcacagaaauucuacuuaucagaauaaacuguagagaaauucugcacauguguaccuggagauucauaagaauguucauugaagcaauauuuauaauagcaaaaaauugccaacaacccaaauaucuguacaaguuggauaaacggccauguucacucaaugaaauauaauacuacagugaaaggaaucaaguacagccaaaugcaacaacauccaucaaucuuaaaaauaugucauuaagaaaaagcaaguuccaaagaauuacaugcuauaugaauccauuuuuaugcaccucaaagcugaacuuuuuagugauacauaugugaaaaacugcuuuuaaacaggcaaggaugaccgggcaugguggcucacacuuguaaucucagcacuuugaaaggcugaggcaggaagaugacuugagcucaggaguuuaagaccagccugggcaacacagccagacuucaucucuacuaaaaaucaaaaaaauuagccaggugugguagcaugugucuauagucucagcuauucaggaggcugaggcagaaggaucaccugagccugggaaauugaggcuacagugaguuauaauuuugccacugcacuccagccugggugacacagugaaauccugucucaaaaaaaggcaaggaaguaagacccaaaauguacaacagugguaaccucuagguagggagaaggaagcagagaagcacuaacaaggauuuuauaauuaugcuuuguaacauauauauucuuuaaguauuuuaaauauuaaauguaaauaacggggggugggaaucaaccuaccaaagguuauuuccagcccugcauuauggcaguuacaggacauaaagauucuuucaaagaauuuauuaugggugagauuaaauuaauucauaugaaaccaaacaaggaagcauuaacugcaaauguuacauagaacuaagaggccuacauaagggaguaauuagaaugagucacugaaauaagauuagaaauagguaagauaaagacaagaggaaaggguaagcaaaguaguggggaaaagugugaacaaaggaaaauaagaaaucaugacagugcuuaggucaacaaagcucaaacagguaaggcauggugacggacugagaaaaaccauaccaaauaaaagacugggccagaugcaguggcucaugucuacaaucccagaacucugaaaggccaagacaggcggaucaccugaggucaggaguucaagacgagccuggccaacauggugaaacccugucucuaauaaaaauacaaaaauuagccgggcaucguggcgggagccuguaguaccagcuaucgggaggcugaggcaggagaauagcuugaacccacgagguggagguugcagugaaccaagauugugccacuguacucuagccugagcgacagagugagacuccuucucaaaaacaaacaaacaaacaaacaaauaaaagacugguguuagauuagaagaucucaauuuaacauaaaauaacuugaauuugauaaaaccugaacagaauccugaacaagggaauauauaugaucaaaauggauuauuauuuuuuuauuuuuuauuuuuuugagauggaguuucgcucugucgcccagacuggagugcaguggcgcggaucucagcucaccgcaaccuccaccucccagguucaagugauucuccugccucagccuccugacuagcugggacuacaggcccgugccaccauauccagcuaauuuuuuguauuuuuaguagagacaggguuucaccauguuagccaggauggucucgaucuccugaucuugugaucugcccgccucagccucccaaagugcuaggauuauagccgugagccacugcgcccagcccaaaguggaacuugauaauaauuugugcggcaauaacagaauaaaauucagauaagcuagagacuaaggagaagacagguaacauuacaacuuagcaggaaaugaugaaagucuagaaugaaaugauucagagaaaagcaagcuaaaaggaaagaaucuuaagaaaauuuucuauuacuuuuuucuuuuacuuaacuagcuauuuaucccuuaauauaauuucaggcaaggcacugaacauuuuuauuucauauuguacccaaaaauucacauucugguaaagaacaagaauaaaugagaaaaaauaaagugcugccugagagagguuguagaaacucaaacccauuuuucuuucuaaaauguacauuuaaggcucauucuuuuucauuuccaauaccacuuaaguuuuugaguaaauacaugaacagaaaaaccaauuuaaaguugucuuaauccaagaaagacaauuucauuaaagauaucuuuuccuugcauauccuaaauguaagccuuccugugucccaaauucuacgguauuagaugaguucaagggcuuuaaaauucuacuuucccccucaacuguaacagccagaauacugcuuuugacagauuuuugagacgaaaauauucacagggcuaaaaaaugagauauuuucagccagacacaguggcucacaccuguaaucccagcacuugagaggccaaggcggacagaucaccugaggccaggaguucgggaccagccuggcaaacaugguaaaaccccauuucuacuaaaaauacaaaaauuaggccaggcacgguggcucacgccuguaaucccagcacuuugggaggccaagguggguggaucaccuaaggucaggaguucaagaccagccuggccaacacggugaaacccagucucuacuaaaaauacaaaaauuagccgggcaugauggcaggugccuaaaaucacagcuacucaggaggcuguggcaggagaaucacuucagcgcgggaggcggagguuacagugagccaagaucgugccacuguacucuagccugggcgacagagcaagacucugucucaaaaauaaauaaauaaauaaaauaaaauaaaaauuagccagguguggugaugcacaucuguaaucccagcuacucugauggcugaggcaggagaaucacuugaacuugggaggcggagguugcaaugagcuaagaucaugccacagcacuccagccugggugacagagcaaaauacucucuuaaaaacaaacaaaaaaaaagagguauuuucuuuuuaaaauuaggcauguuaugacuguuuaaaaacucuaaauuauguuauuuacauucauucaauaacauuuauugaauagauauuguguaaggcauuuccaggauauaaagaaaaucacguucuaacuaaagaaaaauaaaccguaaaaaugcagaaacugcaguauaaauuaaguuuugcaaacaaaauaaagaugaauaacccuugaacauuccucagcgguuauacuguaacacacauacacauaaaugcaugccaauuccaguggugauaauacagcuucccuaauuuugggugcucaagcauagcaaucaauugugcaauaacuuuuaggguaccugggagacagaggugggaagacugaguuugucucccuuccuuucaauuaaauuacauuuauuaaaagucuuagauuuuauguaugggucaacaucauccaagaauaugagguaaguaacuaaaaguaaacauaaauguaagaaugauuaggguguauuuuuaaauuauugauaaacugaaaauuuauauauauuaaauauauauuuauacauuauauauuuaucuguaauuuauagauaguauauauuuacuauauauagugcauauauaugcacaauucuauaguacuugaaaauguauuaaguaccuaaucauugcaagauacuauuuuuuaauacuugaauauuuguggcacuaaggggucuaaguagcauuuuaaauacuucuugauggaauacaacauacaguaugcagaauacacauauagacagaaauauauaaaaacaauuaguaaauagguuuaauaaacaggugagcaacacccauacagccaccauccagguaaguuuaaaaaacagaauacugcuagcauuccuguagugccccauguaccuaccccuuccugguuauaacagcaacccuuccuaugcuuuggagauaacuuauccuaacauuuuaagaaauaggucuucaauuuucuuuauagguuuacuauccauaugcaaauuccuaaauauuaauuuuuuuuaagugauggaagcuaacuuuauuagaaaugaaagguucacucuuguccuugcucccuaauuacuuuaauuuuacuuuaaguucugggauacaugugcaagaacaugcagguuuguuacauagguauauaaaauuuugucuaucuuuauggaaaugaaaucauacuggacaaaauauuuugucaugcuucuuucacucaaccuuacauuuuaagaguuauccauguuacuguaugcagccaguuuauuuucaugacuauuucuuuuauaauuuauccauccuuuuuuuuuuuuuuuuugagacugagcuucacucugucgcccagguaggagugcaguggcaucaugucagcucacugcaaccuccaucuccuggguucaagcaauucucuugccucagccucccaaguagcugagauuacaggcacccaccauuacacuuggcuaauuuuuguauuuuuaguagagacaggguuucaucauguuggccaggcuggucucgaacuccugaccucaggugaucugcccaccucggccucccaaagugcugggauuauaggcaugagccacugcgccuggcccauucuuauguuaauaaauauuugaguuauuucuacuuuuucugauaucauaagcaaugcuguugugacuucugauauacauuauagcuagccucucugcuuauacacccaggaacugcuggcucauaugguauauguucuuucacuucaguaaauaaugucaaaguauuuucaaaagugguugucccucauuuacaccccucaccaacaguguaugagaucuguuguucuuauguaccauggaacuuaauuuuuaucaaucuggugagaguguaaauaacaucuaauaguaauuuuaauuugcacuccccaauuacuaauaaaguugaacagcuuuccacguuuauuggcuauuucaauuaguaaagugucucuggaaguugucuauuuuucuuuugugcuggcuguucuuuucuuauuaauaggauacuaguuacacucauuaugcauauucuggauaguaguauucauuuguuaugaguugaaaguuaaguauuucuucucacucagguggguuuucacccucuuuauuacauaaauuauuauugauuuguuucaaaaacucaaacaauagagacuaagggaaguuucagauuauuuucuguucguaccauaaacuacaaauaacaucaggucauaguagggacauauuauacuuccaucaaguaaguaaguacuuaaguacccagugugugacauagccaaagauaaucaccuguccuggaagagcuuauaguuugguuaaggaaagaagcuguauacagaugcaaucauaagaacaaggauaaaaaauguuuagcaaucaagggguaacaugagggauguggauuauagugcaaucauuauuaacaucuucuugucaacaguuuauacaugcaaaacugcauucugaacugcuagcuaucuuguccuuuccauggcauccuuuacccaagaaauucccaaggcucaaccuugugaguucaaacaguugaauucugugauucugcuucugugauucugcucaacuguaacugaccaaaacucagaauccaggcaugcaaaaaagaaauuucugcagcagauaauccaaguaaaauuaaaguacaauuaaccucugcauuagagucaagggcaaaugaucuuucacaucauucuaggaaccuagguucauucugggauauuccucuaucugggcaaaguuucauauaaaacaucauuguuccggaauaacuucaaauucauaucuggagcaaccgaugacuguagccuauggaaugacuggauacaaguuacaucuaauucaguccaaaggcacuaagaccuauccugaaauuggcacacuauuaccugaauacaaccaaccaaccaaugacagaaauaucuaguccuuaguucuucagaguuauccuuaaaucuucucagaaagguaaaaagccaccuaauggagguaugauacagauauaaugccaccucuuaauccauaguaaggucacuucucaucaauaaauuaguuuuaaaaauguguuuauucuguaaguuuugaaaauaggaaacagccauugggaaguuuuucuuuuuguuauuuuuuuagauggaguuuugcucuguagccuaggcuggagugcaguggugccaucucggcucacugcaagcucugccuccuggguucaagcaauucuccugccucagccuccggaguagcugagauuacagguacccgccaccacgcccagcaaauuuuuguauuuuuaguagagacaggguuucaccauguuggccaggcuggucuugaacuccuaaccucgugaucugccugccucagccucccaaagggcugagauuacaggcgugagccaccgugccuggccuggaaaguuuuuauggagauacuaguuuaggucaacauguuuaauaacuacuuugugguugcucugguaaaccaugaauuauaugaaacaagaguuaacaacaaaagcaaucuaauggaguuuaaagaaaaauguccgguagucaagugaagaaagcuaacagacuagguaugacccagugacuacacuuccauagauaaaucuuaaagaaacaugugcaaaagagacaugugcaaagauacuaacuuugaaauuaauagcaaaaauuggaaacauaaguauccaucaguaggaaaauaugucaauaaacuguuacaugaugaaaaaaaaaaagaaaaacuuucaaaugaccaucaugcagaaguugagaaaaaaaaagaaaaaaauuacagcaauuagaaauaaauguucaucuacauauaugaauacagaucaaauucaaaaauaagaguaaaaaaugcacacaaauacaucuauauuaucucauuucuuuuucuuuuuuaauagagaugaggucucacuauauugccuaggauggucuugcacuccugggcucaagcuauccucccgccuuggccucccaaagugcugggauuauaagcaagagccaccacgcccagcuauauuuuaccauuucuaaaaacuuuuaaaaugccacacaaaacaauauguucuaaaaugcagaaacaucuauuguuauggccauaguugccucaaagguaggaggggacuccacucuacaguuuaacuguaguuuaacacaaugguuaagagcagagacaagaugcuggauuggagcuuauuuccaccaccuauuugggugacacuauaaucucucugugccuuaguguguucuuaacuguaaaaaaggaaagaucauuaccuaauuuaugagcuuauugugagaauuaaaugagcuaauacaucaagugcuuagaaaagugcuuggcauaaaguuacacuauauaugcuaucuaaaaagagggcugaaggcugggugugguagcucaugccuguaaucccagcacuuugggaggccaaggcgagaggaucacuugagcccaggaguuugaagcugcagugagcuaugaaugcaucacugaauuccagccuaagcaacagaaugagauuuugccucaaaaaaaaaaaaaaaaaaaaaaaaaggggggcugggcacuguggcucaugccuguaaucccagcacuuugggaggccaaggugagaggaucacuugagccaggaguucaaggcugcagugagcugugaucacucuacuguacucuggccuguggaacagugcgagacguugucucaaaaaaaaacaaagccaaaccauuugaaaauauauacauuuuuuaaaagagagagagagaaagaaagagcuaaagaacacaugacauuccaaugcauuuguucauguugggugguggaaauacagguguuuguuauauaaacuguccuuuucugcuuuuuuuaacggaccuuuccaaugcuuuuuuuaacuuuuuuuaacugaaucuucuuacagaauucagauucuuaauacuuaauucccucaaauuaauuugugcucaauugauguuaccuuuuaaccauuauacucucaucaccucccucaugucuuuuucuaucuccccaucuaaacagaaaaauugcugucaucuauaguucuuaugaguauuaaguuccugaaaaguccaggaaugagcuaacugcaaaagaaucacaggggaauuugcugacuaacaccgguaaacccucagcccuuccacuaagauucacaggucuagagaguagcccaaaaaugugcauuuuuacuauggauccagccagcugguucuaaagaaagugauccaaggaucacauuuuugaaaaacagugcucuagcaaagggauccucaaaaaagggaggagaauauuuuuuuaaacacaaaguccuuuuugcaauugauagucccuuuaguaacaggauauuccccaccaacaaucccauccccaucccaggaguaacucaggcaagacaggguacaaaaugaggcuaucaacugcuguuucauuaaauaaaaagagcaucugugacuacuccuguuggucuuagguuaccuacuuccucucaaaacuuuucucacacucaaaagaggauuuucagagauuugaagaacacucaaaguuuagaguaccaaacaaagacaaaccaauaacaagagauuagaaacguacagcagacauagugagcuaucagggagaaaagauauguuuuacuuguacuuaggaguuuuaaagaaucugaaaaacuauuaguccagguguuuucaauaauacuuuaauaguucucaguacccaauuccaaucucuaugaaucugaaauaaaaauagcaauugcaucucuuuucugguaacaacucaucugaucuuggauuucucugguggcaguaguaugacuuuauaaccuucaaucagaaaagccaccucgcuuuuuaaauuuuuuauugugaaaguugaaagaaaaaugcaaacuuacugaauccuucuuacgagaucguuccuucuucauuuucccuccugcugcucugaugcugacucuguuuucuccucccagguaaccccggcaauuggcugauccgcagaaacauuucugggcuucuuuucuguucaaagagcauaggaaagaagucagcuauguggaaguaaaccauacaaaacuguuggcaauacacacaaaagucauaccagucuaaacaaaaucaaacaaacaaaaaccauaacuugaagagauuccaacaagucugcuauuacuaauagaaaugucugaaaacugcucuuuaaaaauauucauuauuuuuccaaucaucuuucuuugggagacaaaacuagccaagaaauaaacaauucuuccauuuuaugagaauaccuaguaauaugaaaauaagagaucauauacauguuuggauuaagaauaaaauugcuuaaauaguucagagaacuauuacuuauauguaaauguuuaauuggcacauagaacaaacaaacaugcauuaguauaagcagacauaaaaugauuaauacaggauacuuaaaaggaaacauuugauuauuaaaagacuggcugggcacaguggcucacgacuguaaugucagcacuuugggaggccaggaguuugagaccagccuggccaacauggugaaaccccauuucuauuaaaaauacaaaaauuagcugggcaugguggcacacaccuguaaucccagcuacucaagaggcugaggcaugagaauuguuugaauccaggaggcagagguugcagugagccgagauugcaccaccgcacuccagccugggugacagaguaagacucugucucaaaaaaauaauaauaauaauaauugaguauucuaauaguaaacugguggacuuaggauaugauaguggcaauuagagggauaaaaauaaauuguucaauaaguagagcaggaauucccaaacagcacuugauuuccacuuuucuuucccucagagaggacaauacaagcacagaggcaaaaaaauggagcccgacacagaaccuggucugcauucaugcccugaauaucugacaagagaagcagacagaaucggaaacaaccaucuggcauuuguccuagauuauaaucagaucaucaguuucagaguucacuauguuuaagacaugaagcauguaugaaacaaugugaaggaguauguaaaagaccuucauugccagaagucugguaacugucaccagacugaacagaguacaggaauuaaaaccucaucauaugguagcauuaaaagaauuaaaauauucaggaaacucugcagcugugugcuuuucuagcauaaacaccaaaagcuacuaauugauauagguauaaucugaaaaaaauaaaauaaaaacuuuuaggguuuuguaucuuacuuaaauuuuccaauauuuuaauuguacugguuucuuaauaaucagaaaguaucuugcauaggucacugguccuaaagacccaaagaagauagacuguuucacggguaauguuguguucuuucauuaugaggcacacauuaguugucuuuuucugauauuagcggccacuaaugaccacuguuuaggacccauaccuuacuaaguguugcaaaauggugauauuuuuacuacuuaauuuaguuuuaucuuuuuguuuucugagacagggucuugugcuauggcccaggcuggacuguaguagcaaggucaugccucccugcagccucaauguccuaggcucaagugauccucccaccucacccuccugaguagcugggacuauaagcaugcaccacucaccuacuacuacauuuauuaacuggaagacuuguacaaagaaaaacuucuucucaucaacuauuugguuuaaccuaaagcagaagucacuugagaaaggcagaauaaauguuuaaaugcuuaauuuuuuuccuuuuuuauuuuuaaacuagucuucaaagucaugaauugguugacuaauauaccuuuuuuuuuuuuugcuuuuuuguuuuuguuuuguuuuuuucgagacagagucuuucucugugcccaggcuggagugcaguagcacgaucucaagugauucuccugccucagccuccggaguagcuaggauuacaggcaugugccaccccaccuggcuauuuuuuguauucuuaguagagacgggguuucaccaugugaccaggcugaucucgaacucuugaccucgugaucugcccaccuuggccucucaaagugcugagauuacaggcaugagccaccgcacccagccucccaggcguaguuuuuuguucguuugcuuuuuauuuuuuuuagauggagucccucugucacccaggcuggagugcaacagcacgauuucagcucacugcaaccuccgccucccagguucaagcuauucuccugccucagccuccagaguagcugggauuacaggcgugcgccaccacgcccagcuaauuuuuauauuuuuaguauggacgggguuucaccauguuggccaggcucaaacuccugaccucaugaucugcccgccucagccucccaaaaugcugagauuacaggcgugacccacugcaaccagccuguaguuuuauuuuuaaguagucauuagaacacagggauuuuacauaaugugcuucaaaccuccucaguaucuuuauuaaugcuucaguguuaauaagaacucucacacuuuuugcuuaggcagucuuugcuauugcaucgguuacuguuuuuaggaaacagaacuagguaaccaggccgggcgcaguggcucaagccuguaaucccagcacuuugggaggcagaggcgggcggaucacaaggucaggagaucaagaccauccuggcuaacacggugaaacccugucucuacuaaaaauacaaaaaauuagcugggcgugguggcgggcgccuguaguaccagcugcucaggaggcugaggcaggagaacggcaugaaccugggaggcggagcuugcagugagccaagaucacgccacugcacucuagccugggcgacagagcaagaguccaucucaaaaaaaaaaaaaaaaaaaaaaaaaagaacuagguaaccaauuauauuuaagaguacaaaaugguacagaugaaauagacugguuaugaguuaugcuaacuguuaaugcugaauaacggauacagaggaauuuauaauacuguacuauucucuucagacacaaaaagaguuggcaugucuaaaguuuuucagaauuacauaagaaauauaauuauacaaguagaccauaugaaguugaggagaaaauuauacaguuccuguacaacaucccuuaagggucagaagugucauacaguagaaaaacacacaaaaccaaaacaauaucuuauagauaagaguuaagaguaaauauaacuuuuaaguaauuuauauuaaaguuuuauauccuuauaucugaacagccuauuuccccaucagaagcagcaaaauuaguagaaacaauacuuacccauaucucuggaacugauagucaaacguuaacucugagccugaaggaaccaguuuggugguaaaaaacccaacccucaguuguccguucacaguccacugagaugauguuugaaaacaaaagaaauuaguaacuuauuagugugugugugugugugugugugugugugugugugugcgcauauauaaagaucaucaucaucugccuuaauuaugcaagugggucuuuaggcaaugaagguuuucccaaauagcacauggagacuuuuuucuuuaaaagaacuaaaauauuuaaguguaacucucauuuaauggacuaccagauugcauauaucucuaauucgucucuaauaaaaguaacugcuaaaaaaaagaaaaaaaaguaacugcuauuuuaauuuaucuuaacauuuccauacaguaaagauucacuuguacuaaaaauuggcaaacagaggaugcuugugucacugaguaucaaaggcaagucuauauuaacauauguuaaaaguaaccauguuguaagauaagaugagauauagaaacuaggaaacacugaucccaaaaguuuaauuccaugaagugguggucaucuggcugaguauagugaaagggacaucagaacagaugcauaagacucaagaauuaaaaugggggcagauacauguuaggcagaucuuuuaguuccaaaacauguaagcaagucaaggacugaggagcucugauccagacaauuugcacauguuacuaaugaaaacucuggacuugcagagauuaagggacacuguacagugagagucucacagcuagacauguggccaccagcucuggcagaacuauaaccaaaaccuagguugaaugauuccacaguagguucuccuuuuuguuauacaacuuggcucuuggaagagccaugcauaaaaucuauuaguguauaguucaaagggcaaaaaauauccagacucaaaagugcuauuucaacaugagaggaaaucaaugauauacauuugcagagcggguucauagcuuuaaccuuaaaaaguuacaaucccagcugggugcggaggcucacgccuauaaucuuagcacuuugggaggcugacggggguggaucgcuugaggccaggaguucgagaccagccuggccaacauggcaaaaccccgucucuacuaaaaauacuaaaaaaauuagcuggacgugauggcacgcacguguaaucccagcuacuugggaggcugaggcaggagaaucgcaugaauccaggaggcggagguugcagugagccgagaucaugucacugcgcuccagccugggcaaaaaaaaaaaaaaaaaaaagauacaaucccucucaauguuaguccuucagucccucaucaguguuauuaaaagucaaauguugcaccuagauaagaccuaauaaagaauccaaauacacacugaacuuucaaaauuaaaauuuaguuuuguauuuuggcaccauuaaaauaauauacaaaauaauuaugggcaaggaaggagaggugacaacuaaaugcaaugugaguuccuggauuggaucuuggaccagaaaaacaacagcugucaaaauuggaauacggucuucauauuacuuaauagcauucucuggaucugauccuuuuauuaugguuauauaugauguuaacauggggaaagcuaggugaagacugauauauggguguagucaauacuauuuuucuaacauuccuauaaaucuaaaccuauuuccaaauaaaaucuuaaauaauaaaguagaauaggaaaaagggacuaaaaaauucaugaguaccuuagauaugggaucuaaaauuaauggucagaacagcaaucgugaacaaauaccucaaacucuaaauccaccucaacuuacuuuuuggguuucacaauuugguucacagcugugauucaugaaacgagagcaauuuccuuuuugaguggcaucuauuaucugggagaagaggaucauuuaagaauuaaaaaauaauaccuuaaauauucaugcaauuaccugcaaaacuacauacaucucuuaugcaucaauuaaaaaaaagauugugcugcgaaaccuaaccaguuaagguagggcagugaggccuccugacuaccagcuucaaaguuuuuccacuguaaacaauggcucaguuuccauuauuucuaacugaagacagaugacacugugaauuaaauuaacccaaucaaaaaaaauuuacacauuuuacaaaggaaaagcauuaagacaaauguaagauacaugcaaugcacacgcacgcacacacacacacacucccuuauccccacuuugcccuugcuucagagaacugucacacugcuucccacuucaaagcaacaaauaccuaacugaugcuuuuggaagaucugcuaauuauuaacuuuugcccauaggcaaaauuaucuuuaucagugucucucccauuuauccuuagccauuucuuauauucuauuacauccuaaucucacugcaugguauaauacuucacuuuaaagugugggcuaugucacaaugccauaggucucaaccuugaguguguauccaaaucccauggagaguuuguuaaaacuugcugaacccaucccuaggguuaaacuaaacagcucugggguuaggucccuagaauuuacauuuccacacugaauacagaggcagauauaugagaauugaacugaauuuuauuaagccagacauuaaagagauuuauaaaaauguaaagcgaugcaacucuuuucacuaaaaaaaaaaaaaaaauuuaaauaaucauuuuccaaggccaggcacagugguuuaugucuguaaucccagugcuuugggaaguugaggcaggaggauugcuucaggucagaagugagaccagccugggcaacacagcaagacccugucucuacaaaaaauuuaaaaauaagccaggcaugguggcaugugccuguaguuccagcaccucaggagacugaggugggaggacugcuugagcccagcaguucaaggcugcuguaagcuaucaucaugccacugcaccccaggcugggcaacagagcaagacccugacucaaaaaaaaaaaaguuauuuuucauaauaccauguuauuuuuaucaauaaguaaugggcuuacuauuguuacaguuaaguccucacuuaaagucaucaacagguucuuugaaacugcaacuuacaaaagcaaaacaacauacaaggaaaccaauuuuaccauaggcuaacugauacuaaacaauaguuaaguuccuauggcagauuucuggccacaaaacaucaacaaacuucuaaauaaagaccaagaugggcuggguguagugguucaugccuguaaucccaacgcucugggaggccaaucugggccaacacucaagugauucucuguuuuagccuucggucugagcccuuggagcagcuguaacuagaugcaugcaaaaccaugcccgguuaauuuuuuuuuguuuuuguagagaugaggucucacuauguugcccaggcuggccuccuuuggcuucaaaugauucucccacuuggcccuaaugugguuuuaaacagacauucuaaauuucucaguugugauuuuuaauaugauuaaguauaaguaauuauaacccacauaaccuauauaagcaaaagcacuuuggggccaggcacgguggcucacaccuauaauaccaguacuuugggaggcugaggcacauggauugcuugaggccaggaguucaagaccagccuggccaacauggcaaaaccccgucucuacuaaaaauacaaaaauuagcugggcaugauggugugugccuguagucccagcuacucagaagacugaggcacaagaaucgcuugaacccgggaggcagagguugcaaugagccaagauggcaccacugcacuccagcccagguaauauagcaagacacuaucucuaaaaaaaaaaaaaaaaaggcacucugggggucaucaauaauuucuaagaguuguaaucuaaaacacacuacguuuaucuuuacauauauauauguaaauuccucucucuuccauguuuuuauuuucuaccuugucaugcaacaguaacuuccacgcuuuuugaaaacaaauagacgcuauuuauacugcucugccccucauuuuugucgcuuaauauauuuuagaaaucagucggcaggacacgguggcucaugccuguaaucucaaugcuuuggugaggucaggagaucgagaccagccuggccaacguggugaaaccccgucucuacuaaaaauacaaaaauuagcaaggcgugguggcgggcgccuguaaucccagcuacucaggaagcugaggcaggagaaucucuugaacccaggaggcagggguugcagugagccgagaucuugccacugcacuccagccugggcgauagagcgagacuccgucuccaaaaaaaaaaaaaaaaaaaaaaucaaaucaguaucaauggcuccuucaaaccuaacagaucuguuucaaggcaaacauauccaagcugcuuaccucaucauucuucagggccaugaaauaguaauggauguuuuuguuucgugcauacuccuucacucgagcuuuaaacucuuuaugaucgaguaccucuccacaauauucuaggacaaagguguuccugcaaaccaaaaggaaaaaaauagcacuuccuaccuaggagcaguagggaaaacauauaugcucaggcaaaaauaaggaauuuaaauaaauacugcaauguggauaaauucaguuauuacacaaaauaaauuucaaacacaugucaaguaucuagcuucuaaccaagguuacuuuucuccuucacaguacuuuucaaagaauguugauucuaagaugcuuuuauaauuuauaccuacuaccaaaauauauauccuuuaacuagauacuaaaucauucaagucuggcuuacaauaucaaaaaaaguuauuaacagcuggaaaacagcucugaagaaaucaagagacacugaaaaguuagaggauuuuugcucuaaaaaaaaaaaaaaaaaaaaaaaaaaaaaaaaaggcagccgggcgcagaggcucaugccuauaaucccagcacuuugggagguagaggcggguggaucaccugaggucacaaguucgagaccagccugaccaauauggugaaaccccaucucuacuaaaaauacaaaaauuagccaggugugguggcaugcaccuguagucccagcuacuugggaggcugagacaggagaauugcuugaaccugggaggcagaaguugcagugagccgagaucgcgccacugcacuccagccugggcaagagagugagacuccgucucaaaaaaaaaaaaaaaggaaaaagaaaaagaagaaggcaacuuaaauauagcagcccuucugcugucuuuacucucaaaggucucuaaaaauguuaaagaucaaaucuaauucccuuuauguaaugacauucucuuugacgucucuuuagaauguuaucaguaauuguuauuuaucuucuucuuuggcaucuuucaguuacccuuuaucuuugaauguucuuuucuugauuauuuaccuauuuauucugaacugaagauauuaaauuaucagucuuuuccccuucucuuaauucucuaaaagcucauucuaaccaaugacuucaacuauuaguucuauguagacaaauguuauacuauguuuuacucugaaguucugacauaaaauggccugccugaaagucuuuucuuauccccucaaaauaaacauacccuaauucuaaugaaagaaauuuuuuuaauguaaaucuuuuguauuuguuuacaacauacuggcauaaucaauguacuuauuaaaggaguuaacuucgccaacugaaaaaaauuaaauccuuuuacuuuaaaaaauaaagcaauuaaaaacaaaugagaaaagaacacauauauuaaaaagcagagcucaaaaacaggauuggagaaguuuauaguggauguauauauauauuuauauaguaguccaucacaaacacauuuaggucucaauaauaaaaaucugauuauucauggguaaaccuagaaagucaaauuauuaccucuauaaccaauauuugaaauguccuuucuaaccccagaagcuuaucaucuugcaaauaauuuaaaaugaugacaaaauuugagguccuacaauguuggacucuccacuuccaggauuagugcccucccucaagaaaaagaaaagucacuuuggguggcgggggggggugggggggggguggcaggauugcuuuggcccaggaguucaagaccagccugaaaaacacaggaagaccucaucuugacaaacaauaaaaaauuaaaaaauuagccggccaugguauuaugugccuauaguccacuacaccaguugaaagccuggggcaggagaauugcuugagcccugaguuugaaucuacaaugagcuacaaucacauuacugcacuccaggcuaggugacagagcaagaccccauugcauuaaaaaagaaaaaaaagcugggcacaguggcucaagucuguaauuccagcacuuugggaggccgagguggguagaucacuuaagccugggaguuuccgaccagcugggcaacauggugaaaucccgucucuaccaaaauaaauaaauuuuaaaaaauguuuuaaaacauuuuuuaaaaacuuaaaaaagagagaaaaagaaaaaugacaucauggacugccuugugaauuaaauguggugacuacaaaacauauauuauccaggaucuggaacugcacacauaaaaaauauuuccaaucccucuucugccaaaaaucuaucuucccuaaacuuacucauuuaaggcuugauuaccugcuuuugaaagguaguaugaaaaauaaaaauaaagcauauugaugucaucuggcaucgauauuaugcccauuugacaaauaagacagaguuuggauaauguaggugaucuauccaacuucauaaagcucaauuacagccugggauucaaacuccaccuaaauaacuauuuaccucauuauauuauaaagaugcuuucuugaauuuuacuaaaauauucaauucuaaugauauuacucucaaaucaccuuauuuagaaaaaguucuuaaauaucagagccugaccagccaguaaaucacucagaguagagaccccacaucaggaaguuggaaggauauaccaacacacauggaucuaacaguuugagcuugaggaagcagcugagagaagcaucucaaaguccucaggaauuuggggaauguaggaagaguggcuagacccuccagcugccugaccuccaaaaaacuaaaugaggccaguguaaaagucuaucaugcaguccuuaaaacucuaagauuuagguuucuuagagaagcuacgugucucaauuaaaaaccaaaauaaaaacaaaaacaaagcagaaaacaucauauugccuggcaugcagugacuaaaucccaugaaggcaaaggcaaugagaagugugauucuuaugauucuuauuaaucuuuuucuaagccugaaauuugcuccuggcugaauagggucacuucauugaacuccuucuccuuaaagccuguucagggcaacagggcucuacuauggcagguggguggggacagaaauugucacugucacugcaaagcuauggaagguuuagggguuaaggguaacgucugcaacucccuuuaagcuucaucaaaaaaagacugauagauaaaaaagagacgggcagacagagaauguaaaauaaagcaaacagaacaaaauguuaauaacuauaaaaccuaaguggugcuuacauggacacuaacuguucaacucuuucaacuuuucuguaaguuugaaacuuuuuauuaauaaaacgggccaggggugguggcucacgccuguaauaccagaacuuuggaaagccaaggugagaggaucacuggagcuuaggaguucgagaccaaccugggcaacacggcaaaacccugucucuacuaaaaauacaaaaaaauuagcagaguaugguaguguacaccuguagucccagcuacugaggaggcuaagguugggggaucaccugagcccaggagguugaggcagcaguaagcugugaucgcgccacugcauucaagccugggcaacacagugagacccugugucggaaaacaacaaaaaaauguggaggggaaagauggcuucuaaaaaagccucauuucggccagccacgguggcuuaccccuguaauuacagcacuuugggaagccaagccaggcggaucaccuguagucaggaguucgagaccagcugggccaacauggugaaacccccucucuacuaaaaauagaaaaauuagcugggcaugguggcgcacaccuguaaucccagcuacucaggaggcugaggcaggagaaucacuugaacccgggaagcagagguugcagugagccgugaucgugccacugugcuccagccugagugacagagcaagacuccaucucaaaaaaaaaaaaaaaagccucauuugcccaaauguccaucaacuaacaaaaggauauacaaaauaucguauacccauacaagagaguauuauucagccauaaauaggaauuaagugcugacacaugcugcaauacagaugaaaccucaaaaacauaaugcuaagugaaagaagccagacacaaaaggccacauauuguauaauuucauuuauacgaaauaccgagaauagaucaacccacagaaacagacagcaaauuaguggcugccaggccugggaggaggcagguaugagaagauucugcuuaacaggcagaguuaguucccuuuucagaugaugaaaauguuuuggacacagacaaaaguggcaguugcacaagauuaugaaugcacuaaaugguacugaauuguaaacuuuaaaauggucaauauuauauuaugugaauuuuaccucaauuaaaacccuaucugguauccaauuacauuaagucaaccuggacugccuucucuuccuacaacugggagauuuccuaaaacuacagggguuuugguaauaaccugcuuuuuugguggggucugccauggcacuuuaacacuaacuaguaacuuagcuccaaauaauuucucauccuguguagcucugacaaucuguccuuauuaaaugguaauacucuaccaguaaacaacgcaagaguuuugacuaguuuaugaaauucauaaacuauugguauuacacaucaucauguggcaguuauaggaguaggaagguaugggaaacauggaaacauuaaguccuaguauauuuuaccaaagcaggguucucugugaauagcugaagaaaacggaagagcuuuaggaaauuuuaaccuggcuuauaaacuggagccauauauccuuuccucccuuccccagucuccuuuccccuuaauaugagaagagcacugagcuaucaaagagugucuguugcaaguaacagaauuuagaucagguuugaagcuauguguuuuacugcagauaccacaaaagaccagcauccagacagcucauccacuauugucccuguaagagaggcuuguguccaaacugugguuccuuuaaaaaaaaaaaaaaaaaaaaaaaaaaaaaaaaucucaagaaggccuggcuggcuagggcagaaugaaagaaggcaucuuugaaaaugugcgucuggacuagaacuagugauuuuggaaauucaaugggcugcuuugagagguauugaguucuguaucaacaguguucaaaggaaguguaaccaauuauuuguuuaaaauauuauaaagaauccaaugaauggauauggggcauaugacaauucugugggauauuugcuucaaauaaacaauuaaaaaccaguuaugagaagccuaggcaacauagugaggaccccaucucuacaaaaaauagaaaaauaaaguagcugggcauacuggcucacacuuauagucucagcuacucagaaggcugaggcaggaggauaaauugagccugggaggucgacacugcagugagcuaugauugcgccaggauacuccagcgagggugacagggcaagacccugucucaaaaaaauaaaaaacaauaaaaaccaguuaugagccaggguguguuuuuacaaaacuuagaggagaagagaaaucuaugagguuccuacuagcccccuuuuuguguaacaaaacauguugcuuucugauugguucccaaaaggauagauuaauaucaacaucauuucuuaucuucaaaggaaaaaaaaaaaaagaacaauuugcuuaucaaaagauauaugaggauuccugucauaaaacuaaauuauugccaaggggaaaacagugagaaaaaaaaauuauugucuuuauuaccuguguuuugaauucccacaauaaacagauuaaaccccaccaaguccugccccaacuccaacucccauccaacuguggccauaugcucagaggguucugaaagaauaguuaugucuaaguuacuagaauccagcaaauguuuuauuuccuuccauuuuuucuuuuauauauuuuuuaaauguuucaaccauaaacacauguaaucuguuuauauuuaacuucaaagaggcacuugaccuucauuaagaauacuuuuuuuuuuuuuuuuuggagacagucucgcucugucccccaggcuggaaugcagugccaugaucucggcucacugcaaccuccuccucguggguucaagcaaauucuucugccucagccucccgaguagcugggauuacagcugugcgccaucaugccuggcuaauuuuuguuuuguuuuuugagacagaguuucacucuugucacccaggauggaguacaauggcgcaaucucggcucacugcaaccuucgcuuccccgguucaagagauucuccugccucagccccucaaguaacugggauuauuggugccugccaccacauccagcuaauuuuuguauuuuuaguagugacaggguuucaccacauuggccaggcuggucuugaacuccugaccucaggugaucugcccaccucggccucccaaagugcugggauuacaggcgugaaccaccacguccagcguaauuuuggguuuuuuguuuguuuucgagauggagucuugcucugucucccaggcuagagggcaguggcaugaucucggcucacugcaaccuccaccucccaaguucaagcgauucuccuaccucagccucccagguagcugggauuauaggcgugcgccaccacacccaucuaauuuuuguauuuuuaguagagacgggguuucgccauguuggccaggcuggucucgaacucccgacuucaggugauccacucaccuuggcuucccaaagugcugggauuacaagcaugagucaccaugcccggccaagaauacuuuaaauaugcuauauauaagaaaauuaaacauuuccaggaaauacugaauaugguagaaaauaaagugaaccuuuugcuguauuacauuaaaaacuuacaucaguuacauggaaagcaacauuuauucauucaagaaauguuuaaugauuaucuaucaaguauguuuuaauucuuaaccuugauaugcucagguauucucuucuacucuuuuuuuuuuucuuuaagagacaagagaucacugccauccaggcuagaaugcaguggcgugaucacagcucacuguaaccuugaacucccaggcucaagcaguccucccacuuagcuucccauagcgcugagauuacaagcaugagccacugcaccuggccuucucuucuacucuuaucccaacucaauuuuauguauacuaauggauucugucccaacuucuuuuuauauagcuucauagagauucuggggguccacaguaaacacuugguaguugcuuggaauuaaagaaaacauaauuaccaaaaaagaaaaaaagauuuuuuaacaacaaacuagcuaccaaguggucauucuacauaauaaucaucauuaaaccucaguguaauaaagaaauuguuucccuacaaaaacaucuaaguucaacaacacaaaaaugaagugaagcccaggcgcgacggcucacaccuguaaucccagcacuuugggaugccaaggugggcggaaaacuugcggucagaguucgaaaccagccuggccaacauggugaaacaacgucucuaccaaaaaaauacaaaaaaaauuagcugggcaugguggcaugagccuguaguuccagcuacuugagaggcuaaggcaggagaauugcuugaauccgggagguagagguuccagugagccaagaucgugccacugcacuccagucugggugaaagagugagaccuugucucaaaaaaggaagugaaagguaauuaaaaaagaacuuacgaaggaaggucuuuggcagcucucaagccccagccuuucuuuucugugaguaugacuuccacaucugcaugcuguuuucucugaaaccgucuauuggaacaauaauccccauuuggacaccgagaagaacugaaaugagaaaaggaggaaauuuaauucuuuaaagcagcaaaagaaccaaaguaacuuugaaaaaauguguuaguauaacuacauauauacauacuuuuaugguauaauuagcauauguaugacuaacccccaacuaagucuuccuuuccuuccaucacaaagggauuccuuagaacugaguaucuacauuguuacuuaaacagaucauacccacaauacagccuugauaucuggucaucacagaaauaucuaccacucccuaggugucuagaauacauuuucaggcugcauguaagcuuucaguacauugacaacucugcagaacuuauauucuguaagugcaccuucccuuccuucuacucuaaucacuuuuaauuucauuuuuugaaugcagcuaacuacuugaucuacaauugagaaaaucuaaagucauuauuaaauauauccuuguucagaguaaacagaauaacauggcauggcucuucucccauggauccuagaguaaaaaugauaaaaucgaacacugauugacuucuuaauaugugauagauauaaagguuuuaacgaugauuaaaacuacaccagagggggcugaguacggugauucaugccuguaaucccagcacuuugggaggccaaggcagguggaucacuugaggucaggaauucaagaccacccucgccaacauagugaaauccugucucucugaaaaauacaaaaauuagccgggcaugauggugcacgccuguaaucccagcuacuugggaggcugaggcaggagaauuguuugaacccaggaggcagagguuguagugagucaagauugugccacugcacucuagccugggcgacagagggagacugucucaaaaaaaaaaaaaaaaaaaaaagaccacuggaaauuaccaaucauuuugaauauauuauuauuuauugcccacccagcagcaaauaacauuuuuagcaauggucaaaggaugaaggauuugcucuagagugaggcaguauaaaggaaagcuuucaggagggaagagaauuuaaggcagaaucucuaaugauacauaggauaugcauaaagaaagcuggagauacaacugucccugucugugugcagaaauaggaaaacaaucccuguuuggacaaagagaaaugaaacaacuaaagauaacugauaagaaaggugaguugcuggaggaugaaaagacaggcugaugauaugcuaccaagggcucugaauacaaggcuaaguuugaaccuaaucaugagaacaaccgagaacuaccaaaagcuuaagugugugaauaauaugaagaaauauuuuucuucauguaugcuucacaagguuggcaggaaaacccagaagaaugacuagggcaacaauaugaaguuagaauaaugcuaacucuaugucuucucuucuuacaucuguacugucaucucucucucuaguuuggauaaaagaauaccaaaaauccuuucucuuuauuuuuucaagguauauauauuuuauuuuugcaacacuauaacaugagcaaaaccaaaaacugagcuuuggggaaaaaaaaccuucacuaacaucaaaaauaagguauacucuuuccauguaaaagacaagaauauauuuuucaucaaucagauugguuaaaaaaauuuuuuugagacaacaucucgcucugucacccaggcuggaguauaguggaaugacagcucacugcaagcuccaccuccuggguucaagugcuucuccugccucagccuccagaguagcugggauuacaggugugugucaucaugccuggcuaauuuuuguauuuuuuaguagagaugggguuucaccauguuggccaggcugauccuaaacuccuggccucaagugaucugcccgccucagccucccaaauagcugggauuacaggcaugagccacuacgccuggccaaaauuaaauuuuuuaauguaaagauauuuacuauuuauaagaacaauacagaagcaaaugucugucaacagacuaauuaccggcuaacuaugaauagaauacauaaugcagucaagagaaagauuuaggcaggucuguacacagagcucugauuaggucugauuagcaaauccaagcaaguauauagaauaagauuuuaucuguauacauaaaaagaggaaaacaucuaccuaugcuagcauaggcauuaaaaguuuucuggaaaaaugacaaaacaaugggacugauguuugggagaagacauucacuuuaugcauuucugaaauguuaggguuuuauuucacuuuauagugaaagcuaaaaaauaccaacauuuaccucuaggacauaaauauuauaaaagauaaaaaaguacugaauagaaauuaauauuauaggacuacuuuaccaagcacuuaaaacaugguggguacuguaaucuaaugcacaaugcaagggauauuuguuucccuauuaauauguuuucuacuauacaucaaagugucuacuauacuuuuuugcuuguagucauccauagguaggagaaagguuaaauuuuauucuucauugauaauucaauauuuagagacauuuaauagaaguguugagcaaaagccgaguauucuaauuuacuuaccauucaaucaugagaagacgauuaagacaaucuuccccacaugcuauuucaccuugagcucuuucaucuuuagaaagagguguacacucacacugcauucgcuuaauaucucgaugagauuuauucuucuuucuauuggguaaaauuucauaaaaacugauuaaauaaauuuccugguaaagauauaacauauauaaucaaauaugugccaaaucucauuagauucuuuuggguuuuuuuaaacagggucuuguucugucacccaggccagggugcagugaugcgaucauggcucacugcagccucaaccuccuggauucaaaugacccucccacuuccaccuccugaauagcugggaccacagcucaugccaccacgcuugguuuuuguuauuguuguuguuuguuuguucuuuaauauucuguagagacagggucucucuauguuacucaagcuggucuugaacuccugggcucaagaaauuccccugccuccacuucccaaagugcugcaaucgcaggcaugauccacuacgccuggcuagauucacauuuaaugauuccuguaagucaaccauucaaaauaaaacaucuaauuauuaguacuugugagacugaaaauccuaagaccugcauuaccaaaaaaaaaaaaaaaaaaacaaacaaaaaaaaaaacaugagaagggcaaccuuaaccuuggcaaauggggaagaugagaugaguucaagacuacucauucuggaacucagcccuuauuuccuacuccaggucagcuaagccuuggauucagaacaguuucaaguguuaaagucauacuagguucuaggaaaaauaggaaaacucaugcauuucaaauagugacauagcugguuaaaguuaaguuuaagaaucagaccucauggaugagcaaauaauaguugagauauaagauugagggagaaaagggguuucuaaaaaaauaagagugaguucuaacucaauccaauauuuuagagaaucuuucaguaacaucacaucugcauaaauuuuguuuaaaagcagacugaauuuuuuaaaugaaguguaauuacagaauaaucagguaaauguuuaagagggcucaacuuucuccaugcagacagauuuauuuuggagaagaacauaaacugcuaaaauuugauugcguucauaauaagccaugccagagugugcaaagcaaaagugaaaaugugauuauuuauuggccuuuuugcugaugaacuagucuuuuacccuggucuaaaaacaaaacaaaacaaccaaagauggucaaaaaagaucuguuauguuuaagauuagggaacuauaagaacuauaacucacucuuugacuaucaaacaggaaacagcauagcugcucuaaaugguuaucuaaucuccuaccucuaaucugcuuugaucuucaacauauguucuauucuagugccaauuuuaugaagugccucaagaguguuaugauaguuuuaacuaaguuuaggugaaaagaaugauuccucuugauuaaagacacaauucguuaaugaguauaugaauaugcuuagccugaagaugacuaaacgaaauuaucuauuuagaaguacuuagcuacaauuuugaagaaucagcagcagcuuuauuuuguauugcucuagaaggcuggaauaggacgaaugggcauagauuuuggcagguaagcccuuuuccauuaaacauaagaaaaauguuuucauuauauucauauuauuuuuuauaagaguuugucuucuuaguggcuccuaaaugccuagcauauaacaggcacuucaaaauuuugaauauauaggccaggcgugguagcucacgccuguaaucccaguacuuugggaggcugagacgggcggaucaccugaggucaggaguucgagaccagccuggccaacauggugaaacccaucucuacuaaaaauacaaaaauuagcugggcgugguggcacccggcagagguugcagugagcugagaucacgccacugcacuccacccugggagacaaagugagacucugucucaaaaaaaaaaaaaaaaaguuaaauauauauaaauccuucccacugcaaagugguggaagcccucuuaugccuccacuaaccaaaucuaugugcacaguuuuauauauauauaucugauucucaaugcuaaagaaaagucagagaauuggacugauuaguuuuauuuauauucuuuuacaaagaucuuguaaguuccauuagucuacucacacaauuccuaaaggguacuacuuaaaauauugaauauuuuaaauguaaacuuaauuuauaacuagauauaaaugaaaauagcuguaaaaggcucucuguuaaaagguuauuuuguaauagaaaaaaauuucugguaggaccuaccuuuaaaauuaagucuuuuaccuuauacacagaggaaaauuugauuuaauaacauuuugauccuuaaagauacaauggcuagguugauucucaacuagcaggaaaacuuccaaaaaaggagaguaagggggcaggauacuuuuuguuuugguuuuuuaagcacaaucaauauaaauuuacaucaggaaaaugagaaaauuaucaaggagggguuaaaguuaaaacagacugagaagcccugcucuagaggacuauguuuucauuacucuuauucucauuauaauuuguuucauguuagggauuuuuugauaaaccacuuuaucauuucuaaaauauuuauuacacuauugccagauuuaaucuauuaacaauagucuaaaaaaaaaugagagaagaaaauuauguucuagucuaguucuaacuuuauaaguaccugauaugguuuggcuguuuccccacccaaacucaacuugaggagguaacugaaucaugggggccggccuuucucguguuauucuugugauggugauuaagucacacaagaucugauggguuuaucaaggguuuucacuuuugcuucuuccucuuuuucucuugccaccaccauguaagaagugccuuuugccuccugccgcaauucugaggccuccccagccauguggaacugcaaguccaauuaaaccucuuuuucuucccagucucggguaugucuuuaucagcagcaugaaaacggacuaauacaguacccaaagauacuucauucugcacauuuuugaaaauaaaauccaaaguaaccacuuuuuucuucucuaaguacagauuauuuugcugggguuuuauucuguuuuuuuggucagacuuucacauguaaaaggaauuacagaaauacugggcuagccuaaauuguaccuugaaaaccaaacaaguaaugaaagaaaaaaauagacaucuccuuuccuggggauggggcggcggggggaauggggaaaggaaucuauacuaucaaaucuaaauagguaaaaacacuuuuuuagacuuuuaaauuuacuuuaucccacaacucuuucauguguuuaaucucauacagucugaauuguuuaaaggcuuuuucuaacaacaaaaaaagaguuaaaauuugucaaacaaguauuaauuagacuuaccuuucuguuaaauaaacauuuucuucaauaagaucaaaguaacauggcauuuucccuugcuuggcacauuccuuccaucgcugugggucccugaagucauccaugacacaggagggcccaaccagugcugaaccugggggcacugaugucucucccugcucuaccuccacucuaacuuucuuucuguccugaagcucaccaucacuuucagaaucacucucuauuuccugccuccuuuuuuuaagaggcccucuaucuuugauaucauuuuuuucuaaguuuuuugaaaaaucuuucuuuucauucacagcuaaaguguccuuaauggaauugcugcuuauuucaggugcuugcacugaccccuugucuuucugaagggauagaagaaauuuaucggacuggucugaaaaaugggauccauccuguugaucccaauucuccucuucuucacgaucaucuguuagggaaucugguacuuguccuugaguucgaucauacacaaccccaguuccaggaggucuaccugaucuuggaucccaguaaccauugccuugccaguaaucacgugucccaccauacuguucugcauuuugcugauacuuguguccaccacaagcuccauagcuacugucagguugcugauacgugguagaaggcuuuucuugagagaagucccaaccuaaguuucugagcucuucugaugagugcaagccauccacaugugguaucucacaagaggaagaaaaacucaauucuguuuuucccagucuacuaucuggccuguuuuggaaaguggucuguugccaagacuuauuugggacaucuucaaaaucagaagaauaaauuggcagcucuucuugcugccuagaagguauuuuggcuuucacgguuuccucugaauuugggugacccagagggucagauuucacaucuguaugacuuguacuaucaaccccaucacucugaggaugagaaaguucaggcaggcgauuaucuauuuguuuucuacuggacuguguaaaagaaauuuccggauucuucucuguuccuuuaugaaggaaaaacuuaucaguuugaggacaggcuuuacuugcuauacuuucaaauuuuuccucauacaaaugucuccuugacuccaaucucucaucuucccaauggucagaauagugucuauaacuuugacugcuccgagaagaacaaggacuuguuucuuccaugggcaaaguagaauucuuuggcacaaccacaacagacuggagacgguuucuuggaauacugcuaucauccgaaucuguaucuucugaaucacuuucaucauuugaacuuucagaagagccagaauaaucuucaugaacuguagacacaauuucuggggcaugaccacuacugucacacuuuaaugcauaaguuacaccaucacugucuuccaugguuaaauucaaaucacaagaagaaaauacaacuucugagucaucagaaguaugcacauguccuccuucuccucuuucaucuaaagagauuucuggucuuccucuucuuucaggcaauauggaauucccuucuucuugagccucuugcaaacauuucccagauaacccauuauuacgccuguucucccuggaagcaaaucccuuuccugaaucaggaaggucacuaccuacuucuacuauuguuucuuucccugcaugcuuuaaaaacucugaacuuuuuuuacucuuuagcacugcauccagaacuggagauguguucucuccgcauuucaagagaguuagacuguccaccuuuauuccugguggaagacucugaagagaugaagcaauaccugaacucccaauagguugauauaaaucaucaaaaugauuaacagaagcugaacuagugcuaccgaugcucugcuuauauucuucacaugcaaauuuugagugaucugucaaauuucuacuaucacauauaacugguuuugauuccaaaugcacauucauaaagcuauuugaagaaaucuucauaacugaaggcucaauauuuucagcuucagaguuacacaaagaaggguugcuaucguucaaaguacaguauaugucugaaucuuugguuuugcagcaagaaacccucguaucaacugguucuuuaacuacuguuuuggaauaauccacagucauaacuggcauagacaugaguuuaucuugguguggugacaccagagguucuguuucucuaaaugggcuuucugacuucuuaugcagcaugcagguaucauccaagucuuuuucuuugcaccuacuaauauucugaaauccauuugaugaaagcaugcaugcuuugaccaaaggggauaauuccgauccagucacacuaucaucagaagucauuaaaacagcaucaguuuuagaagugcaaaauguugccaaaucagauucugccccaggagauccauuuauauuuaauucuaugggacaaaaacuucuuaauugaucauucuucacuuuagauaaagagucuaauuccuuaauacuaucauggcuaucauguguuauaaauucggacuuaaaaauaggcaauucaucuagcuuuuuuaaaguaggugaaucauuuaaucgauuugauggagcuggagacccagccuuuucucuuucaggauuuuuauuaaucauucuuaauucacuaccuuuugaacaaggugucuguaaacuaaaagaaugagacuguuugauuucuucauuuaauucuguacaacagaaagaauuuuuaaauuuaucagacuuggguauagguuuugaaaggguagauuuauaacgggaagcacuacugucaugcuuagaauaugaugacccucgucggaaucccaguucauuagggggagaacaacaucuuuuaauugcuucauuuucugaaguccuuuuagauucucuuucuaguuuugaagaauacuugccucuucuuuccaucucuaaguaagaggucucaguuuuacagucccgaucagauuuagaauaggaugauguccuuaggucucuguaagaagaggaaugagaugagguacgccuugaguaugucuucuuauacucuucuucugagucagaacucucucgugcucuguuaucuguguauggccgagaauagcgcguccucucucgauaaggggagcuccuaugguagcgacgaucagagucauaauaaugagaucguucugaccuggaauaggauaaauuaguucuagagccucucucagaccuagagugagaucugcuccgccgucgcucucuuucugaucuacaucgggaagauacauaccgaguaucucuuucaaguuuugaauagcuaaaauauuuaucaucucugucuguuuuagaucgugaagguuucccuagauccucacuuuuuaaaggugcugagcucuuuuuaaaaucucuuuccuuuucaaugcuugcugaaaauuuuaaaucaugugaucuuugacuugaagaaguccguacagaaucuucaucagauucugaaccaagaaagaugccuucagauugugaggauuucuucuuagaaccuguuuuuuuacagcucagacuaaucuuagaacuaucuggaauuucuucauccuucccaauaugggaaucuucuuuuuuugaggaaauaucugcuugcucauucaauauuugaguuacguguucuucuaaacuauuagauauaguguccugcuuaguaucugcuucuaaagauucugguacaauuauaauuggugguucuuucagagaucuaacugcuacaucuacugguaaggguacuggugcugccauuagaacuguuauugguguauguggcaaggccacuggcucuguuacuggugcuggugaugagaguguuguggcuugggcagguggaggcgguggaggcggagaugagggcggugagucuacaguuguugauucugcuaucacugcugguaauggugcugcaugaguagguggagaugcuacugcugugguaguagccagcaguggccuggauguuacaugaagcagauguuucuuaaaaugaauuuugcccaauuccacccuugacuuugguggggaagauucuucugcaguagauaagguaucaccaauuuccauuuucauuuuaggagucgagucuaccugaagagguacagcuggaggguuuggaguaucacuuugcuuuucauugccaagugcagugagaaaccuauucugcaaaguuuucuuuguaaggcugaagcugaaugacaccuucugucgucccuguucuuccaaauuaacuuuuguuuuggugccuuugggcaaaaaucgacuagaagcaacaccuuugaacauugguccuuugaugaaaccuguuuucugcacauuuucaaucuuugccuacaaaugaacaaaauaagcaauuacuacuacaauaaauaguuacuuucaaauggacugcacaguuuaaaauguuuacuggagaaaugaaaagcccuuuuuaauaacaaauaguaugaauuucacuaagcuauauauaucuuuauuaugaaaauuuucaaacacagucaaaaguauagaaaaugguauaauaaaucccuaaguauccacuccaagcuucaacaauuaccuauuuuccccauucuuacuuucucguacauaaauaacuuuuuucaguuuuauaacuauuuuccagguagcauuuuuuaaaaagaauuuuuuaaaaaccugacauauguuugaaagacauuuguauaaagggcaauaucuaacaucucaguacucaauaugguuuguucuuguguucuaucagagaugaaaaaucagaggucaucaagaccaguggucuccuggcaucacauggagugcacaguaaaaauacucaucugggucgagcacaguggcucacaccuguaaucccagcaccuugggaggccgaggcgggaggaucacuugaggucaggaguucgagaccagccuggccaacauaaugaaaacccaucucuacuaaaaauacaaaaauuagcaggguguggcagcaugcaccuguaaccccagcuacuugggaggcugaggugggagaaucacuggaaccccggaggcagagguugcagugagccaagauggcaccacagaacuccaaccugggcaacagagcgagccucugucucaaaaaaauaaaaaauuuaaaaauuaaaaaaaaaaacauacucaucugugauccacacucuaggaaauaucaaauaucaacgagcuauugagcucuaagaugaggaaaggguuuguuuuuugggguguuuugagguuuugguuuuuaaaaaaaacaaacaaacaaaaaagcauuacauaggcaauucuaaucaaugucccagguuugggaaaccacugauacagaggaacuucccaccuuacuuguuuuacagaugagguaaccaaaugaggaccaggccuucugccuuccuggagaguacucugccuuggcacauaucacugucucugccugggccccccacccucaaguaauaauacugcuguauaagcaacaguuacaaaguauaaaccuaagaagacuacuuuucuuccauguuugccaaaucaccaaaggaaaugguuagccuuggaaguucaaggcauaacguagguuguacaaagagcaucagaaaaaucuacagcaacaaacucaauccuaaauuaaagauggugguauacuucucauaugcaaaauucuucuaauuaauguucuuuaauccacuuuggcuauuuaagagaguaacuucccuuucaacacaguaaaaucugaaaucaguuuucaaaauuacauaguagucauucaaguuggaaaguaaauacuuucacauauauuaucauggagcagugaauuccaaauacuuuauuuuuuugagacagagucuugcucuguugcccaggcugaagugcaggggcaccaucuuggcucacugcaaccuccuccuccccagcucaagcaauucuccugccucagucuccugaguagcugggacuaagccaccaugucugccuaauuuucuuauuuuuaguagagaugggguuucaccauguuggccaggcuggucucaaacuccugaccucaagugauccaccugccucagcuucccaaagugcugggauuacaggcaugagccaaauacuuuuaagaaacagaauccacuuuucaaguuaaaucuuaaauggaagcucaauacauaaaaaacaaguaaaagauauuuuuagaacuuccaacuuucucuaccuuuccuaaaucucuugaagcucuaaaguuuaaaaaccauuuuucugagauacacaacaucccucacugggauaaguuaccauggcucuaaaaacaaaauuaaaaacuauuacuucauuucacauucaaaaugauagcuacauuuugaguguuuucagcuuuuacccaauuucuaaaauguguuuagugguccaucucauaaucauugaaugacuaguuaaauuauacuuaccucauuuucuucuucucuauuuccauucagccaagaaaacaugcaaaagaauaaaaagaaaucauaaauacuuaaaaacgauugaaauaauaguuauuuguauuaaaacuugggauacuuacuaccuacagguauauucuauauggauuguccauuccuucacacucaguuacauuuaguuuaacaaauauuuacucaagauagugucacauacugugcuaagggcuggagaccaaauuugaauaaagcagcaucccugcccucaaaaagcucagcuuccuguaagucacaaaaaagaaauuuguaacaaaaguaauaccaacauaauggaguaaauauaagaauagaaauauauauaguaaggcagcaaagaggacgauaagcaacucaguuuagugggaaaauaggaaugcaaagaauuuuuccugccuagguguggugguucacaccuguaaucccagcacuuugggaggcugaggccggcugauggcuugagcccaggggauugagacuacacugggcaacauggugaaacccugucucuauaaaaaauacaaaaaaauagccagacaugguggcgugcacuuauagucccagcuaccugggaggcugaggugggaggaucaccugagcccaggaggucgaggcugcagguagccaugaucacaccacugcacuccagcuguggugauggcugucuuuaaaaaaaaaaaaaaaauccugaagagacgauucguuuuugaagaauacauuugugagaagaucccaggcagagucagagauuaacacauaaaauaaggcuggguguaguggcccacacuuguaaucccaacacuuuaagaggcuaaauugggaggaucacuugaguucaggaguucgagaccacccuggguaacauagcaaaaccucaucucucuuaaaaauaauuuuuaggccaggugcgguggcucacgccuguaaucccagcacuuugggaggccgaggugggcagaccaccugaggucaggagcucgagaccagccuggccaacauggugaaaccccaucucuacuaaaaauacaaaauuagccgagcaugguggugcgugccuguaaucccagcuacucgggaggcugagaaucacuugaacccgggagguggagguugcagugagccaaagucgugccauugcacuccagccugggcaacaagagcaaaacuccaucucaaaaaaugaaaaauaauuuuuaaaaggaaggcuaaguugggaggauugcuugagccugggagacagaaauugcacugagccaagaucaugccacugcacuccagucugagcaacugagugaaaaccugucucucucucucacacacacacacacacacacaaaauaacauagaauaauauguguaaaguaucuauaaacaguucaauauuaccugaauauaagguguaaggcagaaagaagccaacaauaagauggaguaggaggcaguggucagguuucucaugagaagaaucauauuucaucuuauggaucaaugcuucucaaucguuuuugguaucuguucaacaguuccaaaggcaagacuauuccacauuacagugcaucugcuccauaacacaaugcgcagcucucuggguuauguucuaacaaagguaaccacacugacuaagagcaaucaaaagccacaagucuaguguacacuagcacaccaacgcauacugagggacugucuacuuggagaaaaggaagcuacaaaaggacaugacagcgagauuuguauuuucagcuagucacucauuggacuauguggcaagacuggaauacaacaaucuguuuucaauguuccugaaaggaaacauauaaaacccuuuuccccaaauguaggccuaacuucaucauaauucauuccauucgccagugucugugguagccauacaaaaccaaguaaugacagggggagagggggcaguaagcugauaauacaugaaugagaucugaagcagugccaaaauuaaccauuuuuuucuacuccaaaaccacuaaaaaccucauaaaugugauguuagcacuacuguacuucaucaauucuaugauguacauuuugcccacaggaugcaugcuaucaaugguauaauaguuuuaacugaaaauuuuuuucacgucucaacguucauaaaauaaucauuuucuuacaaucgauggcauauuagaaccuaugguauauucaauuugauuuaaauuaguaccauuugaaauuuuuucaagacagaagguaccaggagauguccaaccaaggcuuaucugcauaguacgcacacauacgaaaugcuagaaauacaaaagugaccagaacacuuucuuaagccucagcaguucuauuuuggacaggcagaugaaaagaauaauccugacaaaauaugaugaaaauaggcucagguuauauuguaaauuuguggaguugggagggaagggggcauaaugaagguccauuuuagaaaucaaagaauuguuugacagaaaugacaagacaggagggggaaguguuuaaaaaagaaaagaaaagaaaugacauuucccagaacuugauaaaauaaaauguuuauaauaaaagaauauaagcacaaucagaaauuuggagggaaauuuucucaucauuaaaagcauuuaguguuaauagauaaaaaucaaauuacaaacaagcaaaagaaaaguccacaauccaacuuuccagagacaacuacuguuaacacuuugaucuacagagcuuucugcacucguuugugcaugcacuugagugugguuuuuaaacagagaucauuguuuuucuuuuuaaaaacauacaagccauucuguaucuugcuucccucccucaugauagagcuggugagcagacaaguuguuuagaucacagaaaaaguauggaaucaccaaauuagauugaggaagugaucucaagagaaggagauacaggcugggcgcaguggcucacgccuguaaucccagcacuuugggaggucaaggcggguggaucaccugagguuaggaguucaagaccacccugcccaacguggggaaaccccaucucuacaaaaauacaaaaauuagccaggcaugauggcaagugccuguaaucccagcuacuugggaggcugaggcaggagaaucgcuugaaccgggaagcggagguugcagugagaucacgccauugcacucuagccugggcgacagaaugagacuccgccucaaaaaaaaaaaaaagaaaaaagaaaagaaaaaauuggucucuacuuuucugacauaauuaguugaaagcugggggaagagacaggguaaaagacaaagaaaauucaagcguuaggcaacagaaguggaaguagacuguaauccucaauguugcugcccaaaguuggacauuaccaauuuauaauugagcucauuagcauacuuauucuauuuuuguugaagggauuaagccaucagagguaacagcuagugaauuaauccagcaagauuggcgggacaagagggguagaaggcaagaaguugagagaacugauuucucaaaaauauuaaaauaacugaccuaaagaucccuagauaauagacagggagugaaaucugaaggaagcucauaaacucaauaggguagggacaagauauugggggcuuuaaagaguggauuugguggaaaccaggaagagagguagaagggucaauaagguggaagaacuggaaauuauggucagaguauuauuuuagaguugaaguacauuuccaggagagucuucuuggguaggagaccuagguacggccaggaagaguagacugcugcagcaauaagaaggcaggaccuuuuugaagaaauuaauacaauugugagaccacaauuaacagcaagaauuagcuacaaauguuuuuaacauaagaacacuuguuucgguaaauaauaucaagagcaaagaagagaguuuuugaagaaagguugaugaaacaaggguauagaaacaagaaguuaagaguauuaaacuuccuguacucccuaccauaaaaaauaaggaggcaugugaaaacaaguauuuaacuccacaggaugagaucaugcuagaauagccuauuucuucuuucaaaaaacuacuacagagaaaaaaaaaagaauauguuagccaguuaucugucaaaaaaauagugaagugggcaaaucugcagcuugcugauggaauuauauauuuaaagaauccauaucaacacgaagauaaaucucuauuaggucacaugguauauauagaaaaagacuuaguuaagaguuuuagucauggcaagcucaaggaaccaaagaaugacaugacuuaaaaaaaaccaaccaaccaaucucucaggcuaggacauuagaaguaagguuuacaaagggaagcccuauaaaugagagcaauuuggcccuaucaagcgcauuaauaaauauaaacaaguuggauaguaaagaaaucuauucuggauaccaugucacacaagaaaugguuaaagcuaaauagaaguauuuuuaucuaccuuagaagaaaaaagauuuacaggaccauaguaguuuauuucaaacuaccagaaaguuuagaagaugaaauaaucuuauuuugugcaauucugaaagucagaacugugaccaacaaauagaaguuacagaaugacagcuuuuagcucauuuuuaguacauuuuaaauuaauuuuuuuucuuugagacagaguaucgcucugucgcccaggcuggagugcaguggcgcgaucucagcucacugcaagcuccgccucccagguucacgccauucuccugccucagccucccgaguagcugggacuacaggcgcccaccaccacacccggcuaauuuuuugcauuuuuaguagaaacggggcuucaccguguuagccaggauggucucgaucucgaccucgugauccgccugccucggccucccaaagugcugggauuacaggcgugagccacugcaccuggccaaauuaauuuucuuuauuugaaaaaguacuauauguagcugcgggaaauuuuauaauacaaagagauauacaacuaaaaacaaaucacucuccccagagcaacuauuguuaaguuugcauauucuuuuuuuuuuuuuuuaauuuacuuauuuuuugagacagagucucacucugucacccaggcugcaguacagaggcgugaccucagcucacugcaaccuccaccuccuggguucaagcaauucuccugccucagccucgcgaguagcugggacuacaggcgcgagccaccgugcccagcuaauuuuuguauuuuuaguagagacaggguuucaccaugcuggccaggcuggucuugaacuccugaccucgugaucugcccaccucagccucccaaagugcugggauuacagacgugagccacugugccuggccuaguuugcauauucuuauucgaaaacuuugugugcauauaugaacauacacauaucuuuuuuuuuuuuuuuuuuugagacaggaucucauucugucuuccaggcuggaguccaguggcgcaaucuuggcucacugaugccucaaccuuccaaacucaagugauuuuucugcuucagccuccugaguagcugggacuacaggugugagccacugcaccgggcuaauauuuuuugagacaaagucuacuacaaaacuacaaaaacuagccagguguggugguacaugccuauagucgcagcuacuugggaggcugaggcaggaggaucccuugagcccaggagguggaaguuacagugagcagagauugugccacugcacuccagccuagaagauagagggagacucugucucaaacaaaaacaaaacuagaugugucacuguacaggacacuuaagauuccuugacaucaaaaauguuuaagaaucuggauaagaacuuaacuaagauaagacaaagaauauuccuguccucaagguggacagccaaaagugagguccuaggucucacuccagaccuucuacugaauuucguaacuacaaaucagaaauagcuuuuuacuuuaccuugauuuuaauaagcaaagacuucaaaaauucacuccuaccuaaagauuucuuacuaaaacuaaaauacaguguuucuuacacuugaguguaguauaggccucauuuaaagaaaaaaacugucagacauauaagaauagaucacaguucaagauuucugacagaaaacaaaaauuagccuauuaaaauuuauuucauuugaaaacugucauugcagagaauuuuaaacuuaaaacuugucaaaauaauuuuuaaggucuauagguuagaaaauaauauuguaucaguguuaauuuccugaauuugaucauuguaauguuguuuuuaggaaauacauauuugaggauauaggaguaaagaggcaucaugucugcaaauuuccagcauuccaggaaaaaaguaaugauguauacauauauguauauaaacaaagaaugacaaaacaaaugugguaaaauguucuuaucucgggaaucugggugaaggguauauaggaaaucucuguguuuuaaaaaaauauauuuuaauacauauuuuuuguagagacaggggucuaugugguccagguuggucucgaacuccugagcucaaacgauccucccgccuuagccucccaaagugcugggauuacaggcaugagcaacuguacccaguggaaaucucuauuuuuuaaaccauucuguaauuauuuuuuaaacuuaaagauaaucaaauaugaaaaguuguuaaaaauucucacagaaucccccccaacccuuaagaauaugugggccaggcguggugguucacuuugggagguuguggcaggcagaucacaugaguccaggaguuggagaccagccuggccaacauggugaaaccccaucucuacuaaaaauacaaaaauuagccaggcgugguggcacaugccuguaaucccagcuacucaggaggcugaggcaugagauucgcuugaacccaggaggcagagguugcagugagccaacaucacgccacuguacuccagucugggccacagagugagacccugucucaaaaaaaagaguauguggacccuuggaaauccuagagccucagcuggaaaaacauuaccucaaaucuuccuaaauuuauauucugguaagcacugauaaaaauaagcuacauaaaaacuagacucuggaguaugagauuacagggguaacgauacugugaagagaaaacucaaagacaggaaaacugauaacaaaagaaaggaagccaccaauuacaaaucaaagaguauuucauaauauugcuuuuaacauauccuagcccagagguaggauagcaguacccuuaacuuccuagaagaaaggugcuuguuguccccugcccaaagcaagacagaaacagaaauauuggcagggaacucuucucaauuacuaagugauuaccuucaccauuaggaaaccaggaauuucauugcuccugcugccccauccuacacuauaccucauguuuuguuuuaauuuuaggauucuaaauccuugauccgcuucccagcaaguacagguggaagccucuguugugggggggaaaaguuuggaacgaaugaguuaaagucaugcauguuuugacauuuauacauuuaagcaccuauggcguuauauauucaagaguuaaacuuccuccaaucuucacugaucuagaaauaugcaucaggcagaaaucuucaaaauuaaaacuuuuaucacaaaaggucacaccuaccuagcucucugcuuggacuauggucauacacauuugcaaaccucuucuaaacacacugagccaauccuucuguaggcuagaguuuugguagggaauggauguccuagcuaacuaccaagagugagcugggcuuauggcaaaugugaaaacuacaucagaacguaucucaguagcacacaaccaugcugauggacugcucaaugacuuuuuuuuuuuuugagacagagucucacucuggugcccagacuggagugcaauggcacgaucuuggcucacugcaaucuccgccucccaagugauucuccucccucagccacuggaguagcugggauuauaggcaugugccgccacacauggcugauuuuuguauuuuuaguagagacaggguuucaccaugucggccaggcuggucuugaauuccugaccucuagugaucaacccaccucggucucccaaagugcugggauuauagguguaaaccaccacacccggccugaaugacauuuuagaaagguaacacuuaacuauaaauaucaccucucauaucaaucagaggcuauuuguucaauaauuauuuaaggauccaccuuguaaaagcagugcuaggucuguaaaggcaaaaugucaguucacagucucuaccccaccaggaauuucauacuuacuugaaguaacauggcacagagguacaucaaauaacuauaauacaagguaacaaauaauaauugccaugaguagaaaagccaguaaggugcuuucuuuuaagcuucacuuuugggcucaccuggucucaauuuuucugauucucuaugaaaacacaccuuuaguauuuauuacuuugcuuguuaggguggcuuuuuaaauuugagacaggaccuggcugucacccaggcuggaggcaguggcacaaucuuggcucacugcaaccucugccucccgggcucaagcuguccucccacuucagccuccugaguagcugggacuagaggcacacgccacuuacguccagcuaauuuuuauauuuuuuguagagacaggguuucaccauguugcccaggcuggucucagaacuccuaagcucaaacaaucuguccgccuuggccucccaaguguugggauuacaggcaugagccaguacaggcacgccuggccuagggguggcaauuuaauacagaaaaaaaaucaaacuugauaccuaggucagaauccuaucccugccauuuauuaacucuauggcuugugccacucuguucccuuacucuccuagaugccuauuucacacauuccccuaccccaaaucucuaucaccaugaucuccaugaccacucucaauugacgaucccaccacuuugcucaguguccuauccucuugccucaaggacuuccauuuucuauuuauuuccucuccucuaucaucagucucucucucuuuccucucuauucauucucauuagccaaacagcuuuuaguaaguuacuagaccagcaucuuaaagcuagugaucaauuucuuuccuaggcuuucacagaccacauucuucaguuuuuccuccuccccucacugcuacuccuccuuaaucucauuuguuggcuccucccacccauccaacuaauagguacuacuuggauaccuccuacaucucaaauauagcauggucaaaauugaacugaugacgauuaucccauauaccuaauucaguccucccccaagucguuccuaugacaguaauacuaccaucuacccaauugcucagaucaaaccucauuuguccuuaauuuuucucucuccacucacagcccacuccacauaccugcuuauccucuuucugaccuuaccucuuuccauagucccuccuccucauucucuagguuuuagccacauuagccuucucucugucccucauacauuccaagauaauuucuggcucacagcccuuucaccugcuuguuccuucuuggaauaccauucccuccagaucuucaccagacugcugcuucucgauaauaaaaugacaucucacacagccauaaaaaugaaugaaaucauguuguuugcagcaacauguauggagcuggaggccauuauccuuagugaacuaacucagaaacaaaagaccaaauacuaaauguucucacuuguaagugggagcuaaacaauggguacacauggacauaaagaaggaaauaauuaacacuuggggcuccaaaagauagggcaguggguugaaaaauuaccuaaugggggcugggugccguggcucacgcuuguaaucccagcacuuugggaggccaagauagguggaucaccugaggucaggaguuccagaccagccuggccaacaugucaaaaccccgucucuaccaaaaauacaaaaauuagcugggcaugauagcgggugccuguaaucccaccuacuugggaggcugaggcagaagaaucacuugaacccgggaggcagagguugcagugugccgagaugacgccacugcacuccagccugggcaacagagcaagaauccaucuaaaaaaaaggauuaccuagugaguacaauguucacuacuauuuggguaaugggcacacuagaagcccaauccccaccaacaugcaacauacacguguaacaaacaugcacauguacccuuugaaucuaaaauaauuuuuuuaaaaagaugacaccucaaauguuauuuccuuugagauucucccaucauucuauauuauaguaccuuauuuuauuccuagcauuuauuauuauuuuuauuuuauuuuauuuuuauuuuugagauggggucuuacucugucgccaggcuggauugcaguagcgugaucucgacucacugcaaacuccacuuccuggguucaagcgauucuccugccucagcuucccgaguagcugagacuacaggcaagcaccaccacacccagcuaauuuuuguauuuuuaguagagaugggguuucaccauguuggccaggauggucucgaucucuugaccuugugauccacccaccucagccacccaaagugcugggauuguaggugugagccaccgcgcccagccuuccuaguauuuauuacuauaagaguugguuguuuauuuuuuauuuauaaauauuuuauguaaugcccauuuccucccacuagcauacaagcuucuuuaggacagagauuugguuuuaucuuguuuacagcugcauuuaacugccaaaaacaccacuuagaagauauggagcacucaauaaauaucugacauuauuauaaauuuuucuuuuuuucugagacagaaucuugcugucgcccaggcuggagugcaauagugcgaucuuggcucacugcaaccucugccucccagguucaagcaauucuccugccucauccucccaaguaacugagauuacaggcacccgccaccacacccagcuaauuuuauuuuuuuuuuaguagagaugggguuuugccaaguugaccaggcuggucucgaacuccugaccucaggugauccacccgccucagugucccaaaguacugggauuacaguauuaucacuuucuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgccgccacgccuggcuaauuuuuuuguauuuucaguagagacgggguuucaccgugucagccaggauggucucgaucuccugaccucgugauccgcccgccucagccucccaaagugcugggauuacaggcgugagccaccgcgcccggcccacuuucuuuuuuuuugaaaccaagucucacucugucgcccaggcuggaguacaguggcgcgaucucagcucacugcaaccuccaccuccuggguucaagcgaaucuccugccucagccucccauguauagcugggauuacagguguuauuauuauuauuauauuuugagaugaaauuucacucuuguugcccaggcugaagugcaauggcaugaucucggcucaccacaaccuccaccucccagguucaagugauucuccugccucagccucccaacuagcugggauuacaggcauguaccaucaagccuggcuaauuuuguauuuuuaguagagaugagguuucuccauguuggucaggcuggucuugaacucccaaacucuggugauucacccaccuuggccucccaaagugcuaggauuacaggcgugagccaccgcgcccagucaagccuggcuaauuuuuguauuuuuaguagagacgggguuucaccauguuggccaggcuggucucaaauuccuggucucaagugaucugcccaccucagccucccaaagugcugggauuaucauuuuccuaccuaguuaagcugcuuuuacacuacuccccagaaggaaucucaauagcuaugguggucucuuuuaaguucaaaucuagaucagucuuguucaacgucuuucuuucuuuucuuuuuuuugacagggucuugcucuguuacccacugucacccagagucuaggcuggagugcuauggcacgaucauagcucauugcagccucgaacuccuggguucaagcaauccucccucccaagucuccucagcuggcuaauuuucuuuaacuuuuuauagagacgggcucacuuaucuugcccaagcucucaaauuauuuuuuguauugcucguuucaucaccuuccucccucucagccuccacacuacacacauaccacaucacccccauaucuaccuuaauccacucagggaccacuaaagccuuuccuuccuuugacaauuaucugaaugucuaguagguacucagcacuauuaugccuuuuccuauccuuuucuuaccuuuccagauacuacuacuaaauucaacuccuacagcauauacuuuacaaucugacaaucacauacagccuugacuugcauuuauuguucuugucuccccauauagaguuuaaauuucaaagagacaaaggcaacaucuuguccuuauuauauaaucuccccugggccuaacauucccguuccuaucauacauucucguuacuuuuugaaucaaagaaacuccuuaacaacaguacuaguuuuuagcuuccucacuucaagcaauucuuaaaggaaaagagggaaacaucucaaaacugacauguagaaaaagcaagauauauaggccauaaaauuuaugaaauuugccgcauucucaucuaagaacaaggacacgugaagacaagugaauuaaaaaaaaacacugaugaaaaauauacguuauuuauguggucaauaaagcuaugagugauacacugcuuuaucaaagacauugaaauuucagguaaagcacuuuggaguaaguaugcuaaccugaacuagcaugaguagacuugauauacaagcacuccuucucacuuguuuaaguccacaucuucaacugguauaguaucucaaacauacaaagaauccuauugaucaauauauaccgacuaaaucuagaaaaaaauaacuugaucauacucaccaacuauucuuacaccccaaaaauagcugaaacuuuauuuuaauguggaauuacuacacaagugaguaaagcuaacuuauuuucuuuaaaaaagucacuucuaacaagaagugacuuuguuaaaaagcuaaucucaaaugugucacuacggaauucuaaucagugaggaaagguuaagacuauaaucccaaauguuaacaacuguauuuaugccugaaauguuucucuacuugucugccaaauagauacacaagaauaccuaccuaaagugaaugauauucaccuguuaaagccaucugcuuuuuccaaaacccauaaguuggaacguugggugaccuaaccugaacauuuuagagcccaguguugaagacuauuguauucaauugaauuccaguaauuuuacucauuacucugaguuaaucuuuucaauuauccauuuguuuuccucauuagcaaaaagugagagaggaaaaccuccaauaccaaauaagccucaaaagauaaauaugcauaaaugcugaaauucaucuuuaguacaagccagugaaucacacagaaagaguugacuggccaggugcaguggcucacgccuguaaucucagcacuuugggaggccaaggcggguggaucacuugaggucaggaguucaagaucagccuggccaacauggugaaauccugucucuacuaaaaauacaaaaauuagccaggcaugguggcagucaucuguaaucccagcuacucgggaggcuaaggcacaagaauuacuugaaucccagugggguggagguugcagugagcugagauugcgccauugcacuccagccugggugacacagcgagacucugucucaaauaaaaaauuaaaauuaaaauuaaaaauucuaaguaucgaauacgaagaaagacaugagauagguuucugagggagauggcuuguuauaauuagacuauuauaauuagacuguagacucuaagcucgcuugguuaauauuguuuuuuugugagacaggaucucacugcccucacccaggcuggagugcagugucaugaucuugguucacugcaaccucacaccacccacccccgccccauucuagugauccucccaccucagccucccaaguagcuaggauuauaggcacacaccaccaugccuggcuaauuuuugaauuuuuaguagggaugggguuucaccauguugcccaggcuggucucaaacuccugggcucaagcgaucugccugccucagccucccaaagugcugggauuacaagcaugagccacugcacccaguugguuaauguuuaaacuguaccuaucuuguauuguaccagacuaaguacuuaugucagccuuccuguccuacucuugcuuaaccacauuaaaugagaauacaaaaacagcucuuucaaguuacagccuuucaugcaaauuagcucugaaaaacccaccuucuaaauaaaaacacagaaauaaaaccugugaugugauuaaauggaaagacaugagaaagacaaggucucucuuuuuauacauauuucagaucucuuuccaucauaaauaacugcuuacuuucaucuuaauacuaaaaaugcuucugaaaauaauuuuauuauuucauguuucacaaguaaguuuucuuuuguuauaaagaaaaaauaaaaaaaugugugggcugcuuucuauuuuagaaacauaccaaguacaacaauucaaaaaguuucuagcauaaguuaccacccgaccaaaaucaaaacacauuaaaaaacaauucaguacucuuacggaacaaaagcuuaaaugcaauaaaaauagccauuguuuauuuucugguuuugguaaagaguuuaagcauuuuuuuuucauuguaauuaaugucugagguauagaaggaaaagguuucaagucaacuaacacaacuacaaguaggguaaaagcuauccauaccuuaaaaaaaacacuugaaacacauauucuuacaaggcaaagccaaaugauaauauaggaugauugugaauuacaaugcacugaaugcaccacuauccaucauuucauacagaaaaagguuaaaauaaacugcaaaaggcuaucugugugcuaguaaaagguuguaacagugacugaauaacccugguacauccguucaaugugguaguaugcagcuucaaaaaguucuaauuacgaacuuugaucuaaaagaucauaauaaugggcuggacgugguagcucccccaucuguaaucccagcacuuugggaggcugaggcaguaggguuguuugaggcuaggaguucgagaccauccugagcaacauagugagaccucgccucuacaaaaaauaagcaaaauuagccaggugugauggugugcgccuguagucccagcuacucaggaggcugaggugagaagacugcuugagccccagaggccaagggugcagugagaugacauggugccacugcacuccagccugggugacagagcaagaaucuaaguuaauuaauuaauuuaauuaaaauaaaaggucauaaugaagaucucuguauacugcuccggaauguacuguuaaggaaaaaaagcaagaaacaaaacaguaaauuuaguaugcuacuucgugguggggggagguggggaaggggaauaccauauauacauugucuuuuuuuuuuuuuuugagauggaguuuugcccuugucggccaggcuggagugcaauggcgcaaucucgcucacugcaaccuccgccucccagguucaagcaauucuccugccucagccuucugaguagcugggauuacaggagccugccaccacgcccaacugauuuuuuguauuuuuagcagagaugggguuucaccauguuggccaggcuggucuugaacuccugaccucaggugaucugccccaccucagccucccaaagugcugggauuacaggcgugagccacugcgccuggcucauuggcuucuuauuuucaaaauggaaaaaugaaaguuggggcugggcauggugggucacaccuguaaucccagcacuuugggaggcugaugcuggaggaucacuugagcccaaggagcucaagacuagucugggcaacauagugagagcccauuucuacaaaaaauuuaaaaauuagccaggcguuggugaugcaugccuguagucccagguacucagcaggaugaggcaggaccacugcuugagcccaggacgucaaggaugcagugagcuacgaucucaccacugcauuccaccgugagcaacagagcaagaccccgucucaaaaaacaaaacaaaaaaacuuuauuggggaaaaaaccuuaacaaaaguagacauaaaauucugcuguguucaaggagagaaacacuaauauuccaaauauuuaaauccacuuuccaccuaucuguaaucuuuuaggauaaggcacuacagugcuaaauuuucauuuccugcaaaaaauaucuuuugugcucuuaagguaaacagaaaaauaagaguauuuuugaacaucauuuugcagauuagaauugcuaucuagucuacugaucuuuuuaauuucuguaaguugcucauuauuaaauacuaacaguauauaacugcauauucauauaauaaagcuaguugaucuauaaaacaaacuuuuaucagaacuuuaucccauugguuuuauaucucaaaugucaaguuacauuauaccagaacuuuuuuuuuuuauuuugagacggagucucgcugucgcccaggcuggagugcaguggcgcgaucucggcucacugcaaccuccaccucccggguucaugccauucuccugccucagccucccgaguagcugggacuacagacacccaccaccacacccggcuaauuuuuuguacuuuuaguagagacgggguuucaccguguuagccaggauggucccgaucuccugaccucgugaucugcccgccucggccucccaaagugccgggauuacaggcaugagccacugcgcccggccacauuacaccagaacuuaagaaaaugcaguugucccacagcucuagcugucaaguuucuagccacuuaaucagagacaaaacuuaagugcuauaaacagcucacuugaggaggccaaaucuuaugcucuaugacaaagaacuacuccaagcugacaaaguaaauguauaccucacagaaacaacacagggcaaaauaucagaagccaggugcagugacucacaccuguaaucccaacauuuugggaggccaaggcaggaggaucacuugagcccaggaguucaagaccagccugggcagcacugugagacccugucucuaaaaaaaauuauaaaaauaaauaaguccagccgggugcaguggcucaugccuguaaucccagcacuuugggagaccgaggcaggcgaaucacgaggucaagagagcgagaccauccuggccaacauggugaaaccccgucucugcuaaaaauacaaaaauuagcuaggcgugguggugcaugccuauagucccagucucagccacuugggaaacugaggcaggagaaucgcuugaaccagggagucagagguugcacugagccgaguucgcaccacugcacuccagccuggugacagagcgagacuccgucucaaaauauaaaaauaaaaaauaaguaaguccagaaaaagaaauaaggccaggcacgguggcccacaccuguaaucccagcacuuugggaggucgaggcggguggaucacuugaggccaguaguucaugccaacgugguuaaaaccccaugucuacaaaaaauacaaaaauuagaugggcacacacccguaaucccagcuacucgggaggcugagguacgagaaucgcuugaacccgggaagcugaggcugcagugagcugagaucacaccacugcacuccagccugggcgacaagugagacucugucucaaaaacaaucaaucaaucaaacaaacaaacaauaaauaaauauuuuaaaaauaacagaauauggcuuggaauuaaauaguagacaauauuauauccaaaaguuaaaguacgcagcugguuuucaugccuacaucuacagaggugagaacacugaaaaaucaaaacugacaauguguaaacauaacuagaaugaugaaaaaaacugcagguugaguaacgcuuacugaaaacacuugggacaguaaguauguccaacuuuuucagauucuggaauaucugcauauacacgagauaucuuggggccagauaucuuggacccaagucuacacaccaaauuuguuuauguuucauauaccccuuauacacauggccugaagguaauuuuauacaauauuuuuuaauaauuuugggacauggaauaaacuguguuguaugccuguguuuuguuuuuguuuuuaagagacggggucuugcuuuguugcccaggcuggagcaaguacaguaguacaaucccagcuugcugcagccuugaacuccuggacucaaaugauccuccuaccucaggcuccugaagggacuacaggugcaugccaccaugcccagcuuggcuguguuuugacugcagccccucacaucaggucauguguaaaauuucccacuguggcaucaugucagcauuaaaaaaguuuuaacuuuuggagcauuucagauuucacauuuuuggauucagcugaggccuguauacaguuuaagaacuauauaaccuaaaaggaacuaugcagcugaacaggugugguggcucaugccuguagucucagcacuuugggaggcccccaacaggaggagugcuuaaggccaggaauuugagacuggccuggacaacauagcgaggcucugucucuacaaaaaauaaaaaauuagcuggguauaguggcuuacaucuauagucccagauacucaagaggcugaggcaggaggaucaguugagcccaggagucuaaggcuacagugagcuaugauggugccacugcacuucagccugggugacagagcgagacccugucucaaaaaaaaaaaaaaaaaaaaaaaaaaagcuauacagccuaaauugucugcuauggucuuucuagugccucuguccagaaagcauaucccacuugcucuuaucucccaucuuguacucucaaaaugucagcuggagagguaccacccacaguacaauauauuaggagcaaaagcucuuauauucagucaaccugaauuugaauacugacuccaaaguuuuuuaaccuaaguuacuaaaagaaauggaggccaaagaagcuagcuauaaaacugaaauaguacuauauuuacuuuaaaaagagaacgagugucuauuuaaaauccuucauauagccgggugugguggcucacgccuguaauucccacacuuugggaggccgaggcaggcggaucaccugaggucaggaguucaagaccagccuggccaacauagcgaaaccccgucucuacuaaaaauacaaaaauuaaccagucauagugguagucgccucuaauaccagcuacucgggaggcugaggcaggagaaucgcuugaauccagaggcagagguugcaguaagccgaggucaugccacuacucuccaaccugggcgacacagugagacuccgucuaaaaaaaaaaaaaaaaauuccuucauauaggccaggcaugauggcacaugccuguaaucccagcauucuaagaggccaaggcgagaugacugcuugaagccaggaguucaaaaccagcccgggcaacauggagagaucuugccucuacaaaaaaauuuuagaauuauccagguauacuggcguuugccuguggucccagcugcuugggaggcugagacaggagaaucacuugagaguccaggaagucaaaacugcagugagccagguuugcauuacuaguccacucuaggugacagagugagacccugucuucaaaaaaaaaaaaaaauuccuucauauagugccuggcagagaguuuauacucaauaaaugagagcuguaacauauuuguuuuuguuuguuugagacagggucucacucuguugcccaggcugaagugcaguggugcaaucucagcucacugcaaccucugccucccagguucaagcaauucuccugccucagccucccaaguagcugggauuacaggaacucgccaccacacccgcuaauuuuuuuuguauuuuuaguagagacaggguuucaccauguuggccaggcuggucucgaauuccugaccucaggugaucugcccuccucagccucccaaagugcugggauuacaggcgugagccaccaagccuagccacugcaugucauuuuuuuuuuuuuuuuugagacauagucucacccugucgcccaggauggagugcagugacgugaucuuggcucacuacaaccucugccuccucgguucgaacgauucuccugccucagccgcccgacuagcugggacuacaggcaugcaccaccacgcccagcuaauuguuguauuuuuaguagagacaggguuucaccaggcuggucuggaacuccugaugucaggugauccaccugccucagccucccaaagugcugggauuacaggugugagccacugugcccagccagcaugucauuuuuuaagauaguuucuaggccgggcgcgguggcucacuccuguaaucccagcacuuugggaggccaaggcgggcagauuacggucaggagaucgagaccauccuggcuaacacagugaaacccugucucuacuaaaaauacaaaaaaaauuagccgggcaagguggugggcgccuguagucccagcuacuugggaggcugaagcaggagaauggcaugaacccgggaggcggagcuugcagugagcaaacaccacugcacgccagccugggcgacagagcaagacucugucucaaaaaaaaaaaaaaaaaaaaaagauauuuucuuucagcuccuauacuuucugcacucuuguucauaaagguaugcuuagaacccucuuacaaaauuaaaguauuauacucauuggugggcuaaaaauauauuuuaguaaaccuaggcuucaacuauaacauaaccaacugaaacuuguuuuuuugguuguguuuuguuguuguuguuguuguuguuguuguuguuguuuuugauaaagcgucucguucugucacccaggcuggauugcaguggcgcgaucucagcucacugcaaccucugccuccuggguucaaacaauucuccugccucagccucccaaguaguugggauuacaggcacccacugccacgccgggcuaauuuuuguauuuuuaguagagacaggguuuugccauguugcccaggcuggucccaaacuccugaccucaggggauccgcccaccucagccucccaaagugcucggauuacagacaugagccacugugccuggcccugaaacuuuauugaaacagaacaauguuacuccccucaaacuuucuuuuaaugaagacaaaaaauacaaaaacagggaaauuucaaaguacaaucuguguucaaguauucuccaauuuuuuauaccuucuuucuaccucuauacuauucuaaaaugagcacugguuuuuaaaugaacuucaaauaaaugcacauuucugaaucagacaaucauuaauuagggucuuaaauuaaugauguuugacuuagaacugagguuagaauaauaaaaaccccauuuuccaguaggaaaaacuuuauagacauccaaucgacuuacauacaaguuucuuuuuuaaaaguggccauaggccaggcacgguggcucacgccuguaaucccagcacuuugggaggcugaggcgggaggaucacuacauggaauaauggugaaugaaggcuugaguuucauacgggauuaagcucauuuccaguaaagauuucagacuacuuaaggcaccuggacagaaaaacgggcagaucugaaugauccccauauccaguuuaccuuuugcugaaugauauucauacccauaauccuccagcauauacauuugcaaagucagaggaaagaaccaauucaaauacagaaucaccugcacccuccaaauugaacaauuauaaguacaucaaggucaauucugaagaccuuuaggaaaacaaguaacucaauacagaaauccaguuguuuaugaauggcagcuauucuaaauguuauuccuuaacaucauuaaaaagucaguuuuggacaaacugguaaaugaauauuacccaaguucugauaugccacuaaacuagcuagugagcacaaccuguaugucuuuggacuuccuuuucuucccuuuauaaaauuagaggcacuagcuccccuugcccuuuuaaaaucacacucauggcaagucacaaugagcaagcuaaaggggaaaaaaaaaaaguugggagccacagaaaugaggaauuauuagauauaguagaaggacucccuacacuagacaccucuuauagcacucagcaauuuacacuugguuaaaaacugaaggggaaaugggcauaggguucauccucucucuguauccucccccauaauguagcccuacaacauccucuaccaucugccuacuccauuuuugccuaaguccuacucuucaaggcuaaguucagguauucuucugggcugcccucccugauugcccaccugauccccaucccaguagaagucagauaucccugccauagcacauugugcuuacuucuguauccuuagcacaggucuggcauucaacaaauguuagcugaauaaauugucaagaguucaagaguucaaucucagcuaguuguucuaaacauuagguuaaaaggcucgauauaaugaaaagaguuuaaauauaacguuuuuaauugccucauacaguuagaaacugacagacuuuagaaaacugaauuuuuuuguaugcuagguauaaaaaguaucagcuacccuagagaagaacaaaagccucuauuuuuggaguacuaaauuuucuaucauuuuucagugucuuuuggcauauccaaaaauacuuuuuuuuuuuuuuuuuuuugagacagagucucgcucuguugccaggcuggagugcaguggcgcaaucucggcucacuacaaccucugccuccuggguucaagcaauuccccugccucagccuccugaguagcugggacuccaggcaccugccaccacgcccggcuaauuuuaauuuaucuuuuguauuuuaguagagaugggguuucaccacguuggccaggauggucucgaucuccugaccuugugauucgcccgccucggccucccaaagugcugggauuacaagaaugagccaccgugcgcggccucaaaaauaucguuugauuuaccacugcaucugagguuccucacuuccuuuuugcccguaauauuuugcccauaauauuuauaaagagauaaaugagauuacugaucugagaaauuuggauagaaagucaacagaacaaggguaaagugcagcuuacccuuaguuuaaggauuacccauccuggaaaauacacaaguacaaaacaacugaaaaggcugggagaaaaaaguggucuagcauaccaacagaagaagcauaaaaagugcuaugagcaccaagucacugccauuagcccaacacauaccacucaauucccugaccucuguccuaaucuuauaguuauuuaagaaugucugguaauaggcugggcacggugucucacgccuguaaucccagcacuuugggaagcugagguagggagacugccugaguccaggaguucgagacccugucgcuacaaaaaauaaauaaauaaaauuaggcguagugggaggauuucuugagccugggagguugaggcugcagugagccgugaucgugccacuacauuucagccugagugacagagaaagacccuaucuuuaaaaaaaaaaaaaaagaaagaaaaagaaaaaagaaaagcauguauuauaauagaggucagcaauuauuaacaaugcugcugguaaucaaauuagaauaaugaucguuacaaagaaucaggucaauucaaacauuuacuaagcauguacuaccauguacccaacuacuaguuacuaggauuccuccauuaaaagagaagaacauauucuauaauauauucaucaugggucuugaauuuucugauacauagaucuacaaaaucccuuagguccuagcaacaaaaccaaacaggucuaaugagaauagaugaaugcuaagauagccaggcuucaaugaaauguuagccuuucuugaaacuucguauuaauaaucaaccaaaacaucuuaaaaauuacagaauuauaaaaauacauauauaaaaacauaucuuuuaaaaacuuauaugaaaaaauagcaucgaugaaaauaaaaaagcuuaagcaaucgguacauuucaaaaaagcacacagcuaacaaaaaaauugugcagcacacauacgcacaacuggaaaaaaaguccuaucacagauucuaacuccugcucccaguuucauauccugacaccaucaugaucuucucuaagagcaugccgcguacaguggcucaugucuauaaucccagcauguggggaggccaaggcggguggaucaccugagaucgggaguucgagaccagccuagccaacauagugaaacuccaucucugcuaaaacacaaaaauuagccgggcguggugguacgcgccuguaaucccaccuacuugggaggcugaggcaggagaauuacuugaacccgggaagcggagguugcagagagccaagaucgcaccacugcacuccagccugggagagagaccaagacucuugucucaaaaaaaaaaaaaaaaaaaaguuuggaaagaaaauagguagucaaagaaggaagagcaccaaauacuucuugcaaaucucaucaucucccuaauucauaugagcaauacuauaauugggggaacagucuuuuuauauucaaucacuacgguuugaauguguucaagguguucauaucagcuaguaacacuacuuccuuacacaaacugcuaaucugccaaaaaguauacuauacuuuucauaauugugacaacugguuuccugaauaauuguacaacaaaaguuguuuuguuuuuguuccucaauagacaugguaagcuuaagcuugaaaauauaccuauuaugguuaccuugaggcaaacuugaagagauuuucaccaauuucuaaaauguuguauuguaccucaaagaaauuugccuuuacuacagauaauucuuaacuacauuuucagcacagaaccaguaccauaaaauguguagcuuauguuuuagaguugauacuccaaucaaguauugauaaauuaauggaagagucguauuuuuaaccaggcaauuuuuaaccagauguauuuucaaccaggucugugugugcucaaggccagaauaaauggauuucuauagaaagaguuuuuacagucauuuaauauaauuugugaaaaacaguauuugcuccacuuuacauucacacaaaacucauaaaaaauuuaaacuuuaaaccuagcaucuucugcuucuucaaauagaguauguaauuaauaacuauucaucaugaggccaaauaucagacaaaagccucaaaacacaaguuagaccacggauucacaaagagcuaaccaugaagcaaauaguguugauuacgauaauaguccuccccaaagagaggguccaaccacacuuggcagggaagugggccacaggaagaacuacaauuggaaaccaccacuugcucuagguucuugcaagcccagagcagugcucccaguaagcagaccucccagaagccugccagcacaauugcagucuuaucaacacccacaucaucccaaggauauuuucacuugcaagauguuagcauuugacagaaaaagcauucuaaaauaaaaagcaacuaugggaauucagaccuaucuuaaaccuccauugaaaugacaauauguuugcucagcuggaaaaaagacugaaguaaccauuagcuugaccaaaaacacaaaaaacaggcaugguggcucacgccuguaaucccagcacuuuggaaagcugaggcaggaggaucacuugagaccaagaguucaagaccagccugggcagugaggugagacccagugaagugauuaucuaauuuuuaaaauuaaaaaauuaaaaagcaaagacuaccaaauuaaacaaaguaaauuuacacaaauuccaaagcuaagagacucaaauacaacauuuuauuacacaauuuuuauuaaccaaaaauuauacaagguaauuaaccaaaaauuauacaagguaauugccuuucauuugaaugagagacuuccaaauacuguauaaguccaacuauggaaaaaugacaacaacaaaccuaucaaauuuugucuuagcucuguuggccagccucaaaccaaccauuuucaagagacuccccacuuaaggccaggcacaggggugcccagcacuguaauuccagugcuuugggaggccgaggugggaggauuccuugaagccaggaguuugagaccagcuugggcaacauaguaagacuccuaucucuacaaaaaaaauuuaaaaauuagcuaggugugguggcgcaugccuguugucccagcuacuugggaggcugaggcaggaggauugcuugagcccaagaguucgaggcuacagugaacugggaucauaccacugcacuccagccuaggugacaagggaggcccugauccaaaaaagaaaaaaaaaaaaagagaucccacuuaaaugccuucaguuuccuuuuuaaaagaaacaaguaacuaaucaaaguaaggcaggaauaaaaauuaucugcuuaauccaucaguaccauauacaaauagaaauaaguacagauuuuuuaaaaaacucuaaacaaaaucccccaaacaccaucauaaccagaaaaacucacucuguggagaaauacauuuggaaagagacaccuuccacguagcacaauaugcccuaaggcucuuuuaaacugccuaauauacuaaccagacaucuuaagaaaaucaaacaacuuaacaugguacauccauacuacagaauauuguucaacuauuuaaaaaaauaagcacgucuuggccaggcgcgauggcucacaccuguuaucccagcacuuugggaggccaaggagggcggaucaugaggucaaaaaauggagaccauccuggccaacauggugaaaccccgucucuacuaaaaauauaaaaauuagcugggcgugguggugcgcgccuguagucccagcuacuugggaggcugaggcaggagaaucgcuugaauccaggaggcaaagguugcagugagccgagauugugccacugcacuccagccugggcaagagagcgagacuccauaucaaaaagaaagaaagaaagaaagauaagcauaucuuauauguaaauggaaacaaauacagaauguaggaaaaaggcagaaaaauacauacaguaauaugacuccauuuguguaaaaaaauaaaaaccaaaaaaaggaaaagaucucgaaaaauacauuaaguucuuggauaugguauuuggagagguggagcagagaagagauacucagggaggauuuuuacuuuuucuucuauaaacauuuguauugucugacccuuuugcaauaagcauuuauuguugugguaauuaaaaaaacaaaacauuggccgggcgcgguggcucaggccuguaaucccaacacuuugggaggcugagacggacggaucacaaggucaggagaucgagaccauccuggcuaacauggugaaacccaucucuacuaaaaaaauacaaaaaauuagcugggcgugguggcgggcgccuguagucccagcuacuccggaggcugaggcaggagaauggcgugagcccaggaggcggagcuugcagugagccgagaucgcaccaccgcacuccagccugggcgacagagcaagacuccaucucaaaaaaaaaaaaaucuuaaacauacuaucagacccuguuauuguuuuuaaaauaucacauucaugguuaguacauaguaauaaaguacuuccaaaacaaauuuaaaguuauccucagagauugaaaaagacuaagagacaugacaauuaaaugcaauguguaauacuagauugaaaaaaaaagacaucuuugggacaacuggcaaaauguauaaauuacauaucagguaauaguaggguuacaaauguuaaaaugucugaauuugauuacuguauauugauuaucuaagacaauacuuguucuuagguaacacuaucagauauuuaggaaagaaagaucaugaugccugcaauuuacucucaaaagguucugccaaaaguaaauaaaacuuuuuuuaaaauauagaaagguaauacaaacguggcaaaauuccaauuacugguuaaucuagguuaaaaguacauuaugggaauucacugugcuauucuugcaacuuuccugaaaguuuaaaauuuuuucaaaauaaaaaguguuuucugacaggcgcaguggcucacaccuguaaucccagcacuuugggagacugagguggguggaucacuugaggucagaaaaccagccugggcagcauggcaaaccccaucucuucaaaaaauacaaaaauuagccgggugugguagugugcaccuguaguccuaucuacucaggacacugaggugggaggaucgcuugagccucagaggcagagguugcagugagccaagauugugccacugcacuccagccugggugacagagugagacccugucucacacacacauaaaaaaguguuuuuuuguuuuuguuguuuuuuuuuucugucagaaaaacauucuaaccugauuucagugacuuagguguaaauggcuuaguuuccaauauaaacuaucucucaggguuuuacaauaauaguucuuaguguauuacaaaaucaaguacucuacgguacucuuggaagaauuaacagaaaugaagcuagucaacuuuuuuaagaaacugagcaaagaacaauuagcaaauugagcagccucuuaaccaggauagguucagagaggcuccagcagagccacguaauagauuuauggacagagaagcuggucaacuuuugauucucaaacccaggcuggccauccugcuuccauccaaaaccugacaaugcucauggaacaaugaauauuaggguugagaaaauuuauuacaaauaucuauuacagaauaaacuguaauguauuaaacaaaauuuuuaagugaauaaauuaaaucaacgagucacuacagugaaaaaugacugagaagaucuggaaacaccaaaguccugcuaaggaaacuaggaaaguaugacugauagauaaucuuguauguauaaaauacggcuuggcaacuagagacaauucuuaggaaaacacaguuguaucaacaguugcuugauacuuuucuaaagacauaaugugucaauaaaaggagaaugguaugccuaaaauguagcaaaagcaaauggcaaagagggacaugaauauuaaagagguauacccuagccuaagcacuaggauaguucaacaggcuuuccauacuuaccagcaaacccuccaaguacuauacuggccuccugugcaucucaguagcccaaagaagguaaccuggccuguagcaccauaccuccaucacuacaaagcucucucucucaucagaaaaauggauucaacugucuauaaagcuacuaaagguccagauuauauaugaaaucugguaaccacaugauacuuucucucaguuggcuuccuaagguaucucuaucuucuccauucuaacaugaauuauaagaauuugacuugcugggcacgguggcucacaucuguaaucccagcacuuugggaggccaaggacaggaguucgagaccagccugggcaacacaccaaaacccugucucuauaaaaaauaaaaaauuagccagggccaggugcaguggcucacgacuauaaucccagcacuuuugggaagccgaagcaggaagaucacuugggcuuaggaguuugagaccagccugggcaacauggugaaaccccaucucuacaaacaaaauuaguugggcaugguggcaugugcccacaguccccgcuacucagaaggcugaagugagagaaucaccugagccugggaaguugaggcuacagugagccaucaucgcgccacugcacuccagccugggcaagagcgaaacccugucucaaaacaaaaaaauuagccaggagugguggugcacauuugcaguccuagauacaugggacaaucacuugagcccaggaguucaguuacagugagcuauaaucuugccacuguacucuaaccuggacaacagaacaagucccuaaaaauaaaaaauuaauauagaaucugacuauccugacugcuuuguaucucauuugaacaugcugaaauauucuuucccaguuaaacuuucuuuugaccaaauuugccauacuuucacaucauggcgccucauaaguaccguucuuucuagcugacuuguuccauucaauacuaacaauaaaagaacugaccaggggcgugguggcucaugccuguaaucccagcacuuugggaagcccagguggguggaucaccugaggucaggaguucgagaccagccugaccaacauggagaaaccccaucucuacuaaaaauacaaaaguagacaggcaugguggcgcaugccuguaaucccagcuacucgggaggcugaggcaagagaacugcuuaaacccagggggcagagguuguagugagcccagaucacgccacuguaccccagccugggcaacaagagcaaaacuccaucucaaaaaaaaaaaagaaaagaaaaaaaaaagaaacuaacacuguccuaauucuuaaauucucauaaaacccuuugcagaugauacuaccaugauccccacuuuauagguaaggaguaauuaagaaacuugccuagguucacaaagcaauuaaguaaaagagaugagauucuaaaccaggaguucugucuccagagcccagggauuuaacuuuuuuugugcccuauaccauuuuggcaaucuaaugaagcuuguggauuccuucucagucuaauauuuuuuaaugcauaagauaaaauacauaugauugcaaaggaagacaauuauauugaggggaaaaaaaccaaugugucauauugcuuaguaugugcuucucaaucuaguggauuuugauauaaugauaaacauauuucaagauucuauaaaaaccacaauacaguuugccuuugaacaacaugggcuggaacuguccagguccacuuauacacagauuuuuuucaauaaaaguuacacaccuugugccugccuccaguucuaccuccuccaccucugucacucaagacagcaagacuaaaacccccuccucuucuuccuccucagccuacucagugugaagacuacaaggaugaagaccuuuaugaugauccacuuccacuuaaugaauaauauauuuucacuuccuuaugauuuucuuaauaacauuuucuuuucucuagcuuacuuucuuguaagaauacaguauauaauacacauaacauacaacaaaguauguguuaguagacuauguucucaguaaagucaacaguauccuaguagcaguuaaguuuugagggagacaaaaguuauaugcacauuuuugacuguguugcagauugguacuucuaacucccauguuugaucaagagucaccugcauauuuuauuauuaaaauaucugauuucuacacaaaucacaauuaauacuacuguaguuuguuauuuauauuaguaauugaaagaaaugcuaacuucuagucagagguuaccgaagagguaauuuucccaaguucacagaugucauccauguuaaaaccucaaacugcacacuaaaacaguucucuuaacacaggcauuuaaaaaaccaaucaagccaaguguggugguacacaucuauaguuccagcuacucaggaggcugaggugggagaauggcuugagcccaggcugaagaccagccuggggaaaauguaagauuccaucuuaaaaaaaaaauaaaaagaccaauccuuggcccuucucucuuucuaccaaggauucucugguaaucucauccagcuucauggcuugaauaauaccuaaacuggugaaaacaaaauuuaucuccauuccagaccuuuccccugaacuucagacuugguuaucaaaucaacucaauaucuaacaggcaaucucaaacuuacuaugccuaaaauugaacuccuccuaaucuaguccucaaauuugcuccuuuuagucaucacugucuuuguugauggcaacuuucuaacgcugagaccagaaacccuggaaucauccuugguuccucucucacaugucauauuaguuccaucuucaaaacauauccaguauccauccauuucucacuacucuuauauuaccaucuugguacuggcagcaucucuuuucuggauuacuagcuuccuuacuagucuccaggcuuccacuguuguucccuuugcaauucaaaugauccuuugaaacugaaagcagacuaugucacucuucuguucaaaacucuuggcaaaguucuuagaauggcuuuacaagacuguaaaaaagcuaaaccucagccgagagcaguggcucacaccuguaaucccagcacuuugggaggccaaggcagguggaucaugaggucaggaguucaagaccagcguggccaagaaggugaaaccccaucucuaccaaaaacacaaaaauuagccaggcacaguggcaggcgccuguaaucccagcuauucaggaggcugaagcaggagaaucgcuuaaagccagggggcagagguugcagugagccgagaucacaccacugcacuccagccugggggacagagugagacuccauuccaaaaaaaaaaaaaagcuaaaccccaucucacccuaacccaguuuauuauuacaccuucuugcucauuccauucuagccauaaugggcaaaacucacaggucugccucaacaccuugaaacuauucccucuuauugaaaugccuucaccccaguuauuaacauggcuacuucuccuuuaaaucuuuccuaaauaucacucucucaaggauacucacccaguauaccucacuuuaaauugcaaccucuuccucaacaauucugaaucccccuuacucuauuccacuuuccaaagcacuuaccuuugaacacucuacauuauuuauuuaauuuuauuauuuuuuuuucgagauggaaucuccuucugucccccaggcuggagugcaguggcacaaucucagcucacggcaaccuccgccuccagguucaagcaauucuccugccucagccucccgaguagcugggauuacaggcgccugccaccacaccagacuaauuuuuuuuuuuuuuguauuuuuaguagagacgagguuucaccaucuuggccaggcuggucuccaaccacugaccucaggugauccacccaccucggccuccaaaagugcugggauuaccgaugaaagccaccccacuuggccagaacauucuauaucauuuauuaucaccccuauuaggauguaaacuccacaagggcaaaauuuuguuuuguacaccaauuacccuuagugugccuauguuuggcauacaacagacaugcauauguucaaagaccugcaccucuaucacuguaaaguacuugccuaucuccuucauuaaaagaguuccuuaaagacuaacuggaucuacuuugccguguccucaacaccugucccugggccugccccauaauggacacccacugcacagauacucaagugauuacagccauuuucaccugaaacacaauguccucuaugcugcugaauaaaaaagacaucuugcagcugugucugauuaaaagcauggguacaagacaaacccagaacaucagacgcuaaguguuacuucagucaaacugaauuuacauuuuugccucaauuucuucauaugucuaaguaccauuucaaaccauccaaagucuaaaaagggcacuuggucauuucuccccugagccauguugcccaccuagucuuuucauccucaacuuaaauccuaccuuuuaacuuuucccugaugaccccaacuagaagcacuuacacgugccacauucugcgccaagugcucuucaugcauuaucucauucaauccucccaaaaagccccaguaaguuguuaaccauuauaauaccuauauaaaagaugagaaaacccaaguucagagagaugaagucaucguccaagguuaaaauaguguucagauucaggucugacucugaaauccagguuuuuuaaacccuauacugccuuucucucuccucucucuagcauuauaaacacuaacuagcuuacuaucucaagaguuugcugucacuucacuucucuagccuucauuuucuucauaugccaaacaggugauauugcucaggauaccuaccaugauccccuccagucuuuauaguauuaugaaaaaaaggaaaaacaaaacaacaacaacaaaaaacauguuacaauucuuuacuccauacagguuaauacacaagaagaggccuggcacaauggcucaugccugcaaucccagcacuuugggaggccaaggcaggaggcucacuugaggccagggauucaaaaccaguaacguaauuuauuuuuuuuuaauuagcuggguguggugacacaugccuauagucccaacccaggaggcugaggcaggaggacugcuuaagcccagagguucaaggaugcaaugagccaugaugacaccacugcacuccagccugggugacagagugggacccugccucuaaaaaaaaaaaaaaggaaaaaauacacgagaauuuaaaaauauauaaucacuguuagaaauccaaagcaguggauuucuacuacauuaaagcaauaaaaauaaaaacuccaaaacauguaaaaccauaaaacauucuugauuccuuccccacucaggucuaccaaagaugcacuucugaguccauuuucccacauauuaugaaaaauuguuuuuccccaagaaguguaaggaugugauccuuaaagcuuccggacuucaccaaacaaccugguaaaaggaagugaaagcaggcacuuagccuauucagggguuagcauguuacuuuguacagagcaagugcuauauaagcauuuauugaaucgugauauaaaauuuuuuuugagguuuuucaaacuaaaaaccuauaacaugagcuuuguaauuggacugauggugcaguaaaucaaaacaaucuuaccuaacugacccugccaguagcaaaacaaaaagaccaaucuaauuaagguaauguuaaccaauggccaagaacccaugaaaggaaaaagccauguuaacuuacuauugcaaguaagaguuggguuuuuagaaaagcaaaauaaugauuuaucuuguugugcagaaaugaccaacaccucaacagaauccguuuguguugcaaucaaaacuaucaauuaagauccagacauuucuggaccaaugugagaagauguggcaagggauucaaaaacgagccagagcaaaccuaagguaaaaugugucaaaacagcaaagcucuuggaaucauccuggucauaaaaguuugacaguuucaugugaaaccccuaucaaccgauaaguuuuaaaucaauaguauauuccuaggucuaacaccagcaaacgguguuuaagaacggcuuuucaaaacaauggucucgugaggguucagggaaagaagugacuccaggcuuucugagauagcagauacagcagcagauucagaccucaagagaaauguaaagguguccuagacugaaaaauuacuauugggcaaaacugugugucgguuuuccacaacauugucuucuuuagagaauccucaaacgauucuugguuuuuaaccaagucuucacaagaaauagaaagucauccguuuaggguaagagauuccuguuaccaagaaaauuguguccgaaagugugaaaaucucacaaccugcaagaaaauguaugucccucaggaggcuuucauuuucaagcggaaaaacaaacccggugucaccucaacaacgggaccacacaaaccucgccauuacaaaacccaagugccaaaggugcacaaugugaauccggaagcacugcaaggccaggaucgaguucccaggaggaaaaaaucaaacucaggagugcagcgcgggccccuccacggcccgggggccaggcaacccgcgcuaggcccuuccgguccgaggcgccgccgucgcggggaggucgggcgacgggucgagcuuccacccgagcccggggauucgcggccuacccucaccggcgcccucuugccgggcccggcaccggcagcuccuccgacucugcccuuuggcuagcagcggggcccggacgagccacgaggagcccgagaggaccgccgagccccgggauggccgggucggugcggacacggcgguaaccguagggaccguggccgccccucccccaccggcccggcccaaccgccgccgcgacacgagcagcggcgccaacgccgggcccaaccgcgggccugcugcggccccggccaagcggcucgaaguggcggcgcgggccugcucccgacaccgaccgcgcgaggccaccgugggccuguuacuccucgcgccggcccgcgccgccacccgucaggacgcgccgcccucggcuggggauaaggcggccgacagcagcggggggccgcggagcugauacuuacucaggggucgggugcuccgggucguagaaaucccccaucuucggaggcggcugcggcugcagcugcuucaucgggagcggcuggagacggcgacgcgagcccccuccccgcagcagggcgacgc

SEQ ID NO: 192101 - RNA, 7908 nt, Homo sapiens
uuaggucaauauaguuuccauuuuuacugugcauacacauauauacaauguauuuuaaaaaugggcuuuacaauauguaguuugaucacuugguuuacaacuaaauauauugugaacauuuugucuucuacaacaguuaaaagaauugaauagcuuggaggaaacacaauuuauuaagcaaucuuguuggggacauugagguauaauuuuuuuucuaaggaggcuucauucuuuuuauaaugccuuugggaaaaaaaggggaguucuugucuuauauagcuuucuauagaugauggaaacuugcccuuccauuuagccuuuuuacuugcuucucuaccaccaccuaaucaccaaucaaguaacccauuuuguuuuucaaccucucucuucuauuugcuuccucuuuccuacccagucucccugcacacacgcagauggacuuccauuccuucagcacucugguuccuccccuuaaagauguuuucuuuccuuuuaaagagacuauuuuaauugauuuugaucaacucuacucaaaacuguauucuaagguccacauuagaauuagucuccaauaaucugaacauauaauucaaucauuuaaaagaacauauuaagaagaccuugguagaauuacauguaucaagaaacaccaggccuugcacaguugcucacguguguaaucucagcacuucgagaggcugaggcgaguggaucacaaggucaggaguucgagaccagacuggccaauauggugaaacccccaucucuacuaaaaauacaaaaaaauuagcugggcauggugacacaugccuguaaucccaguuacuugggaggcugaggcaggagaauggcuugaaccccggaugcggagguugcagugaaccaagaucgcgucauugcaguccagccugggugacagagugagacuccgucucaaaaaaaaaaaaaaaaagaaacacuggacuuaggcacaauggagauauggcugacuuucuuuugaaaaaagaaguaguuuuuugggagagggcagggcaaagaaguaagaaguaguucuguaaggaaauguuagagaccauuuuggaaauguauucauuauuuuaaggcaacuacaaaugaucaucuuucaguuaggacauuguagcagcagccuuuacuggucaugaaauuugcaugauaucuaaaauuguauuucuggaaauaggucaaugucgauuaauaguagcuuuguauagaaaggcagaugccaacuagcauaaaagugguaguacgugcagacggugguaguucuggaguccuggaagccacgaggugcucauccaucacaaggccaucuggaagguagggaugcuuggucauuaaagcaaaccucucuggcaguucauccugcugcccacaaauguggcauaucuauacgcuacugugaaccugcucuucucaggacacucacaccuggaaccuagcccaguggugaugccuucacuugcaggaaugagcacaaccugguuagauucugauugggccccauguuccaggaagagaacauguucccuacacauccaaucacccaacccacacuuaucaaacaccuauccugagccugacacccaggaugcaaauggcaaagacacaaucccugucuggauuggggaauuccuuccuguucucagugaaauguuugcuuucauuuacuuccuggacuugaauauuuuccauuucuaacaucuccaaggcccagaacuauaauaggucucugaauuuggggggcccuagaaaccuggcucaggcuaggguggagagaggacugucgccucuuuuccucuccaggugcugcccuucuuuucauuguauuccucaaaucaguaaaaaucaagaaggugaaaggguucugugaccagucaugguaaggguucugugaccagucaugguaagguauggggaggggguuaccagggacuuuuaggacucuggaaguuucuaaaggacuagcaaggggccaagccucugauagaauuugucgucagggugggcucuaaaugagcugcccauccugguuugggucccccuacccaaaggaaaggaacaccagagaacaucucuugguuuaacaagagaccgagacuuguuuauuuuccucaauagaaguucagaccauaaaaugucaaauagacuugaaauacaucucuaucugaaaggcagcaggacuagccagguucccgaggaaauaaauaucaaagaggccaaggcaacuaucucaucaggagucugcgaugcuuuuauaagcagaacuuuggcugccaggcucuagcaagacaagagguacaaggagagccugcuaacuaagcaccccccaaggcaacuacguaacuucaaagggcaaaagaaagaggagaaccuccgcuuaccacagccggguagaaaugccugaggaaagcagcggagcugaccgugccagcauuuacacagggaacacuucuugggcagccaggugucauggggcacagacccacaguuccugagaaugaacagguaaggcgauagccuugggucugaaauuuccacuucccuuucucucuccucuccacggcuccccgccccucugaauugcuuacucuuugcgcacaucgugcucacaguuccguccguagaaggagggagggcaggcacaaaaggaccccagcaugcagguucccccauucaggcagcagguucuguuuagcuccuuaccugaaagguaagaacagaugacugaggguguagggauggaaaagugcaagggcaauuccuguaagcgaagguuaauacaacaccaauguguuguaucagaguaagucucugugccuuugagcagagaagucauuuucaugcauaggccaguggugguucuggguuccccagugugaaguggacucaggggaggaaaacugcacucuagggaaguaaaauacacaauccuugucucacuuccaaaaccaaaagcaguccagcaccugcacaguuccagaaccaggugcccuuuuaggugaaagaguguuggaaagauacucaggagacacaugaagggccagggcagaagcaucgaagucaggcaguucuuacugugcuguauccccaugggcggcacacgcugggaagaccgaggccgaauugcaggcuccuccuggggccaaaugcugucaucucugaaggccagguauccccgagauggacgagcaaauuccugauggcccagcccuuaacgacaaaaucaauucauggagucuguauuuuaggccacauaaaaauugagagugaucaaaagaacaaaaggucucucaccggcaacuaaucccaguucaaagacuuuagaaauggccaugauccaaaucacacuaggaagaggaagucagacaugaguuagccaaacaaaggaaauaaaaccuuacaaguuaacacccagguccucucaucacaaggacaagaccacagaucacugaaaagaaauuguagagcaccaucuuucuuuuuuuaauggcuaauucauguaacaaagaaaaauguugaaaaaaagucaccaauauccaagucuuuuuaauauauauuauuauuucuuaggcccuguccucacauaaguaccuaauuuuaaguagguauaugucuuuuaucuucuauuucacauguuuuccccugcauacaauuuucauauaaggauuaaaaaauagcugcaucccauguuaccgaugaaucauuuuacaaacuacuguauuuauuuauuuauuuuugagagggaguuucgguuuuucacccaggcuggagugcaauggugcgaucucggcucacugccuccccuccccaguucaagcaauucuccugccucagccuccagaguagcugggauuacaggugcccgccaccaugcuuggcuaauuuuuguauuuuuaauagagacgggguuuugccauguuggccaggcuggucuccugaccucaggugauccacccgccucugccucccaaagugcuaggauuacaggcgugagccaccgcacccggccaaacuauuuuaaccaaucacuuaaaagguuuuuagguaaaaaauguggguuuuuuuuuuuuuuuuugcuauuaucuuaauaguuuugccaaguauugaaucugcuuauaccuuuaaucuuuucggaagauuuuaaauuugguuguaguacugaccuuuauuuguacaagaauaaagaaacacuauuucauaggcagagucauuaacauaaaaugaaaauuaacauuaacacgaaaauguuaaaagccaauggcaaaguuagaaguaaccaugugaaauuccaggucuuucaggaaaaacagcagugcgguuggcagcucuuuuaaggcuugagcaagagaaaaaucaaaugacagguguagaacauuacuuccuaagcuggcaaucucuagcaaucaaaaaaaguucacauucaagauuagcucauaccuguaagagaagcgggccaucuuccugcaguccauagcuuuuaacaauuagggggaaaagaggcguuagcaucgcuuuaauucagagucauugccaaaacagccaaaggaaaacauucaucuccuaaagcgaaaauggcaauuuaagaagaaaaugagaaauucguuuuccccagaaggucguagcagaagcaggagcaaggcguccaggggaaacuggagggcuuucggccuuggacguuuugaccuugagcuggagacucagccuuuccggggauucuccuucuucaacaacaaaccccagucggggcggggagaccuuucaggugggcgggacgcccaccagcaugacaauggcccacacgcgggaagaggagucuuguaaaacugugguuaacuagcccuaauaucucuaucauuaguugcaggcuaaaaugaucagagguacucuuuugggaaaaaaaaagaaaaaagaaaaaucaguuucucuaaucaaguuggugauuccagguuggaggggugguggaaaguaauugcuuuaauuaggaaaaccugaaaauguaugggucucaaggcauucgauauuuuauuuuauuucaggaaguuuuacuuccugaaauuugcuuccaccuuuguuuuuccagaaggguguuuugagccccguacucccccugggggauacccggguggccaagaaaggggugcucuccgccugaggagcuagguguguguguguggggaagacuaggaagcuugaaacugagauagaaguucagggucaggagggguuccuugggggcuccagacuugaagugcaaauuccaggcggacgugaauuccugaaaggacgcgggagccggcgccaggugcccgggagaggggaggggcggccagaggcgcagcagcugggacucuccagugggagugccggccuguuccaggaaaaaguucuagaaccacggcaguccggcaugggaggccauuucagcccccaaucacgggaauuuaucucagccucccagcucccacagggcggccucuuccagccccucgccguccuggccccacgacaccgagaauuacccccggacucugaugugccgcuugcagggguaaacguguuuauugagugguuccacuaagugccagacgccccagauggagaggcgcgucuaugagccggagucgccucaccuaacauuucaauccuccggguuauuucauguguuauuaaauacgcccaaagucguuaauaguuucuaaaucgcauuuaauuccaauuucuaaaggaaagccugacgguuacuuaauguugccaggcacacaaaugcgaaacuuuuauuagauaguuguuuccauccaucucuguuuauuggauuuaggccucggcagaaagaauugguagcaucugaggccauuucagcgucagugccuaccugugugaaugccauggauccacaggugcugggaagagguguuauuuacuucuacacaugauuuuuuuuuuuuuuuuuuuuuuuuuuuugcgacagagucucccucuguuacccgggcuggagugcaauggcacgaucuuggcucacugcaaccuccaccuccuggguucaagugauucuccugccucauucuccugccucaaccuccugaguagcugggauuacaggcgcccgccacaacgcccggcuaauuuuuguauuuucaguagagacaggguuucaccauguuggucagucuggucucaaauuccugaccucaugauccacccgccucggccucccaaagugcugggauuacaggcaugagcuaccgcgcccggccuuacacaugaucuugggagaagcaaacguaaaauaauuuguauugggggagugaggccccauccagucaauggugggaugcagcaacauuuccaacuccacagcaguugacuauuucauuccugcugcgcuucgccuccucccuguguggccuuuucaggugaaaugcuucagguagcaugcugagauucacaggggacaggggaacauggccugaagcucuaggaggccggaggugggggagggcuccgcaaaggagaaggcuagcccuggagcugcaaggagguuuaaagauguuacucagugugguacauuuguaagguagcuugugcaccacaguccucaccaguccaaggugcuaaguagauaaguagcgcccacaauauuagucucacuuuauggacaagacaacuaguucuauugggggauuuggaugucuugucuuuagagacugggcaggccuguggcagaacuggcaaaagaacacaccccugcguugcuauuuccuuaucuaaagcucuuguggaauuuuuagagcuuaaauaggaccccuggaaaucacugcauuuucagaggaaguaacugaggucuccagucuggcgauguugucauugacgggaccagaaccccaggaugccagcuuuucagccacacaaaaucccuucucuaaggaccagaacccccugaagagauucccauuccccauagguacugacugcagaggaagccaaguggauccaggguauucagagccugggccagguuuugggaugggggguggggagaaggggaagggaagggcugugguguuuaagagagguuagauauuugccguugggcuggagauguaagggcuauuuaacagguauuugaugucuacuacugggcggccuguagacuggaguuuggcgcuggagaaacaguugugagaaguaaccccacugugaggcuggagagaaagaacaguaauuguugauucuaauuguacuaacugcaaaaaguuguugcugccuccaggugggggaauugaauggcuacccuaggauggccacuggucaccucugcuuggucacuguugaaacugggcugcuggccagccuccaggccaaugagugcuuugugucaaaaggucaggccuaggauugggaagugcugugcaacggggguuccccaaucacaggcagcccaucucaucccuuacaaaaggcacugagagcagaaaaugaaaaacaaugcucuugguguuggccauuucuugguacugcccuugagacauuguguauuaaaaacuggggcagaauuguguuuaaaaaucacacaaauaagcauuugacuuaaaaccauccaaacaagaaugguggaaugaaauacaucauaaucaaaggacagacuuccugugucugccuaaaauucaaggaagaaaauaaacuuggagaaugggaucaauuuuagcuaucaaaagccaauucgaccuuguuuaaauaguugagaacacguagaacuaaauuccaaccaaagaguuaacaaaagaaugccaugucugcacuacaaugacaguauuucaagguaaaagccuucuuuuaucauagggcacuuaggucuuaccucugucauuguucccuugaacauccagg

SEQ ID NO: 192102 - RNA, 2955 nt, Homo sapiens
aucucccacuacagaccugccagggcccaggagagcucgacccacccaggcacaccauagccccagagauggcuggggacacagaaguguggaagcaaauguuucaggaguuaaugcgggaggugaagccauggcacagguggacccugagaccagacaagggccuucuucccaacguccugaagccaggcuggaugcaauaccagcaguggaccuucgccaggugagggggaaugugaugguacacguuccagaaaauucuugcacauuucuuacuagguauaccuguuacuuuucuuguucuauucugugcuuucaaauugaagacuauggguaauaagaugcccaucauccaagaaguuguaacuucauuaaagaucguuuuuucacuauuacaaugaaccccaaagcaagagcaggccugagcacccuugugagcuaaugccuggauacagagaaaucagucuguggggguggggagagggagcagccaggaaaggggaggggaggaagggcagcuguugcacccacgggcggugcaugugccccaugccuagggagacugcuggacccaccuuggagccccuaggaggagagacucacggcacugagcagacacccucgggggaggccggaggagcagggggccugggcaacaggcagcaauccugccccucucuacucugagcugauagaaucuuuuuaaaauaggagucuuagaaaucauccuaagccucauccucucuuucccagguggaaauggggagccccaaggcuuggggcugauugcccacagugcacagaggguggaggccgggucccacccgcuguccccucccagggagagucuacauagagggggcagagcucucccacuggccuauggcuaucccaggccaggagcugccauagggagcauugcaccaaagucucaguccauuuauccaugggaaguuugaacucugaacaagcacaggaacagagcacugagacccaggggauggcaguggacuucugcucagaacagggcccaggccccucugcacugcugacucugggugacucccagcaagguccucucacagugaucacagcuucuuggccucucccucucauuucaaccuugcauucacccuguggguugcggcuagagucaagauacaggagcacacccuggacuaacucccucuucccagcccccuccaauucaccaccugcagccuaauuucucuguauccaggcaucgggggcucagccacagugacaaauaaaccuggaaauaucacugauuuaaccuuacacguggcucccaaggucaccgaagcagaggaggagagagcuggaaugucuuaccaaggcuucugugaccauaucuggaaggaacauauaucacugcuggccucaucucauugcccaacuggucccauggccccagccucacggcaaaggggcugggaagugggagggagugcauggauaauuuggugagcauuaaaugucuccgccacagugcagcucucugccucucccauaauuccuuucccaggugcagccaugugcuuccugccuucuucucucucuaccuccugacauguauuuguccagauaccuuagcucaaaaacugcccuccucccugcugagacaagguguauuaucuuguauccugucugaagccaguggcauucagaauaugaaguuuuccaggcuaccuugagcaagggaacuggguuggaggggaaacaaaugaagagagagcuggacacugugaucucccugcaauaccgcagaccagggacccucggcagccaagagaaaggcaaaggcuuuccucuaggagaacccuggacacuucaggcucccaccgccaacccaugagucuauaacuuaaucaacacccaccuauaggcauuuguggauuucaggguccugaacugaacuggcugcuguugcaguuguggccucugacccauuugaaucuacauuugaagaagcuuugcuuuggaauagggagaccacagucccagucaugccuuuuuacacccacugggucucuggacaugaggaguuuccagagugugccucaucucuaaaauggacguguuggacuuagaagaugcccaaggucccucccagaucuaacagcuugcaauucacuguuuucauagcagacacugugcagcaugcagugugucaguggcacaauggagaugggaaagaggucuuagcaauuucuuccaccacugagccacagccccagucaagucaugucucugugcagucgguagcuccuuucucucucuggcaguuccccgugauuuggucacauggagccaggcugagacucucuucugucuccacagguuccagugcuccuccugcucucguaacugggccucugcccaaguucugguccuuuuccacaugaacuggagugaggagaaguccaggggccaggugaagaugaggguguuuacccagagauguaagaagugcccccaaccucuguuugaggacccugaguucacacaagagaacaucucaaggauccugaaaaaccugguguuccgaauucugaagaaaugcuauagaggaagauuucaguugauagaggagguuccuaugaucaaggacaucucucuugaagggccacacaauagugacaacugugaggcaugucugcagggcuucugugcugggcccauacagguuacaagccuccccccaucucagaccccaagaguacacuccauuuacaagguggaggagguaguuaagcccugggccucaggagagaaugucuauuccuacgcaugccaaaaccacaucuguaggaacuuaagcauuuucugcuguugugucauucucauuguuaucguggugauuguuguaaaaacugcuauaugagccuuggaaacaugaagcuaagucagaaaaaaaaucagauacaaaaaguc

SEQ ID NO: 192103 - RNA, 33816 nt, Homo sapiens
aggcuggcguccccgccccgaaagcacugggcccgccgcgucgcaccguccucuuuccuuuccuucucccuccccuuuucccuuccuucgucccuuccuuccuuccuuucgccgggcgcgauggagccggggcgccggggggccgcggcgcugcuagcgcugcugugcguggccugcgcgcugcgcgccgggcgcgcccaauacgaacgcuacagcuuccgcagcuucccacgggacgagcugaugccgcucgagucggccuaccggcacgcgcuggacaaguacagcggcgagcacugggccgagagcgugggcuaccuggagaucagccugcggcugcaccgcuugcugcgcgacagcgaggccuucugccaccgcaacugcagcgccgcgccgcagcccgagcccgccgccggccucgccagcuaucccgagcugcgccucuucgggggccugcugcgccgcgcgcacugccucaagcgcugcaagcagggccugccagccuuccgccagucccagcccagccgcgaggugcuggcggacuuccagcgccgcgagcccuacaaguuccugcaguucgcuuacuucaaggcaaguccgccucgccccgucccaggccccggccccgccccugacccagccuccaggcccuagccccgccccugcgcccggggccgcguugccccuccaguucuagaccuggcucccucccauccagcccugccaaaggucuccuccaaguccugucuccuucuucaucucaacuagagaugaaaaugccuuucuugaaggguaacucuaagguagagaauacguacacagaacgcaguacagcgccaggcacccaacaaagugccugauaaauguucucuguuauuugagggcagacgccucuuuucuguauauaccauuaaagucgccuuuuuucucaagugagcggugacuugcgauaauaaagcagaagaccugaggagccgacaaguaccuuuuauuuuuauuuuuuguugagacagggucucacagucgcccaggcuggagugcagaggcgcuaucauggcucacugcagccuugaccuccucaggcucaggugauccuccaccucagccuccugaguagcugggauuauaggcgcgcgccaccacaccuagcuaauuuuuugguauuuucuguagagacagaguuucgccacguugcccaggcugaucucgaacucccggacucaagugauccucccaccucgccucccagaguucugggauuacagucgugagccauugcacccagcugacuaguuccuuuuaaagaggaugaaauugaggccagggaagggcagggacuccuugcaaggacacaucccugcuuaaaggggaacucgugcaccgugagucaucaggauuggcccucuccgcuguuucucucuuucaucuagaauuuaacacaguucacugccuccuuuuaauggcugcuuaaguucucucugugauugcuggcuaaaaauagccacaaauugcaguucucuauccuauggguucucacuccgaggacccacaaguuuuaagaaugguuagauucccugucacuagauaaagaggcucuagcuugguggguccucacaggguuuggcuaaaagagcccucucaaagcccaguuucuacuuucucugagaaagauuuuaaaaggaauauauuguguuuuuuaaaauuacuacaaaaauagauucauggcauauccuagacucuugagguagaagguuuuuguuuuuaaacuuuguuuucaguuucuggacugcaagaucuguuuuuucagauuuccaccgagacagagccacguguauauuguauuuauaugagcaauaaaauaacacaaaaccccaaagaggggaaaagcuggguuacuucuauacuucuaugcuuaguuacaguuuuauuuaaaguaucaguuuugugaauguuuguucuggcaauuaaaaaaaaacaguuuuaaaacagaagcagggaaugagauuaauaaaauuccagaauguugaaaaugagggcugguucauacaaagcaucauuuuuuaagcuaaaaaugacuuaucuaauucuuuuuuuguauagcuuuuggcaaauauguucugaaccaaauuuaggucacauaaucaagaggaaaucauuuuauuuuuaaaccuagagaauacuagaaccucugauuucuuuaauauacagaugaauuugaacaaguguuacagggaagaggggaagaacauuuuacucaaugugaccaaaaggcauggguuuucucuuucaucaugguggccccaaaagguuaggauggucauagcuucucuucaaaacccuuuacaggucuuguaacaaucacuuaguugaaagucaguaaaauacuaucuaucuaucugucuaucuaucuguuuuuuuugagacacaguuucacuuugucacccagacuggaaugcaguggcacgaucucagcucgcugcaaccucugccuccagggugcaagcaauucuuguaucucagccuccugaguagcugggauuacgggcaugugccaccacacccagcuaauuuuuguauuuuuaguagagaugggguuucaccauguuggccaggcuggucucgaacuucuaaccucaagugauccaccuaccuuggccucccaaaaugcugagauuacagucugggauuugaaccaccaugcccggccaccaucuuaacauuuugagaucucauauagggcaggaaaaagcuaagaauuuuauuaauaaacgugaauguuacuuaauuguuucaauggaagauauaacugaaaaaguaauuuuugguggagauauuguaugguguauuuuuucucaaugauguuuauggcuuggcaugauggcucaugccuauaaucccagcacuuugggaugccaaggugggaggaucucuugaguccaagaguucaagaccagccugggcaauauaaugagaucucaucuguacaaaaacauuaaaaaauuagccgggugugguggcgugccuuucuaguuucagcuacucaggaggcugaggcuggaggaucacuugagcccagaaagucaaggcugcagugagcugugaucuuaccacugcacuccagccugggugacagaacaagacucuugugucaaaaaaaagugauguuuacguguuuaaacucuguuuauggauagagaggaaaagauggguggcaggcacauacauucuaccuggcaccugaaggcuggaggucgauaugaagguagauagugcgcuguggcaggacauggauaaauguuacucugcuguucugaguugcaguucucuguuucagugauuaaggagaaaugccucaauugaucacuggaauagcaaugguggguuccgacugccagagggaggcgaggagguuuggaugugugcucuuguagaaaagggcugugcuacuggugugcagccucaggugcaucauagguuucucgucaccagccuacucuagguccaugucauuagcuuucuuuggguucucuccacaauuaccaucuuccacgaaaaacucauuuuucucauaggccaagcaaaaaguaggccggagcacuucaucaaauccuuaaugacuguugagcucuaaccuggacagagaacacugacucacaggcacuguuaaccccaggccuugccuggcuguggccucuaacuccccggaaccacagggccugccucugugucauggcugauuuaggguggcucaugcugguggcuguaucucaggaacccaaggcaaggugguucccuccaucccuaccaccuucuccaaaaucugccuggggucugucagagguuugguagccaagaugugucuccauguuccagcugcagagccugaguugaaguaaauaaaaucacucuuuucucuucaggaagagauuccguuuuguaaaacauccuaaguuagaagccuuaaaaauccuacucugugccccucuuucuauuccuuucuuucuuucuuucuuucuuuuuugagacggaaucucacugugucacccagacuggagugcaguggugcgauccuggcucacugcaaccuccgccccccggguucaagugauucuccugccucagccucccgaguagcugggauuacaagcaccugccacugugccuggcuaauuuuugucuuuuuaguagagaugggguuucaucaucuuggccaggcugaucuuggacuccugaccucgugauccacccaccucgaccuccuaaagugcugggauuacaggcaugagccacugcucccggccucugugccccucuuucuaagugcuguucugagaauuagugacucuaauuucacuggcaaaugcuuuaaaaggcagcauucauacccucucccuuccuuccagcugaagacuagccuuuuucuggccaggagugugaagcuuucuguagggcuguuuuaaaggcagcccugccacaagccacuaauuggcauucccaaaacaucagcauugacaucugggagucugcccucaucaccacccaccacuucucugauguggccacugccauugucucaaaaugacuugguuccaauucuggggcaauucgguaccgauauaugccauccuaugacucuuagaagucuaggguauaccaaauauuccuuuauuuucucugucuaaaccgaauucccuaauucccgccuuggagcgucccucuggauuggcugagucucugugcacaugcacaggugccugcccuucucccuacuagguugugccaagaguccaucagcaugggggcccucugguugguggucaugaguccucacagggaggccucugcauccuuauuugccugcccuccugagguccugccauaacauaccuguucuuccugaggacuucugccgucuugaacacugccgauaagugccagcccugaagcuccggggcccgcagcccugcugcucucacagaucccaagggaaacuuuuuuccuagccugggagauucccuuucucccucuucuucucccaggccagucagcuucuuccugcagcuccucuccaauuucuuucuccccucaaaccugucaggcucuuuugugagugcaggcuuuuuucaagugaauaauuugcugguucugaccagauaucuaccuccccugagacagugaaacucagaaucauuggccccuucaauggagagaagacagaggggaaaagagaggaaaaugugaauuaauuuuauuauauuuuauggucauaaugucauuauguucaaaucacagauacuuauuguguccugccuuguccugaggacugugugaggcaccaggaauccagauaaugaaugacacacagcugggucccccgaggaucauagucugaugggggagauagacguaccacugagauuguaggguggcguaaaaugcgggaagacagaacccagaacuagcccaacagagaggcucuuaauugaggccacuaggagacagggagaacuuaacagaauauaugguccaugcagguggggauuuuuuuuuccuguuuugcuuauuguuauagacccacaaccuagaaauggugcucuuguaauaugacguuuauugcugcaugaauggaugaauaagugaggaggugguggagucauugagaauguuagcagaaggucugugggggauuugggaaaacaauauauuugucaaggugccaguggaaaagauauggugcagucauauuggguaauuggaggaaaguuuaagaaggugguuauuuacaaaggugugugcagugcauggggaauccacaagagauaguguucugccacaggggugauagcagugggauaugaccaacccuaggccaaaaggggcaggggagagagcagugauugaaaccgggaaggagggagacucuauggagagggucaccuugagaagaacugugaucuucaauuaagggacauagcagcccaagaggacugugcagggagggaaccaggaaaugaaauaacaugaccuuacucucuucccuuccucagucaucuacuggggcuccucaugggugaaccucuuuggaagccagagagcgagggagucuguuguuauaguccacacaggccagccuccuggggcauguagccagugcagaguagauugggaaaggcagaccgaggccauccagacagucgcuuucaggaaaucagcacuugucucacagugccuggacuuggucuugaggggcccuggaagucauggaaccuuuagcuggaaaaguuauagcaacacaaaguuucugaaggacuaagcagauauucuuguuuuacaaaaauuaccacuuagcauccauggaguagcuuuuauguucuuuguccuuuuaggcaaauaaucuccccaaagccaucgccgcugcucacaccuuucuacugaagcauccugaugacgaaaugaugaagaggaacauggcauauuauaagagccugccuggugccgaggacuacauuaaagaccuggaaaccaagucauaugaaguauguuuggauuuuuauguggcaguuaguggcaaccuggacuguuaaagaaaugucucuccauaagcagcugcugauagcuaaggaccucuagugauuuuuggugacauuugcugaauauuaugacaauagaaaugauugacuuuuagcacaaagugauccauuuaauaaugauauuuuguaugccgugaugauuuuaaaagccauguucccuuuaaaugcuacauuuuagaaauauggucauuuaauuauuuaguuuuaagaggguagauuaaagacauaucuuggaaaucaucuaaaaugaccaggaacacaagaaauagaaacauaaaucuccaguuuugaugaaaugagaaggcauauauuuuuauacacacuugcacacaaacgcacccuaaauauauuaagguagaaaaugaagacgaguuaggaaggcugaugugacagaguagaggacacuuaaaucugcgcaucuacgaagaagaguuuugaugagaauuagucguaagaacaacaauaagaaagaacgaucucgcccuuuugagcacucacuauugucaaggucuucuggaacucaggcacugggggccuggguuucaagcaagggcagggcauuguugaaaaugggaauuuggcugggcacaguggcucaugccuguaaucccagcacuuugggaggccgaggcggauggaucaccugaggucaggaguuugagaccagccuggccaauauggugaaaccccgucucuacuaaaaauacaaaaauuagcugggcguggugacucagcaugucuguaaacccagcuacucgagaggcugaggcaggagaaucacuucaucccgggagacagagguugcaaugagcugagauugcgccacugcacuccagccugggcgacagagcgagacucugucucaaaaaaaaugaaagaaaauggggauauguggaaaauauccacuagaaguuauaguucccaaggccugaccacaggguuuucuguagagugaucagaucucaggcucacuuuuugacugcuagggaaaauguauguguggaagucucuuuuuggggguaucugucaguuuuccagggaagacuucaccagccuucugcagggcugguggggugcgcauacuccucugcuggugucugagaaccaguguggggagagggacagggucacccaggugaguaggaauacuucaccugcuuccugauuuuagccucaugccuccacuuggccucugcuacgucuggucccugacuccucagccuuuauggguaaagucucuagaauaaacugccacucucuggugaagaguggcuuugggagauaugaucucuuggguggguggguaggugcugggagcggacccaggaccccaacagccuguucaaacuugcagcccugcuucuagcuccaugccuuaccccagccucccguggucccucaugccugcgcaugccaaugggacauauagcuugcuuccccucuggccccuccuuugugacuauuucacuuccugccuuuccaaaaguuguugaaaucucaucugcugcuugcucccuucccauucucccauaaaagcaauuuaugccuuucauagucuucacuguuguuuucauaggguuuggggaacgaagccgagugcguguggucagugcccugggcuuaucuggaauucagcuaguccuguuggcccucacuggagcccuuuugggguggcugugcugcccuccugugugaucaggggccuccucuuucugcuugguccuucuugcugcugcugcugccccgcugcuucugcagaaccagcugucuggaguuggcuacuuauugacccauucuucaggaaaggcuccuucaguucucagccugucuuauuuccagggcauguggccugcccaggagguuuaagaaaauccacccucggccaggcgcgguccucaugccuguaaucccagcacuuugggaggccaagguggguggaucacgaggucaggaguucaagaccagcuggggcaagauggugaaacccugucucuacuaaaaauacaaaaaaauuagccaggcgugguggcaggcaccuguaauccuagcuacucgggagacugaggcagagagaauugccugaacccaggaguuggagguugcagugagcugagauugcaccacugcauucgagccugggcaacagagcaagacucugucucaaaaaaaaaaaaaaaaaaaaaaagaagaagaaaauccacugucuuuaccugaggccuuaagcuuggugaaaauucuaggucuaaggggugcccucagauaccaccauuccagagcagcugagaacuccaaauggagggucccaugcuuauucagggccuguccuggccucugcaaguuagcagguuuuguguguauccaggaucucuacuuauuucuuggagaccaagcuacuuccuugguccuaguuuauuucucucucucuuuuuuuuuugagaugaagucucgcccuguugcccaggcugcagugcaacggcacgaucuuggcuuacugcaaccuccaccuccuggguucaaaugauucuccugccucagccuccuguuauuucucuucuaaucgagucuaaucaacaauuagcagaaaguccuugaaguuuccacuaucuggcaugugguugcccuuccuaguaacuagugcugaugcaugguggcacuucuguuuaacugcauugucggaggaaguggggugacagacaccugcugauaugguuuggaucugugucuccaccuaaaucucauguccaguuguaauccccaggguuggagguggggccuggugggaggugauuggaucaugggaguggauccuuuauuaaugguuuagcaccauccucucugugccauucucaugauagugagugaguuaucaugagaccuaguuguuuaaaaguguguaacaccuccccgcucucuuccuucuucucuggccaugugaagugccggcucccuguuugccuucugccgugauuguaaguuuccugaggccuccccagaagcagaagcugcuaugcuuccuguauagccugcagaaccaugaaccaauuaaaccucuuuuauuuauaaauuacccagucucgguuuuuuuuuuuuuuuuuuuuuuuugacagagucucgcucugucacccaggcuggaguacaguggcacaaucucagcuuacugccaccuccgccuccuagguucaagugauucuugugccucagccucgugaguagcugggacuacaagcaugugacuacaccugguaauuucuauauuuuuaguacagaugggguuucccuauauuggccaugcuagagguauuucuuuauagcaaugugagaacagacuaauauaccugcucucaaacuuacauuuuucuuuucguuccauuuuaaaaaccaguuuuauugagguacuauuuauauacaauauauuuaucaauuuuaaguguauaaugcaguaaguuuugacaaauacauccaguccuguaacugccaucauaguuacgacauagaauauuuucaucaccccugaacaauuuccucuuguccuuuuguagucaaguuuuugcuguaaccccugacuucuggcagccacugaucugaucucugucauaguuuucccauuuuccuuaauucagauuauuaucaagggccugcuacuuuuugaauugaacuaaauaagaaauguacccaucauaagcaaaguagaaaaaucuagauauaaaguaacucacugauugacuucuucaagggccaguguggcuucuucagagcuaaugagagcuagcuuggugguggucuugguucccuuugagauuucaugacugucucccuucacgcccaagagcgagcuucacuggcuucuccaugccuuucagagccuguucauccgagcagugcgggcauacaacggugagaacuggagaacauccaucacagacauggagcuggcccuucccgacuucuucaaagccuuuuacgagugucucgcagccugcgaggguuccagggagaucaaggacuucaaggauuucuaccuuuccauagcagguuggugguaggucaauaggcucacuacucccauggaauagucuuccuuagaugucugguuucugccugcaugccugcuagaugccuggagcagccucugaggaauuuuugagcauacuuauuaacggguaacugaggguagucaccaccugcauagauaaaccuuugacuuggcaggggcuucuagugaaaucacugagagaagguucaagcacaggccugccaagguagaauucugugucugcccuacuugcuuacagauuuccuacagucauuuugaaaaauaaaaaugggcccaggagcaccucagugacucacauuacugagauaacuuugaugauggcaauuuuccaacacauauaaagguagaaugaaccuuuaaguggccaucacuaagguagcuuuuugaaauuuucuuuucugauuauaaaacaaugugugcucauuauaggaaguuuggaaaacacagaaaggaaaaaugaagaaaggaagaaaauguaaaacucuacacauagguagcccagauuucucuauagugccuagacauuucccaagugcuuuacugggcagcaucacuccagaaacugggaaauggcuaagggaagcucuuucccaaagugguuugagaacacugauccuagaacugugccuuccugaaagcacuagauaaguaaaaucuggacuguaccuuggauaaagguaucaugucuauguacuuguaaauaagucugggaaugggcugagcacugacugcaucucccacuugaagaaucauugugcacuuuaaugguuaaaggcccuuagaaauccugcaguagagaagcucuuuuaaaguuauugaauccagcguuuucgguuuuguuuuuuuuuuucagucacuuuuuauucauuaaucucuuucuacaaaguagguuuuuuuuuuuuuuuuuuuuuuuugccuuaagaaaacuucuuguuauggaaaauuucaaacauacacaaaaaacagagagaagaguagauaaaccaccauguacccaugacccaacuucacaauugucaacucauggcuacuugagcuuccucuaauucccaccuacuuuuccucucauguuauuuugaagcggauuccaaaugccauauuauuucauuuguaauauuucaguauauaccuuuagaagguaaggacucuuuguuuuuuaaacauaacaccaaacuauuaccccuguaagaauuuuaacaaucauucuuugaucucaucauuaaauaccuaaacagugucccaaucauuucagaaaugucauaaauacaugugugugccuuuaauuuaccauuuguuugaaucaggauccaaauaagguccauccauugcaauggguuaucucuugaaaauuuuuauugugguaaaauauacguuaauaugaacuuuauuauuuuagccauuguucaauguacacuccaguggcauugacuacauucacaugauugugcaaccaucagcaccauccaucucuagaacuuuuuauguuuccccaaauugaaacucuguaugcgauaacuccccauauccccuuccccccagccacuggcaacaaccuuucuacuuucugucuuugugaauuugacuacucuagauacaucacguaaguggagucauacaguauuugccuuuuugugacugacucauuucacuuggcauaauguccucguuucauccauauuguggcaaguugguuaucuuuuauggcucguuuaauccauagguucuuccgccauaucuuuuccccuuugcuauugaagaaucugcauuuuuugucccguagagauucccauggucuggguuuugcugacuguauccccauguuccucugucuucuguauuucuuguaaaucgguaauuggauguagaggcuugaacaggcucgguuugauuuuguuuuaggguuuuaaauuuuggugggagucaacugcuucauaguugaugcugaguucuuucaucaggaggcacauaaugucugugguuucucuccaucuaucuuugauacagcuaagauauauauguauuguaaaucaaagaguaucugagacaagucucaaucaauuuagacaguuuauuuugccaaguuaaggauguacuugugacacagacucaggagguccuaacaacauaugcccaagguacucagggcacaguuugguuuuauacauuuuagggagacaugagacaucaaucaauauauguaagauguacauugcuucaguccagaaaggcaggacaacccaaagugggaggggguuuccaggucauagguaggugagagacaaaugguugcauucuuuugaguuucugauuagccuuucacugaauaugcaauuugcaggaauagucacuuaugcuuuagucuggcuuagugaaacaacagagcaaaggaaacaaccauauauacauuuguuccaugugagcagagggaugacugaguucugccuguccuuuguccacaaaaacuuccuugugggcaaauuaugagagagauuuguggcuuuuuuuuuuuuuuuuuaaauuuuuguagcuaucuuauuuaggaauaggaugggaaacacauuuguccuacaugguucccagcuugacuuuucccuuuggcuuagugauuuugagguccugagauuuauuuuccucucacaguauagauauauagauauuuagaguuucuuuaguuuuuauuuuuaaauaauuucaaacuuguagagaagucggaagaaucauacaaagaacucucauguacaccuuaccuagauucaccaauuuguaacauugauugugccacauuuacuuuauugcucucuccauaugugcuguggguauaauuauuauuguuauuauuuuauuuauuuauuuauuuauuuuugacauggaguuucccucuuguugcccaggcuggagugcaacggcgcgaucucggcucacugcaaccucugccccuuagguucaggcaauccuccugccucagccucccgaguagcugggauuacaggcaugcaccaacacgucuggcuaauuuuuauauuuuuaguagagacgggguuucaccacguuggccaggcuggucucgaacuccugaccucaggugauccacccaccucggccucccaaagugcuaggaguacaggcgugagccaccgcacccggccuauuauauuuuauuuuugagacugagucucacucugucgcccaggcuggagugcaguggugcgaucuuggcucacugcaaccucugucugccggguugaagcaauucuccugccucagccuccugaguagcugggacuacuggcaggcgccaccacaccuggcuaauguuuuguauuuuuaguagagacagcguuuugcuguguuggccaggcugguuucaaacuccugaccccaagugauccgcccgccuugcccucccaaagugcugggauuauaggcuugagccaccgcacccagcucuguauaauuauuuuuauuucagaacuauuuggaaguauguugcacaugcauuauuacucuuuaccccauuauacuucaguuuauuuccuaagaacaauaauauuaucuaaauauccauaguaauuaaauucaggaaacuuaauauacuagauacaaugcuuguauucaaucuguaguucauauucucuuuuuguuaauugucacaauaauguucuuucuagcaccuuuuuuuuuccugguacagguuccaguucagaaucaugcuuccuauuuauuugucaucuuccuuuagaauucuuuaaucuggaacaauccuuuggccuucuuugucuuuuuaugccaaugauauuuuuuaagaauauaggcuaauuacuuugucaacauuccucaauuuggguuucuauuaugugucuucacaguuacauucagguuguguauuuuuggcuggaccgcuauauaaauguccuccucaggauaucacgucaagauauguaugauguuuguuugcacccuuauuguugauguuaauuuuuuguuguuggugguaguaaguauguaaggcuuuuuuguuggugaugguaguaaguauggaggcguguuuucagagucaaccaaaguggaaauaauaguucaaagaguaaauguuucuguaaauuaauuuuaguguuuuaagguaucauuuuguacuuccuaccagcaauguuugaaagugccuguuccuccacagucuuaugaaaugugugcaacccuucuggagucuuuugcuucuagcugcauaaagggagaaaagggagggagccaaggaucaugugggagauuuuagggauuaggccuggaaguagcauuccuuaauuguuacucucaacaugucauuggccacgacuagucauauggccccaaccuagcugcaugggaauuguagucuuugacuauauuuagguucaccuuacucucuuucaaaggcuguguagauucuguuauuuuuauauacuguaauuuauuaauccucauccuauugauuggcauuuagguacuuacaaguuuguuuguuuguuguuauaaacaguguuuauguaugccugugucuaaagaaaauuuccuagaaguagacagcuggguuggaaaauauguguauuuuaaccuuugauaaauuuugccaaauuguucuccaaaaaguuuguuccuguuuugcuuccaucaacagaauaugagaguguaaguuucacuguucucuucuuaauacuacaguaugaauuuguaaaacuuuugcaauuugguaguuuaaauuauuuuggggguaauuguauuuccuaauuacaaaagagguguagugucucucaauguuuuuuagacauuuuaauaauuucuauuaauaucauuuggccauuuauauaguggauguucaucuuuuucauauugauuugaaacaacuuuguauauuaaagauuuucagcuccuuguagguguugaaaauauuuuucuuuuucuuuuuuuuuuuuuuuuuuuggagacggagucuugcucuguugcccaggcuggagugcaguggcgcgaucucggcucacugcaagcuccaccuuccggguucacgccauucuucugccucagccuccugaguagcugggaccacaggcgcccaccacgacgcccagcuaauuuuuuguauuuuuagugagacaggguuucacuguguuaaccaggauggucucgauccuccugaccuugugauucgcccgccucagccucccgaagugcugggauuacaggcgugagccaccgcgcccggccuguaaauauuuuucuuuuaacuuuuucauuugggcaggaggcaguagcauauuaagaaaguaauggauccacugcucugaaaauuuauauguuuuguuucagaucauuauguagaaguucuggaaugcaaaauacagugugaagagaaccucaccccaguuauaggaggcuauccgguugagaaauuuguggcuaccauguaucauuacuugcaguuugccuauuauaaguguaaguaaucuucugugacaucuugggugaggcacuuaguccuucuaagacuguaaaauagagguaauaacucuuagcuacgguuguugagaguucaucaagguccacugacaacccuggugcuaugcuuugcacaaaaaggcagcauggcuuagugauucagggcagagccuguaaccacagugccuggguucgauuucagccuuaucacuuacuagcuucucugugcuuuaguuuccucauugugaauagagauuguaguacuaaccucauaggauuguccugaggaguaaaugaguuaauagaugugaaaugucugggguauucccacacuggcacauagcaaacuguguguuuguuuuuguuaucauuauuucccuuccuccuuaucacuagcuuuacuuuucagacuguuagaguuuauuuucuuuucuuuuuucuuucuuucuuuucuuuucuuuuuuuuuuuuuuuuuuuuuuuuugagacagagucuugcucuguugcccaggcuggagugcaguggugugaucuugacuuacugcaaccuccgccucccagguucaagugauuccccuuccucagccuccugaguagcugggauuacaggugugugccaccacgccuagcuaauuuuuuguaauuuuaguagauaugugguuucacuaucuuggccaggcuagucuugaacuccugaccucaagugauccacccacuucagccucccaaagugcugggauuacaggugugagccacugcgcccguccuguuaguuucauucuaguugguccucccuugaucugaaaugggaguuucucaaucagaacguucuaguggacaaugggaagcaaacgugggagagaaggaaguucaggguuagacuucagagccugcguguuucggcuuuuccuccucucccuguaccugacuuugccaagugccacuuguucaagcagugugucccuuggcaguucaguuccaagcacagaagaauuauuagggaaaguggcaguaggacuuccucugcccuaaugaaaugccagggucuagcgguggcagguuucuggcuagaauagauccccugggucgccccuucacacucaggaguggcuggucucagggugccuugggaagagugagagaggugaucuuggcuuuagcccuccuuucccacugugguaauuguguuuuuuuuuugcggggggggguuccucuuuaucucaccucccauccucuucagaacacguaagccuugcacccugaaggucagaaaaagaaaaagaauauguauuauauaaauauaaaaagccauaaggucuucuagcucacugagcauggcuugguucuaaauguauaaagcuagaacacuaggaauuuagaaguguucuggaugcaugcgggcucuggcagcucccugggccucugaaauccucacgugcccugaaaaucgcccugcauaucagaaacuggcaaagacuuaucaacacugguggacugaggccucuagcuaugcuugcugcuucccaggaaaucugcuuucggggaucaacaguaugaaugaaguguacuuccugaaaugagcuuccugaaaaucugccccguuuugaauuuuuucuagaccaccuaccaugcuacauugcuugagggcaggugguauuauuuauauuugaagaguaaaugucccuaagagcuggcuuuaaaguagucauuacaggaaacagccacuggguggcacaauuuauucauacccaagcuuuggcuucuccggccaaccacagcuuuagcaaagguacuguuguguaaauuagaguggaaugugccagaauacauaccaggggcuugugucucaucaccucuuccucauccugcacucccaagacaaaucccaagcccugcaaaaucccuaugcugaagguacugucacaggugggcaacaccaagcagagaggcuggaggugggaguuccaaccucaggagguggcaaaacuaggcgacuuuccaaauccccuccaacccagaggcuccaccauccuuuggguuuuccaggucugguuuagcuguaggggagcuaaccuagaucuggagacuguggucccauccagaugggauccagacacucuaggacccagaugagacaccuguuugcugagcacauccucccuaucucccucagccccaggacaauccagcuuuuuccagcugcuuccagggaccugagaccagcucaggucaccagagcuggaaguggaacauaggcauuucuccauaggcaugugccuaacuagaacuaaguuucaagccuggccuccaggcugccguggagaccccaucuguggccugcccacccagggcugccagucggccccaggcucucugaagaaggacuguggagaaggggcuuguucauauggccuuuuuguuuagaagcagagaaauuauagggugugguuugcugauuucuucauuugucuuuucuucccaacccuagugaacgaccugaagaaugcagcccccugugcagucagcuaucugcucuuugaucagaaugacaaggucaugcagcagaaccugguguauuaccaguaccacagggacacuuggggccucucggaugagcacuuccagcccagaccuguaagucuggugcaccacaccuucccuuuucucuucauucuugccuucuggagacuaccucgugccuuaagagaaaggguuauuuuggaaauaaaggggcugggcgcggugacucaugccuguaaucccagcacuuugggaggccgaggcgggcggaucaugaugucaggaguucgagaccagccuggccaacacggugaaaccccaucucuacuaaacauacaaaaauuagccaggcgugguggcacguggcuguagucccagcuacuugggaggcugaggcagaagaaucgcuugaacccaggggcagagguugcugugagccgagauugcgccaaaaaaaaggaaaucaaggaaaagucauuuuuuucuguaguuuugugcauguguguguuuuaacauuuuacugcuucauucugauuucugaaucuguaaaaacucuacaaauuucaaacauuacagaaauauuuuacuuugaaaacaaaauucucucauaauccuacaccuucuuucucucucggaaaacaaaauucucucguaauccuacaccuucucucucucuuuuuuuuuuuuuuugagacagagucuugcucugucacccaggcuagagugcaguggcgugaucuuggcucacugcauccucugccuccuggguucaagcgauucucuugccuuagccucccgaguagcugggauuacaggcgugcaccaacauaucacacuaauuuuuguaguuuuaguagagaugggguuucgcugggcuagucucgaacuccuggcuucaggugaucugcccaccucagccuuucaaagugcugggauuuacaggcaugagccacugcgcccagccugugccaucucuuuaucuccugcuuuaaagguauauauuuacucauauauauaguaaauauuuguguauuuuuauaaaaacaaggucauauuuacauaguuuuacaacuuuuugcaacuuugucuuucugacaauuugucgugaauauuucuccaugucacauccauguaucaucuuaauuauuauccuuuaacagcucccugguagucucuuuugcggauggaccaucauuuaauucccuugauaggcaaacucaccacuuagcauguguugucagugaaccccauucauuauauauuacuuucaaaagauuuuuucuaauugaucuuugcucuuguauuuucauugggauuucuauaugccaucuugauuuucauaaguuugucuuccacugagggcuggccacucuuuuuuaaaaauugagauauaauuuauauaggauagaauucaccuuuuuaaaguguacaauucagugguuguuaguauauucagaguuguacagccauuaccacuaucuaauuuuaaacauuuucaucaccuuagaaaaaaccccauauccuguuccucccuccucccaguucuaagaugaaaagguugguccuauaaacuguucucuguugugucugaacaggaagcaguucaguucuuuaaugugaccacacuccagaaggagcuguaugacuuugcuaaggaaaauauaauggaugaugaugagguaaguuuucaugcuuagcacaugucugguggcuacgagaaaauauuacucacaucuuugcuagaaucacuggaaggcugaguccucccugaaguaagaaacagaggggaccuugagaaagacaguuccuguggguguuucagugacagucagaaugcuggcaugggaaagagcggcuuucuaggaaaccuaggcaggagugccacauuuccugauagcgaaacggguguggggccacacuccaggaauucacaguggucauucuucaucuuuucacuuuauauaaaaacagugaauuuuuaauugcucagcacucugaagagacauggauacucacaccccaauuuuucugcuagacuauugcuauuauuauuuuuucuaaauugcaucuuuacuguaagcauuuugucauucucuagaauugcuugaaauuccugauuccaccuuacucagcugaccccuuuucugacccugacucaacugguuauggaguggucauuuugugaugagucuggucacagaaaagccaucauuagcgguaguauuuagaguauuuguuuggaacaaacuggaaaaugcuuacugagaaagcuggggacuugucagcuauuggagcucgaagagagcugugagcuugcucuggucugauccuucgcuuuauagaugaggagcauggggccagcaaguuuccugagccuccaggucugcucuuccuauacccguuuuaggugaaguaccucugaauaagacaucuucguggaauuuguuuucugucuauaaauauguaugggaugaacucaucacuggcauuaaacaacugagucucaguucuuuaucuauaaaaugggaauaauaauacugcccucccaggguugugagaauaaaauacuguguugcauguggaaaugcuuucuaaacuggaaagugaugcaaugccuaugucuugguuuggguauccuugaagcagagccugagacaggaucccaagaugccacaggggccauucccccauucccuaaaggaaggaacaccagccagauaccaacaagauuggccacugugguuuacaaaguauagcagaggcuggguguaguggcucacaccugugaucucagcauuugggaggccaaagcaggugauugcuugagaccaggaguucaagaccagccugggcaacaugguaaaaccucgucucuacaaaaaauacaaaaaaauuagcuggguaugguggagugcacccguaguccuagcuacuuggaaggcugaaggagucuggggaguuugaggcugauauugcgccauugcacuccagacucggcaauuggaguaagacccugccucaaaaaaaaaaaaaaggaaaguauagaaaaauauauuuagaaaagguaagagaaguugaguucccaguuaucuagaggcaagcuaauauggauauuuugguauauaucuuuccauuuuuuuauuauuaaagaaaaaauuuuauaguuuuaaauuuguuuuucuacauauuuauuauaaacucagcuauaauuaugucucaugacuuuuucacuuuauauuauuaugugagcaguuucucuuguuauauuuuucuaaaacagcuuuauuuagauauuauucacaaaaaaugaaauucuccuuuuuaaaguauacaauucaguuguacuuguuauauccacaaaauuuugcauccaucacuguuauuuaacuuuagaacauuuuuauugcccccaaaagaaacuccauagcuaagucacuucccauuucuccucugggccaacauucccacuccugccuccaccuccagccccuggaagacucuaaucuacuuucuguuucuguggauuugccuguuguggacauuucauauaaauggaaauauaggguauguggucuuuugugacuggcuucuuucacugagcauauguuuucaaaguucagccauguugaacauguugccuguaaaauuuccucuguacuaccaaguaauauucuucuuuuggauguaccgcauucuguuuauccauucuucaguugauggauguuuggguugguuccacuuuuuggcuauuuugaauaaugaugcuaugaccauuuguguacaaauuuuuguuugaacauaagcuuuccaguuuuuuauaccuaggaguauauacauagguauuauguuaggccauuuuugcaucacuguaaagaaauaccuggcugggugcagugguucaugccuguaaucccagcacuuugggaggccaaggcaggaggauugcuugagcccaagacuagccugaguaacauagugagacucugucucuacagaaaauuuaaaaguuagcugggcaugguggcacaggaaguguggcaauggcaucugcuuggcuucuggugaggucucaggaagcuuauggucauggcaaagggggagcuggcguaugucacauggcaagagcaugccacacucuuuuaaacaacuagaucuugugugaacucagagugagaacucacuuauuaucaugaggacagcaccaagacauuuuugaggcauccgcccaccugacccaaauaccuuccaccaggccccacuuccaacaccggagauuacauuucaacaugagauuuggaggggacauauauccaaaccauaucagguacauaccuaggaauggauugcugggccauaugguaaugguuuaaccuguugagaaacugccagacuguuuuucaaaguggcugcaccauuuacauucccaucagcaguguaugagaguuccaacuuugcaauaucuucaacaaaacuuaauauugucuuuuuuuuuuaauagccaugcuaguggaugcaaguaguauuucauugugguucugacuuccacuuucuguuguuuuucuuuucuuuuugagacagaguuuugcucuuguugcccaggcuggagugcaauggugcgaucucggcucacugcaaccuccgccucccagguucaagugauucccugccucagccauccuaguagcugggauuacaggcgcgcaccaccacacccagcuaauuuuuuguauuguuaguugagauggaguuucacuauguuggccaggcuggucucaaacuccugaccucaggcgauccacccgccucagccucccaaaaugcugggauuacaggcgugagcuacugcacccagcuugacuugcaccuucuuagugacuauguugagcaucccuucaugauuggccauuuguauaucuuugaagaaaugucuauucaaaucuuuuguccacuuuaaaauuguuacuuaucuuuuuauuauuguguuguagaaguucuuuagauauucuaguuauaaguuccuuaucagauauaugaauuguagauauuuucucacaauuuguggguugucuuuucaguugcuaaauggugucuugaagcacaaguuuucaaauuugaugaaauucaauuuaucuguucuuucuuuuguugcuuuuguguugugugucauaucuaagaaaccauugccuaauccaaggucacaaagauuuacuccugauuuuuacuccuacgauuuuuguaauuuuaacuccugcauuuaaauuuacaacccauuugaguuaauuuuaugugugauauuaggaagaggucuaguuucauucucuugcaugugaauagccaguuguuacagcacuauuuguugaaaagacuuuuucaccauugaauugucuugguacccuuugaaagaaaucaguugaccauaaaugugagaguuaauuuuccagacucucagucuauaccacucaucuugauuucuauccuuaaaguuaguacuacacugucuucauuaauauagcuuuuuuuuuuuaaauuacguggacuuucaaccaagauuagauuacuguagcuuuauacuauauuuugaaauuugaauugugaguccuccaacguuguucuucuuuuccaagaugauuuuggcuauuuuggguccuguacauuuccauaugaauuauagguuuagcuuuucaguuuuugcaaaaggcagcugggauuuuuuuauaggaauuccacugaacacauaaaucucuuuggggaguauuggcuucuuaauauugucuucuaauccaugaacaugagaagucuuuccacuuauuuggauuuuuuaaaaauuuauuucacaguguuuucuuauuuuauuauuccuaaacauucuauucuuuuuuaaaaaauuaaaauaaauucuuuccaaccccuaguauucaagcauuuuauucuuuuugaugcuauuauaaaugaaauuguuuucuuauuuucacuuuugggcauauucuaaaagaauagaaauacaauagauuuuguguauugauucugcaaacuugcugaacuuauuuauuaguuuguauguguauguguauuauuuuucuugcguaauuguucuaguuaaaacuucuaguacuauguugaauagaagcagagagagugggccuggcacaggggcucauuccucuaaucccagcacuuugggaggcugaggcaggaggaucacuugaacccaggaguuugagaccagccugggcaacauagcaagaccccaucucuacaaaaaauaaaaaaauuaggcugggugugguggcucacaccuguaaucccagcacuuugggaggcugaggugggcagaucaccugaggucgggaguuugagaccagccuggccaaucggucgaaaucuugcuuuacuaaaaauacaaaaaaauuagcugggcgugguggcacaugccuguaaucccagcuacucaggaggcugaggcaagagaaucgcuuguacccaggagguggagguugcagugagccgagaucacaccacuguacuguagccuggguggcacagugagacacugucuaaaaaaaaaaauuagcuaaguaugauggugcacaucuguaauccuagcuacucaggaggcuaaagugggaggauugcuggagcucaggagugggaggguacagugaaccauaagcaugccacugcacacuaggcuaggugacagagcaagacccugucucucuggaaaaaaaaagaaguggagagagugaacauccuugucuuguucccagucuuaaaaggaaaaagcauacagucgucuuucagcauuaaaugugaaaguacguuauuagcuggggguuuuuuguaggugcccuuuauuagguugaggaaguucuauuuuuaauucguugaauuuuuuuuuuuuuuuuuugagacggaguuucacucuuguugccuaggcuggagugcaguggugugaucucugcucacugcaaccuccgccucccagguucaagugauucuccugccucgcccucccaaguagcuggaauuacaggcaugugccaccacacccggguaauuuuucuguauuuaguagagacggggguuucaccauguuggccagucuggucucgaacuccugaccucaggugaucaacuugccuuggccucccaaagugcugggauuacaggcgugagccaccgcacccggccugaauguuuuuaucaugaauuuguguugaauuuugucaaaugcuuuuucugcaucuauugagauggucacaugauuuuuguuucccuuguuaauauucauuauaaaaaugacuuuuuugugacuaauauuacaugauauagauaauuuuaagaaauauagccuuuuuguaggcauuuaguuugcuuccaacuuuuugcuuuuacaaauagcauagcagggacuaaauuguuuacuucuucucuaaucauuuccuuagaaaaaauucccaguggugaaauuccuggccuaaggcugugaacauuuucaagacuucugauguacaagaacaacauauauagaaagcaaaucauagauacuagaacacgaagagauuuuucacaugauucaguaaagcucucucaugucacagauaaggaaacaaacucagaaaggcagaguggcuugcucauagucacacagaggguuaguaaucaucuaaugaacacgccaagcuuauugcaggcuuuaaaauuccuaggauucuuggauuuggcacuuucaagauaaaaggacuuuguugaagguucuggaguaguuugcuuauuaauugaggcuuuagaauuguggaagaacuaauccaucucuaaagaaugaaccauuuucuuacuauauaccaaauuauggcaaguaauacuuugaaaugaaaauauaaccaaaaucaucaaauucuuaguuaguccuuccauuuuccaaaggacauaauacuccuuugaaacaaagcaucaguacacuuuagcugcugauauguguggcauucuuccuuauuaucuuucugguguugaaauguguauaagcacuccugaaaguuuacgcacugguucagaauuuugcagagguuuauuacaguuucagaaacuuuuuaaaacaggcugaaacagaugcuucagguuucaaguucugaugguuguuugcuucagggaaguccaaaagaaauagaauauaauuuguuggaaggauguauugagggagugcucucagguaggaacggaaugagggucaggggaaggagcucaacaaauacguggucucagcuggagucaagcuucgccugcucccaugggggacucuggagcaugaauugcaccacagaguuguucuugccuuuuguagucccccuuaucagucugucauucguucuucguugccaggaagggcugguguguaaccucccugucaagacugcuguuuuuuuuuguuuuuguuuuuguuuuuggccaaaggcaauugcccagagaaggggcagcugcuagccauuagcaagcagcccucacaggaguuggggaugagugcacugggaaggagaucugagugaggccccaacaguauucacuacaacagccaugcaggggaugcauuucuuucgucugugcugccucgggcacuuauuacuagugagcuaaaagcaaacaauaccaucaucccgcaagucacaacagacacacagcaggauauaguaacucccuaagcagaagucauagcuauacacauaaucccucuacuaugcuguguuuuccuuuuggggucuagaaagcaacugaaaaacaauuuuuccaagcuguagugucuacaguuugaguuucuaaucucaggcaugacauaguagaaguauuugaugauaauacuaagaccccccauuugugucucauguacuugauagguuuuccaguuauucccaaaugcugcaagauuuuuauaaauuucucuguguuaaaacaucaaaaggagccaacaggcucuuggccugggauggugagcucagugaaggaggucgaguuuuagcaggguugguggggccagucuguguugacucuuauggaaggggccucagccuuggucauucacucauucucugcagaaaagagaaugggugucaucagcuggugguccaggaggguuauagaagagaagucaauguggagaaagaaauugggaagggugcugggcugcuucaaguugaaguauaaggcugauugcagaaggagggagcaggugagcuccugguaccgacacugggcaaguggaucccacuaucccugugugucucuccuguaagaggagugauugcuucagucacaccagcaguauguaugcaagcacucaaucauucauccuucaacacauguauugagcaccuucugugugcuggacucuggggaagaaaaaucaacccaguccccugguccuugagaaguuuggguucugguggucaaggcagaaagggaacagauagaaaauguuccugugggagaccugcacacaugagaggggaggaaggggaguaggcagagaugcacacaggagggccacuuaguagagcuguucacaggcugggcuguccgccucacacagcauguuggcggaucucgcagagcacuugauaccaaguucaaauggaguggaagccgagguccccuccacagggagaaaucagguccucugggccccagaccagcagaaaaaaccuguuucagccaaagcagacaguggugauggccucucgggauacuguuucugcucaucaguacuuuuaaaaguccaauagcccauuuaauaaaguuguccuguugucucuuacagggagaaguuguggaauauguggaugaccucuuggaacuggaggagaccagcuagcccacagcaaccaaagagacuuccucuuggcguucaggaaacacagauucuuuguccuuuucccaacagcccaggcuguugauaccucagagccuucucuuuacucuccaaagugaaagggaagcccccgucucucuaacugcaugucaucaggggugagccugccuuuccuaucuucacaccugccaccucauguucacaccuaucuuucucaccuuuuuuuugagauggagucucgcucucuugcccaggcuggagugcaauggcacguucucagcucacugcaaccuccgccucuuggguucaagcaauucugcugcaucagccucccgaguaccugggauuacaggcaugugccaccacgcccggcuaauuuuguauuuuuaguagagacgggguuuugccauguuggccaggcuggucucgaacucuugacuucagaugauccaucugccuuggccucccacagugcugggauuacaggcgugagccaccaugcccggccucuuucucaccuuuacaccugucuucuuauccucacaucuguuuucacaccuucaucccugucuuccucauguucacacuugucuuccccauguucauagcugccuuucuuaccauuuugguuugaagggcagucuucucuggcuuguuuuuuuguuuuucccagaaaaucaguauuauuuuuuaaauaagaaaaacauuccuagaagaugauaauugugaaaaccuccuuuggcuuauuugcuuuuccagauuuuagucuccuuucuccccauccgggaaagaugguggaagacauaggcuaaauuucuccagccucacaauggucuucacuuggucugacuuguaccaauucuagcacccacugaaaaacaaguugaguagagaguguagagugcagaaauguggcuuuugccccacuuugcaucuccaaaauuacaacgguuggccgaucccauuugaggacaaugcuuaguuauaagucuccgaguuggaaaaggaagaaagccagagcugucuaguuucauucauucuuucaguaaauauuuauugaguaccuacugugugcuaggcauugaccugggaacuagagauacuucacagaauaacagggaaaguucccugugcucauggagcuuacauucuacagggagaaagagauagccaauacauaggaauaaauauauacaagguaucauguagugauaauugcuguggagaaaaauaaagcaggggagggaguaagaaauccuggagaugaggcugcaguuuuaaauggggccucacugggaaugugacguugagcagagacguuagggaaguggauccuggacaaggcauuccaggcagaggaacaggaugugcacugccccaaagugagaacuugcucuacguggucaggaaagagcagggagaccaagcagagucgugggcagggguagaauggaaggagaggcggcuggggaggacaggugguggagggccuuggcuucugcuaagugagaugggaaccacuggaggguuugaacagaggagugccuugauugauuuauauuuugcaagggucauucuagcugccauauugugaaaaacuuuaguggacaagggcagaaggaagagggaagaccuguuaggaagcuacugcaagguuccaggcuugggccugggccacagcaacagcaguggucaaauaucuagauuuauuuugaaaagagccaauaggauuugcugagaguuugaauguggaguguaagagaaggaagaguuaaugaugacauuaagguuuuuggccugaauagcaggaaagauggaguuaccaguuacugaaauagggaaggaugggcuggguaaguauggaauuuggugcaaagcaggcugucugugguuggaaugggagguucuggcugcaaaucaaaguggagaguucucucaggucaggucugcagcagagcucgagacagggaucugaaugcacuugguuuauuguugggggugcucucagaaggaaccugugaaagccuuuaucagucauuuauuggcugugagaaguucucugggaguguggguacauuugaaggcaagugacuucaguugagggcaagucucuggaaaagaggcuguaggcaucuggcagcuaccaugcaugguaguguguuggggguggggguccugggcacuggcugugugaagggaucuggcagggcaccacagcgcccccuacugaaccaucagcaugucaguggcauuuaaagccaugcagcuggaggggccacugagauugucucugaguauuacugagaagcaacagaaaagagccauggauggagcccuugggcucucugggaaaugggaaaucagccaaaggacugagaaggaguuaccuuaaggucagagaaaaccaagagagugugguguucuggaagcugagcuuucuuuauucaaccucauucccuucuccaaauaagccacuuguguaguugggccccuccaggguugaaggcaagaggagaaaggcacagcguuugggaaacaagacuuuuccugcaauagccugggaaggaauaaaaggauagaguguuuggguuuuuguguaauggugguuaauugggguggaacacucacacguugugcuuuuucugggcuucccuuaucccccagaacacucuaccaaccucggggaacucgggcacauccuucuguuucuccuucagcucuauccugcuuuccucaucccuucugacaccacguccucacucaccugcacaagaaucccugcaucagguucuccuuugaggguacccacccaggacaguccccuaccacuucugucuugggcugaaguugcccacguccacaaaaucuguacucccagcggggguguuuggcccgaggagucaguguuauuacugguggaugcaccguguccacagcagcccccaaucccagcgaugcgucagaucuuacguggcuuccugcugggggagauggccuucacccacgggaugccggguucuccuuucuuuccucaccccaaccuuuacuccaccagagaaacuuccuuuugaacucaguggggaagagggugaugagacaggacuagaaaguagugggggacccagcgaguggacgcccugcuccgggauuccugagucuguaaauagugugcccagcagcugugaacuccccuuauagccucaggcugcaguguccuucccagcugugugagaaaaugaaagccgacguccacagggacccaggcaggguuggguguugugacucacuccaccucugugcccugcagagguacuguuggguccuugucuugugagccuggggugagcucucuguacauguuguuguuccacguauggguugacuuggcaugcugggggguccucguucacucucugaaguuggccuccuuucacuggggauugaaaagcaccuccaccccuacccuagugauguccccugaggacccgggugauaguacagucaauauugucaguacuuugcuuugauugaaggcuguagagcugaguuaccaaaauuucuauuucaaaggaaaccaaaccuuaaaaaaaaaaaacaaaaacugggcugggucuuccaaaccuaccaugaaacccuggugugcaggcugcacucaaugaccucaacccaacaccucccugagugugcuucuuggaagagccuagaagauuccuggauggagaccccauugguucagccucaagucuggcccgucuucgaaaaaacaaacacauuuguaagcuuugugggagcuuccaggccugcucuaagaugccuugcuuguccuuugacccaucagcauggagcucagugguugcuguuugguucugcaggcugguggggaggccgcccaucgugguggggcaucuguccagccccauugccacucagggcauccaaacaggaggcacccgcugggaagggucuaaagauacuccuuguggccacugcuacuguucacacuugacuuguggagaagcgaagggcugaggggagguuuguguacacccauguauuuaaaagugacugacugacugaaaugagcacauaccgacauaugcaacauacuaauaccuuccugauuuucgagacuuucuaauuacuacaacuaaccuguugugcucaccucuggaauucagaaagagagccacugcgagcacugaccacaagggcugccuuaggaaggaaaugugugcuuucaggaguucuuauuaggggaauuuuaagagcacaaaaauuuuauugaacccaccuuagugacaaacagaaaaugauuuguuagauugucaguuggaagggguuuauuaugacugcuggugaaauaaacagugaccaguuucugccaacauuuauggaaauaacguuucuagguuuuaaaugugagccguaaacugaagcuacuucaguuaaaaaaaaaaaaaucaauacuuaaacuguagggaaaagguggauuggugccagagaaaacauuauuuaauagugucagaacauggaacugcaacacaguuuguagcaaggcacugagaaaaacccacaacuaauccuucaucgcagcugucugaacucuugaucaucugccaucccccaaacagugacuucuuuuuuucuggugacuccaggccugaaugaccuaguguggagaguuuaaacuauguacaagggaggaaagaaaaaaaggaaaggaaccuuaaguaagccucagccaaagguuuuaugcauuggacuuccugugccugcccccaggggcaagacugauccccaugccugugcccaugacaucucccugaaagaggacaccaugacagcccggcuuugccuugacugacccacugcuaccccagaaauaagaaucaagagcagcuauuguuauccuuagaguguuuuccgucuagggccggcucgugaacagccacauauccuugcaccugacacuguccccacacaaauagcuggcuuucguugcuuguugaaugaaugagugaguuggcucuauauccccuuggagcuggccgguaagauauuagugccucauuuuacaagaagagaauaggaaggaauuaagcaauuuggccaacagauacaagauagauuccagaguuuuaucucccacuuuaggguggcagccaguaggccaaacuccaaagaccguugcugaugucuuuuucugccuccccucuuuggguuagugugguauguacaagcucacucuuguugaaaauuagaaaauaguugaaaacaaaagguuuuuguuuuucuuuuuaaaucacauuaaauguuuuacauugcuua
